United States Patent 9,782,462 (MODIFIED POLYNUCLEOTIDES FOR THE PRODUCTION OF PROTEINS ASSOCIATED WITH HUMAN DISEASE) - sequence listing, part 124

SEQ ID NO: 240527 - DNA, 579 bp, Artificial Sequence
  Description of Artificial Sequence: Synthetic coding sequence
atgcagtgggccgtcggcagacgctgggcgtgggctgcgctacttttggccgttgccgctgttctcacacaggtggtgtggttgtggctggggactcaaagtttcgtgttccaacgcgaagaaatcgctcagctggccagacagtacgcgggactcgaccatgaactcgcttttagccgacttatcgttgaactgagaaggctgcaccctgggcacgtgttaccagacgaggaactgcaatgggtgttcgtgaacgcaggcggatggatgggtgcgatgtgtttgctgcatgcatccctgagtgaatacgtcctgctcttcggtacggcactgggctctaggggtcactctggggagaccgtggtacatggacctggagaggctacagccgtcgagtgggggccaaacacttggatggttgaatacggtcggggagttattccttctactttggctttcgctctagctgacaccgtgttttcgacgcaagattttttgacactgttttacacgctacggtcttacgccaggggactacgccttgaactaaccacttatctttttgggcaggacccttag

SEQ ID NO: 240528 - DNA, 2916 bp, Artificial Sequence
  Description of Artificial Sequence: Synthetic coding sequence
atgggtgtggcagggagaaacagaccgggtgctgcttgggccgtcttgcttttgctgctgctgctgccgccactactcctgcttgccggagcggttccacctggcaggggaagggctgcagggccacaggaggacgtggacgagtgcgcccagggcctcgacgactgccacgccgacgcactatgtcagaacacccctactagctacaaatgcagctgtaagccaggctaccagggagagggacgacagtgtgaggacattgacgagtgtggaaacgagctgaatggaggctgcgtgcacgattgcttgaacatccccggtaattaccgatgcacatgctttgacggattcatgctcgcccacgatggacacaattgcttggacgtcgatgagtgtttggaaaataatggaggctgtcagcacacgtgcgtcaacgtaatggggagctacgagtgctgctgcaaggaagggttttttctctcggataaccagcacacatgcatccacaggtctgaggagggactgtcatgcatgaacaaggatcacgggtgtagccacatatgtaaggaggcacctaggggatctgtcgcctgtgagtgccgcccaggcttcgaattagccaagaaccagcgcgattgcattctcacatgtaatcatggaaacggaggttgccagcactcgtgcgacgataccgcagacgggcctgagtgttcctgccatccgcagtacaaaatgcacacagacgggaggagctgcctggagagagaagataccgtgctagaagtgacggagagtaacactacgtccgtggtcgatggggacaagagggtcaagcgtcgcctgctgatggagacctgcgctgtgaataacggaggttgtgaccggacatgtaaggacaccagtacaggcgtgcattgtagctgcccggtgggcttcacccttcagctggacgggaagacatgtaaggatatcgatgaatgtcagacgcgaaatggaggatgtgatcatttctgtaagaacattgtggggagctttgattgtgggtgtaaaaagggcttcaaattgctgaccgacgagaagtcctgccaggatgttgacgagtgtagcctagatagaacctgcgatcattcctgcatcaaccatccaggtacatttgcgtgtgcctgcaacagaggctataccctgtacggtttcacgcattgcggcgatacaaatgagtgcagcataaacaatggcggatgtcagcaggtttgcgtcaatacagtcggatcctatgagtgccaatgtcatccaggatacaagctccattggaataagaaggattgcgttgaggttaaaggtcttctccccaccagcgtgagcccaagagtgtcgctgcactgcggaaagtccgggggaggggatggctgttttctgcggtgtcactctggtattcatctgagttcaggactccagggagcatacagcgttacctgtgggtcgtcctccccattgagaaataagcagcagaaaagcaatgactcagctttcggggatgtgaccactatacgaacaagtgtgacgttcaagcttaatgaggggaagtgctcacttaagaatgccgagctgtttcctgaaggcctgcgccctgctttacccgaaaagcactcgagtgtcaaggagtcttttcgctatgtgaatctcacttgttcttcaggcaaacaggtgcccggtgcacctggccgaccttccacccccaaagagatgttcatcaccgtagagttcgaacttgagaccaaccaaaaggaagtgactgcgagctgtgacttgtcttgcatcgtcaagcgcaccgaaaaacgactgcggaaggccatccggactttacgaaaggcagtccatcgtgaacagttccacttgcagttatcagggatgaacctggatgtggccaagaagcccccaaggacttctgaacgtcaggccgagtcctgcggggttggccaggggcacgcagagaatcaatgcggattgtgtcagccaggagaatactccgccgatggattcgcaccatgccacttgtgtgccctgggtacctttcaacctgaagccggtcgaaccagctgcttcccatgcgggggtgggctagccaccaaacatcagggcgcaaccagctttcaggattgtgaaacacgcgtgcagtgctcacctgggcacttttataatactaccactcaccgatgtatcagatgccccgtaggtacatatcagcctgaattcggcaaaaacaattgcgttagctgccctggaaataccaccacagactttgatggtagcacgaatatcacccagtgcaagaataggcgatgtgggggtgagcttggagactttacaggatatatcgaatctccgaactacccgggaaactaccccgctaacaccgaatgcacatggactattaatcctccacccaaacgtaggatattgattgtggtccctgaaatcttcttgccgatcgaagacgactgcggcgactatctggtcatgcgcaagacgtcaagctccaactctgttacaacgtatgagacatgtcagacttatgagcggccaatcgctttcaccagccggagtaaaaagctgtggattcagtttaagagcaatgaaggcaacagtgctcgaggttttcaagtgccatatgtaacctacgatgaagactatcaggagctgatagaggacattgtcagggacggcaggctgtacgcctcggaaaatcaccaagagattctaaaggataagaagctcatcaaggcactgttcgacgtgttggctcacccccagaattactttaagtatacagcacaagagtcgagagagatgtttcctcggtcatttatccgactgctccgtagcaaagtttccagattcctgagaccctataagtag

SEQ ID NO: 240529 - DNA, 1044 bp, Artificial Sequence
  Description of Artificial Sequence: Synthetic coding sequence
atgggagccgcagccgttaggtggcacctctgtgttctacttgccctggggaccagaggcagacttgccggaggaagcggactgcccggttctgttgacgtagatgaatgctccgaaggcacagatgactgccatatcgacgctatctgccagaacacccccaaatcttataaatgtctgtgtaagcctggatataaaggagagggaaagcagtgtgaagacatcgacgaatgcgaaaatgattattacaatggcggatgtgttcacgaatgcattaatatccccggtaattatagatgcacctgcttcgatggatttatgcttgcccatgacgggcataactgtctggatgtggatgaatgccaggataataatggtggctgccagcagatttgtgtcaacgctatggggagttacgaatgccaatgccacagcggatttttcttgtcagacaaccaacacacgtgcatacatcgctccaatgaaggaatgaattgtatgaataaggatcatggctgcgcccatatctgcagggagacaccaaagggcggagttgcatgcgattgccggccaggattcgatcttgctcagaaccagaaagattgcacgctgacttgtaattatgggaatgggggatgccaacactcatgtgaagacacagacactggaccgacctgcggatgtcatcagaagtacgctctgcattctgatggaagaacatgtattgagaaagatgaagccgcaatcgagcgaagccaattcaatgcgaccagcgtcgccgacgttgacaaacgggttaaaaggaggctcctcatggagacatgcgcggtgaataatggcggttgcgaccggacctgtaaggacaccgcgacaggagtgaggtgctcttgccccgtgggtttcacgctgcaaccagatggcaagacttgcaaagggcagcacgtggagctgtgcggttgtccttgcctttactggcccggacaagagcccccatgcgcgtgtatagctggacctagagctggcctgaacggcggtcatgtttag

SEQ ID NO: 240530 - DNA, 2967 bp, Artificial Sequence
  Description of Artificial Sequence: Synthetic coding sequence
atgggggctgctgccgtgcgatggcatctgtgcgtgctgcttgcgttaggcacgcgagggagactcgctggtggttctggcctcccaggtagcgtagacgtcgacgaatgttcggaggggaccgacgattgccacattgacgcaatctgtcagaacacacccaaaagctataaatgcctgtgcaagccaggatacaaaggtgaaggcaaacaatgcgaggacatcgatgagtgcgaaaatgattattataatggtggctgcgttcacgagtgtattaatatccccggaaattatagatgcacgtgttttgacggcttcatgctcgcacacgacggccacaattgtcttgacgtcgatgagtgtcaagacaataacggtgggtgccagcagatctgcgttaatgcaatgggtagctacgagtgccaatgccactccggctttttcctgtccgacaatcaacatacatgtattcataggagtaacgaagggatgaattgcatgaataaggatcatgggtgcgcacatatctgccgggagacccccaagggaggcgtagcctgtgactgtcgacccggattcgatctggcgcagaaccagaaagattgcacactcacgtgcaattacggcaatggcggatgccagcacagctgtgaggatactgatacagggccaacctgtgggtgccaccaaaagtatgctctgcacagcgacggtcgcacctgcatcgaaacatgcgctgtgaacaatggaggctgcgaccggacttgcaaagacactgctacgggagtaaggtgttcctgcccggtaggctttactcttcaaccggacggcaagacctgtaaagacataaatgagtgtctcgtgaataatggaggatgcgatcatttttgtagaaacacagtgggcagttttgagtgcggctgccgcaaaggatacaaattgcttaccgacgagaggacctgccaagacatcgatgagtgcagcttcgaacgcacttgcgaccacatctgcatcaacagccctggctccttccagtgcttgtgccatcgtggttacatcttgtatgggacaactcattgtggtgacgtggatgagtgctcaatgagtaacggaagttgtgatcaggggtgtgtcaatacgaagggaagctacgagtgtgtgtgcccacccggaagacgactgcattggaacgggaaggattgcgtcgaaacagggaaatgtctgtccagagccaaaacctctcccagagcacagctctcctgttccaaggcagggggagtggagagctgctttctctcatgccctgcccacacattatttgttcccgattctgagaactcgtatgtgctttcctgtggcgtccccggaccacaaggaaaagctctacagaaaaggaacgggacctcaagtgggctcggtccctcctgctctgatgcacccactacgccgatcaagcagaaggcccgttttaaaattcgggatgctaagtgccacctcagacctcattctcaggcaagggccaaagaaaccgccagacagcctctgcttgatcactgtcatgtgacattcgtgaccctgaagtgcgattctagcaagaagagacggaggggacggaagtccccgagcaaggaagtgagtcatattacagccgaattcgaaatcgagaccaaaatggaggaagcgtcggatacctgtgaggcagactgtctgcgcaaaagggctgaacagagtctgcaagccgctatcaagaccttgcgaaaatccataggcagacagcagttctatgtgcaggtgtccgggacggagtatgaggtggcacagcggcctgctaaggctctcgagggccagggcgcatgtggcgctggtcaagtgttgcaagactctaaatgcgtagcttgcgggccaggcacgcacttcgggggtgagctcggtcagtgcgtctcctgcatgcctggcacctaccaggacatggaaggacagctgtcatgcacgccatgtccaagctcagacggcctgggacttccgggtgccaggaatgtgtcggagtgcggcggacagtgtagccctggcttcttctctgcagatgggttcaagccctgtcaagcatgccctgtggggacttaccagcccgaacccggaaggaccgggtgctttccctgcggaggcggactgctcactaagcatgaggggaccacctcttttcaggattgcgaggccaaagtgcattgtagtccaggccatcattataataccactacccatagatgcattagatgccccgtcggaacctaccagcctgagttcgggcagaaccactgcatcacctgtcctggcaatacttccacggactttgatggttccacaaatgtcacccactgcaagaatcagcactgtgggggtgaacttggagattacacaggatatatcgaaagccctaactacccaggagattatccagctaacgccgaatgtgtgtggcatattgcccctcccccaaagcgcagaatactcatagtggtgccagagatttttctgccgatcgaggacgagtgcggcgacgtactggtcatgagaaagtctgcctctcccacatctatcaccacctatgaaacttgccagacatacgagcggccaattgcatttaccagccgctctagaaagttgtggatccagttcaaatcaaacgagggaaactcgggtaagggttttcaggtaccctatgtcacctatgatgaagactatcagcagttaattgaagatattgtccgagacggtcgactatatgcttcagaaaatcaccaggagatcctcaaggacaagaagctcatcaaagccctattcgatgtgctggcgcacccccagaactatttcaaatataccgcccaagagtccaaagaaatgttcccgaggtcctttatcaaactgctgcggagtaaggtgtcccgtttcctccgtccttataaatag

SEQ ID NO: 240531 - DNA, 1857 bp, Artificial Sequence
  Description of Artificial Sequence: Synthetic coding sequence
atggagacggaggcggcttccactgcagtcagaactcagacgcaggccccaagggtggtggcgaccagatcaacccctagcactcagacggttgccagggcctccaggagagcccagtcaatcactgaggccgcaaccggccacgcacggacgcagcctctggcctgcgatgcggctgccccactagactcgcattgttcacgcacaggtcgccacgccaagacctctacttctgcttggtctacaaccgaggccgcaaccacttccgctgctactccatgggcagcttccagcgccgctgccggacgagcaacatcctgcagtcccacttccgcccctgctcggaccagtacatcggccccatcgtccgggccagtgacaacttctgcatcaacccctcaggctagagccaaggagacagcacgacaacctctgctagatcactgtcacgtgactttcgtcacactaaagtgcgacagttccaagaaaagaagaagaggtaggaaaagtccctccaaagaagtgagtcatatcactgccgaatttgagatcgaaacgaaaatggaagaagcttctgacacttgcgaagccgattgcttgcgtaaacgcgctgagcagtccctccaggctgccatcaagacactgagaaagagcattgggagacagcagttctacgttcaagtttctggtaccgaatatgaggtggcacaacgaccagcgaaggccctggaaggccaaggggcatgcggggctggacaagtgttacaagattcaaagtgtgtggcgtgcgggcctggcactcacttcggcggagaactgggccagtgcgtgagttgtatgcccggtacgtaccaggatatggaaggtcaactctcttgcaccccgtgtccctcctcagatggactggggctgcctggtgcccgaaacgtgagcgagtgtggtggtcaatgctctcctggctttttttcggccgatggattcaagccgtgtcaagcttgccccgttggtacttaccagcccgaaccagggcgaacaggctgctttccatgcggtggcggacttttgaccaaacatgagggtacaacttcttttcaggactgcgaggcaaaggtccattgtagtccagggcaccactataatactaccactcatcgctgcattaggtgcccagtgggcacctatcagcctgagtttggccaaaaccactgtatcacctgccccggaaacaccagtacagactttgacgggagcaccaatgtgacgcattgcaagaatcagcattgtggcggagagctcggagactacactggctatattgaatcgcctaactatccaggcgattatcctgccaatgcagagtgtgtgtggcatattgcccctccacctaaacgacgcatcctgattgtcgtgcccgagatctttctgccgatagaggacgaatgtggcgatgtgctcgtcatgcgtaaatccgccagcccgacttcaatcacaacttacgagacgtgccagacatatgaaagaccaatcgcctttacaagcagaagcaggaagctgtggattcaatttaaatccaatgaaggaaatagtggcaaggggttccaggttccttacgtaacgtacgacgaggactaccagcaactgatcgaggatattgtgagagacggcaggctgtacgctagtgagaatcaccaggagattctaaaggacaaaaagctcatcaaggccctcttcgacgtcctggctcatcctcagaactattttaaatacactgctcaggagtcgaaggagatgtttccgagaagcttcattaaactgctgcggtccaaggtgagcagattcttgcgtccctacaagtag

SEQ ID NO: 240532 - DNA, 1092 bp, Artificial Sequence
  Description of Artificial Sequence: Synthetic coding sequence
atgggcgctgccgctgtgaggtggcatctgtgtgtacttttggccttaggcaccagaggacggctggctgggggtagcgggcttccgggatcagtagacgtagatgaatgtagtgaaggcacggacgattgccacatcgatgcaatttgccagaacaccccaaaatcttataaatgtctctgtaaacctggatacaaaggtgagggaaagcagtgcgaggatattgacgagtgtgaaaatgactactataacggaggatgcgtgcacgagtgtattaacatccctggaaactaccgttgtacctgtttcgacgggttcatgctggctcatgacggccacaattgccttgacgtggatgaatgccaggacaataatggaggctgccaacagatttgcgtgaacgcgatggggtcatacgaatgccagtgccattctggcttttttcttagtgataatcagcatacatgtatccaccggtccaatgaagggatgaattgtatgaataaggaccatggctgcgcacatatttgccgggagacccccaagggaggcgtcgcctgcgattgccgccctggattcgatctagctcagaaccagaaagattgtactcttacatgtaactacggaaatggcggatgtcagcattcttgcgaggacacggacacaggaccaacttgtgggtgtcatcagaagtacgcactgcatagtgatggcaggacctgcatcgagacctgcgcagtgaataacggcggatgtgatcgaacctgcaaggatactgcaaccggtgtgcgctgctcttgcccagttggcttcacgctgcagcctgacggcaagacatgtaaagacataaatgaatgtctggtgaataacgggggatgcgaccacttctgtaggaatacggttggtagctttgagtgcggatgccggaaagggtataagttgctgaccgatgaacgaacatgtcaggacattgacgagtgtagcttcgaacgcacttgcgaccacatttgcattaattctcctggaagctttcaatgcctgattaaacttctcagatcaaaggttagccgatttctccgaccttacaagtag

SEQ ID NO: 240533 - DNA, 528 bp, Artificial Sequence
  Description of Artificial Sequence: Synthetic coding sequence
taacgcgaaaccccgaaaggaggtgtggcgtgcgactgtcgcccaggattcgacctcgctcaaaaccaaaaagactgtactcttacttgtaattatgggaatgggggatgtcagcactcttgtgaggacacagacaccggcccaacctgcggctgccaccagaaatacgcacttcactcagatgggagaacctgcatcgagaaagacgaagccgctatagagcgctctcagttcaatgccacatccgtggcagatgtcgataaacgggtgaaacgtcgattactgatggagacctgtgccgtgaataacggcggatgcgacaggacttgcaaagatacagccacaggggttcgctgctcatgtcctgtaggctttacactgcagcccgacgggaagacctgtaaagatatcaatgagtgcctggttaataatggtggctgcgaccacttttgccgtaacacagtggggtcattcgagtgcggctgccgcaaaggttataaacttcttactgacgagagaacgtgctag

SEQ ID NO: 240534 - DNA, 3000 bp, Artificial Sequence
  Description of Artificial Sequence: Synthetic coding sequence
atgggcgtggctggtcgaaaccgacccggtgcagcatgggccgtacttttgcttctcctcctcctgccacctctgcttttgctggccggtgcagtcccaccaggaagaggccgtgcagctggtccccaagaagatgtagatgagtgcgctcaggggctcgatgactgtcacgcagatgcgctgtgtcagaatacacctacctcttacaagtgtagctgcaaacccggttaccagggagaggggaggcagtgtgaggatattgacgaatgtggaaatgagctaaatggcggttgcgtccatgattgtttgaatattcctgggaattatcgctgtacctgttttgacggtttcatgctcgcccacgacgggcacaattgtcttgacgtggacgagtgcctggagaataacggagggtgtcagcatacatgtgtcaatgtgatgggcagttatgaatgctgttgtaaagagggcttcttcctttccgacaatcagcatacttgcatccaccgctccgaagaaggattatcgtgtatgaataaggaccacgggtgctcacacatctgcaaggaagctccccgaggctccgtggcgtgcgaatgtcggccaggtttcgaactggctaaaaaccagcgggattgtatcctgacatgtaaccacggcaacggtgggtgtcagcattcatgtgatgacaccgcggatggaccagagtgttcttgtcatccccagtataagatgcatacggacggaaggagctgcctggagcgcgaagacaccgtgctggaggtcaccgagagcaataccacctctgtagtggacggcgacaaaagggtgaaacgcagactgctcatggagacgtgcgctgtgaacaacggagggtgcgacaggacatgcaaggacacaagcactggagtgcattgtagctgcccagtgggcttcacacttcaattagacggcaaaacatgcaaggacatcgacgaatgtcagacaagaaatggtggttgcgaccacttctgtaagaatattgttggcagcttcgactgtggttgcaagaaggggtttaagctgctcacggatgagaagtcctgtcaggatgtagacgaatgctcactggatagaacctgtgaccactcttgcataaaccaccccggaacatttgcctgtgcttgcaaccggggttacacgttgtatggattcacccactgcggagacaccaacgagtgctccatcaacaacggagggtgccaacaagtgtgtgtgaacactgtgggctcgtacgagtgccagtgccatcctggctacaagctccactggaacaagaaggactgtgtagaagtgaagggtctactacccacaagtgttagtcctcgggtctcgctacactgcggcaaaagcggtggcggagacggatgcttccttcgctgccacagcggaatccatttgtcaagtgacgtgactactatccggacttcagtgaccttcaagctgaacgaggggaagtgtagcctgaaaaacgcggaactctttccagagggactcagaccggctttgccggagaagcacagctcagtcaaggaaagctttagatacgtgaacctcacttgctcatccggaaagcaggttcccggtgctcccggtaggccctcaactccgaaggagatgtttattacagttgaatttgagctagaaaccaatcaaaaggaagtcacagcaagctgcgacttgtcctgtatagttaagcgtaccgagaaacgcctgaggaaggctatccggacccttcgtaaagccgtgcacagagaacagttccacctgcagctgtctggcatgaatctggacgtggccaagaaacccccacggactagcgaacggcaggccgagagctgcggtgttgggcagggccatgccgagaatcagtgcgtttcctgtcgcgctggtacttattatgacggcgctcgagagcggtgcattttgtgtccaaacggcacgtttcagaatgaggagggccaaatgacatgtgaaccctgtcctaggccaggcaatagcggggcactgaagacccctgaggcttggaatatgtctgagtgtggtggtctgtgccagcctggtgagtactctgccgatggcttcgccccatgtcatctctgcgccctcggtacatttcagccagaggctggcaggacttcctgcttcccatgtggcggtggacttgcaacaaaacaccaaggggctacatcatttcaggactgtgaaacgcgggtgcagtgctctccaggtcacttttacaataccaccacacatcgctgtataagatgccccgtgggcacctaccagccagagtttgggaagaataactgtgtctcatgtcccggtaatacaactacagacttcgacggttccaccaacattacccagtgtaagaaccggaggtgcgggggtgagttgggcgattttacggggtatatcgaaagcccaaattatcccggaaattatcctgcaaatactgagtgcacatggactatcaaccccccacccaaacggagaatcctcatcgttgtccccgagatttttctgccgatcgaggacgattgtggagactaccttgtaatgcgcaagacttccagctccaattctgtaacaacatacgagacatgccagacttacgagcggccaattgcattcacatcccgttctaagaagctgtggattcagtttaaaagtaacgaagggaatagtgccagaggcttccaggttccttacgttacctacgatgaagattaccaggaactgatcgaagacatcgtcagagatggccgactatacgccagtgagaatcaccaggagatactgaaggataagaaactcatcaaagccctctttgatgtgctggctcaccctcagaactatttcaagtacacggcccaagagtcaagggagatgttcccgcgtagcttcatccgcctgctcagaagtaaagttagccgatttctccgtccatataaatag

SEQ ID NO: 240535 - DNA, 2424 bp, Artificial Sequence
  Description of Artificial Sequence: Synthetic coding sequence
atgggagtggccggacgaaaccggccaggcgctgcttgggcagtcctcctcctgctgctactcctcccccctctgctcctgttggcaggagcagtgcccccagggagaggaagagctgccggtccacaggaggatgtcgacgaatgcgcgcaaggacttgatgattgccatgcggacgccctctgccaaaatacaccgactagctacaaatgctcctgcaaaccaggctatcagggagagggaagacaatgtgaagacatcgacgaatgtggtaacgaactgaatggaggctgtgttcatgactgcctaaatattccaggaaactaccggtgcacctgcttcgacggatttatgctggcccacgacgggcacaactgcctggacgtggacgagtgcctagagaacaatgggggatgtcaacacacgtgtgtgaacgtgatgggttcctatgaatgttgttgcaaggaaggctttttcctgagcgataatcagcacacttgcatccaccggtctgaagagggactgagctgcatgaataaggatcacggttgctcacacatctgtaaggaggcccctaggggatcggttgcctgtgaatgtagacccggttttgaactggctaaaaaccagcgtgactgcattttgacctgtaatcatgggaacggcggatgccagcacagttgtgacgacactgctgatggccctgagtgttcatgccaccctcagtacaagatgcataccgacggccgtagttgcttggaaagggaggacacagtgctagaagttaccgagagcaacaccactagtgtggtggatggcgataaacgggtcaaaagacggctgttgatggagacatgtgctgtcaacaacggcggatgtgaccggacgtgtaaggatacatccactggcgttcattgcagctgtcctgtgggttttaccttgcagctcgacgggaaaacgtgcaaggatatagatgaatgccagactaggaacggcggatgcgaccatttctgcaaaaacattgtgggatccttcgactgtggatgcaaaaaagggttcaaactgttgaccgacgaaaaatcctgtcaagatgtagacgagtgcagtttagacagaacttgtgatcattcttgtatcaaccatccaggcaccttcgcgtgcgcatgcaatcgaggttacaccttgtacggtttcacgcactgtggcgacaccaacgagtgctctattaacaatgggggttgccaacaagtttgtgtgaataccgtcggcagttacgaatgccaatgtcacccaggctacaagctccattggaataaaaaagactgcgtagccagctgtgacctgtcttgcattgttaaacggaccgagaaaagactccgaaaggccatacgcacactacggaaagcagtgcaccgggagcagttccacctccaactctccggcatgaacctggatgtggcaaaaaagccgccaagaacctccgagcgccaggctgagtcttgcggcgtcggacagggtcacgcagagaatcagtgcgtttcatgcagggccggtacatactatgacggcgcacgagaacgatgcattctgtgtcctaatggaacctttcaaaacgaggagggtcaaatgacttgtgagccatgcccccgtcctgggaacagcggagccttaaaaacccccgaggcatggaacatgtcagagtgtggaggattgtgtcagcctggtgagtactccgccgacgggttcgccccttgccacctgtgcgcgctgggtaccttccagcctgaggctgggcgaacctcttgctttccatgcgggggaggcctagcaaccaagcaccagggcgctaccagtttccaggattgtgagacaagagttcaatgttcacccggacacttttacaacacgaccacccatagatgcatccggtgcccggtcggaacctaccaacccgagttcggaaagaacaattgtgtttcgtgtcctggtaatacaactactgacttcgatggtagtactaacatcactcaatgtaagacgtcaagtaactccgttaccacatacgagacttgtcaaacctatgagcgcccaattgcattcacgagccgcagcaagaagctgtggatccaattcaagagcaacgaaggaaatagtgccaggggatttcaggtaccctatgtaacgtatgatgaggactatcaggaacttattgaagatatcgtaagagatggcagactctacgcctccgagaaccatcaggaaatattaaaagataagaaactgatcaaggcattattcgacgtgttagcccacccacagaattactttaagtacacagctcaggagagccgtgagatgttcccaagatctttcatcaggttgctgaggtccaaggtgtctcgttttctgcgaccttacaagtag

SEQ ID NO: 240536 - DNA, 3087 bp, Artificial Sequence
  Description of Artificial Sequence: Synthetic coding sequence
atgggggtggccggacgcaataggcctggcgcagcctgggctgtcctgcttctgcttcttcttcttcctccattgctcctccttgcaggagccgtgcccccaggtcgaggccgagctgcgggaccccaggaagacgtcgatgagtgtgctcaaggtttagacgattgccacgccgacgccctgtgtcaaaacacacccacttcctacaagtgtagctgtaagccaggataccaaggggaggggcgacagtgcgaggacattgatgaatgtgggaatgaactgaacggcggttgtgtgcatgattgtctcaacatccccggtaactataggtgcacatgtttcgatggattcatgcttgcccatgatggccacaactgtctggacgttgatgagtgtttggaaaataacggcggatgccagcacacatgcgtcaatgtgatgggcagctacgaatgttgctgcaaggaaggattttttcttagtgacaaccaacatacgtgtatccacaggtccgaagagggcttatcgtgtatgaacaaagatcatggctgcagccatatctgcaaagaggcccctcgtgggtcagtagcatgtgagtgtcgccctggcttcgagctggctaaaaatcagagagattgtatcctgacctgtaaccacggaaatgggggatgtcaacacagctgcgatgacactgccgatgggcctgagtgtagctgtcacccgcaatataaaatgcacacggacggccgatcctgtctggaaagggaagatacagtgctcgaggttactgaatcaaacacaacctccgttgtcgacggcgataaacgcgtgaagcgccgactgctgatggaaacgtgcgccgttaacaacggtggctgcgaccggacatgtaaagatacctcaacaggagttcattgctcatgcccagtggggtttacactccagcttgatgggaaaacatgcaaagatattgacgagtgtcagaccaggaatggaggatgcgatcatttctgcaaaaatatcgtgggatcattcgattgcggctgcaagaaaggttttaaactgttgacagatgaaaaatcctgccaagatgtagatgaatgctcactagaccggacctgtgatcattcctgcattaaccaccctggaacctttgcgtgcgcttgcaataggggatatacactctatggctttacccattgtggcgatacgaatgaatgctccatcaacaatggcggatgtcagcaggtgtgcgtcaacactgtgggtagttatgagtgccaatgccatcccggatacaagttgcactggaacaagaaagattgtgtcgaggtgaaagggctcttaccaacgagcgtcagtcccagggtgagcctccattgtgggaagagcggtgggggagatggatgttttctgcgctgccattctggaatccatttgtccagcggtcttcagggagcctattccgtcacatgtggcagcagctcccctctacgaaataaacagcaaaagtcaaacgactctgccttcggagacgttactacaatccgaaccagcgtgacttttaagctgaacgaggggaagtgcagcttgaagaacgcagaattgttccctgagggcttgagacctgctctgccggagaaacattcgagcgtgaaggaatcatttaggtatgtcaacctgacttgttcgtctggaaagcaagtccccggtgcccctgggcgacccagtactccaaaagagatgttcatcacagtagaatttgagctcgagacaaaccaaaaggaagtaactgcaagctgtgatctgtcatgcatcgttaaacgaaccgagaaaaggctcaggaaagctattcgaacactgcgaaaggctgtgcaccgggaacagtttcatctgcagttgtcaggcatgaacctggacgtcgccaagaagcccccacggacatcggagagacaggccgagagctgcggagttgggcagggccacgcggagaaccagtgcgtgtcctgtagggcgggtacctattatgacggggcaagggagcgctgcattctatgcccgaacggtactttccaaaacgaggagggacagatgacttgtgagccctgcccccgacctggcaactcgggagcactgaaaacaccagaggcttggaacatgagcgaatgtggaggcctgtgtcagcccggagagtactccgcagacgggtttgccccttgtcatctttgtgccctcggaacctttcagcccgaggcagggcgtacatcttgttttccttgtggcggaggcttggctaccaagcatcagggagctacgagtttccaggattgtgagactagggtccaatgtagtcctggacatttctataatactaccacacatagatgcattcggtgtcctgttggaacttatcagcctgagttcggaaagaacaattgcgtatcctgtccgggaaacaccacgacagacttcgatggatccacgaatatcacacaatgcaagaatcggcgatgcggaggagaacttggggatttcacaggatacatcgaaagccctaactatcccggaaattaccccgctaacaccgagtgtacttggacaatcaatcccccacctaaacgccgaatcctgattgttgtacctgaaatcttcctccctatagaagatgattgtggcgattaccttgtgatgcgtaagacatcctcctccaactccgtcaccacttatgaaacctgtcagacgtatgagcggccaattgcgttcaccagtaggagtaaaaagctttggatccagtttaagtccaatgagggaaacagcgctcgcggatttcaggtgccatacgtgacctatgacgaagattatcaagagcttattgaggacattgttagagatggcagattatatgcctctgaaaatcaccaggagatcctaaaggataaaaaactcattaaagccctgtttgatgtgttagcccacccccagaattattttaagtacaccgcccaggagagcagggagatgtttccgaggagcttcatacgtcttcttaggtccaaggtatcacgattcctcaggccgtataaatag

SEQ ID NO: 240537 - DNA, 411 bp, Artificial Sequence
  Description of Artificial Sequence: Synthetic coding sequence
atggtcctgctggagagcgagcagttcctgacagaactaacgcggctgttccaaaagtgtcgtacgtccggcagcgtgtatatcacactaaagaaatacgacggcaggaccaaaccaatcccgaagaaaggcactgtagagggctttgagcccgcagataataagtgcctgctgcgggctaccgatggaaagaaaaagatcagtacagtggtgtcttctaaggaggtaaataagtttcagatggcttactccaacctcctcagggctaatatggatggccttaaaaaacgggataaaaaaaataaaactaagaaaacaaaggccgctgctgctgcagccgctgccgctcctgccgctgccgcaaccgcccctacaaccgctgcaacgacagccgctaccgcagcccaatag

SEQ ID NO: 240538 - DNA, 333 bp, Artificial Sequence
  Description of Artificial Sequence: Synthetic coding sequence
atggcatgtgccgcagcgaggagccccgctgaccaggatagatttatttgcatttatccagcctatctcaacaacaagaagaccatcgctgaaggacgcagaatccctataagcaaggcagtcgaaaacccaaccgcgacagagatccaagatgtgtgtagcgctgttggactgaacgtgttcctggagaaaaacaagatgtatagtcgggagtggaatcgggatgtgcagtatagaggacgagttcgagtgcagctgaagcaagaggatgggtcactgtgtctggtgcagtttccctctcactatacgttgagtctgacttcaggttcttag

SEQ ID NO: 240539 - DNA, 435 bp, Artificial Sequence
  Description of Artificial Sequence: Synthetic coding sequence
atggcatgtgccgctgccaggtcccccgcagaccaggacagatttatatgcatctatcccgcatatctcaacaacaagaaaaccattgctgaggggagaagaatccccatctcaaaggctgtggagaaccctaccgccaccgaaatccaggacgtgtgcagtgccgtgggcttaaacgtctttctagaaaagaacaagatgtactcccgtgaatggaaccgagacgtccagtatcgcggaagggtgagggttcaactgaagcaagaagacggaagtctgtgcttggtgcagttcccttccaggaagtctgtaatgctatatgctgcagaaatgattccgaagctgaagacgagaacccagaaaacaggcggagccgatcaaagtctgcagcaaggagaaggctccaaaaagggtaaaggaaaaaagaaaaagtag

SEQ ID NO: 240540 - DNA, 237 bp, Artificial Sequence
  Description of Artificial Sequence: Synthetic coding sequence
atggcatgcgccgctgctagaagccctgcagaccaagacaggcttctgaaaattctccaattacagcggttcaagatgtacgtgcaacagttggatctcacttattttcttcggaagatcaagtgcactcttgaaaatgggatcgttatgtctaacacggaggccgaaagcggcagttcatctaaccggaagatgggggcatccgccctctacagcagccaccacgtgagccagtag

SEQ ID NO: 240541 - DNA, 639 bp, Artificial Sequence
  Description of Artificial Sequence: Synthetic coding sequence
atggaggctaagacactcggcactgtaacccccaggaaacccgtgctgtcagtttccgccagaaagattaaagataacgccgcagactggcacaatctgatcctaaagtgggagaccctgaatgacgccggttttacgaccgctaataatatcgccaacctgaagatctccttattgaacaaagacaagatagagttggacagtagcagccctgcttcaaaggagaatgaagagaaggtgtgcctggaatacaacgaagaacttgagaagttatgtgaagaactgcaagccacgcttgacgggctgacaaaaattcaggtcaagatggagaagctgtccagcaccacaaaaggcatctgcgagctggagaactaccactatggggaagagtccaaacgacctcccctctttcacacgtggccaacaacacatttttatgaagttagccataagctgcttgagatgtacagaaaggaactgctcttaaagcggactgttgccaaggagttggcccatacaggcgacccagacttgactctctcctacctgagtatgtggcttcaccaaccctacgtggaaagcgacagtagacttcacctggagagcatgcttctcgagacaggacacagagccctctag

SEQ ID NO: 240542 - DNA, 1368 bp, Artificial Sequence
  Description of Artificial Sequence: Synthetic coding sequence
atgccacccctctcaatgaaacgatcagccatcgatctggaggaaatggcaagtgggctgaacaaaagaaaaatgatccagcacgctgtctttaaggagctggtcaagttggtggaccccggtgtcaaggcctggactccaaccaaaggaaagcagaatgttataatgtttgtaggactgcaggggagcggaaagaccaccacttgttccaagctggcgtattactaccaaaggaaaggttggaaaacctgtctgatctgcgctgacacgtttagggccggtgcctttgaccagctgaaacagaatgctaccaaagctaggattcccttttatgggtcgtacacggaaatggacccggtcatcatcgccagtgaaggcgtggaaaaattcaaaaatgaaaacttcgaaataattatcgtcgacacctctggacgacacaagcaagaagatagcctatttgaggaaatgctgcaggttgcaaatgctatacagcccgacaatatcgtgtatgtgatggatgcttctatcggacaggcctgcgaggctcaagcgaaagcgtttaaggataaggtcgatgtggcctcagtcatagtcacaaaactggatggccacgctaaaggaggaggggcactgtccgcggtggccgcaacgaagtcacctattatcttcatcggaacaggcgagcacattgatgactttgaaccctttaaaacccagcccttcatttcaaaactcctgggtatgggcgacatcgagggtctcatagataaggtaaacgaacttaaactcgacgacaatgaggcccttatcgagaagctcaagcacggccaatttactctccgcgacatgtatgagcaattccagaacattatgaagatggggccattttcccagattcttgggatgatccctgggtttggcacagacttcatgtcaaaaggtaatgagcaggagagtatggcacgactgaagaagctgatgacaatcatggacagcatgaatgatcaggagttggacagcactgacggagccaaggtgttctccaagcaaccgggtcgcatccagcgagtcgccagaggcagtggagtctctaccagggatgttcaagaattgcttacccagtacactaagtttgctcagatggttaaaaagatgggtggcatcaaggggctcttcaaagggggagacatgtcgaaaaacgtgtctcagagtcagatggccaagcttaatcaacagatggcaaaaatgatggaccccagggtgttacaccacatgggtggcatggccggtttacagtctatgatgcggcagtttcaacagggcgcagcagggaatatgaagggcatgatgggctttaacaacatgtag

SEQ ID NO: 240543 - DNA, 135 bp, Artificial Sequence
  Description of Artificial Sequence: Synthetic coding sequence
atggtactggctgaccttgggagaaagatcacctccgcactgaggagtctgtccaacgcaaccatcataaacgaggaggtccttaatgcaatgttaaaggaggtctgcaccgcacttctagaggcagacgtgtag

SEQ ID NO: 240544 - DNA, 225 bp, Artificial Sequence
  Description of Artificial Sequence: Synthetic coding sequence
atggtgcttgctgatttggggagaaagattacgagtgcactgagaagtctaagcaacgccaccataatcaacgaagaggtgttaaacgctatgctgaaagaagtgtgcactgcactgttggaagcagatgtgaacatcaagcttgtgaagcagctgcgggaaaatgttaagtccgcaatcgatctggaagaaatggcttctggacttaacaagcggaaaatgtag

SEQ ID NO: 240545 - DNA, 1515 bp, Artificial Sequence
  Description of Artificial Sequence: Synthetic coding sequence
atggtgttggctgatttaggccgtaaaattacctctgctctgaggtcactttcaaatgccaccattatcaacgaggaggttttgaatgctatgctgaaggaagtttgcaccgccctgttggaggccgacgtcaacatcaagctggtgaaacaattgcgcgagaatgtgaaatctgccatcgacctcgaagagatggccagcggcttgaacaagcgcaagatgattcagcacgccgttttcaaggaactcgtgaagctggttgatcccggagttaaggcttggactccgacgaagggcaaacagaatgtaattatgttcgtgggactccaaggctcagggaagacgacaacgtgtagcaaacttgcttattattaccagaggaaggggtggaagacctgtctgatctgtgcggacacattccgtgctggggcttttgaccagctgaaacaaaacgccactaaggccagaattccattttacggctcatacacagaaatggacccagtaatcatcgcatccgagggagtcgaaaaattcaaaaacgaaaacttcgagatcataattgtggacacgagtggcagacacaaacaggaagactcgctattcgaggaaatgctgcaagttgccaacgccatccagccggacaacatagtctacgtaatggacgcaagtattggacaggcctgtgaagcacaggctaaagccttcaaggataaagtagacgtcgcatcagtgatcgtcacaaaactggacggccacgctaaaggcggaggcgcactttccgctgtcgccgctaccaagtcccccatcatcttcataggtacaggcgagcacatagatgactttgagcctttcaaaacccaaccatttatctctaaactgcttggaatgggcgacatcgagggactaattgataaagtgaacgaactgaaactggatgacaacgaggctctaatagaaaaactcaagcacggccagtttaccctccgggatatgtatgagcagtttcaaaatatcatgaagatgggacccttttcccagattctcggaatgattcctggattcggcaccgacttcatgagcaaaggcaatgagcaagagagcatggctagattgaagaaactaatgaccatcatggacagcatgaacgaccaggagcttgactctacagacggggctaaggtgttcagcaagcagccgggaagaatccagcgtgtcgcacgcggttccggggtctctacaagggatgttcaggagctgctaacccagtatacaaagtttgctcagatggtcaaaaaaatgggcggtattaagggactcttcaagggcggtgacatgtcaaaaaatgtatcccagtcccagatggctaaactcaaccaacagatggccaaaatgatggatccaagggtgctgcaccacatgggaggcatggcaggtctccagagtatgatgcggcagttccagcaaggagcggcaggcaacatgaaaggtatgatgggatttaacaacatgtag

SEQ ID NO: 240546 - DNA, 1791 bp, Artificial Sequence
  Description of Artificial Sequence: Synthetic coding sequence
atggccgcagaaaaacaagtccccggaggtgggggtggagggggatcaggcggaggtggcggttccggaggtggtggatccggtggagggagaggagctgggggagaagagaacaaggagaatgagcggccttctgccggttctaaggctaataaggaattcggggatagcctatcacttgagatactgcagattatcaaggaaagtcagcagcagcacggcctgagacatggcgactttcaacgttatagaggctactgttcgagacgacagcgccgactgcgcaaaacgctgaatttcaagatgggcaaccgtcacaaatttactggcaagaaagttaccgaggagctactcactgataacagataccttctgctcgttctgatggatgccgagcgcgcatggtcatacgctatgcagttaaagcaggaggccaacacggaaccccgtaagaggtttcacctgttgtcacggctgcggaaagcagtgaagcacgccgaagaactggagagactgtgcgagtccaatagggttgatgcaaaaaccaagttggaggctcaggcctataccgcttatctttctggcatgcttaggtttgaacatcaggagtggaaggctgctatcgaggctttcaataagtgtaagactatctacgagaaactcgcttctgcttttacggaggaacaggccgtgctgtacaaccagcgcgtcgaggaaattagtcctaatatcagatattgcgcatataacatcggggaaacgcgcgcaaaacaggcagctaccatgtccgaagttgagtggcgcggacgcacagtccctgttaagatagataaagtacgcattttcctgctcggcctggcagataatgaagcagcaatcgtccaagcagagagcgaagagaccaaggagagattgttcgaaagtatgttgagcgagtgtcgcgatgccattcaggtcgtcagagaggaactcaagcctgaccagaaacagcgcgactatatactggagggggagcccggaaaagtttccaatctacagtatttgcacagttatctaacatacatcaagctcagcactgcaattaaaagaaatgagaacatggcaaaaggcctccaacgcgcactgctccagcagcaaccagaagacgacagcaagcgcagcccccgtccgcaagatctcatccgtctgtacgatataatactccagaatctggttgagttgttgcagcttccaggcctggaagaggacaaggccttccagaaagaaattggcctgaagacgcttgtctttaaagcttatcgatgtttcttcatcgctcagtcctacgtcctggtcaagaagtggtccgaggccctcgttctatacgaccgcgttctgaaatacgccaatgaagtgaatagtgatgccggagcctttaaaaacagcctgaaggatctcccagatgtgcaggagctcatcacccaggtccgttctgaaaaatgttcattacaggccgcagctatcttagacgcgaacgatgcccatcagaccgagacttcctcttctcaggtgaaagacaataagcctctcgtggagaggtttgagactttctgcttggatccgtctcttgtgactaagcaggcgaacctggtccattttcccccagggtttcaacctatcccctgcaaacctttattcttcgacctcgctctaaatcacgtggcttttcctcccttggaggacaagctcgaacaaaaaaccaagagtggtctcactggatatataaagggcatttttggctttcgatcatag

SEQ ID NO: 240547 - DNA, 1884 bp, Artificial Sequence
  Description of Artificial Sequence: Synthetic coding sequence
atggctgccgaaaagcaagttcccggtggagggggtgggggaggctctggagggggtggcggttccggcggaggcggatccggaggcggacggggtgccggaggcgaggaaaacaaagagaatgaacgccctagtgcaggatctaaggcaaacaaagagttcggggattcactcagcctggaaattctgcagattataaaggagtctcagcaacaacacgggctgcggcatggggatttccagcgatatcgagggtattgtagccgaaggcagaggcgtctgcgaaaaacgctgaacttcaagatggggaacaggcataaatttactggaaagaaagtgacagaggagctgctgaccgataaccgctatcttttgctggtgctgatggatgccgagagggcctggagctatgccatgcaactgaaacaggaagctaacaccgaacccaggaaacgctttcaccttcttagccgcctgcgcaaggccgtgaagcatgctgaagagctggaacgactgtgcgagtccaatcgagtggatgccaaaaccaagcttgaagcacaggcttatacagcttacctgagtggcatgctccgttttgagcaccaggaatggaaggccgctattgaggcttttaataagtgtaagaccatttacgaaaaactcgcctccgcattcaccgaggaacaagccgtcctctacaaccaaagggttgaggaaatttctccaaacatccggtactgtgcatataacattggcgatcagtccgcaataaatgaactcatgcaaatgagactcaggagcgggggaactgaaggtctgttagccgagaaactcgaagcattgatcactcaaacccgggcaaaacaggccgctaccatgagcgaggtggaatggcggggaaggaccgttccagtcaaaatagacaaggtacggatattcctcctgggactagcagacaatgaggctgccatagtgcaggcggagtctgaggagaccaaggaacggttgttcgaatctatgcttagcgagtgtagggatgccattcaggtagttcgcgaggagctgaagcctgatcagaagcagagagactacatacttgaaggagagcccggtaaagtgtctaacctgcagtacctacatagctacctcacatacattaagctaagtactgcaatcaagcgcaatgaaaacatggctaaggggctccagcgagccctccttcagcaacaacccgaagacgatagcaagcggagcccaagaccacaagacctgatccgcctgtatgacatcattttgcagaatcttgtggaactgctccagttacccggactggaggaggataaggcctttcagaaggaaattgggctgaaaactctggtgttcaaggcctaccgctgtttcttcatcgcacaaagctatgtgttggtcaagaaatggtcagaggccctagtcctgtatgaccgggtgttgaaatacgccaacgaggtcaacagtgacgctggcgcttttaagaatagtttaaaggatctccctgatgtgcaggaactcattactcaggtaaggtcagaaaagtgctctctgcaggcagccgctattctggatgcgaacgatgctcaccagacggagacatccagctcccaagtgaaagacaataagccactggttgagaggttcgaaactttttgtctcgacccctccctcgtgacaaaacaggcaaatctcgttcattttccaccagggtttcagccaatcccctgcaaacctttattcttcgatctggctttgaatcatgttgctttccctccactggaggacaaactcgagcagaaaactaagagcggcctaaccgggtacatcaagggaattttcggcttccggagctag

SEQ ID NO: 240548 - DNA, 1581 bp, Artificial Sequence
  Description of Artificial Sequence: Synthetic coding sequence
atggggaacaggcataaattcacagggaagaaggtcaccgaagagctcctcactgacaataggtatctattgctggtgcttatggatgcagagcgtgcctggtcgtatgccatgcagctgaagcaagaggcgaacacagagccacggaaaaggtttcatctgctgtccagactccggaaagcagtgaaacacgcagaggaactggagcggttatgcgaaagtaacagggtggacgccaaaactaagctggaggcccaggcctacacagcatatctatctggaatgctgcgttttgaacatcaagagtggaaagccgcaatcgaagcttttaacaagtgcaaaaccatttacgagaagctggcctccgccttcacagaagagcaagcagtcctgtataaccagcgtgtcgaggagatttcccccaatattagatattgcgcctacaacattggggatcagtcagctatcaatgagttgatgcaaatgcgtcttcgatctggaggcaccgaaggtcttctggcggaaaaactggaagccctcattacacagacgagggcaaagcaggcggctaccatgtcagaggtcgagtggcgtgggcgaacagtgcctgttaaaattgataaagtacgtattttcctactcggcctcgccgataacgaagctgctatcgtgcaggcagaatcagaggagacgaaagaaaggttgttcgagtccatgctaagtgagtgccgagatgcaatccaagttgtgcgcgaagaactgaaacctgatcagaagcagcgcgactacatcctcgagggcgaacccggtaaggtctctaacctgcagtacctccatagctatctcacttacattaagctgtcaacggcaatcaagcggaacgaaaacatggcaaaggggctgcaacgggctttactgcaacagcagcctgaggatgattccaagagatcacccaggcctcaggatctgatccgtctgtacgacattatcctgcagaatttggttgagctactacaattgccgggtttggaagaggataaagctttccagaaggaaattggccttaaaacgttggtctttaaagcctatcgctgtttttttattgcccagtcgtatgtcctcgtaaagaagtggtccgaggcactggtgctgtatgatagagtgctgaagtacgcgaacgaggtaaactctgatgctggcgcttttaagaactctctcaaggatctccccgacgtgcaggagctcataactcaggtcagatcagaaaaatgctccctgcaggctgcggctattctggacgccaacgatgctcaccaaacggaaacgtcaagcagccaggtgaaagataataagcctctggtggagcgcttcgaaacgttttgtctggatcccagcctagtgactaaacaagccaacctggtacatttcccccctggcttccagcccatcccctgcaaaccgctgttcttcgacttggcactaaatcacgtagccttcccgcctttggaggataagctagaacagaagactaagtccgggctgacagggtatataaaaggcatcttcggtttccgatcatag

SEQ ID NO: 240549 - DNA, 984 bp, Artificial Sequence
  Description of Artificial Sequence: Synthetic coding sequence
atgcagatgaggttaaggagcgggggaactgagggactgttggcggagaagctggaggcccttatcactcaaacacgggctaagcaggcggcaaccatgagcgaggtggagtggcgtgggaggactgtccccgtgaaaatcgataaggtaaggatcttccttctgggcctcgctgacaatgaagccgctattgtccaggccgagagtgaggagactaaggagagactgtttgagtcaatgctgtcggaatgtcgagacgctatacaggtagtgagagaggagttgaaacccgaccagaaacagcgagactacatcctggaaggagaacccggaaaggtgtccaacctgcagtatctccacagttaccttacctacattaaactgtccaccgcgatcaagcggaacgagaatatggcaaagggcctccagcgcgcactccttcagcagcagcctgaggacgatagcaagcgaagccccaggccccaggatctgatcaggctgtacgatatcatactgcaaaatctagtcgagctactgcagttacccggtttagaagaagataaggcttttcagaaagagattggccttaaaacactggtcttcaaggcttacagatgtttcttcatcgcacagagttatgtactggtgaaaaagtggagcgaagcacttgttctttacgacagagtgctaaagtacgccaatgaggtgaactctgatgccggagcttttaaaaactccctaaaagatctgcctgacgtgcaggagctcattacccaggtgcgcagcgagaagtgttctttacaggcagcagcaattttggatgcaaatgatgcccaccagaccgagacttcttccagccaagtcaaagacaataaaccacttgtggaacgcttcgaaagtacgcctgggactgacggtgcccttaagagattcgtgatgcttttgcagtatcatggcttcgagatgaatagctccttattatag

SEQ ID NO: 240550 - DNA, 1770 bp, Artificial Sequence
  Description of Artificial Sequence: Synthetic coding sequence
atggcagccgaaaagcaggtacctggcggaggcggaggaggcggaagtgggggtgggggaggctccggaggtggaggctcgggcggaggacgtggagcgggaggcgaagagaacaaagagaacgaacgaccatccgccggtagcaaggcgaacaaggagttcggtgactccctgtctcttgagattttacaaatcattaaagagtcacagcagcaacacggactgagacacggtgatttccagagatatcgctatctcctcttagtgttgatggatgcggagcgtgcgtggtcctacgcaatgcagctgaaacaggaggccaatacagagcctcggaaaaggtttcatctgctgtcccgacttagaaaggccgttaagcacgctgaggaattggaaagactatgtgaaagcaaccgtgtggacgccaagacgaagttggaagcccaagcttatacagcctacctctcagggatgctgaggttcgaacaccaggagtggaaggccgcaatcgaggcctttaacaaatgcaaaactatttacgaaaagctcgcctctgcatttactgaggaacaagccgtgctgtacaaccagcgtgtcgaagagatctccccgaacatacggtattgcgcttacaacatcggagatcagtccgccattaacgaactcatgcagatgcgcttacgtagcggcggaacggagggcttgctggcagagaagctggaggccctgatcacccagacccgggctaagcaagcagctactatgagcgaggtggagtggagggggagaaccgtccccgttaaaattgacaaggtgagaatttttctcctgggcctggctgacaacgaagccgcaatagtgcaggcagagtcagaggagactaaagaaagattgtttgaaagcatgctcagcgaatgccgagatgctatccaggtggtgcgcgaggagctgaagccagatcagaagcagcgtgattacatcctggaaggcgaacctggtaaggtgagcaacttacagtatctccactcttatctcacctacatcaagcttagcacagcaatcaagagaaacgagaacatggccaagggcctccagagggccctgctgcaacaacagcccgaagatgactcgaaacgttctcctcgtcctcaggatctcatccgactctacgacattatcttacaaaatctggtcgagttactgcagttgcccggtcttgaggaggataaggcattccaaaaagagatcgggctcaagaccctcgtttttaaggcatatcgctgctttttcatcgcacaatcctacgtgctggtcaaaaagtggtcagaggctttggtgctttacgatcgggttctgaaatatgccaacgaggtaaacagcgatgccggagctttcaagaattctctgaaggacctacccgacgttcaggagcttattactcaggtacgaagcgagaagtgtagtctgcaggcggctgccattctcgatgccaatgatgcccatcagacggaaacatccagctcacaggtgaaggataacaagcccttggtcgaacgtttcgaaactttctgcctcgacccaagtctcgtcaccaagcaggccaacctggtgcatttccctcccggttttcagcctatcccgtgtaaaccattgttcttcgacctggctcttaaccacgtagcgttccccccactcgaggataaacttgaacagaaaaccaaatcagggctgactggatatattaaaggtatattcggtttccggtcatag

SEQ ID NO: 240551 - DNA, 1110 bp, Artificial Sequence
  Description of Artificial Sequence: Synthetic coding sequence
atggcggcagagaagcaggtgccaggcggaggagggggaggaggaagcggtggcggtggcggtagtggcggaggcggttcggggggaggcagaggagcaggcggtgaggagaataaagagaacgagcggccttctgccggatccaaagctaacaaagagtttggcgacagcctcagccttgagatactgcagataattaaggagagccagcagcaacatggactgaggcacggggactttcagaggtatagaggctactgctcgcgaagacagcgtcgcctgaggaaaaccctgaactttaaaatgggaaaccggcacaagtttaccggaaagaaggtgacagaggaacttctgacagataataggtatctattgcttgtgctaatggacgccgagagggcctggtcatatgcgatgcaactgaaacaggaagccaacactgaacctaggaaaaggtttcatttgctaagtaggctaaggaaggcagtcaagcacgcagaggaacttgaacggctctgtgaatctaaccgggtggatgccaagaccaagctcgaagctcaagcttataccgcttacctgtctgggatgctccgattcgaacaccaggagtggaaggccgcaatcgaggcgttcaataagtgcaagaccatctatgaaaaactggccagcgcctttaccgaggaacaagcggtcctgtacaatcagagggtggaagaaataagccccaatatacgctactgcgcttacaatattggcgatcagtccgccatcaacgagttgatgcagatgcgtctgcgaagcgggggaaccgaggggctgctggccgaaaagttggaggccctgatcacacaaactagagcgaagcaggctgccaccatgtcggaggtcgaatggcgcggacgcacagtgcccgtgaaaatcgacaaagtcaggatcttcctcctggggcttgctgataacgaagcagccattgtccaagctgaatctgaggagaccaaggaaagactctttgaatccatgctgagcgaatgccgcgacgctattcaggtggtgcgcgaggagctgaagccggatcagcgagaccttctccttccctctcagggccaatag

SEQ ID NO: 240552 - DNA, 867 bp, Artificial Sequence
  Description of Artificial Sequence: Synthetic coding sequence
atgctatctgagtgtcgagacgccattcaggtagtccgggaagagttgaagcctgaccagaagcagagggactatatcctcgaaggcgaacctggcaaagtgtcgaatctgcaatacctgcacagttacctcacttatatcaaactgagtacagcaatcaagcgtaacgagaatatggccaagggactgcagcgggcattactccaacagcagccagaggatgacagcaagcgctcccctcgcccacaggacctgattagattgtatgacattatactgcagaacttggtcgagctacttcagctcccaggattggaggaggacaaagcgttccagaaggaaatcggtcttaagacattggtattcaaagcatacaggtgcttttttattgcacagtcctacgtgttggttaagaaatggtccgaggccctggtcctttatgatagagtgctgaagtatgccaacgaagtgaattccgatgctggagccttcaaaaactcacttaaagacttacctgacgtccaagagttaattacccaggtcaggtcggaaaagtgcagtcttcaggcggcagccatcctggacgctaacgacgcccatcaaacagagacgagttccagccaggtgaaagacaacaaacccctagtggagcggtttgagaccttttgtctggatccctctctagtgaccaagcaagctaatttagtgcactttccacctgggtttcagcctattccatgcaaacctcttttttttgatctagcacttaaccatgtggcgtttccacctctcgaagataagctggagcagaaaactaaatccggcctcaccggatatattaaggggatatttggatttcgatcatag

SEQ ID NO: 240553 - DNA, 2016 bp, Artificial Sequence
  Description of Artificial Sequence: Synthetic coding sequence
atggccagcgggggatccgggggagtgtctgtgccagccctgtggagtgaagtcaaccgatacggacagaacggcgactttacacgcgcactgaaaactgttaataagattctccagatcaacaaagatgacgtcacagccctgcactgtaaggtagtctgtcttatccagaatggctcgtttaaggaagccctgaacgtgattaatactcacaccaaggtcctggccaacaacagcctgagcttcgagaaagcgtattgcgaataccggctgaacagaatagagaatgcgctgaaaaccatcgaaagtgccaaccagcagactgataaattgaaggagctatacggacaggtactgtataggctggaacgctatgatgaatgcctggctgtgtacagggatttagtgcgaaattctcaggatgattatgacgaggagaggaagaccaatctttccgctgtggtggccgctcagagcaattgggagaaggtggtgccagaaaatttaggtctgcaggaaggcacacacgagctgtgctacaataccgcgtgcgcattaataggccagggccaactgaatcaggccatgaaaatccttcagaaagccgaggacctctgtagacggtctcttagcgaagatactgatggcactgaggaagatcctcaggctgagcttgctatcattcacggacagatggcttacatccttcaacttcagggaaggactgaggaggccttacaactgtacaatcaaattatcaaattaaagcctactgatgtgggtttactcgcagtaatcgcgaacaatatcatcactatcaataaagaccagaatgtgtttgattcaaaaaaaaaagtcaagctgacaaacgcagaaggagtggaatttaaactgtccaagaaacagctccaagccattgaattcaacaaggcactgctagcgatgtatacgaatcaggccgaacaatgcagaaaaataagcgcctctctgcaaagtcaaagccccgaacacttacttccagttttgatccaggctgcacaactttgtcgagaaaagcagcacaccaaggccatcgaacttctgcaagagttcagtgatcagcatcctgaaaatgcagcagaaataaagctaactatggcacagctgaaaatatcccagggaaacatcagtaaagcctgcctgatcctcagatccatcgaagagttgaaacataagcccggaatggtgtccgccctggtcacgatgtattcccatgaagaagatatcgactctgcaatcgaagtatttacacaggcaatccagtggtatcaaaaccaccagccgaaatctcctgcccatctaagtcttatacgagaggcagccaatttcaaattgaagtatggacgtaagaaggaggctatttctgatttacagcagctgtggaaacagaatcctaaggacatccatacccttgcccagctcatctcagcatacagcttagtggacccagagaaagccaaggccctgagtaaacacttgccttcctctgactcgatgtccctgaaagttgatgtagaagcactggagaattcagccggtgccacctacatccggaagaaagggggtaaggtgaccggcgattcacagcccaaggaacaaggtcagggagacctgaagaaaaagaagaagaaaaagaagggcaaactacccaaaaattacgatcctaaagttaccccggatccagagcgctggctgcctatgcgggagcgctcttactaccgcggtagaaaaaaagggaagaagaaggaccagataggcaaaggaacacagggtgccacggcaggggcaagtagtgaactcgacgcatctaagaccgtgtccagtcccccaacttcacctcgccctggatctgccgctacggtgtcagcaagcacaagtaacatcattccaccacgacaccagaagcccgctggagcccctgctacaaagaaaaagcaacaacagaaaaaaaagaagggcggtaaaggcggatggtag

SEQ ID NO: 240554 - DNA, 1878 bp, Artificial Sequence
  Description of Artificial Sequence: Synthetic coding sequence
ccactggtctcaagcaagatggccagcggtggaagtggcggtgtctcagtgcccgctctgtggtccgaggtcaaccgctatgggcagaacggagacttcactagggccctgaagaccgtgaacaaaatcctgcagatcaacaaggacgatgtgaccgcattgcactgtaaggtcgtgtgcttaatccagaatggttcttttaaggaggcactcaatgtgatcaatacccatacaaaagttctggccaacaacagtctctcttttgagaaagcctattgtgaataccgcctcaacaggatcgaaaatgcccttaagacaattgagtccgcaaatcagcaaacagacaaactcaaggagctgtatgggcaggtactctatcgacttgaacggtatgatgagtgcttagcagtataccgggatctagttaggaatagtcaagatgactacgacgaggagcggaagaccaatctcagcgccgtcgtggcagcacaatctaactgggagaaggtggtgcccgagaatctggggctgcaggagggaactcatgagctttgctacaacaccgcctgtgcattgatcgggcagggccaactcaatcaagcgatgaagatccttcaaaaggccgaagacctgtgtcgcagatccctgtcagaagataccgaccagaatgtgttcgactccaagaaaaaagttaaactgaccaatgccgagggtgtagagtttaagctttctaagaagcaactgcaggctattgaatttaataaagccctgctggccatgtacaccaatcaggcggagcagtgtaggaagatctctgccagtcttcagtcccagtcccccgaacacctcctgccagtgctgatacaagcagctcaactgtgtcgcgagaaacagcacacgaaggcaatcgagctcctccaggagttttcagatcagcaccctgaaaacgccgcagaaatcaagctaactatggcccaactgaagatcagtcagggaaacatcagcaaggcatgcctcatcttacgttccatagaagaactgaagcataagccaggtatggtcagtgctcttgttacaatgtactcacacgaagaagatatcgatagcgctattgaagtgtttacacaggccattcagtggtatcagaaccaccagccaaagtctccggctcatctgagtttgatcagagaagcagcgaacttcaagcttaaatacggcagaaaaaaggaagccatttcagacctgcagcagctgtggaaacagaaccccaaggacatccacactcttgcccagctcatttcagcctatagtctcgtggaccctgaaaaggccaaggctttgtctaaacacctgccttcatctgacagcatgtccctgaaagtcgacgttgaagcgctggaaaactccgcaggagcaacttacattagaaagaagggagggaaggtcaccggggattcgcagcccaaggaacaaggacagggggatctgaaaaagaagaagaagaagaagaaaggtaaactgcccaagaattacgatccaaaggtgacacccgatcccgagcggtggctgccaatgcgagaaagaagctattataggggacggaaaaaggggaaaaagaaggatcagattggcaaaggcacccagggagccactgctggagcttcgagtgaattggacgctagcaagacagtttcaagccctcccactcaagacctagccgtactgcagcagtatctgcctctgcaggtcacttcttacccccaggatacaaggaaccttcaggggctgcaacagcagaaacggaacagcaataggaaaaggcgaaaagtcgagaaggtggctggtgacgaaaatatcctggtagcgggttgcttttag

SEQ ID NO: 240555 - DNA, 1833 bp, Artificial Sequence
  Description of Artificial Sequence: Synthetic coding sequence
atggcctcagggggaagcggcggagtgtctgtcccagcactgtggtctgaggtaaatcgctacggtcagaatggggacttcacacgcgctctgaagaccgtgaacaaaatcctacagatcaacaaggacgacgtcacagccctgcactgtaaggtggtgtgtctgatacagaacggtagcttcaaagaggccctgaatgtgatcaacacgcacaccaaggtcctcgctaataactccctgagtttcgagaaggcttactgcgagtacaggctgaataggatcgagaatgctttaaagactatcgaatcagctaaccagcagactgataaacttaaagaactttacggccaggtgctgtaccgactcgaacgatatgacgaatgccttgccgtgtaccgcgacctggtgagaaactcacaggatgactatgatgaagaacggaagaccaacctgagcgccgttgtcgctgcccagtccaattgggagaaagtggtaccagagaacttagggctgcaggaaggcacacacgagctctgctacaatacggcctgcgctctaattggacagggacagctgaaccaggcgatgaaaatactccagaaggcagaggacctgtgtcgccgaagcctatccgaggacaccgaccagaatgtatttgactctaaaaaaaaggtgaaacttacaaacgccgaaggtgttgaattcaagctctctaagaagcaacttcaagccatcgagttcaacaaagctcttctggccatgtacacgaatcaggcggagcagtgtcggaagattagcgcctcactgcagtcacagtctccggaacatctgctgccagtgctcattcaagcagctcagttatgtagagagaagcagcacaccaaggctatagaactgctccaggagtttagtgaccagcatccagagaacgctgccgagatcaaactcactatggcacaattgaagattagccaggggaacataagcaaggcttgcttgatcctacgctccattgaagagctaaaacacaaacccggaatggtcagtgctctggtgaccatgtattctcatgaggaagacatcgactccgcaattgaagtgtttacacaggccattcagtggtaccaaaatcaccagccaaaaagtccagctcacctcagcctgattagagaggcagcaaacttcaaactgaaatacgggagaaagaaggaggccatcagcgacttgcagcaactctggaagcagaatcccaaagacatccatactctagcacagttaatttcggcctattcacttgtggatcccgaaaaggctaaagccctctctaaacacttaccaagctccgattctatgtctctgaaggttgatgtcgaagctctggaaaactccgcgggtgccacttacatacgaaagaagggcggtaaagtaaccggggactcccagcctaaggagcaagggcaaggagacctaaagaagaagaagaagaagaaaaaagggaagctgccaaagaattatgatccgaaggtcacccccgatcccgaacgctggttacccatgcgtgaacgaagctattatcggggacgtaaaaagggtaagaaaaaagatcagataggaaagggcacgcagggagccacggcgggtgcttcaagtgagctcgacgcatctaagactgtgtctagcccccctacaagcccgcgacctggcagcgcagcgactgtctccgccagcacttccaacatcattcccccacgccaccagaagcctgcaggtgccccagccaccaagaagaagcagcaacagaaaaagaagaagggcggtaagggcggttggtag

SEQ ID NO: 240556 - DNA, 1917 bp, Artificial Sequence
  Description of Artificial Sequence: Synthetic coding sequence
atgttagactttttcactatattcagtaagggaggccttgtgctgtggtgttttcagggcgtgagcgattcttgcacaggcccagtcaacgcacttatacgctccgtcctcctgcaggaaagaggcggtaataattctttcacccacgaagcactaaccttgaagtacaaacttgacaaccagttcgagctagtcttcgtggtgggatttcagaaaattctgaccctaacctacgtagataaattaatagacgacgttcatcgcttatttcgcgacaagtaccgcaccgagatacagcagcagagcgctctgagtctgctcaacggaacgttcgacttccagaacgatttcttgcgcctgctgcgggaagctgaagaaagctccaaaattcgtgcccctactactatgaaaaagtttgaggatagcgaaaaggctaaaaaacctgtgcgatccatgatcgagacacgcggtgagaagccaaaggagaaggctaaaaacagcaaaaagaagggcgcaaagaaggaaggctcagacggcccactcgctacaagcaaaccagtacctgcagagaagtccgggctgccggtgggcccagaaaatggggtggagctgtctaaagaagaactgatacgtagaaagagggaagaatttattcagaagcatggaagaggcatggaaaagagcaacaaatccacaaagagcgacgcccctaaggaaaaaggaaaaaaggcccctagagtgtgggagctcgggggatgtgctaacaaagaagtgttagactactccacgccaaccacaaatggcacacctgaggcagccctgtctgaggatataaatttgatcagagggacaggtagcgggggtcagctgcaggacctagactgtagttcaagcgacgacgagggcgctgcacagaattctactaaaccaagtgcgactaagggcaccctcggtgggatgtttggtatgctgaaagggcttgtcggctccaagagcctgtcgcgggaagacatggagtctgtgcttgacaaaatgcgtgaccatcttattgccaagaacgttgcagcagatattgccgtccaattgtgcgagtctgttgctaacaaactggaaggcaaggtaatggggaccttttccacagtgacatctaccgtgaagcaagctttgcaagaaagcctggtccagatacttcaaccgcaacgccgagtagatatgttaagagacattatggatgcccagagaaggcagcgcccttatgtcgtgaccttctgtggagtaaacggtgtcggaaagtctaccaatctggccaagatctccttttggctgctcgaaaacggcttctctgtgctcatagctgcatgtgacacattccgcgctggcgcagttgaacaactgcgcacacacacaaggcgcctatctgccctgcacccacctgaaaaacacgggggacgcactatggttcagctcttcgagaaaggctatgggaaggacgcagccggaattgctatggaggcaatagctttcgcaagaaaccagggttttgatgtggtgctggtggataccgcgggtaggatgcaggataatgctccgctgatgactgccttggcgaagctgatcaccgtcaacaccccggacttggttctgttcgtgggagaggccctggtgggcaacgaggccgtcgaccagcttgtgaagttcaatcgagcattggcggaccactcaatggcccagaccccgaggctgatagatggcatcgttctcactaaatttgataccattgacgataaagtgggtgcagccatcagcatgacatacatcacatccaaacccattgtgtttgtcggaactggacagacgtattgcgacctgaggagcctgaacgccaaggctgtggtggctgccttgatgaaggcatag

SEQ ID NO: 240557 - DNA, 552 bp, Artificial Sequence
  Description of Artificial Sequence: Synthetic coding sequence
atgcgtctgttaagttttgtggtcctagctctgtttgcagtcactcaggccgaggaaggtgcgagacttttagcaagcaagtcgctgctgaacagatacgccgtggagggacgggatttgaccctgcagtacaacatctacaatgttggctctagtgctgcgctggatgttgaactgagcgacgatagctttccgcctgaggattttggcatagtgtccggaatgctgaatgtgaagtgggatagaatagccccagccagtaacgtgtcacacactgtggtacttcgacccctaaaagcagggtatttcaactttacaagtgcaacgattacatacctggctcaggaagacgggccagtcgtcatcggttctacgtctgctcctggccaggggggaattctggcccagcgggagttcgatcgaaggttcagcccgcattttctggactgggctgcattcggggtcatgacactgcctagtatcggaatccctctgctactttggtattcctcaaaacggaagtacgatacccctaagactaaaaagaattag

SEQ ID NO: 240558 - DNA, 552 bp, Artificial Sequence
  Description of Artificial Sequence: Synthetic coding sequence
atgagactgctgagctttgtcgtcctcgcgttgttcgctgtgactcaagctgaggagggcgctcggttattagcctccaagagccttctcaaccgctatgccgttgagggtcgcgacttgactctgcaatacaacatatataacgtgggctcctcagcggctctggatgtagagttgtcagacgatagcttcccacctgaggatttcggcattgtgagtgggatgctgaacgttaagtgggacagaatagccccagctagtaatgtctcccacaccgtagtccttagacctcttaaggcgggttactttaacttcacatccgcgaccatcacatatctcgcacaagaagacggccctgttgtgatcggttctactagcgcaccaggacaggggggaattcttgcccaaagggagttcgatcggagattctcccctcacttcctggattgggcggcttttggcgtgatgactctgcctagcattggcatccccctccttctgtggtacagctccaaaagaaaatatgacaccccaaaaaccaagaagaactag

SEQ ID NO: 240559 - DNA, 258 bp, Artificial Sequence
  Description of Artificial Sequence: Synthetic coding sequence
atgaggctgttgtcttttgtggttctggctctgtttgctgtcacacaggccgaggaaggggctaggctcctcgctagtaaatccctattaaacagatatgccgtggaaggacgggatctgacacttcagtacaacatctacaacgttggaagctctgctgcattagacgtggagttgtccgacgacagcttcccgccagaggattttggaatcgtgtccggaatgcttaacgtcaaatgggacagaatagccccttag

SEQ ID NO: 240560 - DNA, 444 bp, Artificial Sequence
  Description of Artificial Sequence: Synthetic coding sequence
atgcggctgctttccttcgtggtgctagcactatttgccgttacacaagctgaggagggagccagattgctggcatccaagtctcttctgaatcggtacgccgtggagggacgggatctaactctccagtacaatatctataatgtgggctcttccgctgcattggacgtggagctttctgacgactcttttccacctgaggacttcgggattgtttccggtatgctcaacgtgaaatgggaccgcatagcgcctgcctcaaatgtgagccatactgtcgtgctgcgccctctgaaagctggctattttaacttcacctccgctacgattacatatctagcccaagaggacggaccagttgtgattggcagcacatccgctcccggtcagggtggtatcctggctcagcgcgaattcgatcggaggttcagccctcatttctag

SEQ ID NO: 240561 - DNA, 522 bp, Artificial Sequence
  Description of Artificial Sequence: Synthetic coding sequence
atggccgcaatggcctccttaggcgctctggcactgcttctcctgtcaagtctgtccagatgcagcgctgaggcttgcctggagccacaaattaccccctcctattataccaccagtgacgcagtgatttccaccgaaactgtgtttatcgtcgaaatttcgctgacttgcaagaaccgcgtgcagaacatggcactctacgctgacgtgggcggaaagcagttccccgttacccgcggacaagatgtgggtaggtaccaggttagctggagccttgatcataagtcagcacacgcaggcacgtacgaggtcagattcttcgacgaagaaagttactcgctgctgcgcaaggctcagcgaaataacgaagatatttctatcatcccccctctgttcacagtaagtgtggaccaccggggtacttggaatggtccctgggtatctacagaggttcttgcggcagctatcggattggtgatttactacttggcattctcagcaaaatcacatatccaagcctag

SEQ ID NO: 240562 - DNA, 447 bp, Artificial Sequence
  Description of Artificial Sequence: Synthetic coding sequence
atggcggctatggcatcccttggagctctggcactgctgttactgagcagtctgtctcgctgttcagccgaagcctgtctggaacctcagatcacaccaagttattacaccaccagtgacgctgtgatctccacagaaaccgtgtttatagtggaaataagccttacttgtaaaaacagagtgcaggtgagctggagcctggaccacaagtctgctcacgcgggaacgtacgaagtgcggttcttcgatgaagaatcgtactccttgcttcgaaaggcccaacgaaataatgaagacatctccatcatacctccacttttcactgtaagcgtggaccatcggggaacctggaacggaccgtgggtgtcaacagaagtgctggcggcagccattgggctagtgatttactatctggcgttttctgcaaagtcacatatacaggcttag

SEQ ID NO: 240563 - DNA, 522 bp, Artificial Sequence
  Description of Artificial Sequence: Synthetic coding sequence
atggccgcaatggcctctctcggtgccttggcgctcctgttgttgtccagtttatccaggtgttctgctgaggcctgtcttgagccacagatcaccccaagttactataccacttcagatgcagtcatatccacagagaccgttttcattgtagaaatcagccttacgtgcaagaatagggtccagaatatggccctctatgccgatgtgggtggcaagcagttccccgtgacccggggtcaggatgtgggaaggtaccaggtttcctggagcctggatcacaaatccgctcatgcaggcacatacgaggttcggttctttgatgaggagagctactctctgctccgaaaagcccagcgcaacaatgaggacatctctataatccctcccttgttcacagtgtcagtggaccacagagggacatggaacggtccttgggtgtccacggaggtgctggccgctgccatcggactggtgatctactatctggctttcagtgctaagagccacatccaggcatag

SEQ ID NO: 240564 - DNA, 522 bp, Artificial Sequence
  Description of Artificial Sequence: Synthetic coding sequence
atggcagccatggcatccctgggagcactggcgttactcctcctttcatctctctcaaggtgttcagctgaggcatgtctagagccacaaattacccctagctactacaccaccagtgatgctgtaatatcaaccgagacagtctttatcgtggagatttcgcttacatgcaagaaccgcgtgcagaacatggcgctgtacgccgacgtaggaggaaagcagttcccagtgactcgaggtcaggatgtcggcaggtatcaagtgtcctggagtctggatcacaagagcgcacatgctggcacgtatgaggtacggtttttcgacgaggaatcttatagcctgctcaggaaagcccagcggaataacgaagatatcagtattattcctccattgtttactgtgtcagtggatcatcgtggaacttggaacggaccgtgggtgagtactgaagtacttgcagccgcaattggccttgttatctactatctggctttttctgcgaaatcacatattcaagcctag

SEQ ID NO: 240565 - DNA, 363 bp, Artificial Sequence
  Description of Artificial Sequence: Synthetic coding sequence
tgagtgggctctgggtgtagaagcgccgctgtgtctgcactggttgtgagagtggcacccccttgtccactatgtcctcactctgcccagcacccaacccaggtgtcttggagcttggatcacaaaagcgcccacgctgggacatatgaggtcagattcttcgacgaggagagctactcccttttacgaaaggcacaacgaaataacgaagatatctctataatccctccattattcacagtctcagtggatcacagaggcacatggaacggaccatgggtgagcactgaggtcctcgccgctgctataggtctcgtcatatactatctcgcctttagcgctaagtcccatattcaggcttag

SEQ ID NO: 240566 - DNA, 2544 bp, Artificial Sequence
  Description of Artificial Sequence: Synthetic coding sequence
atgagtttgtggggtctggtgtccaagatgccccctgaaaaggtgcagagattgtacgtcgattttccgcagcatctgcgacatctgctgggcgactggctggaaagtcagccttgggagttcctggtcggctcggatgcgttctgctgcaatcttgcatccgccctactctctgatactgtgcaacacttgcaggcctccgtgggcgagcagggggaaggaagtacgatcctgcagcacatttccaccttggagtccatctaccaaagagatcctttaaagctcgtggctacattcaggcaaatcttgcagggggagaagaaggcagtgatggaacagttccggcatctgcccatgccatttcactggaaacaggaagagctgaagttcaaaactggactgcggagactccagcatcgtgtgggggagatccacctgctaagagaagctctgcagaagggcgcagaggctggtcaggtatccttacattctttgatagaaactcctgcgaacggtaccggacccagtgaggctctggcaatgcttctccaggaaaccactggtgaacttgaagctgcaaaggcccttgtcctgaaacggatccagatctggaagaggcagcaacagttggcaggcaacggcgcaccatttgaagagagcctggcacccttacaagaacgatgcgaaagcctggtcgatatatatagccagctgcagcaggaggttggtgccgctggcggagaactggagcccaagaccagagccagtcttaccgggaggctcgacgaagtgctgcgaactttagttacttcatgctttctggttgagaagcaacctccccaggtattgaagacgcagacaaaatttcaagctggcgtaagattcctgctcggcttaaggtttctgggcgcacctgcaaagccaccgcttgtgcgggcagacatggtcactgaaaagcaggccagagagctctccgtgccacagggcccaggagccggtgcagagagtaccggagaaattatcaacaataccgtgcccttggaaaactccatcccaggaaattgctgtagtgcgttgtttaaaaatctcctactgaagaagatcaaacggtgcgagaggaaaggcacagagtctgttaccgaggaaaaatgtgcagtgctgttcagtgcctcatttactttaggacccggaaagttgccaatccaattacaagctctcagcctgccactggtggtaatagtccatggcaatcaggataacaatgccaaggcaacaattctttgggacaacgctttttctgagatggatcgggtgccattcgtagtagcagaaagagtcccatgggagaagatgtgtgaaacgctgaacctgaaatttatggctgaagtgggaaccaatcgcggactgcttcccgagcatttcctgtttctcgcccagaaaatctttaatgacaactccctcagtatggaggctttccaacatcgaagcgtgtcatggtcccagtttaacaaggagattctcctggggcgtggcttcacgttctggcagtggtttgatggagtgctggatctgactaagcgctgcctcagatcctactggagtgataggttgataattggatttatcagcaagcagtacgttacgagcctgctgttgaatgaacccgatggtacctttctgctacgtttttcagatagcgagatagggggaattacaattgctcacgtcatccggggacaggatggatctccccaaattgagaatatccagcctttcagcgccaaggacctatctatccgctccctcggggaccgcataagggacctggcgcagctcaaaaacctgtatccgaaaaagccaaaggacgaagctttccggtcacattacaaaccagaacaaatgggcaaggacggcagggggtatgtgcctgcaactatcaagatgaccgtagagcgtgaccagccactcccgacaccggaactgcagatgcccaccatggtgccttcttacgacctcggaatggctcctgattcctccatgtctatgcagctgggcccagacatggtgcctcaggtgtaccccccacacagccacagcatccccccttatcagggtctgagtcccgaggagtcggtcaatgtgttgtctgcgttccaggaaccccaccttcagatgccaccatccctgggccagatgagtctaccatttgatcagccacatcctcagggactcctgccctgtcagcctcaggagcacgctgtctcctccccggaccccttattgtgcagcgatgtgaccatggtggaggactcctgtctgagtcaaccagtgaccgcgtttcctcagggcacatggatcggggaggacattttccccccactcttgcccccaacagaacaggaccttaccaaacttctgctggaaggtcagggggagagcggagggggatctctcggagcacagcccctgctccagcctagtcactatggccaatctgggatctccatgagccacatggacctgcgtgcaaaccccagctggtag

SEQ ID NO: 240567 - DNA, 2544 bp, Artificial Sequence
  Description of Artificial Sequence: Synthetic coding sequence
atgtcactgtgggggctggtcagcaagatgccccctgagaaagtgcagaggctgtacgtcgattttccacaacacctgcgccatctattaggtgactggttggagtcacaaccgtgggagtttctcgtaggctccgacgccttttgttgtaacctcgcctcagcattgttgtctgacacagtgcaacatcttcaggcgtcggtgggcgagcagggcgaagggtcgactatcttgcagcatatttctacccttgagtccatttaccagagggatcctctgaaacttgtggcaacattccggcagatcctgcagggagagaagaaggccgtaatggaacaatttagacacctgcctatgccgttccattggaagcaggaggaactgaaattcaaaactgggctacgcagactccagcaccgagttggcgaaatccatcttctgagggaggctctgcagaaaggggcagaggccggtcaggtgtcattacattcacttatcgagacccccgctaatggcacaggaccctccgaggccttggctatgttgctgcaagaaacgactggagaactggaggctgctaaggccctggtactcaagcgaatccaaatttggaaacggcagcagcaactcgctggtaatggtgcaccttttgaggagtccctggccccactacaggagaggtgcgagagcctggttgacatctattcgcagcttcagcaggaggtcggggcagctggtggcgaactggagcccaagacccgggctagcctcaccgggagacttgatgaggttctgcggactctggtaacaagctgctttctagttgagaaacagcctccacaagtacttaaaacgcagaccaaattccaggctggcgtgaggttcctgctggggttgagatttcttggcgcacctgcaaaaccccctctggtccgggcagacatggtaacagaaaagcaagctagggagttgagtgtgccccagggcccaggtgcgggtgccgaatcaactggagagattatcaacaacacggttcccctggaaaactccattcccggaaactgttgcagtgccctttttaagaatctcctgctcaaaaaaatcaagcgttgcgagcggaagggaaccgaatccgtcacagaggagaagtgtgctgtgctgttcagtgcttcatttactctcggaccaggcaaactacctattcaactgcaggcattgtccctgcctctagttgtgatcgttcatggaaatcaggacaataatgctaaggctaccattctctgggacaatgcgttcagcgagatggaccgagtgccattcgtggtggccgaaagggtgccttgggaaaagatgtgcgaaacgctgaatctcaagttcatggccgaagtcggaactaaccggggactgctgcctgagcacttcctgttcttagcccagaagatttttaacgacaattctttgagcatggaggccttccagcaccgatctgtcagctggtcccagttcaacaaagagattctgctcggccgaggcttcactttttggcagtggtttgatggcgtgttggacttgaccaaacggtgtttgaggtcctattggagcgaccggctcattatcggatttatttccaaacagtacgtcacttcactgctgctgaacgaaccggacggcacattcttgctgaggtttagcgacagcgagatagggggaatcacaattgctcatgtcattagaggccaagatggaagtccccagattgaaaacatccaaccatttagcgccaaagatttgagcattcgatctttaggtgacaggatcagggatcttgcacagctaaagaatctataccccaagaagcccaaggatgaggcgtttcggtcgcactataagcctgagcagatgggcaaagatggaagagggtacgtaccagctaccattaagatgacagtggaaagagaccagcccctgcctactccagaactgcagatgcctactatggtccccagttatgatttgggaatggctcccgattcttcgatgtcaatgcagctcggtcctgatatggtccctcaggtttaccctcctcattctcacagcattcccccttaccaagggctgagtccggaggagtctgtgaacgtattgagtgcctttcaagaaccgcatcttcagatgcctccgagcctaggccagatgtcccttccctttgaccaaccccacccgcagggtctgctgccttgccaaccacaggaacatgccgttagctcccctgaccctctgctgtgttctgacgtcaccatggttgaagattcttgcctgtcacaaccggtaactgctttcccccaggggacctggatcggtgaggacatcttccctcctttgttgccacccactgaacaggacctgaccaaactgcttttagagggccagggggagtccggaggtggaagtcttggagctcagccgctgctgcaaccatcccactatgggcagtccggaattagcatgtcccacatggaccttcgtgcgaatcccagttggtag

SEQ ID NO: 240568 - DNA, 2214 bp, Artificial Sequence
  Description of Artificial Sequence: Synthetic coding sequence
atggagcaattccgtcacctgcccatgccctttcattggaagcaggaggagctcaaattcaagaccggcctgcgccgactgcagcaccgcgtaggcgaaatccatctgctcagggaagcattacaaaaaggcgctgaggctgggcaggtcagtctccattctctaattgagaccccagccaatggcactggcccttccgaggcactcgccatgctactgcaggaaaccactggggagctggaggccgctaaagccctggtgttgaagagaattcagatctggaagaggcaacagcagctcgccggtaatggcgcaccatttgaagagagcctggcgccactccaagagagatgcgagtcactagtggacatttactctcagctacagcaggaggttggtgccgctggcggtgaactggagccaaaaacacgcgctagtttgactggtagacttgacgaagtcctgcgcaccctcgtgacatcctgttttctcgtcgaaaagcagccgccacaggttttgaagactcagaccaagttccaggcaggcgtaagatttctgctgggcttaagattcctcggggctccggctaagccacctctggtcagagctgacatggtcacagaaaaacaggcaagggagcttagcgtgccacaaggccctggggcaggagcagagtctaccggagagatcatcaataataccgtccccctggaaaattccataccagggaattgctgttcagctctcttcaaaaacttactgctgaaaaagataaagcgctgcgaacggaaaggtaccgaatctgtgaccgaggagaagtgcgctgtattattcagtgccagttttacactcgggcctggcaaactgcccatacagctgcaggccttaagcctccccctggtggtgatagtgcatggtaaccaggataataacgctaaagccaccattctctgggataatgcctttagtgaaatggacagggtgcccttcgtggttgctgaacgcgtgccttgggaaaaaatgtgcgaaacactcaacctcaagttcatggccgaggtgggcaccaatagagggcttctccctgaacatttcctctttctggcacagaagatcttcaacgataactcactcagtatggaagccttccagcaccgatccgtgtcatggagccagttcaacaaggaaattctcctaggccgtgggtttaccttctggcagtggttcgatggggtattggatctgacaaaacgctgcctgcgcagctattggagtgataggttgattattggatttatttccaaacagtacgtgaccagcctacttctgaatgaacccgatggtacatttttgcttcgattcagtgacagtgagatcggcggtatcactatagcgcatgtgatacggggacaggatgggtccccgcagatagagaatatacagccattttcagccaaagatctctctataaggtcattaggagatcgaattcgagatttggcccagttgaaaaatctctacccgaagaagcccaaggacgaagcgtttaggtcacactacaagcccgagcagatggggaaagacggcaggggctatgtgcctgccaccataaagatgacagtggaacgagaccagccattgcccactcccgagctgcaaatgcccaccatggttccctcatatgacctcggaatggcccctgatagttccatgtccatgcaacttgggccagacatggtaccacaggtgtacccgccacattctcacagtattcccccatatcagggcttgagcccagaggaatccgttaatgtgctgtcagcctttcaagaaccccaccttcagatgccaccgagcttaggtcagatgtcactgcccttcgaccagccacaccctcaaggacttctcccgtgccagccccaggaacacgcggtgtcttcacctgaccctctgctgtgttcagacgtgactatggtggaggacagttgcttgtcccagccagtaaccgcgttcccccagggcacttggataggcgaggacatattccctcctctgctgccacccacagaacaggatctcactaaactccttctagaggggcagggggaatccggaggcggttccctgggcgctcagcccctgctgcagccaagccattacggtcagtctgggatttctatgtctcacatggatctgcgggcaaacccttcctggtag

SEQ ID NO: 240569 - DNA, 2214 bp, Artificial Sequence
  Description of Artificial Sequence: Synthetic coding sequence
atggaacagttccgacaccttccaatgcccttccactggaagcaagaagagctgaaatttaagaccgggctccgcaggctgcagcatagagtaggagagattcatcttctgagggaggcgctgcagaagggtgccgaagcaggtcaggtcagcttgcattccctgatcgagacccccgcaaacggaaccggcccttctgaagcgctggccatgctactccaggagaccacaggtgaactggaagccgcaaaggccctcgttttaaagcggattcagatttggaaaaggcagcagcagctcgcaggaaacggcgcaccctttgaggaatctctggcaccactgcaagagcggtgcgagagcctagtggatatctatagccagctccaacaggaggtaggcgctgcaggaggcgagctagagccaaagacccgagccagtctcactgggaggctagacgaggttcttaggactctcgtgacttcatgttttttagtggagaaacagccgccacaggtgctgaaaacccagacaaaatttcaagcaggcgtcagatttttactgggcctccggtttctcggggcacccgctaagcctccgctcgtgcgggcagatatggtgactgaaaaacaggctagagaactgtctgtcccgcagggcccaggggcaggagctgaaagcactggcgagataattaataacacagtgccactagagaactccatcccaggcaactgctgtagcgcactgttcaagaatctcctcctgaagaagattaagcgttgtgaacgaaagggaacagaatccgtgacagaggagaagtgcgccgtgctgttctccgccagcttcacactgggcccagggaagctccctattcagctccaggccctgagtcttccattggtggttatcgtacacggcaaccaggataacaacgcgaaggcaacaattttatgggacaatgcttttagtgagatggaccgggtgccttttgtagtcgctgaaagagtgccatgggaaaaaatgtgtgaaacactcaacctgaaattcatggcagaggtgggaacgaatcgcggtttgctgccggaacactttctcttcctggctcagaaaatttttaacgacaattcgctctctatggaggctttccagcataggagtgtctcgtggagtcagtttaataaggagattttactgggacggggttttactttctggcagtggtttgatggggtgctcgacctcaccaaaaggtgcctgaggagctactggagcgataggctgatcatcggtttcatctccaaacagtacgtaacatctctccttctaaacgaacccgatggcacctttctgctgcgattctccgactctgaaatcggcggaataacgatagctcatgttatccgcggacaggatggttctccccaaatagagaacatccaacctttcagcgccaaggacctctctattcgctcattgggggacagaattcgggatctggctcagttgaaaaacctgtatcccaagaaaccaaaagatgaagcttttaggtcccactataagcccgagcagatggggaaagacggacgcggatacgtgccagctacaatcaagatgacggttgaacgggatcagcccctgccaactccagagctgcagatgccaaccatggtgccgagttacgacctcggaatggcaccagatagctctatgtccatgcagctcggcccagacatggtcccacaggtttatcctccacactcccacagtatcccgccttaccagggtctctccccagaagagagtgtaaatgtactgagtgcattccaggagccgcacctccagatgccccctagccttgggcagatgagcctgccttttgatcagccacatccacaaggtcttctcccatgccagccgcaggaacatgcagtttcatcccctgacccgctgttgtgtagtgacgtaaccatggtagaggattcgtgcctgagccagcctgtcaccgcattcccccagggcacttggatcggcgaggacatcttcccaccacttctacccccaactgaacaggacctgacaaaactgctactggagggacagggagaatccgggggaggatccttgggcgctcagcctctgcttcagccatctcactacggccaaagcggaataagcatgtcccacatggatctgcgggctaacccgagttggtag

SEQ ID NO: 240570 - DNA, 2214 bp, Artificial Sequence
  Description of Artificial Sequence: Synthetic coding sequence
atggaacagttcaggcatcttcctatgccctttcactggaaacaggaggaattaaagtttaagacagggttacgcaggctgcaacatcgagttggggagatccacctgctgcgagaggccttgcagaaaggagcagaggctggccaggtttccctgcactccttgattgagacacccgcaaatgggaccggacccagcgaggcactggcaatgctgctccaggagaccaccggggagctagaggccgcaaaggcccttgtgctgaagcggatccagatctggaaaaggcagcaacagctcgccggaaatggggctccctttgaggagtctttggctcccttgcaggaacgatgcgaatccctcgtggatatttactcacagctgcagcaggaggttggtgccgctggcggagagctggagccaaagacaagggcttccctaaccggtagattggacgaggtgctcaggacattagtaacctcatgtttccttgtagagaaacagccaccccaggttctgaagactcagactaagtttcaggccggtgtgagatttttactcggcttgagattcctaggagcgccagcaaaaccacctctcgtgcgcgctgacatggttacggagaagcaagcaagagaactgagcgtccctcagggacccggagccggagctgagagcactggggaaataattaataatacagtgccccttgaaaatagcatcccaggcaattgctgtagcgccttgtttaagaatcttctgctgaagaagattaagcgctgcgagcgcaaagggaccgagtcagtgactgaagaaaagtgtgccgtactgttctccgcttccttcacccttggccctgggaagctgcctattcaattgcaggccctcagcctgcctttggtcgtgatcgtgcatggtaaccaggataacaatgctaaagccaccattctgtgggacaacgcattcagcgaaatggaccgcgtgccctttgtcgtggccgaaagggtgccctgggagaaaatgtgtgagactctgaacttaaaattcatggctgaagtaggaaccaacaggggcctgttgccagagcacttcttatttcttgcacagaagatctttaacgacaattccctgtccatggaggcctttcagcacaggagcgtgtcctggagtcagtttaataaagagatcttgctaggccgaggattcacattctggcagtggtttgacggagtgttggacctgacaaagaggtgcctgcggagctattggtcggaccgactaattattggatttatatcaaaacagtatgtgactagtctcctactaaacgaaccggacgggactttcctcctaagattttcggatagtgagattggcggaattaccatagcccacgtgatcaggggacaggacggctctcctcaaattgaaaacattcaaccatttagtgctaaggatttgtctattagaagcctcggggatcggattcgcgatctcgctcagctgaaaaacctctacccgaagaagcccaaagacgaggcctttcgctcacactataagcctgagcaaatgggaaaggacggccgtgggtacgtgcccgcaactatcaaaatgacggttgagcgggaccaaccactaccaactcccgaattacagatgccaaccatggtgccttcctacgacctggggatggccccagattcatcaatgagtatgcagctggggcctgacatggtgccccaagtctaccccccacactcacactcaatccccccttaccagggcctgtctccagaggaaagcgtcaatgtactgagtgccttccaggagccccacttgcagatgcctccgagtctggggcagatgtccttgccattcgatcaacctcatcctcagggactgctcccgtgccagccccaggaacacgctgtgtcaagtcctgacccgctactgtgctcagacgtgacaatggtcgaggattcttgcctttctcagcccgtcacagccttccctcagggaacatggatcggtgaagacatttttcctcccctgctccctcccactgagcaagatctgacaaagctcttgttggaaggacagggtgagtctgggggagggtccctgggggcacagcctctgctgcagccctctcactatgggcagtccgggatttcaatgagccatatggaccttcgagccaacccatcctggtag

SEQ ID NO: 240571 - DNA, 2040 bp, Artificial Sequence
  Description of Artificial Sequence: Synthetic coding sequence
atgtcactgtgggggctcgtgagcaaaatgccccctgagaaggtccagcggctctacgttgatttccctcaacacctgaggcacctgttgggcgactggttggagagccagccttgggaattcctggtgggttcagacgctttctgctgcaacctcgcaagcgctcttctgagtgacactgtccagcatctccaagcatctgtgggggaacagggagagggtagcacaattttacagcatattagcactctagaatcaatctaccagcgagaccctctgaagctcgtggcaaccttcagacagatcctgcagggagaaaagaaagcagttatggagcagttccgccacctgcccatgcccttccactggaagcaggaggagctcaagttcaagactggtttgaggcgccttcagcatcgagtaggcgagatccacttactccgcgaagctctacagaagggtgcagaagcagggcaggtatccttgcactcactgatcgagacacccgcaaacggtaccggtccgagtgaggccctagctatgcttctccaggagaccaccggagagctcgaagcggcaaaagccctcgttctcaaaaggatccagatctggaaacgacagcagcagctggccggaaacggcgcaccattcgaggagagtttggcacccttacaggaacgttgtgagtctcttgtagatatttacagccaactccaacaagaggttggcgcagccggtggtgagctcgagcctaagacacgggctagcctgacagggaggctagatgaggtgttacgcacattagtgacatcttgttttctggtggagaagcagccccctcaggtcttaaaaactcaaactaaattccaggcaggagtgagatttctgttaggtctccgatttctgggagcaccggcaaaaccacccctggtgcgcgcagacatggtcacagagaagcaggccagggagctgtccgtgccccagggtcccggtgccggagctgagagcacgggcgagatcataaacaataccgtccccctggaaaatagcattccaggcaattgctgttccgcactgttcaagaacctgttgttaaaaaaaattaagagatgcgagagaaaaggtacagaaagtgtgacagaggagaagtgcgccgtgctgttcagcgccagtttcacactcgggccaggaaaattgccaattcaactgcaagccctctccctgcccttggtagtaatcgtgcatggaaaccaggacaacaatgctaaagctactattctctgggataatgcttttagtgaaatggaccgagtgccatttgtcgtggctgagcgtgttccctgggaaaagatgtgcgagacactgaaccttaagttcatggccgaagtgggtacaaaccggggtctgctcccagagcactttctttttctcgcacagaagatcttcaacgacaactctctgtctatggaggcatttcagcacagaagcgtttcctggtcccaatttaacaaagagatactgctgggcagaggattcactttctggcaatggttcgatggtgtgctcgatctgactaaacgatgcctgcggtcatactggtctgacagactgataattggctttatcagtaagcagtacgtaacgagcctgctattaaacgagcccgacggtacattcctgctgcggttttcagactcggaaatcggaggtataacaattgcccacgttattcggggacaggatggctcaccccagatcgagaacatacagcctttttctgctaaagacctctcaattcgaagtctgggcgaccgtatcagggacttggcgcaactgaagaatctgtatcctaaaaaaccaaaagacgaggcttttcgatctcactacaaacctgaacagatgggcaaggacggtagagggtacgtgcccgcaacaatcaaaatgacggtcgagcgtgatcagccgttgcctacgcctgagttgcaaatgcccaccatggtaccctcttacgatcttgggatggccctcattcccccatag

SEQ ID NO: 240572 - DNA, 2193 bp, Artificial Sequence
  Description of Artificial Sequence: Synthetic coding sequence
atggagcagtttcggcatctgcccatgccctttcactggaaacaggaagaactgaagttcaagacagggctgaggcgattgcagcatagggttggggagattcatcttctgagagaggccttgcagaagggggcagaagccggtcaggtttctctgcacagccttattgagacccctgcaaacggcactggaccctccgaagctttggctatgcttctgcaggaaactacgggagaactggaggccgctaaagccctcgtcttaaagaggatccagatctggaagaggcagcagcagctggccggaaacggggcaccgttcgaggagtcccttgctccccttcaggaacgctgcgaatccctcgtcgacatctactcccagctccagcaggaagtaggggctgctggtggagagctggagcctaagaccagagcctcccttacgggaagactggacgaggtcctgcgaaccctggtgactagctgtttcctggtggagaagcagccccctcaggtgctcaaaacccagaccaaattccaggcaggagtaagatttctcttgggcctgaggtttcttggtgcccctgctaagcccccactcgtccgggctgacatggtgacagagaagcaggcgagagagctttctgtaccacagggtcccggagctggtgccgagtcaaccggtgagattataaataacactgttcccctcgaaaatagtatccctggcaattgttgctccgctctgtttaagaaccttctgctgaagaagatcaagcgttgtgagaggaagggcaccgagtcagtaactgaggagaagtgtgccgtcctgttttccgcatccttcaccctgggaccgggaaagcttccaattcagcttcaggccctttctctccctcttgttgtcattgtgcacggtaaccaggataacaatgcaaaagccactatactctgggacaatgctttttctgaaatggatagggtaccgtttgtagtcgcagaacgggtgccatgggaaaagatgtgcgagacgctgaacttgaaatttatggctgaagtaggtacgaatcgcggtcttctaccagagcatttcctttttctggctcagaagatttttaatgataacagtctttcaatggaggctttccagcacagaagcgtctcatggtctcagttcaacaaagagatcctgctgggaaggggctttacattttggcagtggttcgacggcgtgctggatttaactaagaggtgcctgaggtcatattggagcgaccgcctcattatcggctttatctccaaacaatacgtgaccagcttgctcttgaatgagcctgatggtaccttcctcttgcgcttttctgactccgagattgggggaatcaccatcgctcatgtgatccgcggtcaagacggaagtcctcagatcgagaacattcagccattctctgctaaagacctgtccattcgctccctgggtgatcggataagggacttggctcaattgaaaaacctataccctaagaaaccaaaggacgaagcttttcgctctcactacaagccagagcaaatgggaaaagatgggcgaggctatgtgcccgctactatcaaaatgacagtggagcgagaccagccacttccaacccctgaattgcagatgccaaccatggtaccaagttatgatctgggtatggcgcctgattccagtatgtccatgcagctcggcccagacatggtgcctcaggtctatcccccacatagtcactctatccctccataccaaggtctctctcctgaagaatctgtaaacgtgctctcggcattccaagagcctcatctccagatgcctccctcccttggacagatgtcactaccattcgaccagccccaccctcagggattgctaccttgtcaacctcaggaacacgcagtgagctctccagaccctctgctgtgtagcgatgtcacaatggtggaggattcttgcctgagtcagccagtaactgccttccctcagggtacatggatcggagaggacatcttcccaccattattgcctcccaccgaacaggatctgactaagttgctgctggagggccagggtgagagtggagggggatcacttggccattctccatcgtgctcaccccctacaatgggcaacctggggtcccaatgtcctacttggacgtag

SEQ ID NO: 240573 - DNA, 2544 bp, Artificial Sequence
  Description of Artificial Sequence: Synthetic coding sequence
atgagcttgtggggccttgtgagcaagatgcctccagaaaaggtgcagaggctgtacgttgattttccacagcacctgaggcatttgcttggagactggctggaatctcagccctgggaatttctggtggggtctgatgctttttgctgcaaccttgcatctgctcttctttccgataccgtccagcacctgcaggcgagcgtcggggagcaaggggagggcagtacgattttgcagcacatctccaccttggaatccatctatcagcgtgatcccctgaagctagttgctacattccgccagatcctgcaaggagaaaagaaagccgtcatggaacagttccgccatctgccaatgccattccactggaagcaggaagagttgaaattcaagaccggccttagacgtctccagcatcgagtcggcgagattcacctcctgcgcgaagccttacagaaaggcgctgaagccggtcaagtcagcctgcacagcctgatcgagaccccggctaacggcacaggccctagtgaggcattggccatgctactccaggaaacaactggcgagttggaagccgcaaaggctctagtactaaaacgaatccagatctggaaacgtcagcagcagctggccggaaacggagcccctttcgaggagtctctcgctcccttgcaggaacggtgtgaatccctggttgacatctattctcaattgcaacaagaggtgggtgccgcaggcggtgaactggaacccaagacgcgggcaagccttaccgggagactggacgaggtgttgaggacgctcgtgactagttgctttcttgttgagaagcagcccccacaggtcctcaagacccaaacgaagttccaggctggagtgcgcttcctcctgggcctccgctttctcggagcaccagctaagccaccattggtccgggcagatatggtgacggagaaacaagcccgagagctgagcgttcctcagggccctggggctggcgctgaaagtactggagaaattattaacaacactgttccactcgagaactctataccagggaattgctgctccgcattgtttaagaatttgttgctgaagaagatcaagcgctgtgaaaggaaggggaccgagagtgttaccgaagaaaagtgtgccgtactgttttctgcctcatttacgctggggcctgggaagttaccaattcagcttcaggccctgtccttgccactggttgtgatcgtccatggaaatcaggataataacgcaaaagctactatcctgtgggacaatgctttctctgaaatggacagggtaccttttgtggtggccgagagagttccctgggaaaagatgtgcgaaactctcaatcttaaattcatggccgaggttggcaccaatcggggtctgctccccgagcacttcctatttttagcacaaaaaatttttaatgataatagtctttccatggaggcgtttcagcatcggtcagtgtcctggtcccaatttaacaaggagatccttctggggaggggcttcactttctggcagtggttcgacggcgtcctggatctgactaagaggtgtctccgaagctactggagtgacaggcttattattggattcatttctaagcagtatgtgacctcactgctgttgaacgagcctgacgggacatttctcctgcggttctccgacagcgagatcgggggaataactatcgcacacgtgatcagaggccaagacgggagccctcagattgagaatattcaaccgttttctgccaaggatctatccatccgctccctaggtgatagaatccgggacttggcacagctgaaaaacctctaccccaaaaagccgaaggatgaagcattcaggtcacactacaaaccggaacaaatggggaaagatggcagagggtacgtgcctgccacaatcaagatgacggtagaacgggaccaacccttgcctacccccgaattacagatgccaacaatggtgccttcctacgacctggggatggccccagacagcagtatgtccatgcagctggggccagacatggtgccccaagtgtaccctccccacagccattccatcccaccttaccagggcctaagccccgaggagagtgtgaacgtgctctccgccttccaggagccacacctccagatgcccccatccttgggtcagatgagtctaccatttgaccagcctcatccgcagggcctcctaccgtgtcagccccaggaacacgctgtttccagtccggaccctctgctgtgcagtgacgtaactatggtagaagactcatgcctctctcaacccgtgactgctttcccgcaggggacatggatcggagaggatattttccctccactgttgccaccaaccgagcaggacctcacaaagttgctccttgagggccagggcgaatctggcggaggctctctcggggcacagccgctgctgcagccctcacactatggacagagtggcatttcaatgtctcacatggatctcagggcaaacccatcctggtag

SEQ ID NO: 240574 - DNA, 195 bp, Artificial Sequence
  Description of Artificial Sequence: Synthetic coding sequence
atgtcactttgggggttggtgtcaaaaatgccccctgaaaaagtgcagaggctgtacgtcgacttcccacagcatcttcgacacctgttaggcgactggttggaaagccagccatgggagtttctcgtgggctccgacgctttttgttgtaatttagcgtccgccctgctttccgacaccgtacaacatctatag

SEQ ID NO: 240575 - DNA, 435 bp, Artificial Sequence
  Description of Artificial Sequence: Synthetic coding sequence
atgagcctttggggactagtgtcaaagatgccccctgagaaggttcaacgtctatatgtggattttccccaacacttgcgccacctgctgggcgattggttggagtcacaaccatgggaatttctcgtcggttcagatgctttctgctgtaacctggcatcggctctcctctctgacacagtgcaacacttgcaggcgagcgttggggagcaaggggaaggttctactatcctgcagcacataagtacactggagagcatttaccaacgcgatcctctgaagctggtggccacctttagacagatccttcagggagagaagaaagccgttatggagcagtttcgccacctccctatgcccttccactggaagcaggaggagctgaagtttaaaactggtttgcggaggctgcagcacagggttggagagatttag

SEQ ID NO: 240576 - DNA, 465 bp, Artificial Sequence
  Description of Artificial Sequence: Synthetic coding sequence
atgtctttatggggattggttagtaagatgcctcctgaaaaggtccagaggctctacgtagactttccccagcacttgaggcacctgctcggagattggctggaaagccagccttgggagtttttagtcggcagcgatgctttttgctgcaatctggcatcagccctgttatccgatacagtacagcacctgcaggcctccgttggcgaacaaggagaaggctccaccattctgcagcacatctccacgctggagtccatttatcagagggacccactcaaattggtggccacgttccggcagatattgcagggtgagaagaaagcagtgatggagcagttccgacacctgcccatgcctttccattggaaacaggaggagctgaaattcaagaccggactgcggagattgcagcacagagtgggcgagatccatctcctccgggaggcattgcaaaagggctag

SEQ ID NO: 240577 - DNA, 318 bp, Artificial Sequence
  Description of Artificial Sequence: Synthetic coding sequence
atgtccctatggggccttgtgtccaagatgccgccagaaaaggttcagaggctgtatgtagactttccgcagcatttgcgccatctgcttggagactggcttgagagccagccctgggagttccttgtgggcagcgatgccttttgctgcaacttggccagcgccctgctctctgacacagtgcagcacttacaagcctctgttggagaacagggagaaggctcgaccatcctacaacatatttccactctagagtccatctatcaacgtgaccctctaaagttggtggctactttccgccagatactgcagggctag

SEQ ID NO: 240578 - DNA, 312 bp, Artificial Sequence
  Description of Artificial Sequence: Synthetic coding sequence
atgagtttatggggactcgtcagtaagatgccaccagaaaaagttcagcggctctacgtggatttcccgcagcacctccggcacctattgggcgattggttagagagccaaccctgggagttcctagtgggatccgatgccttttgctgtaacctggcttcagcactgttgtcagacaccgttcagcatctgcaggcctctgtgggcgaacaaggcgagggatctaccatcctccagcatatctcaactttggaatccatctatcagagagacccactgaaattggttgctactttccgccagattttatag

SEQ ID NO: 240579 - DNA, 480 bp, Artificial Sequence
  Description of Artificial Sequence: Synthetic coding sequence
atgagcctgtggggactggtgagtaagatgcccccagaaaaggtgcagagattatacgtggactttccccaacacctgagacacctgttgggagactggctggaatcccagccatgggagttcttggtgggcagcgacgctttttgctgcaatctggcctcggcccttctttctgatacggttcagcatctccaagcctcggttggagagcagggcgaaggaagcaccatcttgcagcatatttcaaccttggagagtatttatcagagggaccccctaaagctggtggccacgttcaggcagattctgcagggggagaaaaaggccgtaatggaacaatttcgccaccttccaatgcccttccattggaaacaagaagagcttaagtttaagacaggactgaggcgactgcaacatagagtgggtgagattcacctactgcgcgaggcccttcagaagggagcagaagccggacagtag

SEQ ID NO: 240580 - DNA, 2544 bp, Artificial Sequence
  Description of Artificial Sequence: Synthetic coding sequence
atgtctctttgggggctggtgtcgaaaatgccaccagagaaggtccagaggctctatgtcgatttcccacagcacctgcgtcacctgctcggggattggctggagtctcagccttgggagtttctggtgggttccgatgccttctgttgtaatctcgcatccgctctgttgtccgacaccgtgcagcatttacaggcgagcgtcggtgagcagggagaagggtccacaatccttcagcatattagtacacttgaatcaatttaccagcgcgatccacttaagctcgtagcaacgttccgacagatcctgcagggtgagaaaaaggcagtaatggaacagtttaggcatctgcctatgcccttccactggaagcaagaggagctaaaattcaaaaccgggctgagacgactgcagcatcgagtaggtgaaattcatcttctgcgcgaagccttgcagaaaggagctgaggcaggccaagtgagccttcacagtctgatagagacccccgcaaatggcacagggccttcagaagccctcgccatgttgctgcaggagacaaccggagaactcgaagcagcaaaggcattggtgcttaaacgcattcaaatatggaaaagacaacagcagctggccggtaatggcgctccatttgaggagtctttagcacctttacaggaacggtgtgaaagcctggtcgatatatatagtcaactgcagcaagaagtgggtgccgctggaggggagctagagcccaagactcgggcatccctcacaggcagactcgacgaagtgcttaggaccctcgtcacgagctgttttctggttgagaagcagccgcctcaggtcttaaaaactcaaacaaagttccaagccggtgtccggttccttcttggcctgcgattcttgggcgcacctgccaagccaccattagtccgcgctgacatggttactgagaaacaggccagggagctcagcgtcccacaggggccaggtgccggtgcggaatccaccggagagatcattaataatacggtccccctggaaaactccattccaggaaactgctgtagcgcgctttttaaaaacctcttgcttaagaaaatcaaacgctgtgagaggaaaggcaccgagtccgtgacagaggagaagtgtgcagttctgttcagcgctagtttcacgctcggcccaggtaaacttcccattcagctccaggccctgtcactgcctttggtagttatcgtgcacggaaatcaggacaacaacgcgaaggctaccattctgtgggacaatgccttctctgaaatggaccgggtcccatttgtagtggcggaacgggtaccatgggagaaaatgtgtgagacgctcaatctcaaattcatggccgaggtcggaaccaaccggggactgcttcccgaacacttcctgttcttggcgcagaagatatttaatgacaattcgctgtcgatggaggcattccagcacaggtctgtgtcctggagccagttcaacaaggagattctgttgggtaggggctttacattttggcagtggttcgatggcgtgctggacctgacaaagagatgcctgaggtcatattggagcgataggctaatcatcggatttatctccaaacagtatgtgacttctcttctgctgaatgagcctgacgggacctttctgctgagattcagtgactccgagatcggtggcattacaatcgcgcacgttattcgcggtcaggatggtagcccacagatcgagaacatccaacctttctctgctaaagacttgtcaatccgatcactgggtgaccgaatccgcgacctcgcacaactgaagaacctttaccctaagaagcctaaggacgaggcatttaggtctcactacaagccggagcagatgggtaaagacggcagaggatatgtgccagctaccatcaagatgaccgtggagagagaccaacctttgcctacacccgagctgcaaatgccaactatggtgccctcatacgacctgggcatggcaccagactcctcaatgagcatgcagctgggtcctgacatggtccctcaggtgtatcctcctcactcacattccataccgccttatcagggtttgtctcccgaagagtccgtaaatgtgcttagcgccttccaagaacctcacctgcaaatgcctccgtcactgggacagatgtccctgcccttcgaccagcctcaccctcagggcttactcccatgtcagccccaagagcatgccgtgtccagtcccgacccattgctgtgtagtgatgtgaccatggtggaggactcttgtcttagtcaacccgtgaccgcattcccacagggaacttggatcggcgaggatatcttccctcccctacttccgcctacagagcaggacctcactaagttactgctggagggacagggggaaagcggcggaggtagtctaggagcccagcccctcttgcagccttcacattatggtcagtctggtatttccatgtcccatatggatctccgtgccaatccaagttggtag

SEQ ID NO: 240581 - DNA, 225 bp, Artificial Sequence
  Description of Artificial Sequence: Synthetic coding sequence
atgtcactgtgggggctcgtctctaaaatgcctcctgaaaaagtgcagagattgtacgtggacttccctcaacacttgcggcaccttctgggcgactggctagagtctcagccctgggagttcttggtcggttcagatgcgttctgctgtaaccttgcctctgccttattgagtgacactgtgcagcatcttcaggccagtgtgggcgagcagggagagggctag

SEQ ID NO: 240582 - DNA, 564 bp, Artificial Sequence
  Description of Artificial Sequence: Synthetic coding sequence
atgctgggccaccctaaggtttgcgaaaaactcaaggctctgatggtggaatggactgacgaattcaagaatgacccacaactgagcctgattagcgctatgattaaaaatctgaaagagcagggggtgacgttcccggctatcggttcccaggccgcagagcaagccaaagcctcccccgctcttgtggcaaaagaccccggaactgtggcaaacaagaaggaggaggaggacttagctaaagcaatcgaactttcccttaaagagcagagacagcagagcacgaccctctctaccctgtacccgtccacaagttctctcctgacaaaccaccagcatgaaggaagaaaagttagggcgatctatgatttcgaggccgcagaagataatgaacttacattcaaggccggagaaattatcactgtccttgacgactcggatccaaactggtggaagggtgaaactcatcagggcatcggtttatttcctagcaatttcgtgactgccgacttgaccgccgaacccgagatgattaagactgagaagaaaaccgtccaattttag

SEQ ID NO: 240583 - DNA, 1623 bp, Artificial Sequence
  Description of Artificial Sequence: Synthetic coding sequence
atgcctctcttcgctactaacccgttcgatcaggacgtggaaaaagccacctccgagatgaatactgcagaggattgggggctgatcctcgacatctgcgataaagtcggacagagccgaactgggcctaaggattgcctgcgttcaattatgcggagagtgaatcacaaagatccccatgtggccatgcaggccttgacgttactcggggcatgtgtgagcaactgtggtaaaatcttccatcttgaggtttgttctagagattttgcttccgaggtgtctaacgtgctgaataagggacacccaaaagtgtgcgagaagctgaaagccctgatggtggaatggacggacgagttcaagaacgatccccagctctcactgattagtgcaatgatcaagaacctgaaggaacagggcgtgactttccctgctatcggcagtcaggcagcagaacaagccaaggcaagcccagcgctcgtggctaaggacccagggactgtagccaacaagaaggaggaggaagacctggcgaaagcaattgagttaagcctcaaagaacagcgccagcagtccaccacactaagcacgttgtacccctcaacaagcagccttctgaccaaccatcaacacgaagggagaaaggtgcgcgctatctatgactttgaggctgctgaggataatgagctaacattcaaggcaggagaaattatcactgtgctggatgactctgacccaaactggtggaagggcgagacccaccaggggattggtttattcccatcgaatttcgtgaccgcggacctgaccgcagaacccgagatgattaagacagaaaagaagactgtgcagttcagcgatgatgtccaggttgaaacaatagaacctgagccggaaccagcatttatcgacgaggacaagatggaccaattactacagatgctgcaaagcacagatccaagcgacgaccagcccgacctgccggagctgcttcacctagaagctatgtgccaccagatgggacctctaattgatgaaaagctggaggatatcgatcgtaagcattcagagctatcagagctaaacgttaaagtcatggaagccctcagcctctacactaaactgatgaatgaggatccgatgtactctatgtacgctaagctgcagaaccaaccatactacatgcagtcatctggagtctccggaagtcaggtctatgcagggccaccaccgtccggagcttacctggtcgcaggcaatgctcagatgtcacacctccagagctactcacttccacccgaacaactcagctccctgtcgcaggctgtggtccccccttccgccaaccccgcactgccatctcaacaaacccaggcagcctacccgaatacaatggtttctagcgtgcaagggaacacgtatcctagtcaggcgccagtttactcgccgccaccagctgccacagccgcagccgctacagcagacgtgactctgtaccagaatgccggtcccaacatgccacaggtacctaactataacctaaccagctctactctcccgcagccaggcggttcacagcagccacctcaaccacagcagccatattcccagaaagccctcctgtag

SEQ ID NO: 240584 - DNA, 357 bp, Artificial Sequence
  Description of Artificial Sequence: Synthetic coding sequence
atgagaagggtgaaccataaggaccctcacgtggctatgcaggcactgactctcttgggtgcctgcgtcagtaactgtggcaaaatcttccacttggaggtctgctcccgggactttgccagtgaggtatctaatgtgttgaacaaggggcacccaaaggtttgcgagaaacttaaagccctgatggtggagtggacagacgagttcaaaaacgacccccagctttccctgatttcagctatgatcaagaatctaaaggaacagggtgtcacattcccggctattggctcccaagccgctgagcaagctaaggcaagcccagctctggtagccaaggatcccggtaccgtggcctag

SEQ ID NO: 240585 - DNA, 1290 bp, Artificial Sequence
  Description of Artificial Sequence: Synthetic coding sequence
atggtcgaatggacggatgagttcaaaaacgacccacagctgagtctaatttccgcaatgatcaagaaccttaaggaacagggcgtgactttccccgcaatcggctctcaggccgcagaacaggcaaaggcctctcccgctctagttgcaaaggacccagggactgtcgccaataagaaggaggaggaggacttggcaaaggcgatcgagctgtctctaaaagaacagcggcagcagtctaccacattaagcactctgtacccgtctacctcctccttattgacaaaccaccagcatgaggggaggaaggtgcgcgctatttacgatttcgaggcagccgaggataatgaattgacattcaaggccggtgaaattattaccgttctcgatgacagcgaccctaattggtggaagggcgagacacatcagggaatcgggctgtttccaagcaactttgtgacagcagatttgacagcggagccagaaatgataaagacggaaaagaaaaccgtacaattctctgacgatgtgcaggtggaaactatagaaccagaacctgagccagcctttattgacgaagacaaaatggaccagctgcttcagatgctgcaaagcaccgaccctagcgacgaccagccggatctgccggaattgctgcacttggaagctatgtgtcatcagatgggaccactgatagatgaaaaactggaggacattgacaggaaacattccgaactgagtgaactgaacgtgaaggtcatggaagcgctctctctgtacacaaaacttatgaacgaagatcctatgtatagtatgtacgctaagctccagaatcagccttactatatgcaatcatctggagtgagtggcagccaggtgtatgccggtcctcctcctagcggtgcttacctagtcgctggcaatgcacaaatgtctcacctgcagagctactctctgcctcccgagcagctgtcttcgctatctcaggcagtggtcccaccctccgcgaacccagccctgccctctcagcagactcaggcagcttatcctaatacaatggtatcttctgtgcaagggaacacatacccttctcaggcccctgtgtattcaccccctccggctgctactgccgcagccgcaacagctgatgtgacattgtaccaaaatgccggacccaacatgccccaggtccccaattataatctgacctcttctactttgccgcaaccaggagggagccaacagccccctcaaccacagcagccatattcccagaaagccctgctctag

SEQ ID NO: 240586 - DNA, 1578 bp, Artificial Sequence
  Description of Artificial Sequence: Synthetic coding sequence
atgcctttgtttaccgccaacccatttgaacaagacgttgaaaaggcaacgaacgaatacaataccacagaggattggagcctcatcatggacatttgcgacaaggtgggctctactcccaacggtgcaaaggactgcttaaaagcaatcatgaagcgcgtaaatcacaaggtcccacatgttgccctgcaggccctgacattgttgggggcatgcgtcgccaactgtggcaagattttccacctggaggtctgttctagggacttcgcgacagaagtaagagctgttattaaaaataaagcccacccaaaagtctgcgagaaacttaaatctctcatggtggaatggtccgaagaatttcagaaagaccctcagttttctttaatcagcgccacaatcaagagcatgaaggaggaaggcatcactttcccccctgccggatctcagacagtgagcgccgctgctaaaaatggcacctccagtaacaaaaacaaggaagacgaagatatcgccaaggctatcgagctgtctctgcaagaacagaagcaacagcacactgagacaaagtccctgtaccccagtagtgaaattcagctgaacaacaaagtcgccagaaaagtgcgggcattgtatgacttcgaagcggtagaggacaatgaattgacctttaagcacggggagatcatcatcgttctggatgactcagatgccaactggtggaagggagaaaaccaccggggaatcgggctgtttcctagtaatttcgtcaccacaaatcttaatattgaaactgaagcagcagctgtcgataaactgaacgtgatagatgatgacgtggaagagattaaaaagtctgagcccgagccggtgtacatcgatgaagataagatggatagagcccttcaagttctgcaaagtatagacccaacagattccaagccggatagtcaggatcttttagatttagaggacatctgtcagcagatgggtccaatgattgatgagaagctggaagaaattgaccggaagcatagcgagctgtctgaattaaatgtcaaggtattagaggcgttggagctgtacaacaagctcgttaatgaagctcctgtgtattccgtctactcaaagttgcaccccccagctcactatccgccagcttcatcaggcgttcccatgcagacatatccagtgcagtctcacggaggtaactacatgggtcagagcattcaccaggtcacagtggcgcagtcatactccttagggcctgatcagatcggcccactgcgctccctcccccctaatgtgaattcaagcgtcacggctcagcccgctcaaacgtcatatttatcaactggccaggatacagtgagtaaccctacttatatgaatcagaattctaacttacagagtgccacagggacaacagcctacacacagcaaatgggcatgagcgtggacatgtccagttaccaaaacacgacgtccaatctgcctcagctagcaggattccccgtgacggtgccagcccatcctgtagcacaacagcacacaaactaccatcaacagcctctgttgtag

SEQ ID NO: 240587 - DNA, 3129 bp, Artificial Sequence
  Description of Artificial Sequence: Synthetic coding sequence
atgccaatgtgggctgggggagtggggtctcccagacgcggaatggcccctgcttccacagacgacttgttcgcccgaaagttacgccagcccgctagacctccactgacacctcacacttttgaacctcggccagtgaggggacctctcctacgttcagggagcgatgccggagaagcgcgtcctccgaccccagcatcccctagagccagagctcatagtcacgaagaagccagtaggcctgccgctacctcaactcgcttatttaccgatcctcttgcacttttgggtttgccagcggaggaacctgagcctgctttcccgccagtgctagaacccaggtggtttgcacactacgacgttcagtctcttctgttcgactgggcccctcgctcccagggcatgggtagccactccgaagcaagtagcggcacattggcctctgccgaagatcaggccgctagttccgatcttctccatggcgctcctggctttgtgtgcgaattgggaggcgaaggcgaacttgggttgggagggccagcaagccccccagtcccacccgctttacctaacgcagctgtgtccattcttgaagaaccacagaacagaactagcgcttactcgcttgagcatgccgatctgggggctgggtactaccgaaagtatttctatgggaaggagcaccaaaacttctttggcatggatgagtcactggggcctgtcgccgtgagcctgcgccgtgaggagaaggaaggttctgggggaggcacactgcacagctatcgagtaatcgtgcggaccacacagctacgtaccctgcggggaactatctccgaagacgccttgccaccgggaccccctcgcggactgtctccacgcaagctgttagaacacgttgccccacagctgagtcccagttgtctgcgcctggggtccgcaagtcccaaggtgcccagaacgctacttaccttggacgaacaggtactctcctttcaacggaaggttggtatcctctattgcagagccggacaaggatccgaggaggagatgtacaataaccaggaggctggtcccgcatttatgcagtttctgaccctacttggagacgtcgtgagattaaaaggcttcgagtcatatcgagcacagctggacactaagacagactctaccggcacccatagcctgtacaccacttaccaggaccacgaaatcatgtttcacgttagtacaatgctgccatataccccaaacaaccaacagcagctgttgcggaaacggcacatcggtaatgacatcgtaactattgtcttccaggagcccggttccaagcccttctgccctactaccattcgctctcacttccagcacgttttcttggtggtgagagctcacaccccttgtaccccacataccacatacagggtcgctgtgtcacggacacaagatacaccagctttcggaccagccttacccgctggcggtggcccttttgccgcaaatgctgacttccgagcctttctgctcgcgaaggccctgaacggcgagcaggctgctggccatgccagacagtttcatgcgatggcaaccaggacccgacagcagtacctgcaggatttggccacgaatgaggtgacaacgacatcactggattctgcatccagattcggactgcccagtctaggcggaagacggagagcagctcctagaggccctggcgcagagcttcaggccgcagggagtctggtctggggggtgcgggcagcgcctggcgcaagggtcgctgccggtgctcaagcttcaggaccagagggcatagaggttccatgtttgctcgggattagcgcagaggcgttggtgctagtcgctccccgagacggcagggttgtgttcaattgcgcatgccgagatgtgctggcctggactttcagcgagcaacagctggatttatatcacggacgcggagaagcgatcacccttcgtttcgatggcagtccagggcaggccgtcggtgaggttgtggcgagactgcagctagtgtcccgcggatgcgaaactcgcgagctcgcacttcctagggacggtcagggtcgtctgggctttgaggtggatgccgaggggttcgtcacacacgtggagaggttcacatttgccgagactgccggtctacgcccaggcgcaagactcttgagggtctgtggccagaccctgccatcactgcggcctgaggcggctgcacagctcctgcgctcggcccctaaggtttgcgtgaccgtcctcccccctgacgagagtgggagacctagacgatctttctccgagctctatactctgagcctgcaggagccaagccggagaggagcccctgacccagtccaagatgaggtccaaggagttacgctcctgccgacaacaaaacaactgttgcatttgtgtctgcaagatgggggaagtcctcccggaccaggcgacctggcagaagagagaactgagttccttcacagtcagaatagtctttctcctcgctcatccctcagcgatgaggcccctgtgctccctaatacaacccccgatctccttctcgcaacaacagctaagccgagtgtgccctctgccgactctgagacaccactgacgcaagaccgacctggctctcctagtgggtccgaagacaaggggaatcccgcaccagagttgcgcgcatcctttctcccccgtacgttgtcacttcggaactcaatttcacgaatcatgtccgaagccggaagcggaactctggaggacgaatggcaggcaatcagtgaaattgcctctacttgtaataccatcctggagagcctgagccgcgaggggcaacctatcccagagtcgggtgaccctaagggcacccccaaatctgatgccgaaccagagccaggaaatcttagtgagaaggtgtctcacctggaatctatgttacgcaaattacaagaggacttgcagaaggaaaaagcggacagagccgctttggaggaagaggtcagatctttaaggcacaacaaccgccgtttacaggctgagtccgaatcagcagctactaggcttcttctggctagtaaacaactgggttctcccacagctgatctcgcttag

SEQ ID NO: 240588 - DNA, 2823 bp, Artificial Sequence
  Description of Artificial Sequence: Synthetic coding sequence
atgcccatgtgggcaggcggtgtcggatctcctcgaagaggaatggcgcctgccagcaccgacgacctctttgcccgtaagctacgccagcccgcacgtccacctctgacgccacacacctttgagccacgcccagtgcggggaccattactgcgaagtggctccgatgctggggaagctaggccccctacccccgcatcaccaagagcaagagctcacagtcacgaagaagcctcccgaccggcagcaacatctactcgtttattcaccgatccgctggctctgctgggtttacccgctgaggagcccgagccagccttccctcccgtgctcgaacccaggtggttcgcgcattacgacgtacagtctttgttgtttgactgggcacccaggagccagggcatgggcagccacagcgaagcaagtagcggtacgctggcctccgctgaagaccaagccgcatcctcagatctgttgcatggcgctcccggttttgtttgcgaactgggcggagagggagagctaggtctgggcggtcctgcatcacccccagtgcctcccgcactgccaaatgccgctgtttccatccttgaggaaccccagaataggacctcggcatacagcctggaacacgctgatttaggggctggatactaccgcaagtacttttacggcaaagagcaccaaaacttcttcggtatggacgaaagtctgggccctgtcgcggttagcttacggagggaggaaaaagaaggtagcgggggtggaaccctgcattcctaccgggtgattgtaaggaccacacagctcaggaccctaaggggaactatctcggaagacgccttgcctcctgggcctccacgcggacttagccctcgcaagttgctggagcatgtcgcccctcagctatcaccctcttgccttaggctgggctctgccagtcctaaggtgccacggaccctcctcacgctggacgagcaggtcctttcatttcagaggaaagttggtattctgtactgtcgagccggacaggggagcgaggaggaaatgtacaataaccaggaagctggacccgcatttatgcagtttttgactttgctgggcgacgtagtgcgcctgaagggattcgaatcttacagagcccagttggatacaaagacagattcaaccggtactcactctctttatactacctaccaagatcacgaaattatgttccacgtttcgaccatgctcccttatactcctaacaaccaacagcagctgcttcggaagagacatatagggaatgatattgttactattgtctttcaggagcctgggagtaagccgttttgccctactacaattcgatcccactttcagcacgtgtttttggtcgttcgggcacatacaccctgcaccccgcacaccacctaccgggtagccgtaagtagaactcaggacactccggctttcggtcctgcactgcccgcaggcggaggaccttttgctgctaatgcggacttcagagctttccttctcgctaaggcgctgaacggcgaacaagcggctggccatgctcgacagttccatgcaatggccaccagaacaaggcagcagtacttacaggacctggcaacgaatgagcagctcgacctttaccatgggcgaggcgaggcaataacgctccgttttgacggctcaccaggtcaggccgtcggggaggtagtggcgaggttgcagctggtgagcaggggctgcgagactagggagctcgcactcccaagggacgggcagggccgacttggctttgaggtggatgccgagggatttgtgactcacgtcgaaagattcaccttcgccgaaaccgcaggcctacggcctggggcacgtctgttaagggtctgtggacaaaccttgccctccttgcggcctgaagctgctgctcaactactgaggtccgcacccaaggtgtgtgtcaccgttctaccccctgacgagagtggcagacctcgaagaagcttttctgagctctacactctctccttgcaggagcccagcagaaggggcgctcctgatccagtccaagatgaggtgcaaggcgtgaccctgctgcccacaacaaaacagctgctacacctgtgcctgcaagatggtgggagccctccaggcccaggtgacctggctgaggagcgtactgagttcctccacagccaaaattctctatcgcccaggagctcacttagcgatgaggctcctgtgctccctaacacaacacctgacctgctgttggccacaactgcaaagccttctgtgcctagtgctgactccgagacgcctttgacacaggacagacccggatcacctagtgggagcgaggacaaagggaatccagcgccagaactcagggcttccttcctgccgagaacgctgagcttgcgaaactccataagtcggatcatgtcagaagccggatccgggaccttggaggatgagtggcaggccatttcagagattgcgtccacgtgtaatactatcctggaatcactatcaagagaaggccagccaatccccgagtccggagacccaaaaggcaccccgaaaagcgatgccgagcccgagcctgggaacttgtccgaaaaagtttctcatcttgagagcatgctacggaagctgcaggaggacctccaaaaggaaaaagcagacagagccgctctcgaggaagaagtgaggtccttgcgccacaacaaccggaggttgcaggctgagtccgaatcggcagccaccagactgctgctggcttcaaagcagttaggcagccccacagcggatctggcctag

SEQ ID NO: 240589 - DNA, 21 bp, Artificial Sequence
  Description of Artificial Sequence: Synthetic coding sequence
atgccaatgtgggccggatag

SEQ ID NO: 240590 - DNA, 312 bp, Artificial Sequence
  Description of Artificial Sequence: Synthetic coding sequence
atgccaatgtgggcaggaggtgtaggctctccacgtagaggcatggcgccagcatcgactgatgatctattcgcaagaaaactgagacagccagctcggcctccccttacccctcatacctttgaaccgcgacctgtgcgaggtccacttcttcgcagtggaagtgacgcgggagaggcacgcccaccgacaccggcatctcctcgcgctcgggcacactcccacgaagaggcaagccgcccagccgctacttctactcgtctcttcactgatcctctggccttgctcggcctccccgctgaagagccgtag

SEQ ID NO: 240591 - DNA, 3129 bp, Artificial Sequence
  Description of Artificial Sequence: Synthetic coding sequence
atgccaatgtgggccggtggtgtcgggtccccaaggagaggtatggctccagcctctacagatgacctgtttgcccgaaagttgcgtcagcccgctcgccctcccctgacccctcataccttcgagccacgccctgtgagaggacctctgttgagaagcggctccgatgccggtgaggccagacctcccactccagcctctcccagggcacgcgcacatagccacgaagaagcctctagaccagctgccacatccacaaggctgttcaccgaccccttggccctgctgggcctgcccgcagaggagcccgaacctgcatttccaccagtgctcgagcccaggtggttcgcccattacgatgtgcagtcactacttttcgattgggcaccgcgttcccaaggtatgggctcgcacagtgaagctagtagcggcaccctcgctagcgccgaagatcaggccgcaagctccgacctcctgcatggggcacccggattcgtgtgcgaactaggaggcgaaggtgaactgggtctgggaggtcccgcttctcctcccgtgccgccagctcttcctaacgctgcagtgtcgatcttagaggaacctcagaatcggacatctgcctacagcctggagcacgcagacctgggcgctggatattaccgcaagtatttctatggcaaggagcatcagaacttttttgggatggatgaatcgctggggccagtggctgtgtcgcttcgacgagaggaaaaagaaggctccggcggaggcaccctccactcctaccgagtgatagttcgaacgactcagttgcggaccctgcggggaacaatatcagaagacgccctgccacctggaccaccgcgaggactttcccccaggaaactgctcgagcatgtggcaccccaactgtccccttcttgcctccgccttggatccgctagcccaaaggttccacgaacattgctgacactcgacgaacaggtgttgtctttccagcggaaagtcggcatactttactgtcgcgcaggccaggggtccgaggaagagatgtacaacaaccaggaggccggaccagcgttcatgcagtttttaaccctccttggagacgttgtgaggctaaagggctttgagtcctatcgtgcccagctggacactaagacagacagcaccggcacccattccctgtacaccacctaccaagaccacgagatcatgttccacgtttccactatgctgccttatacaccgaataatcaacagcagctcctacgcaagaggcacatcggcaacgacatcgttaccatcgttttccaagagcccggttcgaagccgttttgccctaccacgattcggtctcactttcaacatgtttttttagttgtacgcgctcatactccctgcaccccccacactacatatagggtggcagttagtaggactcaggataccccagcattcggccctgctctgccggctgggggaggcccattcgcagcaaacgccgacttccgtgccttcttgttagccaaggccctcaatggcgagcaggctgccggtcacgcaaggcagttccacgctatggccacaaggacgagacagcagtatctacaggacctggcaactaatgaggtgaccacgacctcattggattctgcatctagatttggactcccctccctcggaggacgacgcagggcagcccctagaggcccaggcgctgagctgcaggcggcaggatctctcgtttggggagttagggccgctccaggtgcccgtgtggccgcaggggctcaggcctctgggccagaggggatcgaagtaccgtgcctgctcggcatctccgctgaggcattggtactggtcgctccgagagatggcagagtcgtttttaattgtgcttgccgcgatgtacttgcatggaccttctcggaacaacaattggacctgtatcatgggaggggggaagctattacactccgattcgatggctcaccgggacaagccgtcggggaggtggtggcacgcctgcaactcgtgagcaggggttgcgaaactagagaactcgctctgccgcgtgacgggcagggtcgcctgggtttcgaggtcgacgctgagggctttgtaacacacgtggaaaggtttacgttcgctgagaccgccggtctgcgccctggcgctagacttcttcgggtgtgcggccagaccctaccatccctgagacccgaggccgctgctcagctccttcggtccgcgccaaaggtgtgcgtgactgtgctcccaccggatgagagcgggcgaccaagaaggagtttcagcgagctatataccctgagtttacaggaaccttcacggaggggcgcacctgatcctgtacaggacgaagttcagggcgtgactcttctgccgacaacaaagcagctacttcatctttgtttgcaggacggtggtagcccacctggtccgggagacctcgccgaggaacgcactgagtttcttcattcgcaaaactctttatcccccagatctagtctgtctgatgaggcaccagtgttgcctaataccaccccagatcttttgctggctaccacagccaagccatccgtgcccagcgccgattccgaaacgccactgacccaggataggccgggatctcccagcggatctgaggacaagggcaatcctgcacctgaactgagagcctcctttctgccacgaacactctcactgcgcaacagcatctcacgaatcatgtctgaggctggttcaggcactctcgaggacgaatggcaggccatctctgagatcgcttcaacatgtaacacaatcttagagtcgctgagccgagagggacagccaattccagaatccggcgacccaaaaggtaccccaaagtcagacgctgaaccagaacccggtaatttgtctgagaaggtgtctcacttagagagcatgctgagaaaactacaggaggacctccagaaggaaaaagccgaccgcgctgctctggaggaggaggtgcgttcactgaggcataacaaccggaggcttcaggccgagagcgagagcgccgcaacacggcttttactggccagcaagcaactagggtcccctaccgccgatctggcctag

SEQ ID NO: 240592 - DNA, 5169 bp, Artificial Sequence
  Description of Artificial Sequence: Synthetic coding sequence
atgtctgacccacggcaatctcaggaggaaaagcacaagctcggtcgtgcctcaagcaaatttaaggatcctccccgaattatgcagtcagatgattacttcgcacggaagttcaaggccataaacggaaacatggggcctacaacctccctgaatgcctcaaatagtaatgagacgggcggtgggggtcccgctaacggcacacctgcagtgcctaaaatgggcgtgcgcgctagagtaagtgagtggcccccaaagaaggattgcagcaaagagctcacatgtaaggctctctgggagtcaaggtctcagacctcctacgagtcaatcacgtccgtgttacagaacggccagtctgaccaatcagaggggcagcaggatgagcaactggatcttgatttcgtggaggcaaaatatacaatcggcgacatcttcgtgcatagtccgcagcgtggcctccatcccattaggcaacgctcaaactccgacgtcacaatctccgacatagatgctgaggacgtcctcgatcagaatgccgttaatccaaacacgggagcggcactgcatcgtgaatatgggtccacctcctccatcgatagacagggactgtcaggcgaaaatttcttcgccatgctgcgcggttatagagtagaaaattatgaccataaggcgatggtcccttttggatttccagaattcttcagatgtgatcccgcaatttctccttccctgcatgctgcggctcagatttcccgcggagaattcgtaaggattagcggcctggactatgtcgattctgcgcttcttatgggcagagatcgggataaacccttcaaacggaggttaaagagcgagagcgtagaaacctctctgttccgcaagctgcgcacagtcaaatctgaacatgaaaccttcaaattcaccagcgagctggaggaatcccggctggagagaggtattaggccctggaactgccagagatgcttcgctcactacgacgtgcagtcaatactgttcaatatcaacgaggccatggccacacgggcaaatgttggtaagcggaagaacattacaaccggagccagtgcagccagtcagacgcagatgccaacggggcagactggcaattgcgaatcacccctgggatctaaggaggacttaaacagcaaagagaatctggatgccgacgagggcgacggcaaaagcaatgacctcgttctgtcatgtccctacttcagaaatgaaactgggggtgagggagataggcggattgctctgagtagggccaatagcagcagtttctcctctggggagagctgttcgtttgaatcctctctgagctcccattgcacaaacgccggtgtgtcagtgctagaggtgccacgagaaaaccaacccatccatcgagaaaaagtaaagcggtatatcattgagcatatcgacttaggtgcctactattacagaaagttcttctacgggaaggagcatcaaaattacttcgggatcgacgaaaacttgggccctgttgctgtgtccatacggagggaaaaggtggaggatgccaaggaaaaggaagggtctcagttcaactatagagtggcattcagaacgtcagagctgacaactcttcggggtgccatcctggaagacgctatcccctctactgctagacacggaactgcccgaggtctgccactgaaagaggtgttggagtacgtaatcccagagttgagcattcagtgcctccggcaggctagcaacagccctaaggtctccgaacaactgttgaaactcgatgaacagggactatccttccagcataagatcggaatcctgtattgcaaagcgggtcagagcacagaggaagagatgtacaataacgaaacggcaggaccagccttcgaggaatttttggaccttttgggccagagagtcaggctgaagggtttttccaaatatagggcacagctggataataagactgattcaactgggacccattctttatatacaacttataaagattacgagttaatgttccatgtctccacacttttgccatatatgcctaacaatcggcagcagctactgcgcaaacggcacatcggtaacgacatcgtgacaatcgttttccaggagcccggagcgctgccttttacccctaaatccatccgatcccacttccagcatgtttttgtcatcgtgaaagtacacaacccttgcacagagaacgtgtgctacagtgttggagtttctcggagcaaagacgtccccccattcgggcctccgattccaaaaggagtgacatttcccaagtctgcagtttttcgcgacttcctgctggccaaagttatcaacgccgagaacgctgcacacaagagtgagaagtttagggcgatggcgaccaggacaagacaggagtacttgaaagatcttgccgaaaacttcgtcacaaccgcaactgtcgacacatctgtcaaattctcctttattaccctgggagccaaaaagaaggagaaggtgaagccacgaaaggacgcccatcttttcagcattggcgcaataatgtggcatgtgattgctcgggactttggccagtccgccgacattgaatgcctgttaggaattagcaacgagtttataatgctgattgagaaggactccaagaatgtggtgtttaactgtagctgcagggacgtcataggctggacgtctggattggtgagtattaaagtgttttacgagaggggcgagtgtgtgctcctttcctcagtggacaactgtgcagaagacattcgcgaaatcgtgcagagattggttattgtgactcgcggatgcgagactgtcgagatgactcttagacggaatggcctgggccagctgggctttcacgtgaacttcgagggcatagtagccgacgtcgagccctttggatttgcttggaaagctgggttacgccagggctcgaggcttgtggaaatttgtaaggttgccgtcgccactctcacgcacgaacagatgattgacctgctgcggacgagcgttacagtcaaggtggttattatccaaccccacgatgacggcagtccgagacgcggatgttctgaactctgtagaattcccatggtggagtataagttagattctgagggcacaccatgcgaatataagacaccttttcgcagaaacacaacatggcaccgcgtccccacaccagctctacagccgctgtcacgcgcttcacctatcccaggcactccagatcgccttccctgccaacagttactgcagcaagcccaagccgcaattccacgctctacctcctttgatcgcaagctgcctgatggcactagatcaagccctagcaatcagagttcttcttcagacccaggcccagggggatctggcccatggcggcctcaagttggctacgatggttgtcagtctcctttgctgctcgagcaccagggcagcggccctttagagtgtgatggagcccgagaacgcgaggatactatggaggcgagtaggcacccggaaacgaagtggcacggaccccctagtaaagtgctcgggtcttataaagagcgggcactgcagaaagacgggtcttgcaaagattccccaaataagctgagccacatcggtgataagagctgcagcagccactcctcaagtaacacactcagttctaatacgtcttctaattcggacgacaaacattttgggtccggcgatcttatggaccctgagctgctgggcctcacttatatcaagggtgcttcaactgattccggcatcgacaccgcaccatgcatgcccgctacaattctgggcccagtgcaccttgccggtagccggtctcttatacactcaagggctgaacagtgggcagatgcagcagatgttagcggacctgacgacgagcctgctaaactgtactccgtccacggatacgccagtacaatctccgccggttccgctgcagagggttctatgggcgatttgtctgagattagcagccatagttccggcagccaccattccggaagcccttcagcgcattgtagtaagtcctcggggtcacttgactcttccaaagtgtatatcgtaagccactcatctggccagcaggtccccggatcaatgtctaagccctaccacagacaaggagctgtcaacaagtatgtcatcggttggaaaaagtcggagggatcgccgccacccgaggaacctgaggtcacagagtgtccagggatgtacagcgagatggacgtaatgagtactgccactcagcatcagaccgtcgtaggcgatgcagtcgccgaaacccagcacgtcctcagcaaagaagactttctaaaactgatgctgcctgacagtcctttggtggaggaagggagacgaaaattctcattctacggaaatctgtccccaagacgtagcctgtatagaacattgtccgatgaaagcatttgctctaacaggcggggtagcagcttcgggagttctaggagttctgtcttggaccaggccctacctaatgacatcttgttctccacaacaccaccctatcatagtaccctgccccctcgtgcccaccccgcaccttccatggggagtctgaggaatgaattttggtttagtgatggaagtctgtccgataaatccaagtgcgctgatcccggactgatgcctcttccagatacagccaccgggttggattggacccatctggtcgacgcggcacgcgcatttgaaggtctcgactccgatgaagagttgggcttgctttgtcaccacacttcctatctggaccagcgagtggcgagcttctgtactctcacagatatgcagcatggccaagacctagagggagcacaggagcttccgctctgcgtggatcctggtagcggtaaggagtttatggacactactggcgaaaggagccccagcccgttaactggcaaagttaaccaactggagctgatcttacgacagctgcaaaccgacctaagaaaggagaagcaggacaaggctgtgctacaggccgaagttcagcacctgcgtcaggataacatgcgtttacaggaagagtcccagacagctaccgcccagctccggaagttcactgagtggttttttaccaccattgacaagaagtcctat

SEQ ID NO: 240593 - DNA, 2337 bp, Artificial Sequence
  Description of Artificial Sequence: Synthetic coding sequence
atgtccccgtgcttcagctttattggctgcaaactgtgctccattgtgactcgcggttgtgaaacagtggaaatgaccctcaggagaaatggtctgggacagctgggattccatgtgaatttcgaagggattgttgccgatgtggaaccatttgggttcgcatggaaggcaggtctgagacagggcagccgtttggttgaaatctgcaaggtagcggtcgctacgctaacacatgaacaaatgattgacctcctcagaacttcagtgactgtgaaagtagtcataatacaaccccatgatgacggctcccctcgtcggggatgtagcgaactgtgtagaatccctatggtcgagtataaactggacagcgagggcactccatgcgaatataaaaccccgtttaggagaaatacaacatggcacagggtgcccactcccgcacttcagcccctatcaagggcatctcctatccccggtacgcctgatcggcttccatgtcagcagctgctgcagcaggcccaggctgcaattccccgatcaacctcttttgataggaagctcccagatggcacgcggtcatctcctagtaaccagtccagttctagcgacccaggtccaggtggatccgggccatggcgaccacaagtcggctacgacggctgccagtcccccctcttactggagcatcagggttctgggccattggagtgtgatggcgctcgggagcgagaggacactatggaagcaagcagacatcctgaaacgaagtggcatggccctcctagcaaagttttggggagttacaaggagcgggctctgcagaaagacgggtcctgtaaggatagccctaacaagctatctcatatcggagacaagtcctgttcttcccattctagcagcaatactctctcttctaatacgagtagtaatagtgacgacaaacacttcggaagcggagacctgatggatccagagctcctcggacttacttacataaaaggagccagcaccgacagcgggattgataccgccccttgcatgcctgcaaccattctgggacctgtccatctggccggatccagaagcctgatccattcccgggcagaacaatgggccgacgcagccgatgtctccggcccagacgacgaacccgcaaaactatactctgtccacgggtacgcatctaccatcagtgccggaagcgcagctgaaggttcaatgggtgacttatcagagataagttcacactcctctggatcacaccactctgggtctccatccgcacactgtagcaaatcttcgggtagcctcgattcatccaaagtttatattgttagccacagctctgggcagcaggtgcccggaagcatgtccaaaccttaccaccgacagggcgctgtgaataaatatgtgatagggtggaagaaatccgaaggcagcccacctcctgaggagcctgaagtgactgaatgccctggaatgtattcagagatggacgtgatgtcaacagctacacagcaccagacagtggttggggatgctgttgccgagacacagcatgttctctccaaggaggacttcttaaagctgatgctgccggacagccccctcgtggaagagggcagacgcaagtttagtttttatggaaacctctcacccaggcgatccctctaccgaacactatcagacgagagcatttgctcgaatcgacgaggctcgtcctttggaagctccaggtcatcagtgcttgatcaggcgctaccgaatgacatactgttcagtacgacaccgccataccactccaccctgcctccgagggcccacccagccccatccatgggaagtctcaggaacgagttctggttctctgacggctctctgtctgacaagagtaaatgcgctgatcctggtctgatgccactcccagacacagccacagggcttgactggacccacctggtggacgccgcacgcgcatttgaagaccaacgagtcgctagtttttgtacactcaccgatatgcagcatggacaggacctcgagggtgcacaggagctgccactctgtgttgacccaggatcaggaaaggagtttatggacaccaccggcgagagatccccttcaccactgactggcaaggtgaatcaattagagctgatactgcgacagttacaaacagacctgagaaaggagaagcaggacaaggccgtactccaagccgaggtgcagcatctacgccaagataacatgaggctgcaggaagaaagccaaaccgcgacggcacagttaaggaagtttacggagtggttctttacaacaatcgataaaaaaagttag

SEQ ID NO: 240594 - DNA, 5168 bp, Artificial Sequence
  Description of Artificial Sequence: Synthetic coding sequence
atgtcagaccccagacagagccaggaggaaaaacacaagctcgggagagcgtctagtaagttcaaagaccccccaaggattatgcaatctgatgactacttcgcgaggaagttcaaagcaattaacggcaacatgggcccaacaacttcactgaatgcttcaaattccaatgagacagggggagggggtcccgctaatgggactcctgccgttccgaaaatgggggtgagagctcgcgtcagtgaatggcctccgaagaaggattgttcgaaggagcttacctgtaaagctctttgggagtccagatcccaaacatcctacgagagcattacatccgtcctacagaacggccagtccgaccagtccgagggacagcaggacgaacagctggatcttgattttgtcgaagcaaagtacaccatcggggacatcttcgtacacagccctcagaggggtctccatcccattaggcagcggtccaatagtgacgttacaatttccgacattgacgccgaggatgtactggaccagaatgccgttaacccgaatacaggcgctgctcttcaccgcgagtatggaagtacgagcagcatagacaggcaaggtttgtctggggaaaatttcttcgcgatgttgagagggtatcgcgtggaaaactacgaccataaggccatggtacctttcggtttccccgagttttttagatgtgacccggcaatctctccgtcgttgcacgcggctgctcagatcagtaggggcgaatttgttcgcatttccggcctggattacgtggactcggctcttctgatgggtcgggatcgtgacaaaccgttcaaacggcgactcaagtcagaaagcgtcgagacttccttgtttagaaagcttcgcactgttaagtcagaacatgagaccttcaagttcacatctgagctagaggagtctagactggaaagaggtatacgcccttggaattgccaaaggtgtttcgcccactacgatgtccaatccatcctgtttaacatcaacgaggcaatggcaacccgcgcaaatgtcggaaaacggaaaaatattacgacgggagcatctgccgcatcacagacccagatgcctacgggtcagaccggaaactgtgaatccccacttggaagcaaagaggacctgaactccaaggagaacctcgatgctgatgagggcgacggtaaatctaatgatctggtactatcttgcccctactttcgcaatgagaccggcggagaaggcgatcgaagaattgccctgtccagagcaaactcgagcagcttctcctccggagaatcctgcagctttgagagctcattgtccagccactgcaccaatgctggagtgagcgtgctggaggttccaagggagaatcagcccatacatcgcgagaaagtgaagcgttacattatagaacatatcgatctgggtgcctattattatcgcaagtttttctatgggaaggaacaccagaactacttcgggatcgatgaaaacctaggtcctgtggcggtctctatccgcagagaaaaagtagaagacgctaaagagaaggaaggctcacagtttaattaccgggtggcatttaggactagcgaactcactaccctgaggggcgctatcttagaagatgctattccctcgacagcgaggcatggtaccgccagaggcctgcctctgaaggaagttttggagtacgtcatccctgagctttccatccaatgtctgaggcaggcgagtaactctcctaaggtctctgaacagctactcaaattagacgagcaaggactgtctttccagcataagatagggatcctctattgtaaagcaggccagtcaacagaagaagaaatgtacaacaatgaaaccgccggacccgcattcgaggaattcttggatctgctcggacagagagtgcggttaaagggtttttcaaagtacagggcgcaactggataacaagaccgattcaaccggaacccattcgttgtataccacctataaagactacgaacttatgttccatgtcagcacactccttccctacatgccaaacaaccgccagcagcttttacgtaagagacatattgggaacgatattgtgacgatagtgttccaggagccgggagctttaccttttacaccgaaatccataaggagccactttcaacacgtgttcgtcatcgtaaaagtccacaacccttgtactgagaacgtatgttattctgttggcgtctcacggagcaaagatgtgcccccattcggcccacccatccccaagggagtcacctttcccaaaagtgccgtgttccgtgattttttgctggccaaagttatcaacgccgaaaacgcggcacataagagtgaaaaattccgggctatggcaacacgcacaaggcaagaatacctgaaggaccttgcagaaaacttcgtaacgaccgcaaccgtcgacaccagcgtgaagttctcatttataacactgggagccaagaaaaaggaaaaggtgaagccgaggaaagacgcacacctcttttccattggcgcaatcatgtggcatgttattgcgagagatttcgggcagtctgcagatatcgaatgtctgctgggcatatctaatgagtttataatgctgattgagaaagactccaagaacgtggtcttcaactgctcttgcagggacgtcatcggatggacttctggacttgtaagcatcaaggtgttttatgaaaggggagagtgtgtgcttttgagcagcgttgacaactgcgctgaggatattcgggaaatcgtgcaaagactggtgattgtcaccagaggttgcgagacagtggagatgacattgaggagaaacggactagggcagcttgggtttcacgtcaactttgaggggattgtcgcggacgtggaacccttcgggttcgcttggaaggccggattgcggcaaggcagcaggctcgtcgagatatgtaaagtcgctgtagccacactgacccatgagcagatgatagatctgcttagaacctcagtgacagttaaagtcgtgataatacagccccacgatgacgggtctcccagacgagggtgttccgagctatgtcggatacccatggtggaatataaactcgattctgaaggcactccttgtgaatacaaaacccccttcagacgcaatacaacatggcatcgagtcccaactcccgctcttcaacctttgtctcgggctagtccgatacccggaactccggatagactcccctgccagcagctgctgcagcaggcacaagctgcaatccccaggtccaccagcttcgaccggaaattgcctgacggaactcgttcgagtccttccaaccagtcatcatcatctgaccctggaccaggaggatctggaccttggaggccacaggtcggctatgacggatgccaatcgccactgttactggagcatcagggtagcggtcctttggagtgtgacggcgctagagagcgggaggacaccatggaggcaagtcggcatcccgaaacaaagtggcatgggcctcccagtaaggtgctcggatcctacaaggagcgcgctctccaaaaggacggctcatgcaaggactcaccaaataagctctcacacataggagataagtcgtgttcatctcatagtagtagcaacacgctcagctccaataccagctcaaactctgatgataagcacttcggttccggagatctgatggatcccgaacttctagggcttacatacattaagggtgcttcaacggacagcggcatcgacactgcaccatgtatgcctgctaccatcctcggccctgtccacttggctggatcccgatctctgatacatagtagggccgaacagtgggccgatgcagcggacgtctcaggccctgatgacgagcccgcaaagttgtacagcgtacacggttacgcctctacgatatcagcgggatccgcagccgagggctcaatgggtgatctgagcgaaatatcaagccactcttcggggtcccaccattccggatcccccagcgcccattgttcaaagtcaagcggaagtctggacagtagcaaggtatacattgtgtcccatagttccgggcaacaggtaccaggaagcatgagcaagccttaccataggcaaggcgctgtgaataaatatgtcatagggtggaagaagtcagagggatctcctccaccagaggagcccgaggtcactgagtgcccaggcatgtattctgaaatggacgtaatgtccaccgcaacccagcatcaaacggtcgtcggggatgcggtggctgaaacacaacacgtcctttccaaggaggactttctgaagcttatgttgccggatagcccacttgtggaggaaggcaggcgcaagttcagtttttatggcaatctgtctcctaggagaagtctctatcggaccctgagcgatgagtctatttgcagcaacaggaggggaagttcatttggaagttcacggtctagcgtcctcgaccaggccctgccgaatgacatcctcttctcgaccacaccgccatatcattctaccctgccacctcgcgcacatccagccccaagcatgggcagcctgcggaacgagttttggttttctgacggctctttgtctgataagtcaaaatgtgccgaccccggactcatgcccctaccagacactgctacaggccttgactggacccacttggtggacgccgctcgggcatttgaagggcttgacagcgatgaagaattgggtctgctctgccaccatactagctatctggaccaaagagttgcatccttctgtacactgacggacatgcaacatggccaggacctggagggggcacaggagttgcctctctgcgtggatcccggatcaggaaaggaattcatggacactactggtgaaagaagcccatcacctcttacagggaaggtgaatcagctggaactcatactccggcagctccaaactgacctacggaaggagaagcaggataaggctgtactgcaggccgaggtgcaacaccttagacaagacaacatgagactccaggaggaatctcagacggccacagcccaactgcgaaagttcacagagtggtttttcaccacaatcgacaagaagtcata

SEQ ID NO: 240595 - DNA, 918 bp, Artificial Sequence
  Description of Artificial Sequence: Synthetic coding sequence
atggacccaaagggccttctttccctcaccttcgtgctgtttctatctctcgcatttggcgcatcttacgggacagggggtagaatgatgaactgtccaaagatattgagacagttgggatccaaagtgctattacccctcacatatgaaagaattaacaaaagtatgaacaagagcatccacattgtagtcacaatggcgaaatccttagaaaactcggtggaaaacaagatagtgagcctggatccctcagaagcaggccctccccgatacctaggcgacagatacaagttctatctggaaaatctgactctgggcatcagagaatctcgcaaggaggatgaagggtggtacttgatgaccctcgaaaagaacgtgtccgttcaacgcttctgtctccagcttaggttgtatgaacaggttagcacgccggagattaaggtgctgaataagacgcaggaaaacggaacttgcactctcattctcggttgtaccgtggagaagggcgaccatgtggcctatagttggtccgagaaggccggaacacaccccctgaacccagcgaatagttcacacctgttgagcctcactctgggccctcagcatgccgataacatttatatttgtactgtgagcaaccccatctcgaataattcacagacgttctccccctggcccggatgcagaacagatccttcaggcaagacaaaccactatcaaaccaccgtggaaaaaaagagcctaacaatctacgcccaggtccagaagcccggacctctgcagaaaaagctcgactccttcccggcacaggatccttgtacaaccatatatgtcgccgctaccgaacctgtgcccgaatccgtgcaggagaccaactccattacagtgtacgcttcagtcacgcttcctgagagctag

SEQ ID NO: 240596 - DNA, 1008 bp, Artificial Sequence
  Description of Artificial Sequence: Synthetic coding sequence
atggaccctaaagggctactctcactgacttttgtgctgttcttaagcctggccttcggagcaagttacggcaccgggggtagaatgatgaattgtccaaaaattctgagacagctggggtccaaggtacttctacccctgacatacgaacgcatcaacaagagcatgaataagagcatccatatcgtcgtgacaatggcaaaatccctcgagaattccgtggaaaataaaattgttagtttagacccatcagaagcgggacctcctcggtacctgggggatcgttataagttctacttggaaaacctcactttgggtattcgggagagcagaaaagaggacgaagggtggtacctgatgacactggaaaagaacgtgagtgtacagagattctgcctgcaactgagactctatgagcaagtaagtacacctgagataaaggtactgaacaagacacaagagaatggaacctgcaccctgattctgggatgtaccgtcgagaagggagaccatgtagcttattcatggtctgagaaagctggaacacatcccttgaatcctgcaaattctagccatttgttatcactgacactgggtccgcagcacgcagacaatatctatatatgcactgtttctaacccgatctctaacaattctcagaccttttccccatggccagggtgcagaaccgatcccagcgagactaagccttgggcagtatatgctggcctccttgggggagtcattatgattttgatcatggtcgtgatcctgcagctccgtagaagagggaaaacaaaccattatcagactaccgtagaaaaaaaatctctaaccatctacgcccaggtgcagaagccaggacctcttcaaaagaaactggatagtttcccagcccaggatccatgtactacgatctacgtggctgctacagagcctgtcccagagagtgttcaggaaaccaattcgatcacagtctatgcttctgttaccctgcctgagtcctag

SEQ ID NO: 240597 - DNA, 897 bp, Artificial Sequence
  Description of Artificial Sequence: Synthetic coding sequence
atggaccccaaggggctgctgagcctgacttttgtgctgttcctctcgcttgcattcggagctagctacgggaccggaggacggatgatgaactgtccaaagattctacggcaactaggaagcaaggttctgctgccgctgacttatgaaaggattaacaagtccatgaacaagagcatccacatagtggtgacgatggcgaagtcactggagaatagcgtggagaataagatcgtctccctcgatcctagtgaagctggtcccccacggtacttgggcgaccgatacaagttctatctcgaaaacttaaccctggggatcagagagtccagaaaggaagacgagggctggtaccttatgactctggagaaaaatgtgtcagtgcagcgcttttgccttcagttaaggctttacgagcaagtttccacacccgagataaaagttctgaataagactcaggagaacggaacttgtacgttgatccttggatgcaccgtggagaaaggtgaccacgttgcctacagttggtccgaaaaagccggaacccatcctctcaaccctgcaaactcttctcacttgctgagtctaaccctgggcccacagcacgccgacaatatctatatctgtaccgttagtaatcctataagcaataattcccagaccttctcaccttggccaggctgtcgcaccgatccgtccgaaacaaagccatgggcggtatacgcgggacttctgggtggcgttataatgatccttatcatggttgtcatcctgcaattgcggcgacgagggaaaaccaaccattatcaaacaaccgtggaaaaaaagtccctcaccatttacgcccaggttcagaaacctggcgacagtcaccaccagacttcagacttgttttag

SEQ ID NO: 240598 - DNA, 435 bp, Artificial Sequence
  Description of Artificial Sequence: Synthetic coding sequence
atggatccaaaagggctgctgtcactcacgttcgtgctgttcctaagtctggcgtttggcgcatcctatggcactgggggaagaatgatgaattgccccaaaatcttgagacaactcggctccaaagtgctgttacccctgacatatgagcggatcaacaaatctatgaacaaaagcatccacattgtcgtcacaatggcaaagtccctggagaacagtgtggagaataaaatcgtgtcattggatccatctgaagccggacctccaaggtatctcggtgatcgttacaagttctacctcgagaacctgacactgggtatcagggaatcgcgcaaagaggacgagggttggtatctgatgacgctcgagaaaagtctccatttcggctacctctacttcgtcctcggcgctgaccatgacaacttacagacttag

SEQ ID NO: 240599 - DNA, 810 bp, Artificial Sequence
  Description of Artificial Sequence: Synthetic coding sequence
atggatccaaagggcctgttaagcttaacgttcgtgttgttcctgtctctggcttttggggcttcctatggcacagggggaaggatgatgaattgccccaagattctgcgacagctgggatccaaggtcctgctcccactaacatacgaacgcataaacaagtcaatgaacaaatcgatccacattgtcgtcaccatggctaagagcctggaaaattcagtggagaataagattgtatcactcgatccgtcagaagctggacctcccagatatctcggtgatagatataagttttacctggagaatcttactctggggattcgcgagtctaggaaagaagatgaaggctggtatctaatgacactcgagaagaatgttagcgtacagcggttctgtctgcagctccggttgtacgaacaggtctcgacccctgagattaaagtcctgaacaagacacaggagaatggcacatgcacacttattcttggatgcactgtcgaaaagggtgatcacgtagcgtactcatggtccgaaaaagcgggaacccatcctctcaaccccgcaaacagcagccacctccttagtctgactctgggtcctcagcacgcagacaacatctatatctgtaccgtgtctaaccccatctcaaacaattcccagactttctctccctggcccggttgccgtaccgacccttccgagactaagccctgggctgtatacgcgggactcctaggaggggttatcatgatcttaattatggttgtaatactccagttgcggaggagggccagtagcgaggagacatag

SEQ ID NO: 240600 - DNA, 1029 bp, Artificial Sequence
  Description of Artificial Sequence: Synthetic coding sequence
atgtgctccactatgtccgccccaacctgcctggcccacttacccccttgcttcctcctgcttgctctggtgctcgtgccatccgacgcctcaggacagtctagtcggaatgactggcaagtgctgcagcccgagggccctatgctggtggctgaaggcgagaccctgttgctgcggtgcatggtcgtgggtagttgtacagatgggatgatcaagtgggttaaggtttccacccaagaccagcaagaaatttacaatttcaagcgagggtcattcccgggtgtaatgccaatgattcaaagaacaagtgagccactgaattgtgattattcaatctacattcacaacgtcactagagaacacacagggacctatcactgcgtcaggtttgacggattgtcagaacactctgagatgaagtccgatgaagggacatccgtgctggtgaaaggtgcaggcgatcccgagcccgacctctggataatccagccccaggagttggttctaggaactacgggcgacaccgtgtttctgaattgcactgtgctcggagacgggccacccggtcccatacgctggtttcagggggctgggctttccagggaggcaatctataattttggcggaataagccatcccaaagagacggcggtgcaggcctctaataatgacttctcaatcctcctgcagaacgtgagttccgaggatgcgggaacgtactattgtgtcaagtttcagaggaagccaaacagacagtatctcagcggacagggcacaagcttgaaggttaaggctaaatccacaagctccaaggaggccgaattcacctccgagccagctactgaaatgtctccaactggtctgttggttgtgtttgcacctgtcgtgctgggactcaaagcaatcactctcgcagcgttgctcctcgctttagctacatctcggaggagcccgggacaggaagacgtgaagactaccggacctgccggagcgatgaacaccttagcatggagtaagggacaggagtag

SEQ ID NO: 240601 - DNA, 624 bp, Artificial Sequence
  Description of Artificial Sequence: Synthetic coding sequence
atgtgctccaccatgagcgctcccacttgcttagctcacttacccccatgctttctgttactagcactagtgcttgtcccaagcgatgccagtgggcagagtagccgcaacgactggcaagtgctgcagcctgagggccctatgctggtcgccgaaggggcaggcgatcccgaacctgacttgtggataattcagccacaggagctggtgctaggtaccaccggggacactgtgttcctcaattgcaccgtattaggcgatggcccaccaggccctatccgatggtttcagggtgccggactcagcagagaggcaatctacaactttggaggtatctcacatccgaaggaaaccgccgtgcaagcctccaataacgatttttcaatcctcctgcagaatgtgtcttctgaggatgcaggaacctattactgcgtaaaatttcagaggaagcccaatagacagtatctttctggacaagggacatcattgaaagtgaaggaacagaatctccctctccccaagcggcagaactccccagtcaacttgcagttaagatgcctgcagcaagtctcagtacctacaagcgtggagagtatgtcacccccacaggctcgtggaccttag

SEQ ID NO: 240602 - DNA, 624 bp, Artificial Sequence
  Description of Artificial Sequence: Synthetic coding sequence
atgtgcagcactatgtcagctccaacatgcttggcacatctgcccccttgtttcctgctgctcgctctcgtgctggttccttctgatgcgtccggccaaagctcccgtaatgactggcaagtgctacagccggagggcccaatgctggtggccgagggtgccggtgatcccgaaccggacctatggatcattcagccacaagagctcgtgctcggcacgaccggcgataccgtatttttgaactgcactgtattgggcgacggccctcctggcccaatcaggtggttccagggagctggcctcagtcgagaggccatttacaacttcggcggaataagtcacccaaaggaaactgcagtgcaggcctccaacaatgacttctctatcctactacagaatgtctcctcggaggacgccggaacatactactgtgtcaaattccaacgcaagccaaaccggcagtacctgagcggacagggtacaagccttaaggtcaaagagcagaacctgcctcttcctaagaggcaaaatagcccagtgaatctgcagctacgctgtctgcagcaggtctccgttcccacttcggttgagagcatgtcaccgcctcaagccaggggaccctag

SEQ ID NO: 240603 - DNA, 735 bp, Artificial Sequence
  Description of Artificial Sequence: Synthetic coding sequence
atgtgctccactatgtccgccccaacatgtctggcccacctccctccctgcttccttttgctggctctggtgctcgtgccatccgatgcaagcggtcagtcatctcgaaatgattggcaggtcctacagcccgaagggcctatgctggtggctgagggcgctggggatcccgaacccgacttgtggatcatacagccgcaggagctggtcctcgggaccaccggagacacagtattcctaaattgcactgtcctcggtgacgggccaccgggtcctatccgctggttccagggagctggactgtctcgcgaggccatttacaacttcggcggtatttcacacccaaaagagacggcagttcaggcgtcaaataatgatttcagtattctcctccaaaatgtgagcagcgaagacgccggaacatactactgcgtaaaatttcagaggaagcctaaccggcagtatctgtccggccagggcacctccctcaaagttaaggcaaaaagtacaagttcaaaggaggccgagtttacatccgagcctgccacagagatgagcccaaccgggttactcgtggtgtttgcgcctgtggtcctcgggctgaaggctatcactctggccgcactgctgttggcattagccaccagccggcgatctcccggacaggaggatgttaagactacaggcccagccggtgccatgaacactctagcctggtccaaagggcaggaatag

SEQ ID NO: 240604 - DNA, 633 bp, Artificial Sequence
  Description of Artificial Sequence: Synthetic coding sequence
atgaaatctgatgaaggaaccagtgtgctggtaaagggcgcaggagatcctgagccagatctgtggatcatccagcctcaagagttagtcctgggtacaactggcgacacggtctttttgaactgtaccgtgctgggtgatgggccacccggacctatcaggtggtttcaaggagcaggcttatcccgcgaagccatctataatttcgggggtattagccatcccaaagagactgctgtgcaggcttcgaataatgacttctcaattcttctccaaaatgtgtcatccgaggatgccggtacctattactgcgtgaagttccagaggaaaccaaatcgccaatatctctcggggcagggcacaagtcttaaggtgaaggctaaaagcacaagtagtaaggaggctgagtttacatccgagcccgctacggagatgtcccccacaggggagagaactcatttatcaggggtgaatgaaagtcctactgggaagggcgctatgaacggattagtcatggggagagaacagtctcagactcctggagccaatctgcccccaaggatgctccctggacttcatctcaactgtcgcacccggacacccgaaaaccacgtgataacagcacaattatag

SEQ ID NO: 240605 - DNA, 2046 bp, Artificial Sequence
  Description of Artificial Sequence: Synthetic coding sequence
atgaatgcctccagcgaaggggagagtttcgctggatccgtccagatccctggtgggaccaccgtgctggttgaactcacacctgacatccatatctgcgggatttgtaagcaacagtttaataatctggacgctttcgtggcccacaagcaaagtggttgccagctgacaggaacaagcgcagctgcgccatctaccgtacaatttgtctcagaggaaaccgtgccggcaacccaaactcagaccaccacccgcaccattacgagcgagacccaaactataactgtttctgccccagagttcgtttttgaacatggctatcaaacttatctgcccaccgagagcaatgagaatcagacagccaccgtgatctccctgcccgctaaaagcaggacaaagaaaccaacaactccacctgcccagaagcggctgaactgttgttacccgggttgtcagttcaagacggcgtacggaatgaaggacatggagagacacctgaagatccacacgggagacaagccacacaaatgcgaggtgtgcggtaagtgtttttcaagaaaagacaaactaaagacacacatgaggtgccatactggggtgaagccttataaatgtaaaacttgcgactatgcagccgctgatagcagcagtctcaacaaacacctgaggattcatagcgatgagagaccctttaaatgccaaatctgcccttacgcgtctaggaatagctcacaattgacggtacacttgcggtctcatacaggggatgcaccgttccagtgctggctgtgcagtgccaagttcaagatctccagcgatctcaaacggcatatgagagttcactccggcgagaagccgtttaaatgtgagttctgcaacgtgcgctgtaccatgaagggaaacttaaaaagtcatatacgcataaagcattccgggaacaatttcaagtgtccacactgcgattttttgggcgattcaaaagcgactctgagaaaacactcaagagtgcaccaatccgagcacccggagaaatgcagtgaatgtagttattcctgtagcagcaaggctgctttaagaattcatgaacggatccactgcactgatcggccattcaaatgtaactattgtagtttcgacaccaagcaaccctctaacctatctaaacacatgaagaaattccacggtgacatggtgaagaccgaggccctggaacgcaaagatactggtaggcagagcagccgccaggtggcaaagctggatgctaagaagtctttccactgcgacatatgcgacgcttcctttatgagagaggactcacttaggtcacataaacgccaacacagcgaatatagtgagtccaagaattcagacgtgacagttttacagttccagattgaccctagcaagcagccagccaccccactgaccgtgggtcacctgcaggtgccgctgcaaccctcgcaggtgccccagtttagtgagggccgtgtgaagattatcgtgggacaccaggttccccaggccaataccatcgtccaagctgcggcagccgcagtaaatattgtaccacctgcacttgtcgcccaaaatccggaggaactgcctggaaacagtcggctgcagattttgcgacaggtaagccttatcgctcccccacagagcagccgctgcccaagcgaagccggtgctatgacccagccagccgtgctcctcactacccatgagcaaacggatggggcaacactgcaccagaccctgattcctaccgcgtccggagggccacaggaaggttcaggcaaccaaacctttatcacttcatccggtatcacctgcacagattttgagggtctgaatgccctcatacaagagggcactgccgaagttaccgttgtgtctgatggcggtcagaatattgcagttgccacaaccgctcctcccgtcttttctagttcatctcagcaagaactacctaagcagacctattcaataatccagggggcagcccaccctgctctgctttgtccagctgactccattccggactag

SEQ ID NO: 240606 - DNA, 1164 bp, Artificial Sequence
  Description of Artificial Sequence: Synthetic coding sequence
atgccagtgccggcaagctggccgcaccctcctggcccttttttactccttacactgttgctcggtctgacagaagttgcaggagaagaggagctgcagatgatccagccagaaaagctgttactagtgacggtgggcaagactgcaacactccactgtaccgtaacttcactactgccagttggacctgtgctgtggttccgaggtgtggggcctggccgagagctcatatacaatcaaaaggaaggccatttcccaagggtaacaaccgtatctgacctgacgaagaggaataacatggacttcagtatacgaatctcatccataactcccgctgacgtcggtacctattattgtgtaaaattcaggaagggcagccccgagaacgtggaatttaaaagcggccctggaactgagatggccctgggggctaagcccagcgcccctgtggtactgggccctgccgctcgcactacccctgaacacactgtgagctttacatgtgagagccacggcttctctccgagagacatcactctgaaatggtttaagaacgggaatgagttgtctgacttccagaccaacgtggaccctacaggccagagtgtcgcgtatagcatccggtccaccgccagggtggtgctagacccctgggacgtccggagtcaagttatctgtgaggtggcacatgtgaccctccagggggatccgctccgtggtacggcaaacctgtccgaagctattcgagtcccccctacactcgaggttacacagcagcccatgcgagtggggaatcaggtgaacgtcacgtgtcaggtaaggaaattctaccctcaatccttacagcttacgtggtccgagaacggcaatgtgtgtcagcgggaaacagcctctacgctcaccgagaataaagacggcacatataattggacttcctggtttttggtgaatatttccgatcagagggatgatgtggttttgacttgtcaagtaaagcacgacggtcagcttgccgtgtccaagagactggctctggaggtcactgtgcaccagaaagatcaatcctcagatgcaactccgggacccgcttcatcactcactgcacttcttctgattgccgtgttactgggacccatctacgtaccttggaaacagaagacatag

SEQ ID NO: 240607 - DNA, 513 bp, Artificial Sequence
  Description of Artificial Sequence: Synthetic coding sequence
atgcctgtacccgcatcctggccccatccacccggaccattcctgttactgaccctcctcctcggattaaccgaagttgccggagaggaggaactacagatgatacaaccggaaaagctcttgttagttacggtgggaaaaaccgccacactacactgcacagttacatccctgctgcccgtgggaccagttctttggttcagaggcgtcggtcccggaagggagctcatatataatcagaaggaaggacactttcctagagtgactacagtcagcgacctgaccaagcgcaacaacatggatttcagcatacgcatttcttctattacccctgcggatgtcggaacatactattgcgtcaagttccgcaaaggttcgcctgagaacgtcgagttcaagagtggcccaggcaccgagatggctctgggtgggccagcgagctcattgaccgctctccttcttattgcagtcctcctcggacccatttacgtaccctggaaacaaaagacctag

SEQ ID NO: 240608 - DNA, 1065 bp, Artificial Sequence
  Description of Artificial Sequence: Synthetic coding sequence
atgatccagccggaaaagttactgctggttaccgtcggcaaaacggcaactctacactgtactgtgacttctctgttaccagttgggcctgtgctgtggttcagaggagtggggcctgggagggaactcatctataaccaaaaagaagggcattttccacgggtgactaccgtcagcgacctcaccaagcggaataacatggacttttcaatacgcataagtagtatcacaccagccgatgtgggcacctactactgtgttaagttccgtaagggaagcccagaaaacgttgaattcaagagcggcccaggaactgaaatggcacttggagccaaaccatctgctcccgtcgtcctcggacccgctgccagaaccacccctgagcatacggtgagtttcacttgtgagtcccacgggttctcgccaagagatatcacccttaagtggtttaagaacggtaacgagctgtccgattttcagacaaacgtcgaccccacaggccaatctgtggcgtactccatacgctctacggcgcgagtggtccttgacccttgggatgtaagatctcaagtcatctgcgaggttgcccacgttactctgcagggggaccctcttcgagggacagctaacctttctgaggcgattagagtgccacccactctggaagtgactcagcagcctatgcgggttggaaaccaagtgaacgtgacgtgccaagtcaggaaattctacccccagtctcttcagttgacgtggtccgaaaatgggaatgtatgccaaagggagaccgcaagcactctcaccgaaaacaaggatggcacctacaactggacgagctggtttctggtgaatatttcagaccaacgcgacgacgtcgttctgacttgtcaggtgaaacatgatggccaactggccgtgtcgaagcggctggcactcgaagtgacagttcatcagaaggatcaatcttctgacgccacgcccggtcctgcctccagcttaaccgccctcctactcatcgcagttctgttagggccaatatacgtcccctggaagcagaagacctag

SEQ ID NO: 240609 - DNA, 831 bp, Artificial Sequence
  Description of Artificial Sequence: Synthetic coding sequence
atgccagtccccgcatcttggccccatcctcctggcccatttctgctgcttactctcttgctgggcctgaccgaggtagcgggagaggaagagctccagatgatccagcccgaaaaactgctcctcgtgactgtcgggaagaccgccacacttcattgcacagtgacctcattactgcccgttggtcctgtgctttggtttagaggcgtggggcctggccgagagcttatatataatcaaaaagagggccacttcccgcgagtaacaaccgtttctgatctaaccaagagaaataacatggatttcagcataagaattagcagcatcacccccgcagacgtgggtacgtattactgcgtgaagttccgaaagggctccccggagaatgttgaatttaagtctggccctggtacagaaatggcactaggcgctaagccctcagccccagtggtgctgggacctgccgctagaactacccccgagcacacagtgagctttacttgtgagtctcacggtttttctccgagggacataacacttaaatggtttaaaaacgggaacgaactgtcagactttcaaacaaacgtcgatcctaccggacagagcgtcgcttattcgattcgatctacggccagggtcgttctggacccatgggacgtgcgctcacaagtgatttgcgaagtcgcccatgtgactctccaaggggaccccctgagaggcacagcgaatttgtccgaggcgatccgaggcccagcatcctcccttaccgcactgctgctgatcgccgtgttgctaggcccaatttacgtcccatggaagcagaaaacttag

SEQ ID NO: 240610 - DNA, 1386 bp, Artificial Sequence
  Description of Artificial Sequence: Synthetic coding sequence
atggccccacagagtctaccaagttcacgcatggcccctctggggatgctgctggggctgctcatggctgcctgtttcaccttttgtctttctcaccagaacctgaaggagttcgccttgaccaaccccgaaaagtctagtacaaaagagaccgagcgcaaggagaccaaggccgaggaagagctggacgctgaggttctggaagtgttccacccaacacatgagtggcaagcactccagccgggtcaagcagtgcccgctggcagtcacgtgaggctcaatctgcagaccggggagcgagaggcaaaacttcagtatgaagacaagtttcgtaacaacctgaagggaaaacgcttggacataaacactaatacctatactagtcaggatctcaaaagcgccctggctaagttcaaagaaggcgctgaaatggaaagtagtaaagaggataaagcgcgtcaggctgaggtaaaaagattgttcagacctattgaggagcttaagaaggactttgatgagctgaacgtggtgatcgagacggacatgcagatcatggtgcggttgatcaataagtttaacagtagctcctcatcacttgaggagaaaatcgcggcactattcgatttggagtattatgtgcaccagatggacaacgctcaagatctgctgagctttggaggactacaggtcgtaataaacgggctgaacagcactgagccgctggtgaaggagtatgctgccttcgtgctcggcgcagccttctcctcaaaccccaaggtgcaggttgaagccattgagggaggagctctccagaagctgctggttattctggccactgaacagcctcttactgccaagaagaaggtgctttttgccttatgtagcctgctcagacatttcccctacgcacagcgacagttcctgaaattggggggacttcaagttctccgcacactcgtccaagagaagggcacggaggtgctggccgtgcgagtggtgaccctgttgtatgacctggtgaccgaaaagatgttcgctgaagaagaagctgaactgacccaggagatgagccctgaaaaactccagcagtatcgccaagtacacctgctgccgggtttgtgggaacaaggctggtgcgaaatcacagcccacctgctggctttaccagagcatgatgccagagaaaaagtgctccagactttgggggtactgctcaccacctgcagagacagatatcgacaagatccacaactgggccgaacactggcctccctgcaggccgagtatcaggtgctagcttcactcgagttacaggacggagaggacgaggggtattttcaggagctattggggtcagttaacagtctgcttaaagaactacggtag

SEQ ID NO: 240611 - DNA, 1386 bp, Artificial Sequence
  Description of Artificial Sequence: Synthetic coding sequence
atggcaccccaaagtctgccgtcatctagaatggcacccctcggtatgctcctggggctgcttatggctgcatgctttaccttttgcctgagtcaccagaacctcaaggagttcgctctgacgaatccggaaaaatcttcaacgaaggaaactgagagaaaagaaacaaaggcagaggaggagttagacgccgaagtcctggaagtgtttcatcctacgcacgaatggcaggcgctccaaccaggccaagcagtcccagccggttcacacgtgcgccttaatctccagacaggagagcgggaagccaagctgcagtacgaggataaattccgtaataaccttaaaggcaagcggcttgacatcaacactaacacttacacatcccaggatctgaagtctgcccttgctaagtttaaagagggagccgagatggaaagtagcaaggaggataaagctaggcaagctgaggttaaaaggttgtttcgcccaatcgaggagttgaagaaagatttcgacgagttgaatgtggtcatcgagacagatatgcagattatggtccgtcttatcaataaattcaatagctcttcatcaagtctggaggagaaaattgcagcactctttgacttggagtattacgtgcatcagatggataacgctcaggaccttctgtctttcggcggtctgcaggtggtcataaatggtctgaactcaaccgaaccactagtcaaagaatatgccgcattcgtcctgggagcagcattctcctcaaacccaaaagtgcaggtcgaggctatcgagggtggtgcgctgcagaagctgctagtcatcttggcaacagagcagcctttaactgcgaagaagaaggtgctctttgccctgtgctcactgttgcgccactttccctatgcccagaggcagttcttaaagctcggaggattacaggttctgagaactctggtgcaggagaaaggcaccgaggtgttagcagtgagggtcgtgacactgttatatgacctagtcacggagaagatgtttgccgaggaggaagctgaactgacccaggagatgagcccagaaaagcttcagcaataccggcaggtgcacttgcttccaggcctgtgggagcaaggctggtgcgagatcaccgcccatctgcttgcactgccagagcacgatgctcgagaaaaagtactccagacacttggagtcctgctaacaacatgtcgggatcggtatcgacaggacccacaactcgggagaacccttgcgtccctccaggctgaatatcaagttctggcttcccttgaactgcaggatggtgaggacgagggatatttccaggagctcctgggaagcgtgaattcactgctaaaggaacttcggtag

SEQ ID NO: 240612 - DNA, 288 bp, Artificial Sequence
  Description of Artificial Sequence: Synthetic coding sequence
atggcccctcaaagtctgccctccagcagaatggcgccactgggaatgcttttggggctgctgatggcagcttgtttcaccttttgcctgtcccaccaaaatctgaaagagtttgcacttacaaaccccgaaaagtctagcaccaaagagacagagcgaaaggaaaccaaagcggaggaggagctcgacgcagaggtgctggaagtgttccaccctactcatgaatggcaggccctgcagccaggccaagctgtgcccgcaggatcccacgtgcgactgaacctctag

SEQ ID NO: 240613 - DNA, 492 bp, Artificial Sequence
  Description of Artificial Sequence: Synthetic coding sequence
atggcacctcagtccctgccgtcctcccgtatggcgcctctggggatgctgcttggcttgctcatggcagcctgcttcactttctgcctgtcacaccagaacttaaaagagtttgcattaacaaaccccgagaaatctagtacaaaagagactgaaagaaaggaaacaaaagctgaggaggagctcgacgccgaggtgctggaggttttccaccctacacacgagtggcaggcattacagccgggtcaggccgttcctgctggctctcatgtccgtctgaatctacagaccggtgaaagggaggcgaaactccaatatgaagataagtttcgcaataacctgaaaggtaaacgccttgatatcaacacgaacacctatacatcccaagatttaaaatccgctctcgcgaaatttaaagagggagcggagatggagtcgtcaaaagaagataaggcccgtcaggccgaggtgaaaagactcttccggccttag

SEQ ID NO: 240614 - DNA, 372 bp, Artificial Sequence
  Description of Artificial Sequence: Synthetic coding sequence
atggccccacaatctctccctagctccaggatggcccctctgggtatgctgctcggcttgttaatggcagcctgctttacattctgtttgtctcatcaaaacctgaaggaattcgcactaaccaatccagaaaaatcttctaccaaggagacggaaagaaaggaaacgaaggccgaggaggagcttgatgccgaggtgctggaggtattccaccctacccacgaatggcaggcgctgcagcccggacaggctgtaccagccggaagtcacgttagactgaatctccagacaggcgaaagggaggcaaaactacaatacgaggataaatttcggaacaatctgaaaggcaagcgcttggacattaatacgtag

SEQ ID NO: 240615 - DNA, 579 bp, Artificial Sequence
  Description of Artificial Sequence: Synthetic coding sequence
atggcagcatgctttactttctgcctgtctcaccagaacttgaaggagttcgcacttactaatcccgagaaatctagtacaaaggaaaccgagagaaaagagactaaagcagaggaagagttggatgccgaggtgctcgaagtgtttcatcctacgcatgagtggcaggccctgcaaccgggtcaggcggtacccgctggatcccatgtgaggttgaacctgcagaccggcgagagagaggccaaactgcaatatgaagacaagttccgcaacaatttaaaaggtaagagattagacatcaatacgaacacgtataccagccaggacttgaaatccgccctggccaagtttaaagagggtgctgagatggaatcctccaaggaggataagatggataacgcccaggaccttctatcattcggtggcttgcaagtcgtaattaacggtctaaacagcacagagcccttagtcaaggagtacgccgcttttgtgctgggcgctgcattctcttccaaccctaaggtacaagtcgaggccatcgaaggtggggcattacagaagttgctcgtgattttgtag

SEQ ID NO: 240616 - DNA, 3822 bp, Artificial Sequence
  Description of Artificial Sequence: Synthetic coding sequence
atgaaaagacgcctcgatgaccaggaatctcctgtgtatgcggcacagcaacggcgaattccgggaagcacagaagctttccctcatcaacaccgggttctcgccccagctccccctgtctatgaagctgtctctgagactatgcagtccgcaactggaattcaatattcagtgaccccgtcctaccaggtgagcgctatgcctcagagctccgggtcgcatggtcctgcgatcgctgcagtccacagttctcatcaccaccccaccgcagtgcagccacacgggggtcaggtggttcagagccacgcccatcccgcacctccagtggcccctgtgcagggccagcagcaatttcagaggctcaaggtggaagatgctctttcctacttagaccaggttaagctgcagttcgggtcacaaccacaggtttacaacgattttctggacattatgaaagaattcaagtctcagtcaatcgatacaccaggcgttatttcaagggtcagtcagctgttcaaagggcatccagatttgatcatggggtttaacacgttcctgcctcccggttacaaaatcgaagtgcagactaacgacatggttaatgtcaccaccccaggacaagtccatcaaattccaacacatggcatccagccccagccgcagcctccaccacagcaccccagccagccttctgcccagagtgccccagcacccgctcagccggcaccccagccaccacccgcaaaggtttccaagcccagtcagttgcaagcccacacccccgcttcacagcagaccccaccccttcctccatatgcaagtccacgatcaccaccggttcagccacacacacccgtcacaatctcactcggcacagccccttccctccagaataaccaaccagtcgaattcaaccacgctatcaactatgtcaataaaattaagaatcgatttcagggccaacccgatatctataaagctttcttggagatcttgcatacttaccaaaaggagcagcgcaacgcaaaagaggccggaggcaactacactcctgcccttactgagcaggaggtttacgcccaagtggctcggctcttcaaaaatcaggaggatctgttgtcagagttcggccagttcctgccagacgcgaattcaagtgtgttactgagtaagacaacggccgaaaaagttgattccgtgcggaacgatcatgggggtacagtgaaaaaaccccaactgaacaataagccacaaaggccaagtcaaaatggctgccagatacgcaggcacccaacagggactacaccccctgtgaaaaagaagcccaaactgctaaacctcaaggactcctctatggctgatgccagtaaacacgggggagggacggagtctctctttttcgataaagttcgaaaggcactgcggtcagctgaagcttacgagaactttctgcggtgcctcgtgatctttaaccaggaggtcatatctcgggctgaactggtccagttagtgagccccttcctgggcaaattccctgagctattcaactggttcaagaattttctaggatacaaagaaagtgtccacctggagacttatccaaaggagcgtgctacggagggaatcgccatggaaattgactatgcttcgtgtaagaggcttgggagttcctacagagcgcttccgaagtcctaccagcagcccaagtgcacgggacgcacccctctgtgcaaagaggtcctgaacgatacctgggtttccttcccttcctggagcgaagactccacttttgtgagttccaagaagactcaatacgaagagcacatctacagatgcgaggacgagaggttcgaactggacgtggtgttggaaactaatctggcaactatcagggtgctggaggctattcaaaagaaactgagtagattaagtgccgaagaacaagccaagttccgtctcgataacacccttggtgggacgtccgaagtgattcaccggaaagctcttcaacgtatctacgctgataaagctgctgacattattgacgggttgcgaaagaatccctccatcgccgtgcccatcgtcctcaaacgactgaaaatgaaggaggaggagtggagggaagcccaacgcggattcaacaaggtctggcgagaacagaatgagaagtattatctgaagagcctcgaccatcagggtataaacttcaagcagaacgacacgaaagtcctgaggtccaagtcactgctcaatgagatagaatcaatttacgatgaaaggcaggaacaagcgactgaagagaatgccggagtgccagtcggcccacacctgtctctagcatacgaggataaacagatcctggaggatgccgctgcattaataatccatcatgtaaagcggcaaaccggaatccaaaaagaggacaagtacaaaattaagcagatcatgcatcactttatacctgatctgctgtttgcccaacggggtgacctgtctgacgtggaagaggaagaggaggaggagatggacgtggacgaggccacaggagccgtcaaaaaacacaatggcgtgggtgggagcccacccaaatcaaagttgcttttcagcaatactgctgctcaaaagctgcgaggcatggatgaggtatacaatctgttctacgttaacaacaactggtatatttttatgcgcctgcaccagatcctgtgtctaagactgctgcggatctgctctcaggcagagcgacagattgaggaggagaacagggagcgggagtgggagcgagaggtgctgggtatcaagcgggataaatcagactcccccgcaattcagcttaggctcaaggaacctatggatgtcgacgttgaggattactacccagcattcctggacatggtgcgaagcctgctggacggcaatattgattcatctcagtatgaagactccttaagggaaatgttcacgattcatgcttacatcgctttcaccatggacaaactcatccagtccattgtgcggcaacttcagcacattgtcagcgatgagatctgtgtgcaagtaacagatctatacctggctgagaacaataacggcgctaccgggggtcagttgaacactcaaaattcaaggtctctgctcgaatcgacctatcaacgtaaagccgagcagctgatgtcagacgaaaactgctttaaactaatgttcattcaaagccaggggcaggttcaacttactatcgagctcctcgatacagaggaggagaactccgacgaccctgtggaggccgagcggtggtccgactacgtggaaagatatatgaacagcgatacaacaagcccggaattacgcgagcacctggcacagaagcctgtgtttctacctaggaatctgcggagaattcggaagtgtcagcgtggacgagaacagcaggagaaggaaggaaaggaggggaattcaaagaagactatggagaacgttgactctctggacaaacttgagtgtagatttaagcttaatagttacaaaatggtgtacgtcattaagtctgaagactacatgtataggcggacagccctcctgcgggctcaccagagccacgagagagtaagcaagaggctccaccagcggtttcaggcatgggtggataagtggacaaaagagcatgtgcctcgcgagatggcggcagagactagcaaatggttgatgggggaggggctagagggtctggtaccatgcacgacgacctgtgataccgagactcttcattttgtgtccattaacaagtatagagtgaagtatggcacagtctttaaagctccatag

SEQ ID NO: 240617 - DNA, 3822 bp, Artificial Sequence
  Description of Artificial Sequence: Synthetic coding sequence
atgaagcgtcgccttgacgaccaagaaagtcccgtttacgcagctcagcaacgcagaatcccagggtcaaccgaagctttccctcaccagcacagggttctggctccggctccgcctgtgtacgaggccgtgtcagagacaatgcagtccgccaccggcattcagtattccgtaacaccaagttaccaggttagcgcgatgccacagagtagcgggagccacggccctgccatcgcggcagtacacagttcccatcaccaccctactgccgttcagcctcacggaggtcaggtggtacaaagccatgcacaccccgcacccccagtcgccccagtgcaggggcagcaacagtttcagaggttaaaggtagaggacgccctgtcctaccttgaccaggttaagctgcagttcggcagccaaccccaggtatacaacgactttttggatattatgaaagagttcaagtcccagtccatagacacaccaggggtaatttcacgcgtgtctcagctctttaaagggcatcctgatctgataatggggttcaacacattcttgcccccagggtataagattgaagttcagaccaatgatatggtgaatgtaaccactcccggacaggtccatcaaatccctacacacggtattcagcctcaaccacagcccccaccccagcacccctcccaacccagcgcccagtccgcgcctgccccagctcagccagctccccagcccccaccggcaaaagtttcaaaaccctcacagttgcaggcccatactcctgcttctcagcagactccacccctaccaccctatgcctctccacgttcacctccagttcagccgcacacgcctgtaaccatcagtctcggtacagcgccatctcttcagaataaccagcccgtcgagtttaatcatgccatcaactacgtaaacaaaattaaaaaccgatttcagggccagccagatatttacaaagcctttctggaaattctccacacctaccaaaaggagcagaggaatgccaaagaggccggtgggaactatacccccgcacttactgagcaggaagtctatgcgcaggttgctcgtctgttcaaaaatcaggaagatctcttgagtgagtttgggcagtttcttcccgatgcaaattcaagcgtgctgctgtctaagacaacagccgaaaaggtggatagcgtacggaacgaccacggcggtactgttaagaaaccacaactcaacaataaacctcagcgcccttcgcagaatggttgtcagattcgtcgtcaccctacagggaccacccccccagttaagaagaaacctaagctgctcaatctgaaagactcttctatggcggatgccagcaaacacggtgggggaacggaatctttgttctttgacaaggttcggaaggcgctgcggagcgcagaggcctacgagaatttcctgagatgtctggtaatcttcaatcaggaggtgatcagcagagccgagctggtgcaactggtaagcccatttctcgggaaattcccagagcttttcaactggtttaagaacttcctggggtataaagagagtgtgcatttggagacttacccaaaggaaagggccaccgaaggaatagccatggagattgactatgcttcatgtaaacggttagggtccagctatcgagccctccctaaatcttatcagcagcctaagtgtaccgggagaacgcccctgtgcaaagaagtcttaaacgatacctgggtgtcatttccatcctggtcagaagattctacttttgtttcctccaagaaaacacagtatgaggagcatatataccgatgcgaggacgagcgctttgagctggacgtcgttctcgagaccaatctggcaacgatccgcgtgctggaggcgattcagaagaagttgtctagattatctgctgaagaacaggctaaattcagactagacaataccctcggcggaacatcagaagtgatccatcgcaaggcactgcaaaggatctacgctgacaaggccgctgacataatcgacgggttgcggaaaaaccccagcatagccgttccaatagtgctaaaaaggctcaagatgaaggaagaagagtggagagaggcccagcgcggattcaacaaagtctggagggagcagaatgagaagtactacctgaaatcactcgatcaccaaggcatcaactttaagcagaacgatacgaaggtgctgaggtctaaatcacttcttaatgagatcgaatctatttatgacgagaggcaggagcaggcaacagaagaaaacgctggagtacctgtggggcctcacctgagtctggcctatgaagataaacaaattttggaggatgccgcagctcttatcatccaccacgtgaagcgtcagactggtattcagaaggaggacaagtacaagattaagcaaattatgcatcacttcatacctgacctgctatttgcccagcgcggtgacttaagcgacgtcgaggaagaagaagaagaagaaatggacgtggatgaagccacaggcgcagtgaaaaaacacaatggcgtgggtggatcccccccaaagagcaaactattgttttctaataccgccgcacagaagctcaggggcatggacgaggtatacaacctgttctatgttaataataattggtatatcttcatgagactgcaccagatcttgtgcctacggctgctgcgtatctgtagtcaggctgaaaggcagatcgaagaggaaaatagagagcgggagtgggaacgggaagtcctcggcataaaacgggacaaatctgattcaccagccatccagttgaggttgaaagaaccgatggatgtggatgtggaggattactaccccgcttttctcgacatggtgcgctccctgctggacggcaatatcgattcttcacagtatgaagacagcctgagagagatgtttacgattcatgcctacattgctttcactatggataaacttatccaaagcattgttcgccagctacagcacatcgtctcagacgagatttgcgtacaggtgaccgacctttaccttgcggaaaacaataatggggctactgggggtcagctcaacacccagaactcaagatccctgctggagagcacataccagagaaaagccgagcaacttatgagcgacgaaaattgctttaagcttatgttcatccagtcgcagggccaggtgcagctaaccatcgagttactggataccgaagaggagaacagcgatgatcctgtcgaagccgagcgttggagtgactacgtcgaaaggtacatgaattctgacaccacgtcacccgaactgcgcgagcaccttgctcaaaagccagtgtttctccccagaaacttacggagaattagaaaatgtcaaagaggacgcgaacagcaggagaaggaaggaaaggagggcaatagcaagaagaccatggaaaatgtggattcgctggataaactcgagtgtcggtttaagctgaacagctataagatggtgtacgtcatcaaatccgaagactatatgtacagacggacggccttgctacgcgctcaccagtcacacgaacgagtatccaagcgtcttcaccagaggttccaggcttgggtggacaaatggacaaaagaacatgtgccaagggagatggcagccgagacctctaaatggctgatgggggagggtctggagggactcgtcccatgcacgaccacatgtgacacagagactctacatttcgtcagtattaacaaatatagggttaagtacggcacagtgtttaaggcaccatag

SEQ ID NO: 240618 - DNA, 3822 bp, Artificial Sequence
  Description of Artificial Sequence: Synthetic coding sequence
atgaagagacgcctcgacgaccaggaatctcccgtgtacgcggcacaacaaaggcgcatacctggatccactgaagcgttcccccatcagcatcgggttctggcgcctgctccacccgtatatgaggctgtgtcagaaacgatgcaatccgcaaccggaatacaatattctgtcaccccctcttatcaggtgtccgccatgccacaatccagcggaagccatgggcctgcaatcgccgctgtgcattcttcgcatcatcaccctaccgccgtgcagccacacggaggtcaggtcgttcagtcccatgcacacccagccccacctgtcgcgcctgtccagggtcaacagcaatttcagcgcctcaaagtcgaagatgctctttcatatttggatcaagtgaagctccagtttgggtctcagccacaggtttacaacgacttcctcgacattatgaaagagttcaaatctcagtcaatagacacccccggagtcatatctcgggtttctcagctgttcaaagggcaccccgacctgatcatgggttttaacaccttccttcctcccggatacaaaattgaggttcagactaatgatatggtcaacgtcacgacacctgggcaggtgcatcaaattccaacccatggcattcaacctcagccacagccccctcctcaacaccctagtcagccttcagcccagtccgctcccgctccggctcagccagctccccaaccccctccagcgaaggtttccaaacccagtcaactacaggcacacaccccagcctcccagcaaactcctcctctgccaccgtatgcttcacctcggtccccacctgtacaaccccacacacccgtcacaatcagtctggggaccgccccaagcctgcaaaataaccagccggttgaattcaatcatgccatcaactacgttaataaaataaaaaataggtttcagggccagcctgacatttacaaagctttcctcgagatactacacacctaccagaaagagcagaggaacgcaaaggaggccggtgggaactatactccagccctgactgaacaagaagtgtacgcacaggttgcccgtctgtttaagaatcaggaggacctcctcagcgaattcggccagttccttccagatgcgaatagcagtgtgcttctgagcaagaccaccgctgagaaagttgattctgttcgaaatgatcacggtggtacagtcaagaaaccccaactgaacaataagcctcagaggccttcgcagaatggatgtcagattcgaagacatccgacgggcacaactccacctgtgaaaaaaaagcccaagctgttgaatctcaaggatagttccatggcagatgctagtaagcatgggggaggcaccgaaagcctgttctttgataaagtcaggaaggcgctgcgaagtgcagaggcctatgagaactttctgagatgcctggttatctttaatcaggaggttatctcaagggcagaactggtccaactcgtgtctccattccttggcaagtttccagaactctttaattggtttaagaatttccttggatataaagaaagcgtgcatctggaaacatacccaaaagagcgtgcgacggagggcatcgccatggagatcgactatgcttcttgcaaaaggcttggcagttcataccgtgctctccctaagagctaccagcaaccaaagtgtaccggacggactccattgtgtaaagaagttctcaacgatacatgggtcagttttccatcttggtctgaggacagtacctttgtatcatcaaaaaagacccagtacgaagagcatatctataggtgtgaagacgagcgatttgagctcgatgtggtgttggaaacaaatttagcaaccattcgggtgcttgaagctatccagaagaagctctcaaggctgtccgctgaggagcaggccaaatttcgcctagacaacacacttgggggtacatctgaggtcattcaccggaaggctctgcagcgcatctacgcagacaaggccgctgacattatcgacggcctgaggaagaatcccagcattgccgttccgattgtgctgaaaaggctcaaaatgaaagaggaggagtggagagaggcccagcggggattcaacaaggtgtggagggagcagaatgagaagtactacctcaagtctttggatcaccaagggattaatttcaagcagaacgacacaaaggtcctgaggagcaaaagcctgctcaatgagatcgaaagtatttacgatgaacggcaggaacaggctacagaggagaacgccggtgttcctgtcggcccacatctgtccctcgcttacgaggacaaacagatactggaggatgccgctgctctgatcatccaccacgtgaagcgccagactgggatccagaaagaggataaatataaaattaagcagatcatgcaccacttcattccagatttgctctttgctcagcgcggtgacctctcggatgtggaggaagaagaggaagaagagatggacgtggatgaggcaaccggcgctgtgaaaaagcacaacggggtcgggggtagtcctcctaaatcaaagcttctctttagcaatactgccgcacagaaactccgaggaatggacgaggtgtataatctcttttacgtgaataacaattggtatattttcatgcgactacaccagatattatgcctcagactactcagaatctgctcccaggcagaaaggcagatcgaggaggaaaatagagagcgggagtgggaacgggaagtcctagggatcaagagagacaaatctgattctccagcaattcagttgagattgaaagagccgatggacgtggatgttgaagactactacccagccttcctggatatggtgcgctccctgctggacgggaatatagattcctctcagtatgaagacagcctgcgggaaatgtttactatccacgcttatatagccttcacaatggataaactgattcagtccattgtgaggcaactgcaacatattgttagcgatgagatttgcgttcaagtaacggacctttatcttgccgagaataacaacggagccacgggtgggcagcttaacactcagaattcccgcagcctcctggaatccacgtatcagagaaaagccgaacaactgatgtccgacgaaaattgcttcaagctaatgttcattcaatctcaaggccaggtgcagcttacaatcgaacttttggacactgaagaagagaactctgatgaccctgtggaggccgaaaggtggagtgattacgtggagcgctatatgaattctgacaccaccagcccagagctgagagaacatctcgcacagaagcctgtgttcctccccagaaacctgcgtcgtattcgaaagtgtcagcggggacgggaacagcaggagaaagaagggaaagagggcaactccaaaaaaacgatggagaacgtcgatagcctggataagctggagtgtagattcaagctgaattcatacaaaatggtgtatgtcatcaagtcagaggactatatgtatcgcagaacagcactcttgcgcgcacaccaaagccacgaaagagtatctaagaggctgcatcagagattccaggcatgggtcgataagtggaccaaagaacatgtccccagagagatggctgcagagacgtctaagtggttgatgggagagggactggaaggactcgtaccctgtaccacgacctgcgatacagagactctccatttcgtgtcgatcaacaaatatagggttaaatacggcacagtgttcaaggctccatag

SEQ ID NO: 240619 - DNA, 3393 bp, Artificial Sequence
  Description of Artificial Sequence: Synthetic coding sequence
atggctcatgccggaggcggttccggtgggtccggagctggtggcccagctggtcgtggtttatcaggagctagatggggtcggagtgggagtgccggacacgagaagctgccagtgcacgtagaagacgccttgacttatctggaccaggtgaagatccgctttggctctgatccggcaacttacaatggtttcctggagatcatgaaggagttcaagtcacagtccatcgacacccctggggtcattaggcgtgtatcccaattattccatgagcaccctgatttaattgttggcttcaacgccttcttgcccttgggctacaggatagacatccccaaaaacggcaaactaaatatccagtctcccttaacttctcaggagaatagtcacaaccatggcgatggagctgaggatttcaagcagcaggtgccttacaaggaggacaagcctcaggttccactcgaaagtgactctgtggagttcaacaacgctatttcttacgttaataaaataaaaactcgattcctggaccaccccgagatttacagatctttcctagagattcttcatacttaccaaaaagaacagcttaacacaagaggaagaccattccggggaatgtcagaagaggaggtgttcaccgaagtcgctaacttgttcagaggacaggaagatctgctgagtgaatttggtcagtttcttccagaagccaaaaggtctctttttaccggaaacggaccctgtgagatgcactcagtccagaagaatgagcacgataagactccagagcacagcaggaaacggagccggccaagtctgctgcggccagtcagcgcccctgcgaagaagaagatgaagctgagggggacaaaggacttgtccattgccgcagtcgggaaatatggcactctgcaggagttcagttttttcgataaagtcagacgcgtgcttaagagccaggaggtgtacgaaaatttcctgaggtgtatcgctctcttcaatcaggagttggtgagcggaagcgaactcctccagcttgtgtcaccgttccttggaaagttccccgaactcttcgcccagtttaagagttttctgggcgtgaaagaactctcatttgcaccacctatgtcagaccgcagcggagacggaatttctcgagaaattgactatgctagttgcaaacgtatcggctcatcctacagggccctgccaaagacctaccagcagcctaaatgcagcggacggaccgccatctgcaaggaagtcttaaatgacacttgggttagcttcccatcttggtccgaggactctaccttcgtttcaagtaaaaaaacaccgtatgaggaacagttgcatcgctgtgaggacgagcgattcgagctagacgtggtgttagagactaacctcgctacaatccgcgttcttgagtccgtgcagaaaaaactgtcaagaatggctcccgaggaccaggagaagtttagactggacgactcccttggaggtacatcagaagtaattcagcgcagagccatttacagaatctacggcgacaaggctcccgaaatcatcgaatcactgaaaaaaaatcccgtgacagccgttccagtcgtgctcaaacgtctgaaagcaaaagaagaggagtggagagaagctcagcagggcttcaataaaatttggcgcgaacagtacgagaaagcttatctgaagagccttgatcaccaggcagttaactttaaacagaatgacaccaaagctcttagatcaaaatcactgctgaacgagatcgagagcgtgtatgacgagcatcaggagcaacatagtgaggggaggtctgcaccatcaagtgaaccacaccttatctttgtttacgaggaccggcaaatattggaggacgctgcagctctcattagctattatgtgaaacggcaacctgccattcaaaaagaagaccagggcacaatccaccagctcctgcaccaattcgttcccagcctgtttttctcgcaacagctggacctcggcgctagtgaggagagcgccgatgaagatcgcgatagtcctcaggggcaaacaacagatccatctgaaagaaagaaaccagcccctggaccacattccagtccaccagaggaaaaaggtgcctttggagatgcccctgccaccgaacagccgcctctgcctcctccagcacctcataaacctctggatgacgtctattccttattcttcgccaataacaattggtacttcttcctgagactgcaccagactctgtgctcacggctactcaagatctaccggcaggcccagaagcagctgctggagtacagaaccgagaaggagcgcgaaaagctgctgtgcgaggggcgacgggagaaaggcagtgaccccgctatggagctcaggctgaaacagcctagtgaagtggagttggaggaatattatcccgcatttctagatatggtccggagcctccttgaaggctccatcgaccccacacaatacgaggatactctgcgggagatgttcactatacacgcctatgtcgggtttaccatggacaagcttgttcagaatatagcacgtcagctgcaccacctcgtttctgatgatgtttgtctcaaggtggtagagctgtacctcaacgaaaaaaaacggggagccgctggcggtaacctctccagccgatgtgtgcgcgcagcccgagaaacttcctatcagtggaaagcggagcgatgtatggcagacgagaactgttttaaggtgatgtttctccagcgaaaaggtcaagtgatcatgacaattgaactgctcgatactgaagaagctcagaccgaagatcccgttgaggtccagcatttagcccgatacgttgaacaatacgtcggaacagaaggggcatcttcctcacctacggaaggctttctcctgaagccagtctttctgcaacggaatttaaaaaaattccgcaggagatggcagtcggagcaggccagggcgctgcggggagaagccagatcgtcttggaagagattggttggcgtggaaagcgcctgtgatgtcgactgccgcttcaagctgtccacacacaagatggtgtttatcgtaaattcagaagactatatgtacagaagaggaacgctctgccgcgctaagcaggtccagcctttggtgcttttgcgtcatcatcagcactttgaggagtggcactccaggtggctagaagataatgtcacggtagaagctgcttcactagttcaggactggctcatgggtgaggaggatgaagatatggttccatgtaaaactctgtgtgagactgtccatgtccacggcctcccggtgacgaggtaccgagtccaatactctcgaagaccagctagtccctag

SEQ ID NO: 240620 - DNA, 3489 bp, Artificial Sequence
  Description of Artificial Sequence: Synthetic coding sequence
atggcacatgctgggggtgggtccgggggaagtggcgcaggagggccagccggacgcggattgtctggcgctaggtgggggaggagtggatctgccggacatgagaagctgccagttcacgttgaagacgcactgacctaccttgatcaggtgaaaattcgcttcggtagcgatccggctacttataatggattcctagaaataatgaaggagttcaagagtcagtcaatcgatacccctggcgtgatcaggcgggtaagccagctcttccacgaacatcctgatttaatcgtagggttcaacgcattcctacccctcggataccggatcgacattccaaaaaacgggaagctgaacattcagagccccttgacctcacaagagaatagtcacaaccatggcgatggagcagaagactttaagcagcaggtaccttacaaagaggacaagccgcaggttccactcgaatctgactccgtggagttcaataacgccatcagctatgtgaataaaattaagaccagattccttgaccaccctgagatctacaggagctttcttgagattctgcacacctaccagaaggaacagcttaatactcgcggtaggcccttccggggaatgagcgaagaggaagtttttaccgaagtggctaatctctttagagggcaagaagaccttctttcagaatttggccagtttctccccgaggccaagcggtcccttttcacaggaaacggaccttgcgagatgcactcggtccaaaaaaatgagcacgacaagacgccagagcacagccggaagcgcagccgcccttccttgctgagacccgtttcagcgccagccaaaaagaaaatgaaactgcggggtaccaaggatttgagtattgctgcagtcggtaagtacggaacactgcaagaattttctttctttgacaaagtgcgcagagtactaaagagccaggaagtgtatgaaaatttcctgcggtgcatcgctctattcaatcaggaactggtaagcggcagcgagctgctccagttagtgtctcccttcttagggaaatttccggaactgttcgcacagttcaagtcattcctgggggtgaaggaactgagcttcgcacctcccatgagcgacagaagcggagacgggatatcccgcgagatcgattacgcttcctgcaagaggattggaagcagttatcgtgctctgcccaagacctaccaacagcccaagtgcagcgggcgaactgcaatttgtaaagagctggaccactggaccctgctgcagggctcctggacagacgactattgtatgagcaaattcaagaacacttgctggatccccggttattccgcaggggttttgaacgatacctgggtgtcttttcccagttggtccgaagattcaaccttcgtgagttctaagaagaccccgtatgaggaacagctgcacagatgtgaagacgagcgatttgagcttgacgtggtcctggagaccaacttggccacaatccgggtgctcgaaagcgtccagaagaagctatcccgaatggctcctgaagaccaggaaaagttccggctcgatgactcactcggtgggacctcagaggtcattcagaggagagcgatatatagaatctacggtgataaggcaccagagattatcgaatcactgaagaagaaccctgttactgccgtgccagtggtgctgaaacgccttaaagccaaggaagaggagtggcgcgaagcccagcaaggcttcaataaaatatggagagaacagtacgagaaggcctacttgaagagcctggatcaccaggccgtgaattttaaacagaatgatactaaggcccttcggtctaagagtcttctaaatgaaattgagagcgtctacgatgaacaccaagagcagcatagcgaaggacgctcagcacctagtagcgaacctcacttgatctttgtctacgaggataggcagattctggaggacgcggctgccctgatctcatattacgtaaagagacagccagccatccagaaggaagatcaaggaacgatacatcagctactgcatcagtttgtcccatcactattcttctcgcagcagctcgaccttggggcttcagaagaaagcgcagatgaggaccgcgactcaccccagggacagaccaccgacccttccgagcggaagaagcctgctcccggtcctcacagctcaccccctgaagagaagggagccttcggggacgctcctgccaccgagcaaccacccctgccaccccctgctcctcataagccgctggacgacgtctactccctcttctttgctaacaacaattggtactttttccttagattgcaccagactctgtgttccaggctgctgaagatttacaggcaggcccagaaacagcttttagagtacaggacagaaaaagagagagaaaagctgttgtgcgagggacgtagggaaaaaggctccgaccctgcaatggaattgcgcctcaaacaaccatccgaggttgagctagaggaatactatcccgctttcctcgacatggtgaggagcctacttgagggaagcatcgaccccacacagtatgaggatacccttagagaaatgtttaccatacatgcttatgtcgggttcaccatggacaagctcgtgcaaaatatcgccagacagctccaccatctggtcagcgatgacgtctgccttaaggtcgtcgaactttatctcaatgaaaaaaagcgaggagccgctggtgggaatctgagttctaggtgtgtaagggctgctcgcgagacatcatatcagtggaaagcggaaaggtgcatggctgatgaaaactgcttcaaggtgatgttcctccaacggaaggggcaagtcataatgactatcgagcttctggacaccgaggaggctcaaactgaggacccagtagaagtccaacacctggctagatatgtggagcagtatgtggggaccgaaggcgcatcttcaagcccaacggaaggatttctactaaagcctgtgtttctgcagaggaatcttaaaaaattcagaaggagatggcaatcggaacaggccagagcgttgagaggggaggcaagaagctcatggaagcgtttagtcggcgtcgaatccgcctgtgacgtggattgtcgcttcaaactttctacccacaaaatggtgttcatcgtgaacagcgaggattatatgtatagacggggtaccctctgcagggcaaaacaggtgcagccactagtgctgctgcgtcaccaccagcatttcgaagaatggcactcgagatggctggaggacaacgtgactgtggaggccgctagtctcgtacaggactggctaatgggtgaggaggatgaggacatggtcccctgcaagacattgtgtgagacagtgcacgtgcacggactgcctgtgaccagatatcgggttcaatacagccggagacccgcatcaccatag

SEQ ID NO: 240621 - DNA, 3171 bp, Artificial Sequence
  Description of Artificial Sequence: Synthetic coding sequence
atgtcatcccagcagtttcccagacttggggcaccgagtactgggctgtcacaagcccctagccagatcgcaaacagcggtagtgccggacttattaatccagccgctacagtgaacgatgagtccgggagagatagcgaggtctcagcgagggagcatatgtcttcttcctcctcgcttcagagtagggaggagaaacaagagcccgtggttgtgcggccatatcctcaggtgcagatgttatccactcatcacgccgtggcaagcgctacaccagtggcggtgacagcaccacctgcccacctgaccccagctgtacctctgtcgttcagcgagggactgatgaaacctccccctaagcccactatgccctccaggcccatagcgccagctcctccctcgacactctccctcccacccaaagtgccgggtcaggtcactgtcactatggaatcctctataccccaagcgtctgccattcctgtcgccacaattagtggacagcaggggcacccttccaacctgcaccatataatgacaacaaatgttcagatgagcatcattaggtcaaacgcccctggccctcccttgcacatcggggctagccacctacctaggggagcagccgctgctgcggttatgagctcaagtaaagtgaccacagtcctgcggccaacatcacaactgcccaatgcggcaacagcccagcctgccgtccagcatatcattcatcagcccatccaatcccggccacccgtgacaacgtccaatgcaattccacccgcagtggtggcaactgtatctgccacacgggcacagtctccagtcatcacaactactgccgcacacgccaccgactccgccctctcccgtcccactttgtctatccaacatccaccaagcgcagctatttctatccagaggcccgcacagtccagagacgtgacaactcgcatcacactaccctcacaccccgctcttggcaccccaaaacagcagcttcatacaatggctcagaaaaccatcttttctacgggtactcctgttgcggcagcaacagtggcccctatcttggccaccaataccatcccttcagcaacaaccgcagggagcgtctcccatacccaggcacccaccagcactatcgtcacaatgacagtgccatcgcattcttcacacgccacggcggtgacaacttcgaacatccccgtggccaaagtggtcccccaacagataacccatacctccccccgaatacagccggattaccctgccgaaaggagtagtctcatccccatcagtgggcaccgcgcaagcccgaacccagttgccatggagacccgttcagacaaccgtccctcagtcccagtgcagtttcagtatttcttaccaacataccccccatccgcctatccactggcggcacacacttacacccctatcaccagcagtgtgtcgacaatccgccagtacccagtgtctgcacaagccccaaacagtgcaattacggcacagacgggcgtgggcgtggcttctactgttcatctgaaccctatgcagcttatgaccgtcgacgctagccatgccaggcacatccagggaatacaacccgcaccgatctctactcagggcatccagccagcaccaatcggaacccccggtatccagcccgcacctctaggtactcagggtattcactctgcgacccccataaacacccagggactccagcccgcaccaatgggtactcagcagccacaacctgaaggaaaaacgagcgtggtgctagcagacggagccaccatagtagccaacccgatttcaaatcccttttcggctgcacccgcagcaaccaccgtggtgcagacccatagtcagtccgcaagcaccaacgctccagcccaaggttccagcccccgaccaagtattttgaggaagaaacccgcaaccgatgggatggccgtgcggaagacacttattcctccccagccaccagatgtagcttcccctagggtagaaagttccatgagatccactagcgggtctcctaggccagcgggagccaaaccaaagagcgaaatacacgtgagcatggccaccccagttaccgtttcaatggaaacggtgagcaatcagaataacgatcagcctacaattgctgtgccaccgacagcacagcagcccccacccaccatccctactatgatcgctgcggcatctccaccttcccagcctgccgtggccctaagcaccatacctggagctgttccaatcacgccccctatcacaacaattgccgcagctcccccacctagcgttacagtaggtggatccctctcttccgttttaggacctccagtgcccgagataaaggtgaaggaagaagtagagccgatggacatcatgcgacccgtgagcgctgtacctccactggcgacaaacacggtgtcccccagtctagctcttctggcgaataatcttagcatgccaacaagtgacctgcccccaggggcttcaccacgaaagaagcccaggaaacaacagcacgttatctccaccgaagagggagacatgatggagactaatagcactgacgatgagaaaagcaccgctaaatctctgctggtaaaggccgaaaaacgaaagtctcccccaaaggagtacatagacgaagagggcgtaagatacgtccctgtgcgccctaggccccctattactcttctgaggcactataggaatccttggaaagcagcctaccatcactttcagagatacagtgatgttcgcgtcaaggaggaaaagaaggccatgctgcaggagatcgccaatcaaaaaggcgtgtcctgcagggcgcaaggctggaaagtccacctttgtgcagctcaacttctgcagcttacgaacttggagcacgacgtgtacgagagattgacaaacctccaggaaggcatcatccccaagaaaaaggctgctacagatgatgacctgcaccgtataaacgaattaatccagggaaacatgcaaaggtgtaagctcgtgatggaccagatatctgaggctcgagattcaatgcttaaggttttagaccataaagaccgcgtgctgaaattgctgaacaaaaatgggactgtcaagaaggtgagcaaattgaagagaaaggaaaaggtgtag

SEQ ID NO: 240622 - DNA, 3147 bp, Artificial Sequence
  Description of Artificial Sequence: Synthetic coding sequence
atgggccctcctcgacatcctcaggccggtgagatagaagccggtggcgcaggcggtggaagacggctacaagtggagatgtcaagtcagcagtttcctaggttgggagcccctagcacgggtttatcccaggcaccaagccagattgccaatagcggctcagctgggcttattaatccagccgctacagttaacgatgaaagcgggagagactcagaagtcagcgcaagagaacatatgagctccagctctagcctccagtcaagagaggagaaacaggagcctgtcgtcgtccggccataccctcaagtgcagatgttgtcaacccatcacgccgtcgcgagcgccaccccggtggctgttacagcaccacctgcacatctcaccccagcagttcccctcagcttcagcgagggtcttatgaagcccccacctaagccaaccatgcccagtaggcccattgcacctgcccctccctcgacacttagcctgcccccaaaggtgcctggccaggtgaccgttactatggaaagctccattccccaggccagtgctataccagtagcaacgatcagcggacagcaggggcaccccagcaacctccatcatatcatgaccactaatgtgcagatgtctatcataagaagtaacgcacctgggcctcccctccacattggggcatctcatctgcctaggggtgctgctgccgcagccgtgatgtcttcttcaaaggtgacaacagtgttacgcccaacgtctcagctgccaaatgccgctacagcacagccggcagtgcagcatattattcaccaacccatccagagccgacctcctgtgacaacttcaaacgctattcctcctgcagtggttgctacagtgtccgccaccagggcgcaatctcctgttattacgacgacagccgcacacgcaacggactctgccttatcaagacctaccctgagcatccaacacccaccctctgccgctattagtatccagcgccctgcgcagtctagagacgtcacaacccgaataaccctcccatctcatcccgcactcggcacacctaaacaacagctgcacacgatggcccaaaaaactatattctctacgggcacaccagtggctgcggcaactgtcgccccaatcctcgctacgaacacaatcccctccgctactaccgcaggctcagtgagtcacacacaagccccaacatcaactatagtgacaatgacagttccgtcccattcatcgcacgcgacagccgtgacaacctccaacattccagtcgccaaagtggtgcctcagcagatcacgcatacttcaccccgaatacagccagactacccagccgaacgatcatccctgatcccaatctcaggccaccgtgcctctcccaacccagtcgctatggaaacgcggtctgataaccggcctagcgtgccagtgcagtttcagtattttctgcctacgtacccgccaagtgcttaccccctggcagcccatacgtatacgcccattacttcctccgtgtctacgatccggcaatacccagtatccgcacaggccccaaattcagccatcacagctcaaaccggagtgggggtagcatccaccgtgcacctgaatcccatgcagcttatgactgtggacgccagccacgctcggcacattcagggaatacagccggctcctatcagtactcaggggatccagcccgcacctatcgggactccaggcattcagccggctcctctcggtacccagggcatccatagcgcaacccctatcaacacacagggactacagccggcacccatgggcacgcagcaaccgcagccagagggcaagacctcggctgtagtgttggctgacggtgcgactatcgtggcaaaccctatatccaaccccttcagcgctgcccctgcagcgaccacagtcgttcagacacatagccagtccgcttccactaacgccccagcgcaggggtcatcgccccgaccaagcatcctgcgcaagaagccggctaccgatggggctaaacccaaaagtgagatacacgtgtctatggccacgccagtgacggtgtcaatggagactgtttccaatcagaataacgaccagccaactattgctgtcccacccacagcacagcagcccccacccacaatcccaaccatgatagcagccgcatcccctccgtcccagccggcagttgctttgtctacgatcccgggagctgtaccgatcacgccaccaatcactacaattgcagccgcaccacctccgtcagtcaccgtcggcggttctttatcttcagtcctcggccctcctgtcccagagataaaagtgaaggaggaagtagaacccatggacataatgagacctgtatctgccgtgccaccgttagctactaataccgtgtccccgtccctggccctgctggctaacaacctgagtatgcccacgagcgacctcccccctggggcttcacccagaaagaaacctcgcaagcaacagcacgtgatctcaacagaggaaggtgacatgatggaaaccaatagtaccgatgacgagaaatcgaccgcaaaatcattattagtgaaggccgagaaaaggaaaagccctccgaaagagtatatcgatgaggagggcgtccggtatgtgccagtgcgtcctagaccccctatcaccctgctgcgccattatcgaaatccgtggaaggccgcatatcatcatttccagagatattctgatgttcgggttaaggaggaaaaaaaagccatgttgcaggagatcgccaatcagaaaggggtgtcctgtcgcgcacagggctggaaagtgcatttatgcgccgctcagctgttgcagcttaccaatcttgagcacgatgtgtacgaaagactcaccaatcttcaagaaggcataatcccaaagaaaaaggcagccacggacgatgacctccaccgcattaatgagttaatacaaggcaacatgcagcgttgcaagcttgtcatggatcaaatctccgaggccagagacagtatgctgaaggtgctcgaccataaagatcgggttcttaaacttctgaataagaatgggaccgttaagaaggtatcaaaactgaagcggaaggagaaagtgtag

SEQ ID NO: 240623 - DNA, 3252 bp, Artificial Sequence
  Description of Artificial Sequence: Synthetic coding sequence
atgggaccaccaaggcatccacaggcaggcgaaatagaggcaggcggagctgggggtggtaggcggcttcaggtggagatgagttcccaacagttcccgagactgggtgccccatctaccggcttatctcaggcaccctcccaaattgctaactccggatctgctggtctaatcaatcccgctgccactgtaaatgatgaatctggaagagacagcgaggtcagcgcgcgagaacatatgtcgtcgtcttcatcgttacagagtagagaagaaaaacaggagcctgtggtggttaggccatatccacaggtgcaaatgttgtctacgcaccatgccgtggctagcgcgacccctgtggccgttaccgctccaccggcacaccttaccccagccgtccccttaagcttcagcgagggcttgatgaagccccctcccaaaccaaccatgccaagtcgcccaatcgcccctgccccaccatccaccctatcacttccaccaaaggtgcccggacaagtgactgtcacaatggagagcagtattccccaggctagtgcaatccctgtggcaacaatcagtggccagcagggccacccgtccaatcttcaccacatcatgaccaccaatgttcaaatgtctatcatcagatccaatgccccagggcctcccctccatattggagccagccatttgcccaggggagccgcagcagccgcagtcatgtcaagctccaaagtgactactgtcctccggccaaccagccagttgccgaatgccgcaactgcacagcctgccgtccagcacatcatccatcagcctattcagagccggcctcctgtaaccacctcaaacgccattcctccggcagtcgtcgccacagtttctgcgaccagagctcaatctccagtgatcaccaccacagccgctcatgcgaccgacagtgctctgtcaagaccaaccttatcgattcagcacccccctagcgccgctatttccattcaacgaccagcccagtcgagggacgtgaccacgcgcatcaccctgccctcacatccggctctcggtacgcccaagcagcagctccacaccatggctcagaagaccatcttttctaccggaacacccgtggctgctgccaccgtggccccaatcctggccacaaacaccatcccctcagccacaacagccggtagtgtttcacatactcaagctccgacaagcacaattgtcactatgactgttcccagtcattcgtcgcatgccaccgccgtcaccacatccaacattccagtagccaaagttgtcccacagcagataactcatacctcgccaaggatacagcccgattaccctgcagagagatcctccctgattcccatttccggccatcgggcatctccgaatcctgtcgccatggagacccgcagtgataacaggccatcagtccctgtgcagttccagtatttcttacccacgtacccaccatccgcatacccgttggcagcccacacatatacacccattacaagtagcgtgtctaccattaggcagtaccccgtatccgctcaggccccaaattccgccatcacagcgcagactggcgtaggggtcgcatccacagttcacctcaaccctatgcagctcatgacagtcgacgcttcgcacgctaggcatattcaaggaattcagccagcccctatcagtactcagggaatccaaccagcccctataggtacacctgggatacagcccgctcccctcggcactcaggggatccattcagccacacccatcaatacacagggactccagcccgctccaatgggcacccagcagcctcagccggagggcaagacctccgccgtggtgctcgctgatggcgcaacaatagtggccaaccccatatccaatccgttctcagcagcgccagctgctacgacagttgttcagactcattcccagtctgcctcgacaaatgctccagctcaggggtcttccccaagaccctctattctgcgcaagaagcccgctacggacggcatggcagtgcgcaagaccttaatacctccccagccccctgacgtggccagccctagggtggagtcctcaatgcgctctacctctggaagccctcggcctgcaggcgcaaagccaaagtccgagatccacgtgtcaatggctacgcctgtgaccgtgagcatggagactgtaagcaaccagaacaatgatcagcccacaattgccgtaccccctactgcacagcagccgccacctaccatcccaactatgatcgccgcagcctcgcctccttctcagcccgcagtggccttgtcgaccatcccgggagctgtgccgataaccccaccaatcactactattgccgcagcacccccaccttccgtcactgtgggcggttctctgtccagcgtgctggggccacccgtgccagagattaaggtcaaggaagaggtcgagcctatggatatcatgagacccgtaagcgctgtaccaccgctggctacaaacactgtcagcccctcattagctctgctcgccaacaacttgtctatgcccacatccgacctgccccctggcgctagtcctagaaagaagccacgcaagcaacagcatgttatcagcaccgaagagggggacatgatggaaaccaacagcaccgatgacgagaaatctaccgctaaatcactacttgtaaaggccgagaagcggaagagtcctcccaaggaatatattgatgaggagggagttcggtacgttccagtgaggcccagacccccaatcaccttgttgagacattatcggaacccatggaaggcagcctatcaccatttccaacgctactcggatgtgcgcgtcaaggaagaaaagaaagccatgttacaagagatcgcaaaccagaagggagtaagctgtcgggcacaaggttggaaggtccatctttgtgcggctcagttactgcaactgacgaatctcgagcacgacgtttatgagagacttacaaatctgcaggagggcatcattcccaagaagaaagcagctacagatgatgacctgcatcgaattaatgaacttattcaaggcaacatgcagcgttgcaagttggtcatggaccagatttccgaggcccgagattccatgctgaaggtgctcgaccacaaggaccgagtgctgaagttgcttaacaaaaacggcacggtgaagaaggtgtctaagcttaaaagaaaagagaaagtctag

SEQ ID NO: 240624 - DNA, 789 bp, Artificial Sequence
  Description of Artificial Sequence: Synthetic coding sequence
atgagcagccaacagttcccacgccttggtgccccatcgaccggactgagtcaggctccttcacaaatcgccaatagcggctccgccggtttgatcaatcccgcagcaacagtaaacgatgagtccggccgagatagtgaagtttccgcccgagagcatatgtccagctctagtagcctgcagtccagggaagagaagcaggaaccagttgtggtccggccatacccccaggtgcagatgctgagcacccaccacgctgttgcttccgctacccccgtggcagtgactgcacccccagcccatctaactcctgccgtgcctttaagcttcagcgagggcctaatgaagccccctccaaaacctaccatgccaagcaggcccatagcccctgctcctccaagcacactctcactgccacctaaggtgccaggccaggttactgtgactatggaatcctcaatcccacaggccagtgccattccagtggccaccatctccggccagcagggccacccgtcaaacctgcatcacatcatgacaaccaacgtacaaatgtcaataatacggtctaacgcccctggtcccccacttcatatcggcgcatcccacttgcctcgaggcgctgccgctgcagccgtaatgagctcgtccaaagtaaccacagtattacggccaaccagtcaactgcccaacgctgcaactgcccagcctgccgtgcagcacatcatccaccaaccaatccaaagtaggcccccagttacaacatccaatgctatccccccagcttag

SEQ ID NO: 240625 - DNA, 630 bp, Artificial Sequence
  Description of Artificial Sequence: Synthetic coding sequence
atgaatcccagcatgaaacagaaacaggaggagataaaagagaacataaagaattctagtgtgcccaggagaactcttaaaatgattcagcctagcgcatcaggctctctagtgggaagagaaaacgagctgtctgccggtctgtccaagagaaaacatagaaatgatcatctgacaagtaccaccagttctccaggcgtcattgtgcccgagagcagcgaaaacaagaacctcggaggggtgacccaagaatcttttgacttgatgattaaggaaaatccatcgagccagtactggaaagaggtcgcagaaaaaagaagaaaggcactctacgaggctctgaaagaaaacgagaagctgcataaggagattgaacagaaggataatgagatagcaagattgaagaaagagaataaggagctggcggaggtggcggagcatgtgcagtatatggcagagctaattgaacgattgaacggagaacctctcgataatttcgagagcttagataatcaggaatttgactctgaggaagagaccgttgaggactctctcgtggaagattctgagatcgggacttgcgctgaagggacggtgtccagtagcacagacgctaaaccttgcatttag

SEQ ID NO: 240626 - DNA, 2622 bp, Artificial Sequence
  Description of Artificial Sequence: Synthetic coding sequence
atggccgaaatggagaaggagggacggccaccagagaataaacgatcacgtaaacccgctcacccggtcaagagagagattaacgaggagatgaagaactttgctgagaacacaatgaatgaattactcggatggtacggttatgacaaagtggagctgaaagatggagaagatattgagtttagatcataccccaccgatggagaatccaggcagcatatcagtgttctgaaggagaactcactgccgaaacctaagctgcctgaagactctgtcatttccccatataacattagcaccggatattcagggctagcgactggaaatggcctttcggattctcccgctgggtccaaggatcacggcagcgtgcctattatcgttccgctgattccgcctcctttcataaaacctcccgcagaagacgatgtgtctaatgttcagattatgtgtgcgtggtgccagaaggtgggtattaagagatattccctctccatgggaagcgaagtgaagagtttctgtagcgagaaatgtttcgccgcatgccgtagggcctacttcaagcgaaataaggccagggacgaggacgggcacgccgagaatttccctcagcaacactacgccaaggaaactccacggctagctttcaagaacaactgcgagctgctggtgtgcgattggtgcaagcacatacgccacactaaagaatatctggattttggggatggggagcggaggttacaattctgtagcgccaagtgcttgaatcagtacaaaatggatattttctataaagaaacacaagccaacctgcccgcaggcttgtgctcgaccttgcatcctcccatggaaaataaggccgagggcaccggcgtccagctgctgactccagactcatggaatatccccctcactgatgctaggcggaaagcaccttctccagtcgctacggcagggcagtcgcagggacctggcccttctgcctcaactacagtatcccctagcgacaccgctaactgtagtgtcaccaaaatacccacacccgttccgaaaagtatccctatatcagaaacccctaatatcccaccggtgagtgttcagcccccagccagcattggcccaccactcggggtgccccctagatctccccctatggttatgaccaatcgcggtccagtgcccctgcccatctttatggaacaacagatcatgcagcagataaggcccccattcattagagggcctccccatcacgcatccaatcctaatagccccttgtccaacccaatgctgccaggcattgggcctccgcctgggggtcctagaaacctcgggcctacatctagcccaatgcatagacccatgctcagtccccacattcacccaccaagcacgcccacaatgcctggtaacccccctggtctgttgccaccaccaccacccggagccccactgccctccctcccgtttccgccagtcagcatgatgcctaatgggccaatgcccgtgcctcagatgatgaattttgggttaccctctcttgctcctctcgtcccgccacccacccttctggtcccttatccggtcatagtgcctctaccggtgccgatacctataccaatcccaatcccacatgtctcagattcaaagccccctaatggatttagcagtaatggggaaaacttcatcccgaatgcccctggggattctgccgctgctggcggaaagccttccgggcactctctgtctcctcgggacagcaaacaagggtcatcgaaaagtgcagatagcccaccaggctgtagcggacaggccttatcactggcacccacccctgccgaacatggcaggtccgaagtggttgatttgaccagacgggcaggcagcccgccaggccctcctggtgctggcggacagttgggattccctggggttctgcagggacctcaggatggcgtgatcgaccttactgttggccacagggccaggctgcacaatgtgatccaccgcgctctccacgcccacgtaaaagccgagcgggaacctagtgccgctgagcggcgaacctgtgggggatgcagggatggtcactgcagtcctcccgcagccggtgatcctggcccaggagctccagcagggccagaagcagctgcggcatgcaatgtgatagtgaatggaactagaggcgctgcagctgagggagcgaagagtgcagagcctcctcccgagcagcctccacccccaccccctccagccccacccaaaaaactactgagccccgaggaacccgcagtgtctgagttggagagcgttaaagagaacaattgtgcctccaactgtcacctggatggagaagcagctaagaaattgatgggggaagaggccctggcaggcggtgacaagtcagatccgaacctaaataacccagccgatgaagaccacgcttatgctttgcggatgcttcctaagacaggatgtgtaatccaaccagtgccaaagcctgccgagaaagctgcaatggccccatgcataatctctagccccatgctgagtgcagggcctgaagacctggagcctccactgaagcggaggtgtttaaggattcgaaatcagaacaaatag

SEQ ID NO: 240627 - DNA, 1233 bp, Artificial Sequence
  Description of Artificial Sequence: Synthetic coding sequence
atgcccggtgtgtgtgaccgggctcctgatttcctgagcccatctgaggaccaggtgctccgacccgcattggggagtagcgtggccctcaattgtactgcatgggtagtctctggtccccattgtagtctcccttccgtgcagtggctgaaagacggtctccccttaggcataggaggccactactcccttcacgaatacagttgggtgaaggccaacctcagcgaagtgctggtctcttccgttctgggggtgaacgtcacttcaactgaggtgtacggcgcattcacatgctctattcagaatatatctttttcttcttttacccttcaacgagccggacccaccagtcacgtggccgcagtgctcgcctcactcttggtactgctggcactcctgctcgcagccctgctgtacgtaaaatgtcggctgaatgtgctactgtggtaccaggacgcctatggtgaagtggagattaacgatgggaagctttatgatgcttacgtgtcctattctgactgccccgaggatcggaagtttgtcaatttcatcctgaagccacagcttgaaaggcgaagagggtataagctatttctggacgatcgcgacctgctccctcgagccgaaccctctgccgacctgttggtgaacctttcccgctgcaggcggcttatcgtggttctttctgatgctttcctgtcccgtgcatggtgctcccattccttccgtgagggtttatgtagactgctggaactgactcgcagacccatcttcattacatttgaagggcaacgtcgggatccagctcatccagcactgcgtctgctgcgacagcatcgtcacctggtgactttgctcctgtggcggcctgggtcagtgacaccctcttcagacttttggaaggaagtacagcttgccctgcctcggaaggtgcagtacagacctgtcgaaggtgatccccagacccaactgcaggacgacaaggaccccatgctgattctgcggggaagagtacccgagggccgtgcactggactcagaggtcgatccagatccagaaggggatctcggtgtgaggggtccggtgtttggcgaaccgagcgcgcctcctcacacctctggagtttcactgggcgaatctagatcctctgaagttgatgtgtccgacttgggcagccgcaactattctgcgagaaccgacttttattgcttggtgtctaaagacgacatgtag

SEQ ID NO: 240628 - DNA, 1515 bp, Artificial Sequence
  Description of Artificial Sequence: Synthetic coding sequence
atgccgggtgtgtgtgatcgcgctccagactttcttagcccctctgaggaccaggtgttacggccagccctcggcagctccgtcgctctgaactgcacagcttgggtggtctcaggaccacactgtagcctgccaagtgtccagtggctgaaagacggacttccactaggcatcggagggcattattcgctgcatgaatattcgtgggtaaaggccaacctatcagaagtgcttgtgtcctccgttcttggggtgaatgtaacgagcacagaggtgtatggggctttcacatgtagtattcagaacatctctttctcatcattcactcttcaaagggccggacctacaagccacgttgcagcagtgttagcatcactgttagtactcctcgcgctgttgctcgccgctttactatacgtgaagtgccgcttgaacgttctgctatggtatcaggacgcatacggggaggtagaaataaacgatggaaagctctatgatgcatatgtgagctactctgactgtcccgaggataggaaatttgtgaacttcatcttgaaaccccagctcgagagaagacgcggatacaaactgtttctcgatgaccgcgatctcctcccccgtgccgagcccagcgctgacctgctggttaatctctctaggtgcaggagacttattgttgtgctgagcgacgcattcctgtcgagggcgtggtgttctcatagcttccgggaggggctctgccggctcctcgaattgacacggagacctatctttattactttcgaaggccaaagaagagatccagcccaccccgcactgagattgctgagacaacaccggcacctagtcaccctgctcctgtggaggccgggaagcgtaacaccttccagcgacttttggaaagaagttcagctggcattgccaagaaaggtgcagtataggcccgtagaaggagaccctcagacccagctgcaggatgataaagatcccatgctgattctacgcggtagggtccctgagggccgagctctggattccgaagtagaccccgaccccgagggggatctgggtatgccagcacagccgcatagtcctacaggtgaggcccaacaccgcgctgaatgggggcaggcacaaggaactggcccagggggagccccaggcgttgaggacagctccaggcatcgtgagcccctgcacggcctatgccctggtggcgctagaccgtcagtctgtctaggcacaagctgggcttcgcaagccattacagccggaggcgagcagggtcaacctctggccgttggcctgggccagggctgcggttggccccctcaggcttccagatccccacacccaagatgccctggcgcatgcttgtggagagctatttcctcaacagcacatcagtggggactcgccggacgggaaccggaacagaggtcaggcaggttggggtcacggctagccaagctccagtgtccacataggctgttgcttccaggtgttcaggggtag

SEQ ID NO: 240629 - DNA, 1233 bp, Artificial Sequence
  Description of Artificial Sequence: Synthetic coding sequence
atgccaggcgtctgcgatcgtgcccctgattttctgtcgccgtctgaggatcaggtcctcagacccgcacttggcagcagtgtggcccttaactgcaccgcttgggtggtgtccggccctcactgttcactccctagtgtgcagtggctcaaggacgggctgcccttgggaatcggtggtcactattctctgcatgagtacagctgggtgaaggccaatctgtccgaggtgctcgtgagtagtgttctgggcgtgaacgtgacttcaaccgaggtgtacggcgctttcacctgcagcatccagaacatttctttctcaagctttacactgcagagggcaggtcctactagccatgtggccgctgtgttggctagcttgctggttctactcgcactgctgctcgccgctctgttgtacgtgaagtgtcggctgaacgtgttgctctggtatcaggatgcatatggtgaagtcgaaataaatgacggcaaattatacgacgcatatgtctcttactctgattgtcccgaggatcgcaagttcgtgaactttatcctcaagccacaactggagcggagacgaggttataagctttttctggatgacagagacttactccctagggcagaaccctctgcagaccttctcgtgaacctgagtaggtgtcggagattaatcgtcgtgttgtccgatgcattcctgagccgggcttggtgtagtcatagttttcgtgaaggcctgtgtaggctgctcgagctgaccagacgccctattttcatcacatttgagggtcagcggagggaccccgctcacccagcactacgtctgctgaggcagcataggcaccttgtgactctgttgctctggagaccaggaagcgtcaccccctcctccgatttttggaaagaagtgcagctggccctcccaaggaaggtgcagtatcgccctgttgagggggacccgcagactcaactgcaggatgacaaggaccctatgttgatattgcgcggtagagtccccgaaggcagggccctagactccgaagtggaccctgacccagagggcgacctgggtgtgagagggccagtctttggagaaccttcagctcctcctcatacatcaggtgtgtccttaggtgagagcagaagcagtgaggtagatgtgtccgacctcggaagtaggaactatagtgccaggacagatttttattgtttggtgtctaaagatgacatgtag

SEQ ID NO: 240630 - DNA, 1233 bp, Artificial Sequence
  Description of Artificial Sequence: Synthetic coding sequence
atgcctggcgtgtgcgacagggcaccagacttcctgtctccttccgaggatcaagttctgagacctgccttagggtcatctgtggctctgaactgtactgcctgggttgtgagcgggccacattgttccttgccctcagtacagtggttgaaagatggattgcccttgggaattggcggacactattcactccacgagtattcctgggttaaggccaacctcagcgaggtgcttgttagtagtgtacttggtgtgaacgtgactagtacggaagtgtatggagcattcacgtgtagtatccagaatatttctttcagctcatttaccctgcagcgcgctggacctacatctcacgtggccgcagttctggcctctctgctcgttctactggcgctgctactcgccgctctgctgtacgtgaagtgtaggcttaatgtcctactgtggtaccaagatgcctatggcgaggtcgagatcaatgatggcaagctgtacgatgcctacgtgagctatagtgactgtccagaagaccggaagtttgtcaattttatccttaagcctcagttggagcggaggcggggttataaacttttcctggacgatcgcgatctcctaccgagagccgagccatcggccgatctgttggtaaatttatccagatgcaggcgactgatcgtcgtcctgtccgacgcctttctttccagagcctggtgtagtcactcatttagggaaggtctctgcagactgctggagcttacgcgacgaccgatattcattacctttgagggccagcgccgtgaccccgcacatcctgctctgcgcctcctgcgccagcatagacacttagtcacgcttctgttatggaggcctggttctgtgaccccatccagcgacttttggaaagaggtgcagctggctcttcctcgcaaggtacagtaccgccctgtggagggcgatccccagacccagctccaggatgacaaagaccccatgctgatcctgagaggacgcgtacccgaaggcagagcgctggacagtgaggtggaccccgatcctgagggtgatcttggagtcaggggcccagtgttcggggaacccagcgccccaccgcacaccagcggagtttcccttggtgagtccaggtccagcgaggtagatgtgagcgacctcgggagcagaaattactctgctcgaacagacttctattgtctagtgtccaaagacgacatgtag

SEQ ID NO: 240631 - DNA, 1515 bp, Artificial Sequence
  Description of Artificial Sequence: Synthetic coding sequence
atgccaggagtgtgcgaccgggctcccgatttcttatcacccagcgaggaccaggtcctaagacccgctttggggagcagcgtggcgcttaactgcaccgcatgggtggtgtctgggccacattgttctctgcctagcgtgcaatggttgaaggacggattgccactcggcataggtgggcattacagcttgcacgagtattcttgggtcaaagccaacctgagtgaggttctggtatctagtgtactgggtgtgaacgtgaccagcacagaggtttacggcgcttttacctgctctatccagaatatcagcttcagcagtttcaccctacagcgggcaggacctacaagccatgtggccgctgtgctggccagcctgctggtcctattggcgttactcctcgcagccctgctgtacgtgaaatgtcggctcaacgtgctcctttggtatcaggacgcctacggcgaggtggaaatcaacgatggaaagctgtacgacgcttatgttagttactctgattgtcccgaggaccggaaattcgtgaattttatactgaagccacagctcgaaaggagaaggggctacaaactgtttctcgacgatagggatctgcttcccagggctgagccgtctgccgacctcctagttaatttaagccgctgccgacgtctgatcgtcgttctgagcgacgccttcctatccagggcgtggtgcagtcactcgttcagagagggcctttgcaggctgctggaattgactaggcgaccgatttttattacttttgaggggcaaaggcgcgatcccgctcaccccgctctaagattgctacgccagcaccgacatctcgttaccctcttactgtggaggcccggaagtgtaactcctagtagcgacttctggaaggaggtacagttagcgcttcctcgtaaggttcagtaccgacctgtggaaggtgacccacagacccaactacaggacgataaggatcccatgctcatccttagggggagagtgcctgagggcagagcgctggattccgaggtcgatcccgaccctgaaggagatcttgggatgcctgcccagccccatagccccaccggagaagcccagcatagggctgaatggggccaggctcaaggcaccggccctgggggtgcacccggagttgaagactcctctaggcacagggagcctttgcacgggctgtgcccgggtggagccagaccctccgtctgtctgggaaccagctgggcaagccaagcaattacagcgggtggcgagcaggggcagcctcttgctgtggggctcggccagggatgtggttggccccctcaggcttcacggtctccacacccgcgttgtcccggtgcgtgcctgtggagagcgatttcctctaccgcccaccagtggggattggctggccgagagcctgaacagaggtcgggtcggctgggcagccgtcttgcaaagctgcagtgtcctcatcggctgctgttgccaggcgtgcagggctag

SEQ ID NO: 240632 - DNA, 1107 bp, Artificial Sequence
  Description of Artificial Sequence: Synthetic coding sequence
atgttcgcaaaagggaaagggtctgctgtcccaagcgacggacaggctagggagaaacttgccctttacgtctatgagtatctactgcacgtcggtgcccagaagagcgcacagacctttctctctgagatccgctgggagaagaatattaccctgggcgaacctcccggtttcctccattcttggtggtgcgtcttttgggatctttactgcgccgcacctgaacgccgtgacacgtgcgagcactcctccgaagctaaagctttccacgactattcagccgctgccgcacccagcccagtgcttggtaacattccccctaatgacggaatgcccggaggtccgatcccaccagggttcttccaggggcctccgggatcgcagccttccccacacgctcagccaccaccacataacccgtcgagtatgatgggcccacactctcagccaccgggaggggtaccaggaacacaacccctgctcccaaactcgatggacccgacacgccagcaaggccaccccaacatggggggttctatgcagcgtatgaatccaccacgaggcatgggcccaatgggccctgggcctcagaactacggctctgggatgcggcctccacctaatagtctgggtcctgctatgccgggtatcaatatgggccctggcgctggaaggccatggccgaaccctaacagcgctaattcgattccttattcctcatcttccccaggcacatacgtgggcccacccggaggaggagggccacctggcaccccaatcatgcctagccctgccgatagcacaaacagcagcgacaacatttatacgatgataaatcctgtaccacccggtggaagccgctcaaacttcccgatggggcctgggagcgacggacctatggggggtatgggcggtatggagcctcaccacatgaatggcagccttgggtctggagacatcgatggactccccaagaatagtccaaacaatatctctggcattagtaaccccccaggcaccccaagagatgacggcgaactgggcggaaactttctgcactcctttcaaaacgataactatagcccttctatgacaatgtccgtatag

SEQ ID NO: 240633 - DNA, 1086 bp, Artificial Sequence
  Description of Artificial Sequence: Synthetic coding sequence
atgttcgctaagggaaagggctccgctgtgccaagcgacggacaggccagagagaaattggcgctctatgtctacgaatacctgcttcacgtgggcgcacaaaaaagcgcacaaacttttttgtctgaaatccgatgggaaaagaatattaccctgggagaacctcccggattcctgcactcctggtggtgtgtgttttgggatctctactgcgcggcacctgagcgtcgagacacttgtgaacacagctctgaggctaaggctttccacgactattccgcagccgcagcccctagccctgtcctgggcaacatcccaccgaatgacggaatgccaggcggaccgattccgccagggttcttccaacccttcatgagccctcggtatgccggaggaccccgtccgccaatacgaatgggaaaccaacctcctgggggagtgccaggaactcagcctttgcttccaaactccatggaccccaccaggcaacaaggacacccaaacatgggcggaagtatgcagcgaatgaatcctccgcgaggtatgggcccaatggggcctggtcctcagaattatggatctgggatgaggccccctcctaacagcctggggccagcgatgcccggaattaatatggggcctggggctggcaggccctggccaaaccccaacagcgcaaactctattccatattcctcctcaagcccgggaacttatgtagggccacctggtgggggaggacctcccggaacaccaatcatgccaagcccagccgacagtaccaactcttctgataacatttacaccatgattaatcctgtccccccagggggatccaggtcaaactttccaatgggaccgggaagcgacggacccatgggtggcatgggaggcatggaacctcatcacatgaatgggtctttgggctctggggatatcgacggtctcccaaagaactcgcctaacaatatttctgggataagcaacccacctggcactccccgtgacgatggggagttgggtggaaacttcctccacagctttcaaaatgacaactattccccctctatgacaatgagtgtgtag

SEQ ID NO: 240634 - DNA, 1167 bp, Artificial Sequence
  Description of Artificial Sequence: Synthetic coding sequence
atgttcgctaaggggaagggctcagcagtgcccagcgacggccaggctcgggagaagcttgccctttacgtatacgaatatcttttacatgtgggagcacagaaaagcgctcagacctttctatcggagatcagatgggaaaagaacatcacgctgggagaaccccctggctttctgcattcctggtggtgcgtgttctgggacctttattgtgcagccccagagagaagggacacctgcgagcactctagtgaagctaaagcctttcatgactattccgctgcggctgcacctagtcccgtacttggaaacatcccgcctaacgacggcatgccaggaggaccaattcctcccggtttttttcagggaccccctggctctcagccctcgccacacgcccagcctccccctcacaatcctagcagcatgatgggacctcactctcaaccattcatgagcccgagatacgcaggcggaccacggcctccaatcaggatgggcaaccagcctcccggaggggtacctggtacccaacccctgcttcccaactccatggatcctacccgtcaacagggacaccccaacatggggggaagcatgcagaggatgaatccccctagaggaatgggacctatgggcccaggaccacagaactatggaagcggaatgagacccccacctaattcattggggccagccatgcctggaataaacatgggtccaggagctggtcggccatggcctaatcctaattctgccaactctatcccttacagcagctctagtccgggtacatacgttggaccaccaggcggaggaggacccccagggacacctatcatgcctagccccgctgatagtaccaactcatctgacaatatctatacaatgattaacccagtgcctcctggcggatcaagaagcaacttccccatggggcctggatccgatggcccaatggggggtatgggaggaatggaaccgcatcatatgaacggttcgcttgggtcaggagacattgacggtctgcctaaaaacagtccgaacaatattagcggcatctcgaacccacctggcacaccacgggacgacggtgagctcggcggtaacttcctgcactctttccaaaatgataactactctcctagcatgacaatgtcagtttag

SEQ ID NO: 240635 - DNA, 837 bp, Artificial Sequence
  Description of Artificial Sequence: Synthetic coding sequence
atgccaggaggacctatacctcctggtttttttcaggggccacccggaagccaaccatcaccccacgcacagccacccccacacaatccctcatccatgatgggaccgcactcacagccgtttatgtcaccgaggtatgcgggaggcccaaggcctccgataaggatgggtaatcaaccacccggaggagtcccaggaacacaaccactgctacccaatagcatggatcccactaggcagcagggacatcctaatatggggggaagtatgcagaggatgaatccacctcggggaatgggccctatggggcctgggcctcagaactacgggagtgggatgagaccgcctccaaatagtctggggcctgccatgcccggtatcaacatgggccctggagccggtcggccttggccaaacccgaatagcgctaatagcataccatactcttccagttcacccggaacttatgtgggccctccaggaggtggtggaccacccggtacaccaattatgccatccccggctgattcaaccaactcttcagacaacatctacacaatgataaaccccgtgccccctggtggctcccgaagtaattttccaatgggccctggatcagacggacccatggggggaatgggtggtatggagccgcaccacatgaacggatctctcggtagcggcgacatcgatggcctgcccaagaattccccaaataatatcagcgggatctctaaccccccaggaacgcctagggacgacggggaactcggcggaaatttcctgcactcattccagaatgacaactactctcctagtatgacaatgtccgtctag

SEQ ID NO: 240636 - DNA, 471 bp, Artificial Sequence
  Description of Artificial Sequence: Synthetic coding sequence
cccccaggcggagttcctggaacccaacccttactccctaattccatggaccctaccagacagcaggggcaccctaacatgggagggagcatgcagcgcatgaatcctccgagggggatgggcccaatggggcctggccctcaaaactacggatcaggtatgcggcctccgcctaactcactggggccagccatgccgggtataaatatgggacccggagctgggaggccatggcctaacccgaattcagcaaattcgatcccatatagcagtagctctcccggaacctacgtgggtcctcctggaggaggcggtcccccaggtaccccaataatgccttctcccgctgacagcacaaactcctcagacaacatttacaccatgataaatcccgtccctcccggagggtcaaggagtaatgtgtccttgctgagcaacaacctccacatccgtcaccataacaagagctag

SEQ ID NO: 240637 - DNA, 1158 bp, Artificial Sequence
  Description of Artificial Sequence: Synthetic coding sequence
atgtacgccaaggggggaaaaggctctgcagtgccatccgactcccaggcgagagagaaactggccctctatgtgtatgagtatttgctccatattggcgcacagaaatcagcacaaacatttctctccgagattaggtgggaaaaaaacatcactctcggtgagcctccaggcttcttacactcttggtggtgtgtgttctgggatctttactgtgcagcaccagacaggcgggaggcatgcgaacactcaggagaggccaaggcttttcaggactactcagctgccgcagccccatcccccgtcatgggtagtatggcgcctggggataccatggccgcagggagcatggccgctggatttttccagggaccccctggctcccaaccgtctccccataacccaaacgcacctatgatgggaccacacgggcaaccattcatgtcccctcgcttccctggcggacctagacctactctgagaatgccatctcagccacccgctggcttgcccggttcccaaccccttctgccaggcgcaatggaaccctctccacgcgctcagggtcaccccagcatggggggtcccatgcagcgagttactccacccagagggatggcctcggtcgggccacagtcctacggcggaggaatgagaccaccacctaactctttggcgggacctggcctgcccgctatgaatatgggacctggcgtcagagggccatgggcatccccttctgggaactctataccttactccagcagctccccaggcagctacacaggccctcccggtggcggtggccctccaggtaccccaataatgccttcaccaggtgacagcaccaattctagtgaaaatatgtacaccatcatgaatcccataggtcagggggctggccgagctaactttcctttgggcccaggccctgagggtcctatggccgctatgtctgccatggaaccccaccatgtcaatgggagtcttggaagtggcgacatggatggtctgcctaagtcatcgccgggagcagtcgcaggtctctcaaacgcacctgggacaccaagagatgacggcgaaatggccgctgctggcacctttcttcacccattcccctccgaatcctactctccgggtatgacaatgtctgtttag

SEQ ID NO: 240638 - DNA, 1092 bp, Artificial Sequence
  Description of Artificial Sequence: Synthetic coding sequence
atgtacgcaaaaggcggaaaaggatcggcagtaccttctgacagtcaagcccgtgagaagctggcactttacgtgtacgaatacctactgcatatcggggctcagaaaagcgcacaaactttcttgagcgagattcgctgggagaaaaacatcacactgggagagccacctggctttttgcacagctggtggtgtgtgttttgggacctctattgcgcagcacctgatcggagggaggcctgtgagcactccggcgaggctaaggcatttcaggattactccgctgccgctgctccgagtcctgttatgggatctatggcacccggtgataccatggctgctgggtccatggctgccggttttttccagcctttcatgagtccccgattccccggaggacccaggccgactcttcgcatgccctctcagccccctgccggtcttccaggctctcagccactacttccaggagctatggagccctctcctcgcgcacaagggcatccctccatgggaggacccatgcagagagtgacccctccaagaggtatggcatcagtcgggcctcagtcctacgggggtggaatgcgacctccaccaaactctctggccggacccggactgccggcaatgaacatgggccctggtgtgcgtgggccatgggcttcaccctccggcaactctatcccttattcatcatcgagtccagggagctacactggccctccaggcggtggtggtccccctggaacacctatcatgccaagtcctggcgattccactaattctagcgaaaacatgtatactattatgaaccctattggacaaggcgctggtcgagctaactttcccctgggccctggaccagaaggcccaatggcggctatgagtgccatggagcctcaccatgtcaatggcagtttaggctctggggacatggacggcctccccaaaagctctccgggagccgtcgctggattgagcaacgcccctggcactccccgagacgacggcgagatggccgcagccggaactttccttcacccttttccatcagagtcctacagccccggtatgactatgtctgtttag

SEQ ID NO: 240639 - DNA, 2301 bp, Artificial Sequence
  Description of Artificial Sequence: Synthetic coding sequence
atgaaggagaagtccaagaatgcagcacgcactagacgcgagaaggaaaactccgaattttatgagttggccaagttactgcccctgccttcagcaattacaagtcaactcgacaaggcttcaattatccgcctcaccacctcctatctgaagatgcgggtggtgttccctgaggggctgggtgaagcttgggggcatagctccaggacgtccccattagacaacgttgggagagagctcggttctcatctgcttcaaaccttggacggatttattttcgtcgtggcccctgacgggaagattatgtacatctccgaaacagcgtcagtgcatttagggctgagccaggtagaactgaccggcaattcaatctatgagtatatccaccccgcagaccacgacgagatgaccgcagtcttgaccgctcaccagccataccacagccatttcgtccaggaatatgaaatcgaacgatcttttttcttacgcatgaagtgtgtactggccaagaggaacgctggtcttacctgcggcggatataaagtaatccactgctccggctatctgaagataagacaatactcgcttgatatgagcccatttgacgggtgctaccaaaacgtgggactggtagctgttggccattcgctgccaccgtctgctgttacggagattaaactgcactccaacatgtttatgttcagggccagcctggacatgaagctcatcttcctggactcgcgcgtggccgaactaaccgggtacgagcctcaggacctgattgagaagaccctatatcatcacgtgcacggttgtgatacattccacctgcggtgtgcacatcatttattgctcgtgaaaggacaggtgaccaccaagtattatagattcttggcaaaacacggaggatgggtgtgggtccagtcctacgcgacaatcgtccacaactcgcgcagtagccgacctcactgtatagtgtctgttaattacgttctgaccgacaccgaatacaaagggctgcagctcagtctagaccagatcagcgcgtctaaaccagctttctcttatacaagcagctccacgcccaccatgactgacaatagaaaaggtgccaaatctagactgtcttcttctaaatccaaatcaaggactagtccctatcctcaatactctggctttcacaccgaacggagcgagtcagaccatgatagccaatggggaggctcccccttgacagataccgcaagcccccagctgctcgatcctgccgacagacctgggagccaacacgatgctagttgtgcttacagacagttcagcgacagaagcagtctgtgctacggcttcgcacttgatcatagtagattggtggaggaaagacatttccatacacaggcttgtgagggcggacgttgcgaggccggaagatacttcctaggaacccctcaggcaggacgcgaaccctggtggggctctcgtgcagcgctgcctttaacaaaggcgtcccccgagagcagagaggcctacgaaaacagtatgcctcacatcgctagcgtgcatcgtatacacgggaggggtcactgggacgaggatagcgtcgttagcagccctgatccgggttccgcttcagaatctggtgaccggtacagaactgagcagtatcagtcctctccccacgagccttccaagatcgaaaccctgatacgagctactcagcaaatgatcaaggaagaggaaaaccgcctgcagctcagaaaggctcccagtgatcaactcgccagcatcaatggagccggaaagaagcactcattgtgcttcgcaaattatcagcagcctcccccaaccggagaagtgtgccacggatccgcactggcaaatacaagcccttgcgatcatattcagcagagagaaggaaagatgctgtctccacatgaaaatgactacgataactctcctactgcactatcccgaatctcctctcctaatagcgacagaatctccaagagttcccttatcctcgcaaaggactacctgcatagtgacatttcaccacaccaaaccgcaggagaccaccctactgtgagtcccaattgttttggctctcatcgacagtacttcgacaaacacgcttatacgttaaccggctatgcactcgagcacctgtacgactctgaaactattaggaactacagcctgggatgtaacggttcccactttgacgtgacttcccaccttcggatgcagcccgaccctgctcagggccacaaagggacaagtgtgattattacaaatggcagttag

SEQ ID NO: 240640 - DNA, 2301 bp, Artificial Sequence
  Description of Artificial Sequence: Synthetic coding sequence
atgaaggaaaaatcgaagaacgccgctaggacgaggagggaaaaggaaaactccgaattttatgagctggccaagctactgccgctgccaagcgccatcacaagccagctggataaggcctcaatcatccggctcaccacatcatatctgaagatgcgcgtggtgttccctgagggactcggcgaggcctggggccatagtagcaggacctcacccctagacaacgtcggaagagaactcggatcacatttgttgcagacattggacggtttcatctttgtggtggcacccgatggcaagatcatgtatatatccgaaacagccagcgtccatctgggcctgagccaggtggagcttacaggcaactctatatatgagtatattcatcccgctgatcacgacgaaatgactgcagttctgactgcccaccagccttatcacagtcacttcgtacaagaatatgaaattgagcgtagtttcttcctcaggatgaagtgtgttctagcgaaaagaaatgcaggactgacctgcggaggttataaagttatccattgtagtggatatttgaagattaggcagtactccctggacatgagcccttttgatggatgttaccagaatgtgggcctggtcgcagtcggacactccttaccgccatcagccgtgactgaaatcaaacttcactctaacatgtttatgttccgcgcatctctagacatgaagctgattttcctggactcgcgggtggccgaactcacagggtatgagcctcaagatctcatagagaagactctctaccaccatgtgcacggatgtgacaccttccatctccgatgcgcacaccatctgctactggtaaaaggacaagtaactaccaagtattaccgctttctggctaaacacggcggttgggtttgggtgcaatcttacgcaacaatcgttcataacagtcggtcttcccgtccccattgcatcgttagtgtcaattacgtcctaacagacactgaatataaggggttacaattgagcctcgatcaaatcagcgctagcaaacctgccttctcatacaccagctcatctacccccacaatgacggataatcgcaagggagctaagtctaggctgtcaagctccaagtcaaaaagtcggactagtccctacccccagtattctggcttccatacggagaggagcgaaagtgaccatgacagtcaatggggcggttcacctctgactgatacagcctcaccgcagctacttgatccagccgaccggccaggctctcaacacgatgcatcgtgtgcctaccgtcagttctcagatcgttcctcactgtgttatgggttcgccctagaccattcccgcctggtggaggaaaggcactttcacacacaggcttgcgagggtggccgatgcgaggctgggagatattttctgggcacaccgcaggccggtagggagccatggtgggggagtcgcgctgcattgcctcttacaaaggctagccctgaaagccgcgaagcttatgagaactctatgcctcatatcgctagcgtccaccgaatccatggcagaggccactgggacgaagattcagtggtgagcagccctgacccaggctcagctagcgagtccggagatagatacagaactgagcagtatcagtctagcccccacgagcctagcaagatagagactttgattcgtgctactcagcagatgattaaagaggaagaaaacagactgcagttaagaaaggccccaagtgaccagctggcctcgatcaatggcgcagggaaaaagcactcattgtgttttgccaactaccagcagcctcctccaaccggcgaggtctgccatgggtcagcactggccaataccagcccttgcgaccacatccagcagcgtgagggtaaaatgctgtctccacacgagaacgattacgacaattcacctaccgctctgtctcgcatcagctcacccaattccgacagaatctctaagagcagcctgatcctggctaaggattacctgcactctgacatttcacctcatcagactgcaggtgatcatccaactgtgagcccaaactgttttggaagtcaccggcagtatttcgataaacatgcctatactcttaccgggtacgccctcgaacacctctatgactcagagaccatcaggaattattcactcggatgtaacggctcgcatttcgatgtcacttctcatctgcgaatgcaacctgaccccgcacaaggccacaaggggacaagtgttatcatcaccaatggctcctag

SEQ ID NO: 240641 - DNA, 2004 bp, Artificial Sequence
  Description of Artificial Sequence: Synthetic coding sequence
atgaaagagaaaagcaagaatgctgctaaaactcgcagggagaaggagaacggtgaattttacgagctcgccaaacttttgccactgccttccgctattacgtcccagctagataaagcctcaataatccgcctaaccacctcttacctcaaaatgcgcgcagtttttcctgaaggcctcggcgacgcctggggtcagccaagtagggcagggcctctcgacggagtggcaaaggagctgggatcacatctcctccagacactggatggcttcgtgttcgtagtcgccagcgatggtaagatcatgtacatttccgaaacggcctcagtccacctgggcctcagtcaggtggaactgactgggaattccatttatgagtacattcacccatccgatcacgatgagatgactgcagtactcaccgcacaccaacccctccatcaccatttgctccaggagtacgagatcgagaggtctttctttttgaggatgaaatgcgtccttgccaaaaggaacgccggactcacatgcagtgggtacaaggttatccattgtagtggctatcttaaaattcggcaatatatgctcgatatgtctttgtatgactcttgctaccagatcgtcgggctggttgctgtcggccagagccttcctccgagcgcaattactgaaattaagttgtactctaatatgtttatgtttagggctagtttggacctgaagttgatctttctggattcgcgggtcacagaggtcacaggatacgagccccaagacctcattgagaaaacactttatcatcatgtacacggctgcgacgtattccacttgaggtatgcccatcacctcctgctggtaaaaggccaagtcacgacaaagtactacagattgctgtccaagagaggaggctgggtgtgggtccaatcatacgcaacagtggtgcataatagtagatcgtcgcgtccacactgtatcgtgtctgtgaactacgtactgaccgagatagagtacaaggaactccaattgtccctggagcaggtgagcacagccaaatcccaggactcatggcggaccgcactgtctacaagccaggagaccaggaaacttgtcaagcctaaaaacactaagatgaagacaaagctccgaaccaacccttatcctcctcagcaatattcaagttttcagatggacaagctggaatgcggccagctagggaattggcgggcaagtcctcctgcctccgcggctgcccctcctgagctacagcctcatagcgagtcctcagacttattatataccccgagctactcattacccttctcttaccactatggccattttcccttggactctcatgtttttagctctaagaaacccatgttgcctgcaaagtttggccagccacagggatctccctgcgaggtggcgagatttttcctgagtacacttcccgcttcaggagagtgtcagtggcattatgccaaccccctggtgccgagctccagtagcccagcgaagaaccctccagaacccccagccaacactgctcggcattcacttgtgccctcctacgaggcacccgcagccgcagtgagaaggtttggtgaggacaccgctcccccatcatttccatcatgtggacactaccgcgaggaacctgcactagggccagctaaagccgctcgccaggctgcgcgagatggcgctcggctcgctctggctagagcggctccggagtgctgtgcacccccaactccagaagcccctggagctcctgcacagctcccctttgtcctattaaattatcacagggtgctcgcccgtcgcggaccactgggaggggcagcacccgcagctagcggcctggcgtgcgcccctgggggtccggaagcagcgactggggcactaagactcaggcacccatctccagcggctaccagcccacctggtgcaccattaccacattatctcggcgctagtgtcattatcacgaacgggcgatag

SEQ ID NO: 240642 - DNA, 1713 bp, Artificial Sequence
  Description of Artificial Sequence: Synthetic coding sequence
atgaaagaaaagagcaagaacgccgctaagacacggagggagaaggagaacggggagttctacgagctggctaagctgctccccctgccctccgctataacaagccaactggacaaggcgtctattatcagactcacaacaagctacctgaagatgagggcggtattccctgagggcttgggagacgcttggggtcagccgtcccgtgctggccctctcgatggagttgctaaggagcttggatcacatcttctccagacgcttgacggctttgtgttcgtggtggcctccgacggaaagatcatgtacattagcgaaacggcaagcgttcacctggggctgtctcaggtcgagctgaccggcaatagtatctacgaatacattcaccctagtgaccacgacgaaatgacagccgtgttaaccgcccaccagccactccatcatcacctgcttcaagaatatgaaatcgagcgtagtttctttttgcgcatgaaatgcgtgctggcgaagcggaacgctggtttgacatgttctggttacaaggtgatccattgtagtggatacttaaagatccgtcagtatatgctcgatatgtcactgtacgacagctgctatcagatcgtgggcttggtcgccgtcggacagagcctccccccatctgcaatcaccgagatcaaattgtatagtaacatgtttatgttcagggcttctctcgacttgaaactgatttttcttgatagtcgggtcaccgaggttacggggtacgaacctcaggatctgattgagaagactttgtaccatcacgtccatgggtgtgatgtttttcatctccgctacgcccaccatctactgctcgtcaagggacaggtcacaaccaaatactatcgactgctgtctaagcgcggtggttgggtatgggtgcagtcctacgccacagttgttcacaatagccgaagttcacggcctcactgcattgtatccgtgaattacgtactgaccgaaatagagtataaggagctccagctgagcctcgaacaagtctctacagcaaagagccaggatagctggcgcaccgccctctccaccagtcaggagactcggaaactcgtgaaaccgaagaacaccaagatgaagactaaattgagaaccaacccataccccccacaacagtactcgtcattccaaatggataagctggaatgtggacagctgggcaattggagagcctcacccccagccagcgctgccgctcctcctgaactgcagccccactctgaatcatctgatctgctgtacactccgtcctactctctacctttttcgtatcattacggccactttccactggatagtcacgtgttttcctccaagaagcctatgctgcctgccaaattcggccagcctcaaggttctccctgcgaagtggcaaggttctttctttccaccctacccgcttctggcgagtgccagtggcactacgcaaaccccttagtgccctctagctcctctcctgcgaagaacccgcctgagccaccagcaaacaccgctcgtcactctctcgtccccagctacgagggagggagcggcctgcttgtcggtaaggtgggagggctgcggaccgccggtagcaggtcctctcatggtgggggatggcagatggaaactgagccttcccgattcgggcagacctgcccactctccgcctccaagtag

SEQ ID NO: 240643 - DNA, 447 bp, Artificial Sequence
  Description of Artificial Sequence: Synthetic coding sequence
atgtttcgacgtccagttctgcaggtgctgcgccagtttgttagacacgaatctgagaccaccactagcctggtcctggagagatcactgaacagggtgcacttattgggcagggtgggccaagaccccgtgttgcgccaagttgaaggtaaaaatcccgttacaatcttttcccttgccacgaatgaaatgtggcggtctggtgattctgaagtgtaccaactgggagacgtttcgcagaagacgacatggcatagaataagcgtattcaggcctggacttcgggatgtggcttatcaatacgttaagaaagggagcagaatctatttggagggcaaaatagattacggcgagtatatggacaagaacaacgtcagacgccaggctaccaccatcatcgctgataatattatctttctgtccgatcagacaaaggagaaggaatag

SEQ ID NO: 240644 - DNA, 366 bp, Artificial Sequence
  Description of Artificial Sequence: Synthetic coding sequence
atgttccgcagacccgtgctgcaagtcctgagacagttcgtgcgccatgaatctgaaacaacaaccagcctagtgttagaaagatcacttaatagagtgcatcttttaggacgcgtgggccaggatccagtcctacgccaggttgaggggaaaaacccggtcacaatatttagcttagccactaatgagatgtggagaagtggcgattccgaagtgtatcagttaggtgacgtgtcacaaaagacaacatggcaccgaatatcagtgttccgcccagggctgagagatgttgcgtatcagtacgtgaaaaaaggcagccgcatatacttagagggcaaaatagattacggtgagtacatggactag

SEQ ID NO: 240645 - DNA, 447 bp, Artificial Sequence
  Description of Artificial Sequence: Synthetic coding sequence
atgttccggagacccgtcttacaggttctgcgacagttcgttcgacatgaaagcgagactaccacttccttagtgctggagcgatcattaaaccgcgtgcacctgctcggacgggtggggcaagaccctgttctgcgtcaagttgaggggaagaacccagttaccatattttcactggctactaatgagatgtggagatcaggtgatagcgaggtgtaccagctgggggacgtgtcacagaagaccacatggcatagaatctctgtgtttagacccggactgcgcgatgtcgcctatcagtacgtcaaaaagggctctcggatatacctcgagggtaaaattgactacggcgaatacatggataaaaacaacgtgcgccgtcaggcaacaaccatcattgccgacaatataatcttccttagcgatcagactaaggagaaagagtag

SEQ ID NO: 240646 - DNA, 408 bp, Artificial Sequence
  Description of Artificial Sequence: Synthetic coding sequence
atgtttcggagaccagtgttgcaggtccttcggcagttcgtgcgacatgaatctgagactacaaccagcctggtgctggagcgaagtctgaaccgggttcatctcctcggacgcgtggggcaggaccccgtgttacggcaggttgagggaaaaaatccagtaactattttttcacttgctacaaatgagatgtggcgatccggcgactccgaggtctaccagctcggagatgtctcacaaaagacaacttggcataggatatccgtgttccgtcccggtctgcgcgatgttgcctatcaatacgtgaagaagggatcacgtatttatctagagggcaaaatagattacggggagtacatggataaaaacaatgtgcgcaggcaggctaccacgattattgctgactag

SEQ ID NO: 240647 - DNA, 87 bp, Artificial Sequence
  Description of Artificial Sequence: Synthetic coding sequence
atgttcagacgtccagttctgcaggtgctccgccagttcgtaagacacgaaagcgaaaccacaacgtcactcgttctggagcggtag

SEQ ID NO: 240648 - DNA, 447 bp, Artificial Sequence
  Description of Artificial Sequence: Synthetic coding sequence
atgttccgtcggccagtcttacaggtgctgaggcagtttgttcgccatgagtctgagactaccacgagtctcgtactcgagcgttcactgaatcgggtgcatctgctcggcagggtgggacaggatccagtgcttcgccaggtcgaagggaagaacccagtgacaatcttttctctggcaactaatgagatgtggaggtcaggggactcagaggtttaccaactgggtgacgtgagccagaagactacctggcaccgtatcagtgtgttccgtcctggcctcagagacgtggcttaccaatacgtgaagaagggctcccggatttacctagagggtaagatcgactacggggagtacatggataaaaacaacgtgcggcgtcaggctaccaccatcattgctgacaacattattttcctcagtgatcagacaaaagagaaggagtag

SEQ ID NO: 240649 - DNA, 447 bp, Artificial Sequence
  Description of Artificial Sequence: Synthetic coding sequence
atgttcaggcggcctgtactgcaagtcttacgccagttcgttcgacacgagagtgaaactaccacatctctggtgctggagcgctccctgaatagagtccacctgttggggagggtaggacaggatcctgtactgagacaggtagagggcaaaaaccctgtgactatattcagcctcgctacaaatgagatgtggagatccggggactcagaggtgtatcagttgggtgacgtgagccagaaaacgacctggcatcgcatcagtgtttttcgaccaggcctccgcgacgttgcctatcagtacgtaaaaaagggatcccgaatttacttggaggggaagatcgactatggggagtacatggacaaaaacaacgtgaggagacaggctacaaccatcattgccgacaacatcattttcctaagcgaccaaacaaaggaaaaggaatag

SEQ ID NO: 240650 - DNA, 447 bp, Artificial Sequence
  Description of Artificial Sequence: Synthetic coding sequence
atgttcagacggcctgtgctccaagttctgcgacagttcgtgagacacgaatctgaaaccacgacgtccctagtcctcgaacggtccttgaatcgggtgcacctgctggggagggttggtcaggacccagtacttaggcaagtggaggggaaaaatcccgtaaccattttcagcctcgctaccaacgagatgtggcgttccggggacagcgaagtgtaccagttgggggacgtttcccaaaagacgacatggcaccgaatatctgtgttcagacccggattgcgcgacgtggcttaccagtatgtgaagaagggcagcaggatatatctggagggtaaaatcgactacggtgaatacatggacaaaaataatgttcggaggcaggcaacaacaatcatcgctgataacattatttttctcagcgatcagacaaaggagaaggagtag

SEQ ID NO: 240651 - DNA, 1086 bp, Artificial Sequence
  Description of Artificial Sequence: Synthetic coding sequence
atgtacggaaaaggaaaaagcaactcatccgcagtgccttctgactcacaggcccgagaaaaacttgccctgtacgtatacgaatatctcctgcatgtcggtgctcagaagtctgcccagacatttctgtctgagatccggtgggaaaaaaacataacgcttggggagcctcctggcttcctgcatagttggtggtgcgtgttctgggacctgtattgtgccgctcccgagaggagggaaacgtgcgagcatagcagcgaggccaaggccttccacgactacagcgctgctgccgcaccatcaccagtcctgggtaatattcctcccggagatggaatgcctgtgggtccagtgccccctggcttcttccagcccttcatgtctcctcgataccccggaggccctagaccaccccttagaatcccaaaccaagcccttgggggtgtacccggttctcagccattgctccctagcggcatggatccaacccgccagcagggccacccgaatatgggcggtcctatgcagcggatgacgcctcccagagggatggtgccactgggacctcagaattatggtggagctatgcggcctcccctgaatgcacttggaggaccgggtatgcctggcatgaacatgggtcccggtggcggaagaccttggcctaacccaacaaatgccaactctatcccttacagttccgcctcccccggaaattacgtaggcccacccggaggaggaggacctccaggtacccccattatgcccagtccagcagactctaccaattcaggcgataatatgtataccctgatgaatgccgtgccccctggacctaatcgaccaaacttccccatgggcccaggctctgacgggcctatgggtggtttgggtggaatggagagtcaccatatgaatgggagcctgggatcgggtgatatggattcaatttctaagaacagtcccaacaacatgagcttatcaaaccagcctggcacccctcgcgatgacggagagatgggaggtaatttccttaacccgttccagagcgaatcttactcaccatccatgacaatgagtgtgtag

SEQ ID NO: 240652 - DNA, 945 bp, Artificial Sequence
  Description of Artificial Sequence: Synthetic coding sequence
atgggcaaaaatatcacgttgggcgaaccacctggattcctccactcttggtggtgcgtgttctgggacctttattgtgcagccccagagcgcagagagacttgcgaacactctagcgaagcaaaggcctttcacgactactcggccgctgcggcaccctctcccgtcctggggaacattcccccaggcgacggtatgcctgtggggccagtgcccccaggatttttccaaccatttatgtctcctcggtatcccggaggacctaggcctccactccgtatcccgaatcaagcactcggaggggtgcctggtagtcagcccctgctcccaagtggcatggacccaacacgacaacaagggcaccctaacatgggtggacccatgcaacgcatgaccccacctagaggcatggtgcccttgggtccccagaactatggaggggctatgcgaccacctttaaacgctctgggcggtccgggtatgcctggtatgaatatgggtcccggaggcggtcgtccgtggccaaatccgaccaatgccaattcaatcccctattcttccgcttcaccgggaaactacgttggaccccctggtggtggtggccctcccggtacaccaattatgcccagccccgctgactccacaaactcaggggataatatgtacacccttatgaatgctgttcccccaggtcccaatcgccctaatttccccatggggcctggttctgatggacctatgggcggattgggaggtatggaaagccaccacatgaatgggtctcttggtagcggggatatggacagcatctcaaaaaattctccaaataatatgagcctctcaaaccagcctggcaccccacgagatgacggagagatgggcggaaacttcttgaatccttttcaatctgagtcgtacagtccatccatgacaatgagtgtctag

SEQ ID NO: 240653 - DNA, 1026 bp, Artificial Sequence
  Description of Artificial Sequence: Synthetic coding sequence
atgtatggaaagggaaaaagcaatagcagtgccgttccatctgacagtcaggcaagggaaaaactggcattgtacgtctacgagtacctcttacatgtgggcgctcagaagagtgctcagacctttctctctgagatcaggtgggaaaaaaacattacattgggcgaacccccaggattccttcacagctggtggtgtgtgttttgggatctgtattgtgccgctcccgagcgtagggagacttgtgagcactcgtctgaagccaaggcattccatgactattctgccgctgccgctccatccccagtgttgggtaatattcctcccggtgacggcatgcctgtgggtcccgtaccacccggattctttcaggccctggggggtgtcccagggtctcagcctctgcttccgagcggcatggacccaacccggcagcagggccacccaaacatgggaggaccaatgcagcggatgacaccccctcgcggaatggtccctctggggccacagaattatgggggagccatgcggccaccactcaacgccctaggtggccctggcatgcccggaatgaatatggggccaggcggtggcagaccatggcccaacccaactaacgcgaacagcattccctactcctcagcgtcccccggaaactatgttggacccccaggcggaggaggcccacctggcacacccatcatgccctcacccgcagacagtaccaatagcggggataatatgtatacattgatgaatgcagtccctcctggtcctaatcgccctaactttcccatgggaccagggagcgatggacccatgggaggcctagggggaatggagagtcaccacatgaacgggtccctcggaagtggcgatatggattcaatctccaagaactcacccaacaacatgtctctgtctaatcaaccaggtacgcccagggacgatggagaaatggggggtaacttcctgaatccattccagagcgagagctattcccccagtatgacaatgtctgtgtag

SEQ ID NO: 240654 - DNA, 1200 bp, Artificial Sequence
  Description of Artificial Sequence: Synthetic coding sequence
atggcattttggggatggagggctgctgctgcgctgcgcctgtggggcagagtggttgaacgcgtggaagccggagggggagtgggccctttccaggcgtgcgggtgcagactagtgctgggcggtcgagacgatgttagtgccggactgcgtgggtctcatggggctcggggagaacctctggaccccgctcgcccactccagcggcctcctagaccagaggtgccccgagcttttcgacggcaacctagagcggctgcccctagctttttttttagctcaattaaaggtggcaggcggtccatctcattcagcgtgggggcatcctctgtggtcggcagtggcggtagtagcgacaagggcaagctgtctctgcaggatgtggcggaactgatccgcgcacgggcatgccagagagtcgtcgtcatggtgggggcaggtatcagtactccttccggcatccctgacttccgcagccctgggagcggcctgtattccaatcttcaacagtacgatctgccttatcctgaagccatttttgagctgccctttttttttcataaccccaaaccttttttcactcttgcaaaagaactgtatccaggtaattataaacctaacgtgacccactatttcctgaggctgctccacgacaaaggactcctgctccgcctgtacacacaaaacatcgatgggctcgagagggtcagtgggatccccgctagtaaactcgtagaggctcacggaacttttgcttccgccacatgtaccgtgtgccaacggcctttccctggagaggacatcagggcagacgtcatggctgacagagtgcccagatgtcctgtgtgtaccggggtcgtgaagcctgacatagtattcttcggggagccactgccccaacgatttttgctgcatgtggtggacttcccaatggctgacctcctactgatcttgggcacaagcctggaagtggagccattcgcctctctgaccgaggccgtccgcagctctgtgccgcgattgctcattaatcgcgatttagtgggtccgctcgcctggcatccacgttcccgggatgtagctcagctcggcgatgtggtccacggggtggagtccctggttgagctgttgggatggactgaggaaatgagggacctagtacaacgggaaaccgggaaactggacggaccagataagtag

SEQ ID NO: 240655 - DNA, 957 bp, Artificial Sequence
  Description of Artificial Sequence: Synthetic coding sequence
atggcattctggggctggagagcagctgccgctctaaggctttggggtagagttgtggagcgtgtagaggctggagggggagtcggcccttttcaggcatgcggttgtagactcgtgcttggaggccgagatgacgacgtggctgaattgattagagctcgggcttgtcagcgggtagtcgtgatggtgggagcaggcatttctacaccctcaggaatccctgactttcgttctccgggttccgggctgtacagcaatctacagcaatacgatctgccctaccctgaagccattttcgaattgccatttttcttccacaacccaaaaccattcttcaccctggccaaggaactatatccagggaactacaagcctaacgtgacccattattttctgcggctgctacacgacaaggggctactcctgcgcctctacactcagaatattgatggtctcgaaagggtttctgggatcccggcatcgaagctggtcgaagcccacgggaccttcgcgagcgccacatgtacagtctgtcagagacctttccctggcgaggatatccgggcagacgtaatggctgatagggtgccaagatgtcctgtctgcaccggcgtcgtgaaaccagatattgtttttttcggggagccactgcctcaaaggttcctcctccatgtcgtggactttcctatggctgacctgctgttgatactgggcacatctttagaagtggagccattcgcaagcttaaccgaggcagtccggagctccgttcctaggctgcttattaacagggacctggtcggacccctggcctggcacccgagaagcagagacgtggcacagttaggcgacgtggttcatggagtggaatctttggtggaacttcttgggtggactgaggaaatgagggatctagtccagcgtgagacgggcaagctggacggcccagacaaatag

SEQ ID NO: 240656 - DNA, 774 bp, Artificial Sequence
  Description of Artificial Sequence: Synthetic coding sequence
atggtcggggctgggatttcaacgccatccggtatcccggactttcggagcccgggatcagggttatactcaaacctgcaacagtacgacctcccttatccagaagccatattcgagctcccattctttttccataaccccaagccattcttcacccttgccaaggagctataccctggaaattataagcctaatgtgacacactatttccttcgtctcctgcacgacaaaggtttgcttttgagactctacacccagaacatcgacgggttagagagggtgtccggcataccggcttccaagctggtggaggcgcatgggacttttgcctcagcaacttgtaccgtctgtcagcgcccttttcccggagaagacattcgcgcagatgttatggctgatagggtgccaagatgtccagtctgtactggggtggtcaaacccgatatcgtctttttcggtgagcctctgccacagcgttttctccttcacgtggtggacttccccatggccgatctgctgcttatccttggtacaagccttgaggtcgagccgtttgcttcattgaccgaggctgtccgttctagcgtaccgcgactgttaattaacagggatctggtaggacccctggcctggcacccccgttctcgggacgtcgcacaacttggcgacgtcgtgcacggagttgagagcctggtagagctgcttgggtggaccgaagaaatgcgcgatctagttcagcgtgagaccggcaaactcgatggccctgacaaatag

SEQ ID NO: 240657 - DNA, 945 bp, Artificial Sequence
  Description of Artificial Sequence: Synthetic coding sequence
atgaagatgagcttcgccctgaccttcagaagcgctaaggggagatggatagccaatccttcgcagccttgctctaaggcatccatcgggctgtttgttcccgcatctccacccctcgacccagagaaggttaaggagctgcagaggttcattacactgtctaagaggcttttggtaatgaccggggcaggtatatcaaccgagagcgggatccccgattataggtcagagaaagtgggcctgtatgccaggacggataggcgtcccatccagcacggggacttcgtcaggagcgcacctatccgccagaggtattgggcacgcaattttgtagggtggccgcagtttagttcccaccagcctaatccagcccattgggcgctatccacctgggagaaattgggcaagctttactggctcgtgacgcaaaatgttgatgcgttgcacaccaaggccggtagtcgcaggctgacagagctgcatggctgtatggaccgcgtgctctgcttagactgcggagagcagacccccaggggagttctgcaggagcgctttcaggttctgaaccctacttggagcgccgaggctcatggactggcccctgatggagacgtgttcctgtccgaagaacaggttcgttcctttcaggtgcctacctgcgtccagtgcggtggacacctaaaacccgatgtcgtgttcttcggcgacacagtgaacccggacaaagtcgactttgtccataagagagttaaagaggctgacagcctcctagtggtgggatcctcgttacaggtgtactccggctatcgcttcatactgaccgcatgggaaaagaagctgccgattgctattctcaatataggtcccaccagaagcgacgatcttgcatgccttaagttgaattctcgatgcggtgagcttctgcctctgattgatccttgctag

SEQ ID NO: 240658 - DNA, 879 bp, Artificial Sequence
  Description of Artificial Sequence: Synthetic coding sequence
atgcggccactccaaattgtcccttcacgcctgatttctcagctttactgcgggctcaagccaccagcctcaaccagaaatcagatatgcttgaagatggccaggccaagttcttccatggccgattttcggaaattctttgccaaggcgaagcatatagtcatcatttctggagcaggggtgtctgccgagtccggcgtcccaaccttccggggtgccggtggctactggcgcaaatggcaggcccaggacctggcaacacccttggccttcgcccacaatccctccagggtatgggaattctatcactacagacgcgaggttatgggttcaaaggagccaaacgcaggtcatcgagcaatcgcggagtgtgaaacacggctggggaagcagggaagacgagtggtggttatcacacaaaacattgatgagctccacagaaaggccggtaccaagaatctgctggagatacatggctccctgttcaagacaaggtgcacaagctgcggagtggtcgcagagaactacaaatccccaatatgtccagccctgagcggcaaagggtgcgaggaggcgggttgtggaggattgctgcgcccacatgtggtctggttcggcgagaatctggatccagcaatactcgaagaagtggatcgtgagcttgcacactgtgacctgtgtctcgtagtagggacaagctctgttgtatatcctgctgccatgtttgcaccacaagtcgctgccaggggcgtgcccgtggcagagtttaataccgaaaccactcccgcaaccaatagatttagattccacttccagggaccctgcggaactacactgcctgaggcacttgcctgtcacgaaaatgagacagtctcctag

SEQ ID NO: 240659 - DNA, 933 bp, Artificial Sequence
  Description of Artificial Sequence: Synthetic coding sequence
atgaggccgcttcagattgtgccatccaggctgatttctcagctgtattgtgggttgaaacctcctgcttctacaagaaaccagatctgcctgaaaatggctcgtcctagcagtagcatggcagattttcgcaagttttttgccaaggccaaacacattgtgatcattagcggggcaggagtgtctgccgagtctggcgtccccacctttagaggcgcaggtggctactggaggaaatggcaggcacaggaccttgcaactcccctggcctttgcccacaatccatcccgcgtttgggagttttatcactatcggcgtgaagttatgggcagcaaagagcccaatgcaggtcaccgagctatagcagaatgcgaaactcgtctcggtaagcaggggagaagggtggttgtgataacccagaacattgatgaactgcatagaaaggctggtacaaagaatctgctcgaaatccatggcagcctgtttaagaccagatgcacatcttgcggggttgttgccgagaattacaagtcaccaatatgcccagcactgtcaggcaaaggagccccagagcctggtacacaggacgcaagcatccctgtagagaaactgcctcgatgtgaggaagccggttgtggtgggctgttgcgccctcacgtcgtgtggttcggcgaaaacctcgaccccgctattcttgaagaagtcgaccgcgaactcgctcactgcgacctttgccttgtggtgggtacgagctctgtggtgtatccagccgctatgttcgcaccgcaggtggctgcgaggggagtaccagtcgctgagtttaataccgagacaaccccagccactaacaggttccgctttcactttcaaggcccatgcgggactacgctgcccgaggcacttgcttgccacgaaaacgaaactgtctcatag

SEQ ID NO: 240660 - DNA, 900 bp, Artificial Sequence
  Description of Artificial Sequence: Synthetic coding sequence
atgcggccactgcagatcgtgccatccaggctgatcagccagctatattgtggtctgaagcctccagcaagtactagaaatcagatctgtctgaagatggcccgaccatcatcatcaatggctgacttccgaaaattcttcgccaaagccaaacatattgtaattatttccggggctggcgtgagtgccgagtccggcgtaccgacgttccggggagctggtggatattggagaaagtggcaagcccaggaccttgccacaccacttgccttcgcccacaatccctctcgggtctgggaattctaccattatcgcagggaagtaatgggtagcaaggagcccaatgccggtcatagagcaatcgcggaatgtgagacacggctgggtaaacaaggcagacgggtggtggtcatcacccaaaatattgatgaattacataggaaggcaggaacaaagaatctattggagattcacggatccctgttcaagacgcggtgcacatcttgtggggtggtggctgagaattacaaatctccaatctgccctgcactatccggaaagggggctccagagcctgggacacaagatgctagcatcccagtggaaaaactgcccagatgtgaggaagccggatgcggcggattgctcaggcctcacgtagtgtggttcggagagaacctggatcccgcaatcctagaagaagtggaccgtgaactggcccactgtgacctctgtctcgtcgtggggacttccagcgtggtgtaccctgcagccatgttcgcaccccaagtggccgcacggggagtgcccgtagccgagttcaatactgagaccacccctgctacaaacaggttcagccatctgatctctataagctccctgatcattatcaaaaattag

SEQ ID NO: 240661 - DNA, 609 bp, Artificial Sequence
  Description of Artificial Sequence: Synthetic coding sequence
atgggatcgaaggaacctaatgctggccatagagccatcgcagagtgtgaaacgcggctaggcaagcagggacgccgtgtggtggtcatcacacaaaacattgatgaactccaccgcaaagcaggcacaaagaacctgctagaaatacatggcagcctatttaagacccgatgcacttcctgcggagtggtggcggagaactataagagtcctatatgcccagccctctcgggaaaaggggcaccagagcctggcacacaggacgcaagcatccccgtggagaagctgccacgttgtgaagaagctggatgtggcggtctcctgcggccacatgtggtgtggttcggcgaaaacctggaccctgcgattctcgaggaagttgaccgcgagctggcacactgtgacttgtgcttggttgtcggtacaagcagcgtggtgtatcccgcagctatgttcgccccacaagtcgccgctaggggtgtaccagtagctgaatttaacacagaaacaactcccgcaacaaaccgcttccgattccatttccaaggaccgtgcggtacaacactgcctgaagcactggcatgtcacgagaatgaaacggtgagttag

SEQ ID NO: 240662 - DNA, 1203 bp, Artificial Sequence
  Description of Artificial Sequence: Synthetic coding sequence
atggcggctgggggtctcagccgctctgagcgaaaggcagctgaaagagtccgaaggcttagggaagagcagcaaagagaaaggctccgtcaggtgtcgcgtattttgcgcaaggcggcagcagagagatccgccgaggagggtaggctgcttgccgagtcagccgatctggtgacagagttacaggggaggagccgccgtagggagggactcaagaggcggcaggaggaggtttgcgacgatcccgaagagctgagagggaaagtcagagaattagcgtctgcagtccgaaatgcgaaatacttagtggtctacaccggagcaggcatctcgaccgccgcatctatccctgactatagaggcccaaatggagtgtggaccctcttgcagaagggaaggtctgtctccgccgctgatctttctgaggccgaaccaacacttacacacatgtctataacccgtctccacgagcaaaagctcgtccaacacgtggtgtcacagaattgcgacggtctgcacctccgcagcgggctcccaagaacagccattagtgaactccatggcaacatgtatatcgaagtatgcactagttgcgttcccaatagggaatatgttagggtctttgacgtgacagagagaaccgctctccacaggcatcagactggccgaacctgccacaagtgtggtacacaattgagggatactattgtgcacttcggagagcgcggaacactaggccaacctctgaattgggaggccgctacggaggctgcctcccgggctgacactattctatgtctggggtcctctcttaaagttttaaagaagtatcccaggctctggtgcatgacaaaaccaccatcacgcagacccaagctgtacatcgttaatttgcaatggactccaaaagacgactgggccgcactgaagttacacggaaagtgcgatgacgtcatgagactgttgatggccgaactgggcctagagatccctgcttactcgcggtggcaggatcccatcttttcattggccacgcctctgcgggcaggagaggaaggttctcactctaggaagtctctgtgtcgctcccgcgaagaggcccctccaggtgatcgaggcgcaccactttcttccgcaccgatcctcggcggatggtttggcaggggctgcacaaaacgcaccaagaggaagaaggtgacctag

SEQ ID NO: 240663 - DNA, 963 bp, Artificial Sequence
  Description of Artificial Sequence: Synthetic coding sequence
atgcccggtcctcggcgacgtagcccatcagcctgtcctcaggtctccaggatcctacgcaaagcggctgctgagcgaagcgcggaggagggacggctgctcgccgaatctgcagatttagtaaccgagctgcagggccgaagtagacgaagagaggggcttaagcgaaggcaggaggaagtatgtgacgatcctgaagagctccggggaaaagttcgagagctggcttccgccgtgagaaacgctaaatacctggttgtatataccggagcgggaatctccacagctgcctcgatacccgattaccgagggccaaacggagtctggaccctgcttcagaaggggcgatccgtctccgcagccgacctgagtgaggctgagccgaccctcacccatatgagtattacaagactccatgagcagaagctggtacagcacgtggtcagtcagaattgcgatggcctgcatctccgctccggactgccaagaacagccatctccgagttgcatggcaacatgtatatagaggtctgtacctcgtgcgtgccgaatagagaatacgtccgggtttttgatgtcacggaaagaaccgctttacacagacatcaaaccggccgtacctgccacaagtgtgggacacagctccgcgataccatcgttcattttggtgaacgtggaactcttggccagcccctgaattgggaagccgcaactgaagcagcctcaagggccgataccatcttatgcctgggatccagcctcaaggtcctgaagaagtatcctcggctttggtgtatgacaaaacccccaagtcggaggcccaagctgtacatcgtaaacttgcaatggactcccaaggacgactgggcggctcttaagctgcacggcaagtgcgatgatgtgatgaggctgcttatggccgaactgggcctagaaatccccgcttattctcgcgtgctgtag

SEQ ID NO: 240664 - DNA, 855 bp, Artificial Sequence
  Description of Artificial Sequence: Synthetic coding sequence
atgagcatgttgcccagctttggatttactcaagagcaggtcgcctgcgtgtgcgaagttctacagcagggcggaaatctggagagattaggcaggttcctatggtctctccctgcatgcgatcacctacataaaaatgagagtgtcctgaaagcgaaagccgtggttgctttccaccggggaaatttcagagaactgtataagatcctcgaaagccaccagttttcacctcataaccatccaaagttacaacagctgtggctcaaggctcattacgtggaggcagagaagctgcggggtcggcctttgggtgctgtcggaaagtacagagtgcgtaggaagttccctctcccaaggacaatctgggacggtgaggaaacctcctattgctttaaagaaaaaagccgaggggtcctgagagagtggtacgcccacaacccatacccatccccgagagagaaaagagagctggcggaagccacaggcctgaccaccacacaggtctcaaattggttcaagaacaggcggcagcgggatcgcgcagccgaggccaaggaaagggagaataccgaaaacaacaacagcagcagcaacaagcagaaccagttgtcacctctcgaaggcggaaaacctctgatgagcagtagtgaggaagagttctccccaccccagtcccctgaccaaaatagtgtcctgcttctacagggcaatatgggccatgcccgttctagtaactacagcctgccagggctgacagctagccagccgagccatgggctgcagacacatcaacaccagttacaagatagcctgctgggaccattgaccagcagcttagtggacctgggtagttag

SEQ ID NO: 240665 - DNA, 876 bp, Artificial Sequence
  Description of Artificial Sequence: Synthetic coding sequence
atgagcatgctgccaactttcggtttcacgcaggagcaggtggcctgcgtctgcgaggtactccaacagggcggtaacatcgagcggctgggcaggttcctgtggagcctgccagcatgtgaacacctgcataaaaatgaatctgttcttaaagctaaagctgttgttgctttccaccgaggcaatttcagagagctgtataagattcttgagtcacatcagttctcaccgcacaaccacgcaaagctgcagcagctatggttgaaggcacactatatagaagccgaaaagcttaggggacgtccccttggagctgttggaaagtatagagttcgcaggaagttcccacttccacgttccatttgggatggcgaggagaccagctattgttttaaggaaaagagcaggtcggtgctgagggaatggtatgcccataatccttacccatcgccacgagagaaacgcgagctcgctgaagcaacaggcctcaccaccacccaggtttccaactggtttaaaaaccggcgacagcgggacagagccgcagaggcgaaagagagggagaacaatgagaactccaatagcaactctcataaccccctcaatggttcgggcaagagtgtactgggatcttccgaagatgagaaaacaccctccggaacgcccgaccactccagcagttctcccgctcttctgctgtctccacctccgcctggactgccctccctccattccttgggccacccccctgggccttccgctgtgcccgttccagtaccaggcggtggcggagctgatccacttcagcatcatcatggtctgcaagatagcattttaaatcctatgtccgccaacctcgtagacctgggaagctag

SEQ ID NO: 240666 - DNA, 999 bp, Artificial Sequence
  Description of Artificial Sequence: Synthetic coding sequence
atggtgttccgctcacccctggatctgtattcttctcactttctgctgcccaactttgccgactctcaccataggtcaatactgctcgcttcgtcagggggtggcaatggtgccggaggaggaggaggagcaggaggcggttccgggggaggaaacggagccggtgggggaggggctggcggtgctggaggtggtgggggaggaggctcccgcgctcctcccgaagagctctcaatgtttcagttacccacattaaatttttctcctgaacaagtcgccagcgtctgtgaaaccttggaggagactggcgatattgaacgtctgggcaggtttctctggtctctccctgtggctccaggagcttgtgaggcgatcaacaagcatgagtccatcctcagagctcgggcagtcgtcgcttttcatacagggaactttcgggatttataccacatactggagaatcacaaatttacaaaggagtcccacgggaagcttcaggctatgtggctggaggcacactaccaagaagctgagaagctccgcggtcgccctcttggtccggtggacaaatatcgggtccggaagaaattccccttgcccaggacaatatgggacggcgagcagaagacacattgctttaaagaaagaactcgatcgttactgagagagtggtatctgcaagatccctaccccaatccgagcaagaagagggagctggctcaggcaacaggtctgactcccacccaggttggcaattggtttaagaaccggagacagcgggacagagccgctgccgcaaagaaccggttgcagcatcaggcgatcggcccttccggaatgagatcgctggccgagcctggatgtcctactcatgggtcggcagagagcccttccacagccgcatcccctaccaccagcgtcagttcactgacggagcgcgctgacactggtacgtctattttatcagtgactagctcagattcagaatgcgatgtgtag

SEQ ID NO: 240667 - DNA, 1020 bp, Artificial Sequence
  Description of Artificial Sequence: Synthetic coding sequence
atgaattgggagttactcctgtggctgttggtactttgcgcgttattgttgctgctggtccagttactgcgctttctgagggcagacggagatctcacactgttgtgggctgagtggcagggtcggaggccagaatgggaactgactgatatggtggtctgggtgacaggagcctcgtctggcataggagaagagctcgcttaccagctgtcaaaactgggggtgagcttggtcctgtccgccagacgggttcacgagctggagcgggtgaaaaggcgatgtctggagaacgggaacttgaaggaaaaagacatcttagtgctcccacttgatctgacagacacaggaagccatgaggctgccaccaaggccgtattgcaggaattcggacgaatcgacatcctcgtgaacaatggcggaatgtcacaacgatcactgtgtatggataccagcctggacgtgtatagaaagctaatcgaactcaactatctggggactgtctctctcacaaaatgtgtgctcccccatatgattgagcggaagcaaggcaagattgttacagtcaacagtatactaggaatcattagtgtgccactgagtattggatattgtgcctccaagcatgctctgagaggattctttaacgggctgcgcaccgagctggctacctacccgggaataatcgtgagcaacatctgtcctggacctgtgcagtccaacatcgtcgaaaattctctggccggtgaggtcacgaaaacaatcggaaataatggcgatcagtcgcataagatgaccacgtctcgatgtgtacggctgatgctgatttctatggccaacgatctgaaggaagtttggatttccgaacagccattcttgttggtcacctacctgtggcagtatatgcccacatgggcctggtggattacgaataagatggggaagaagcggattgaaaattttaaatcgggcgtagatgccgactcgagttacttcaaaatttttaaaacaaagcatgattag

SEQ ID NO: 240668 - DNA, 2220 bp, Artificial Sequence
  Description of Artificial Sequence: Synthetic coding sequence
atggccacactgcccgcagagccttctgcaggacccgctgccggtggggaggcagtggcggcagctgccgcaaccgaagaagaggaggaagaggctagacaactgttgcagacgcttcaagcggcagaaggggaggccgcagctgctgcgggagcgggagctggtgcggctgctgctggcgctgagggtccaggctccccaggggtgcctgggtcgcctccggaagccgcttccgaacccccaactggattgcggttctcccctgaacaggttgcttgcgtctgcgaggcactgctccaagccggacatgccggaagactttcccggttccttggcgctctgccccctgcggaacgtcttcgcggttccgaccccgtcctgcgggctagagcactcgtggccttccaacggggagagtatgccgagctgtaccggctgctggagagcagaccattccctgcagcacaccatgcatttctgcaggacctgtacttgcgcgcacgttaccacgaggctgaacgcgctcggggaagggctttgggcgctgtagacaaatacaggctgcgaaagaaattccctttacccaaaacaatttgggatggtgaagagaccgtgtactgctttaaggagaggtccagagctgctctgaaggcatgctacaggggcaacaggtatccaacaccggacgagaagcggcgattggctactctgacaggactgtcgctaacacaggtaagcaactggttcaagaaccgaagacagcgcgaccggactggagccggaggaggcgctccatgtaaatcagaaagtgatggtaatcctaccaccgaggatgaaagcagccgatctcccgaagatctcgagcggggtgccgctcccgtcagcgctgaggctgccgcacaaggcagcatttttcttgccggaaccggaccgcctgccccatgtcctgcaagcagtagcattctggttaatggttctttcctagctgcctccggaagccctgccgttctacttaacgggggacccgtcattatcaacggcctggcactgggcgaggcgagtagcctgggcccacttttgctgacaggtggcggaggtgcccctcccccacagccttcaccccagggtgcttccgagaccaaaacctccctggtgctggaccctcagaccggtgaggtgcgacttgaagaggcccagtctgaagctccggagactaagggtgctcaggtcgccgctcccggtcctgccctcggcgaggaagtgctcggaccgctcgcgcaagtggtacccggacccccaaccgctgcaactttcccgttgcctcccggaccggtgccagcagtagcagcccctcaagttgtgccgttgagtccaccgccaggttatccaacggggctatcacctacaagtccccttctcaatctgccacaggtagttcccacttcccaggtcgtcacccttcctcaggctgtgggcccactccagcttttagcggctggtcctggttctccagtgaaagtggccgctgccgctggcccagctaacgtccatttgataaattctggtgtcggtgtgaccgcactccagttgccctcagccaccgcccctggaaattttttgctggccaacccggttagcggtagcccaatcgtgacaggggttgcccttcaacaaggtaagataatattgactgcaactttcccaacttccatgttggtctcgcaggtgctccccccagctcctggcctagccctgcctcttaagcccgagactgcaattagcgtccctgagggcggtctcccagtcgctccctccccagcattgcccgaagcgcacgcattgggcactttgtccgcacagcaaccccctcccgcagcggctaccacatcatcaaccagcctgccattcagtcctgattcccccggtctgctgcctaatttccccgctcctccaccagagggcctgatgctcagtcccgcagcggtgccagtgtggagtgctggtctggagctgtctgcgggtacggaggggctgctggaggctgagaaagggctcggaactcaagcaccccatacagtgcttagacttccggacccagatccagagggcctgctcttaggcgctacagcaggtggtgaggttgatgagggcctggaggccgaggctaaagtgctaacccaactgcagtccgtccctgtggaagagcccttggaactctag

SEQ ID NO: 240669 - DNA, 741 bp, Artificial Sequence
  Description of Artificial Sequence: Synthetic coding sequence
atgttccagttgcctattctgaacttttccccacagcaggtggccggagtgtgcgaaaccttggaggaaagcggcgatgtcgaacgactcggccgatttctgtggagcttgcctgtggcccctgctgcatgtgaggcactgaacaaaaatgagtctgttctgagggcacgcgcaatagtggcattccacggaggtaattatagggaactctatcacatcctggagaatcataagtttacaaaggaatctcacgccaaactgcaagccctgtggctggaagcgcactaccaagaggctgaaaaactgcgcggacgtcctcttggcccagtcgataaataccgagttagaaagaaattcccgctgccacgcaccatatgggacggcgagcagaagacccactgtttcaaagagcgaacacggcatctacttcgagagtggtatctgcaagacccatatccgaacccaagtaaaaagcgagaactggcgcaagccactggtctgacaccaacgcaggtggggaactggtttaagaaccgccgacaaagggaccgggctgccgctgctaagaatcgcctgcagcagcaggttttgagccagggctcagggcgagctctgagagcagaaggcgacggcacccctgaggtcctgggagtagctacctcccctgcagcctctctttctagcaaagcagctacttccgctatctctattactagctccgactccgagtgcgacatctag

SEQ ID NO: 240670 - DNA, 360 bp, Artificial Sequence
  Description of Artificial Sequence: Synthetic coding sequence
atgacacagcagggggctgctcttcagaactacaacaacgagctcgttaaatgtatagaagagctgtgtcagaaaagagaggaactgtgcaggcagatacaggaagaggaggacgagaaacaacgtctgcagaacgaagtgaggcagctcactgagaagctggccagggttaatgagaacttggcgagaaaaattgcatcacgtaacgaattcgataggactatagccgagactgaggccgcttatcttaagatcttggagagtagtcagactcttttaagcgtgctgaagagagaggccggtaatctgaccaaagcaaccgcacctgatcagaaaagctccggtgggagagattcatag

SEQ ID NO: 240671 - DNA, 666 bp, Artificial Sequence
  Description of Artificial Sequence: Synthetic coding sequence
atgttgtggctctttcaatcgctcctgttcgtattttgctttggacctggtcagctccgcaacatccaggtcacgaatcactcacaactctttcagaacatgacatgcgagctgcacctaacatgtagtgtggaggatgcggacgacaacgtttcctttcgatgggaggccttaggaaacaccctgtccagtcagcctaacctgacggtcagctgggaccccaggatcagtagcgagcaggattacacgtgcatcgcggagaatgcagtttcgaacctatcattctccgtcagcgcccagaaactctgcgaagatgtgaagatccagtatacagacacaaagatgattttatttatggtaagcgggatctgcatcgtgttcggtttcatcatcctcctgcttcttgtactacgaaagaggcgagacagtctctcgttgtctacccagcgtacacaggggccagccgaaagcgcgcgtaatctggagtacgtatctgtgagtccaacaaacaacacagtgtatgcaagtgtaacccatagcaaccgggagacagagatatggaccccaagggaaaatgatactataaccatttactccacaatcaatcattcaaaggagtcgaagccaactttctcccgcgcaactgctctcgacaacgtggtgtag

SEQ ID NO: 240672 - DNA, 999 bp, Artificial Sequence
  Description of Artificial Sequence: Synthetic coding sequence
atgctgtggttgttccagtcactactctttgtgttttgtttcggtcccggaaatgtggtttcgcagtcatccctgaccccacttatggttaatggtatccttggagaaagcgtaaccctccctctggagttccccgcaggcgaaaaggtgaattttatcacatggctttttaatgaaacttcactcgccttcattgtaccccatgagacaaagagccccgaaattcacgtcacgaatccaaaacagggaaagcgcttgaatttcacccagtcatatagccttcagctgtccaatcttaaaatggaggacacaggctcgtatcgagcccagatttcaaccaagacaagcgcgaagttaagttcatacacacttaggatactcaggcagctgagaaacatccaggtcactaaccacagccagctcttccagaatatgacctgcgagctgcatctgacttgctcagtagaagacgcggatgacaatgtgagcttcaggtgggaggccttgggcaacaccttgagttcacagcccaatctgacagtcagttgggatccacgtattagttccgaacaagactacacctgtattgctgaaaacgctgtgtctaatctttcgttttccgtctccgctcaaaagctctgcgaagacgtgaagattcaatacaccgacaccaaaatgattttgttcatggtctctgggatctgtattgtgttcggctttatcatcctgttactcttagtcctccggaagcgcagagatagcctgtccttgagtacccagcggacccaaggtcctgctgaatcggcgaggaacctggaatacgtgtcagtctcccccaccaataatacggtgtacgcttctgtgactcactccaacagagagacagaaatttggactcccagagaaaatgacacaatcactatttactccactataaaccattcaaaggagtccaaaccgactttttcccgtgctactgcactggacaacgtggtctag

SEQ ID NO: 240673 - DNA, 996 bp, Artificial Sequence
  Description of Artificial Sequence: Synthetic coding sequence
atgctgtggttgtttcagagccttttgtttgtcttctgttttggacctggcaatgtggtgtcccaatcaagccttaccccattgatggtgaacggtatactcggtgagtccgtcacattgcctctagagttccctgccggagagaaggtgaatttcattacctggctctttaacgagacaagcctagccttcatcgtgccacacgagaccaaaagccctgaaatacatgttacaaacccaaaacagggaaaaaggcttaacttcacacagagttactcgctccaactttctaacttaaaaatggaagacaccggatcctaccgagcccaaatcagcacaaagacaagcgccaagctgtcctcgtatacactgcggatcttacggcagctgcgcaatattcaagtgactaaccattcccaacttttccagaacatgacatgcgagttgcacctcacctgtagcgtagaagatgccgacgataatgtctctttccgctgggaagctctcggcaacaccctctcctctcagcccaaccttactgtttcatgggaccccaggatatccagcgaacaagactatacgtgcattgccgagaacgcagtctctaacctttccttttccgtctctgcacagaaactgtgtgaggatgtcaaaatccaatataccgacaccaaaatgattctcttcatggtatcaggaatatgcatcgtgttcggcttcattatcttgctcttgctggtgcttcgaaagaggagagatagtctgtctctgagcacacagcgaacacagggccctgaaagtgcgaggaacctcgaatatgtgagtgtgagccccaccaacaacaccgtgtacgctagtgtcacacacagtaaccgggaaacagaaatatggaccccaagggagaacgataccattactatttactcgactatcaaccactcaaaggagtccaagcccaccttctctcgcgctacggctctggacaatgttgtgtag

SEQ ID NO: 240674 - DNA, 891 bp, Artificial Sequence
  Description of Artificial Sequence: Synthetic coding sequence
atggcagggtctccgacatgcctgactctcatctacatactgtggcagctgacaggatctgccgcttccggaccggttaaggagctggttggttccgtaggcggagccgtcaccttccccttgaagtctaaagtcaaacaggtggactctatcgtctggacattcaatacaaccccgctggtgaccatccagcctgaagggggaactatcatagtgacccagaaccggaatagagagcgggtcgatttccctgatggcggatattccttgaaactttccaaactgaagaagaatgactccggtatctactacgttggcatctattctagctcgctccagcagccatctactcaggagtatgtcctccacgtgtacgagcatctcagcaaacctaaggttacaatgggcctgcagtctaacaagaacggcacatgtgtgactaaccttacatgctgcatggaacatggagaggaagacgtgatatacacgtggaaagcactcggacaggctgccaatgagtcccataatggctccattctgccaatttcgtggcggtggggcgagtccgatatgacttttatttgtgtcgcacgtaacccagtgagcagaaatttctcttcccccatactggcacgaaagttgtgtgagggcgctgccgatgatcccgattcaagtatggtgttactgtgtctcctcctcgtgccccttttactgtccctcttcgtgctgggcctgtttctgtggtttttgaagagagagagacaggaggagaacaacccaaaaggtagaagctctaagtatggcctcctccactgcggcaacacggaaaaggacggtaaaagtcctctgacagcacacgacgccaggcataccaaagccatttgtctgtag

SEQ ID NO: 240675 - DNA, 687 bp, Artificial Sequence
  Description of Artificial Sequence: Synthetic coding sequence
atggccggatcaccaacgtgcctgaccctcatttatattctgtggcagctcacagaacatttgagcaaacccaaagttactatgggtcttcagagtaacaaaaacggcacttgcgtgaccaatctaacatgctgtatggagcacggcgaggaggacgtaatatacacatggaaggccctgggacaagcagccaatgagtctcacaatgggagtatactccccattagctggaggtggggggagtctgacatgacttttatctgcgttgcgcgtaatcctgtgtcacggaatttctcatctcctatacttgcccgtaagttgtgcgaaggtgccgcagatgacccagacagttctatggtgctgctgtgtctgctgcttgtgcctctgttactgagtctttttgtgctgggcctcttcctttggttcctgaagcgagaacgccaggaagaatacatcgaagaaaaaaagagggtggatatctgccgcgagacccccaacatctgcccccacagcggcgaaaacaccgaatacgacacgatcccgcacacaaaccggacaatcttgaaagaggaccccgctaataccgtgtattcaaccgtggagatcccaaagaagatggagaatcctcactcccttttaaccatgccggatactccacggctatttgcgtacgagaacgtgatatag

SEQ ID NO: 240676 - DNA, 1008 bp, Artificial Sequence
  Description of Artificial Sequence: Synthetic coding sequence
atggcaggctctcccacgtgcttaaccctgatctatatcctgtggcagctgacgggctccgcggctagcggacccgttaaagagctggtgggtagtgtgggaggggcagtcactttccctctgaagtcaaaggtgaagcaggtggactctattgtgtggacctttaacaccaccccactcgttacaattcagcccgaaggcggaactatcatcgtgacccagaaccgaaaccgggagcgagtcgactttcctgacggcggttacagccttaaattaagcaagttgaaaaaaaatgactcaggcatttactacgtagggatttattcttcatcactgcagcagcccagtacacaagagtatgttcttcatgtctatgagcatctgtccaaacccaaagtgaccatgggcttacagtccaataagaatggaacgtgtgtcacaaacctcacctgctgcatggagcatggcgaagaagatgtcatttacacctggaaggccctggggcaggccgcaaacgagtcccacaatggatcaatactacctatttcgtggcgttggggcgaatccgacatgactttcatctgcgtagcacgtaatcctgtgagtcgaaacttttccagccctattttggcccgaaaattgtgtgagggtgccgctgatgatcctgacagtagcatggtgctcttgtgtctgttactggtaccactgctgctgagtctgtttgtgctcgggttattcctgtggtttctgaagcgtgagagacaggaagagtacatagaggagaaaaaacgagtagatatttgcagggagacacccaacatttgcccacactctggagaaaatactgagtacgataccattccccacaccaatcggactatactgaaagaagaccctgccaacactgtgtatagtacggtcgaaatccctaagaagatggagaatccccacagcctgctgaccatgcctgatactccgagattattcgcatacgagaatgtgatttag

SEQ ID NO: 240677 - DNA, 615 bp, Artificial Sequence
  Description of Artificial Sequence: Synthetic coding sequence
atggccggatctcctacgtgcctcactctcatttacattttgtggcagctgactgggagtgccgcttctggtcccgtgaaggagctcgtgggcagtgttggaggcgcagttacatttccactcaagtctaaggtgaaacaggtagattccatagtgtggactttcaataccactccactggtcaccatccaacccgagggcggaactatcattgtgacgcagaatcgcaaccgcgagcgcgtcgatttccccgatggaggctacagtttgaaattgtccaagcttaaaaaaaacgactcaggtatctactacgtgggaatatatagcagctccctgcagcagccgtctacacaggagtacgtcctccacgtttacgaatacatcgaggaaaaaaagcgagtagatatatgccgagagaccccgaacatttgtccccactctggcgagaatacagagtatgacacgattccccacacaaatcggaccatcctgaaggaagatccagccaatacagtgtactcaacagtggagattccgaagaaaatggaaaatccacactctctgcttacaatgccggatacacctagactgttcgcatacgaaaatgtcatctag

SEQ ID NO: 240678 - DNA, 498 bp, Artificial Sequence
  Description of Artificial Sequence: Synthetic coding sequence
atggctgggagccccacatgcctgactctgatatatatcttatggcagttaacagggtcagccgcatctggcccagtgaaggagctagtgggatctgtggggggagccgtaacttttccactaaagagtaaagtcaagcaggtagactccattgtgtggactttcaacactactcctctggtgaccatccaacctgaagggggaaccatcatcgtcactcagaaccggaacagagaaagggtcgactttcccgatgggggatacagccttaagttgagtaagctcaagaagaatgatagtggcatatactacgtgggcatctactcttcatcactgcagcagccatccacacaagagtatgtgctccatgtttatgaaaacaacccaaagggtcgctcttccaaatacggtctgttacattgcggtaatacagaaaaagatggcaagtcacccctgacagcccacgacgcacggcacactaaagccatttgcctgtag

SEQ ID NO: 240679 - DNA, 450 bp, Artificial Sequence
  Description of Artificial Sequence: Synthetic coding sequence
atggccggtagtccgacgtgccttactcttatttacattttgtggcagttaaccgagcacctgtctaaacctaaggtgaccatgggtttgcagtcaaataaaaacggcacgtgtgtaacaaacctgacgtgctgtatggaacacggtgaagaagacgtgatttacacgtggaaagcattggggcaagctgctaatgagagccataacggtagtatactgccgatttcgtggaggtggggcgagagcgacatgacattcatctgtgtggccagaaatcccgtcagtagaaacttttcatctcctattctcgctaggaaactttgtgaagagaataatcctaaggggagaagttccaagtacggactgctccattgtggcaacacagagaaagatggaaagtctccactgacggctcacgacgctaggcataccaaggctatctgtctttag

SEQ ID NO: 240680 - DNA, 567 bp, Artificial Sequence
  Description of Artificial Sequence: Synthetic coding sequence
atggccggatcacctacatgtctcaccctcatctatatcctctggcaacttactgagcacctctcgaagcctaaggtgaccatgggcctgcagagcaacaagaatgggacttgtgtgactaacctgacatgctgcatggagcacggagaagaggacgtgatttacacttggaaggctcttggtcaggctgccaacgagtcccacaatggaagcatactcccaatcagttggaggtggggcgaaagtgacatgaccttcatctgcgtggcgaggaatcccgtctcccggaactttagctcaccaatccttgctaggaaattgtgcgaagagtatatcgaggagaaaaagagggttgacatctgtagagagacgccaaacatctgtccacactccggcgagaacacagaatacgacacaattcctcacaccaacagaaccattttaaaagaagacccggctaacacagtgtattcgaccgtcgagatacccaaaaaaatggagaatccgcactcactgctgaccatgccagacacacccaggctgtttgcctacgagaatgtgatatag

SEQ ID NO: 240681 - DNA, 858 bp, Artificial Sequence
  Description of Artificial Sequence: Synthetic coding sequence
atggtgatgagacccttatggtccctcttactgtgggaggctttgttgccaatcaccgtgaccggggcacaggtgttaagcaaggttgggggaagtgtcttgctagtcgctgcaaggccccctggcttccaggttcgggaggctatctggcgttccctctggccttcagaggaattacttgccactttcttccgcggttccctcgagacactctatcactccaggtttcttgggagggcccagctccacagcaatctttcactggagctgggacctctcgagagcggtgatagcggaaactttagcgtgctgatggttgacacacgcggacagccctggacacaaacattacagcttaaagtttatgatgcagttccacggccagtagtgcaggtatttattgctgtcgagcgggatgcgcagccaagcaagacatgccaagtgtttctctcctgctgggccccaaatatttctgagattacgtactcctggcggcgtgaaacaaccatggatttcggcatggaacctcacagtctctttactgatgggcaggtgctttccatttcccttggcccaggagacagggacgttgcctactcttgcatagtttctaatcctgtttcttgggacctggctactgtcacaccgtgggactcatgtcaccatgaagcggctcctggcaaagcttcatacaaggacgtgctgttagttgtcgtgcctgtgtcgctcctccttatgctcgtcactctgttctcagcctggcattggtgcccatgcagcgggaagaagaagaaggatgtccatgcagacagggtcggtcctgaaaccgaaaaccccttggtgcaggacttgccttag

SEQ ID NO: 240682 - DNA, 531 bp, Artificial Sequence
  Description of Artificial Sequence: Synthetic coding sequence
atggtcatgcgtcctctgtggtcactcctgctgtgggaagatgccgtccctcgcccagtggtccaagtgttcattgcagtggagagagatgcacagccctccaaaacttgccaggtgttcctatcctgttgggcaccgaacatttccgaaatcacatactcctggaggcgggaaaccaccatggactttggcatggagccgcactctctgtttacagatgggcaggttctgtcaatttctctcggccctggggacagagatgtggcgtattcttgtatcgtcagcaatccagtgagctgggacctcgccacagtgaccccgtgggattcttgccaccatgaggcagctcccggtaaggctagttacaaagacgtcctcctagttgtcgtcccagtgagtcttctgctcatgcttgtcacactctttagcgcatggcattggtgcccatgttccgggaagaaaaagaaggacgtgcatgccgatagagtgggccctgaaacagagaatcccctagttcaggatctgccctag

SEQ ID NO: 240683 - DNA, 444 bp, Artificial Sequence
  Description of Artificial Sequence: Synthetic coding sequence
atgggcggtcggcaccacctgcaacgacaggtgagcgagagcatgtctgctctattccaggcagtgcgtctcgagagcgcttgggcggaccgcgttcggtatatggttgtggtgtacagctctggcagacaagataccgaagaaaatatcttgctcggtgttgacttttcttcaaaagagtccggcttcagcgtcagcacagccggtcgaatgcacatttttaagccagttagcgtccaggctatgtggtccgctctgcaggttctgcataaagcttgtgaagtggccaggcggcacaattattttcccggaggcgtggccttgatctgggccacctactatgagtcctgcatatcaagtgagcagtcatgcattaatgagtggaatgcaatgcaagatctggagtcaacccgccctgactcaccagctctgttcgttgactag

SEQ ID NO: 240684 - DNA, 2112 bp, Artificial Sequence
  Description of Artificial Sequence: Synthetic coding sequence
atggcccgagcacgtcgggcagtggtgggcagcgtgcgggacgtctcaactgcagcgaccaacttgttttacttcacagacttctgtatctttcttcagcctacccattgcttctgctgtccagaggttagtagctctaactacctgtctgagtctttcttcatggtaaagggagccgcactgttcctgcaacagggatcaagtccccaagggcaacgcagtctgcaacatccacacaaacacgccggagaccttcctcagcacctgcaggtaatgatcaaccttttgagatgcgaagataggataaagctggcagtcagattggagtccgcatgggccgacagggtgcgctatatggttgtagtatactcttccggcaggcaggacaccgaggagaatatcctgttaggtgtggacttttcctccaaggaatcaaagtcttgtaccattggaatggtactgaggttatggagtgatacgaagatccacctggacggcgacggtggctttagcgtttccaccgctggtcggatgcacatcttcaagcctgtatccgttcaggccatgtggtcagcccttcaggtcctgcacaaggcctgtgaagtcgcgcgacggcacaactattttcctggcggagtggccctgatttgggcaacatattatgaatcctgcatatcttctgaacagtcatgtatcaatgaatggaatgccatgcaagacttggagagcacccgacctgattctccagcgctttttgttgacaagcccactgaaggggaacgtactgaaaggctgatcaaagccaagttgcgctccatcatgatgtcgcaggacctggagaacgtgaccagcaaggaaatccggaatgagttggaaaaacaaatgaactgtaacttgaaggagctcaaggaatttatcgacaacgaaatgctcttgatcttgggccaaatggataaaccctctctcatattcgaccacctctacttggggagtgagtggaacgcctccaacttggaagaactccagggatcgggcgtggattatatcttgaatgtcacccgagagatcgataactttttccccggtctctttgcctaccacaatatacgagtctatgatgaagaaacgactgacctgttggctcactggaacgaggcctatcatttcatcaacaaggccaaaagaaatcactccaagtgcctagttcactgtaagatgggagtttcacgctcagcatccaccgttatcgcatacgcaatgaaggagtttggttggcctttggaaaaggcctataattacgtgaaacagaaacgttcaatcactaggccgaacgccggtttcatgcgccagctcagtgagtatgagggaatcttggatgctagcaaacagcggcacaataagttgtggagacaacagaccgacagctcattacagcagcccgtcgatgatccagctggcccaggagatttcctcccagaaacgcctgatggcacgcccgagagtcagctcccctttctggacgacgctgcccagccaggattaggacctcctctcccttgttgcttcaggcgcctgagtgacccacttctcccatcacctgaggatgaaactggttcattggttcacctcgaggatccggaaagagaggcccttctcgaggaggctgccccacctgccgaggtgcatcgaccagcacgccagccccagcagggctctgggctctgtgaaaaggacgtgaagaaaaaactcgagtttgggtctccgaaagggaggagcggatcactgctccaggttgaggagacagagcgcgaggaaggacttggggctgggagatgggggcagttgcctactcaactggaccagaacctgttgaattcagaaaacctcaataataatagcaaaaggtcatgcccaaacggcatggaggttggcagggcacggccagcgggttggcacacaccatccctcccatcacactcaaactggccgacctcagcttcagtggtggggaccaccggcacgcgccaccacacacagctcatttttttctactgcctcctttgggcgcctagtagccatctgcagggacctgaaggatccttcacaggatag

SEQ ID NO: 240685 - DNA, 3150 bp, Artificial Sequence
  Description of Artificial Sequence: Synthetic coding sequence
atggccttggtgacgttgcagcgttcccctacacccagcgccgcatccagcagcgcttcaaacagtgagctggaagccggatctgaggaggatcgcaagctaaacctgtcattgtcggaaagcttctttatggtgaagggggcagctctgttccttcagcaaggctcgagcccccaaggtcagagaagtctgcagcatccccacaagcacgcaggagacttaccgcagcacctgcaggtgatgattaacttgcttcgatgcgaagacagaatcaagctcgcggtgcggttagagtctgcctgggctgaccgggttagatacatggtggtagtatactcatccgggagacaggatacagaggagaatatactgctaggcgtcgacttttcctccaaggagagcaagagttgtacaatcggcatggtgcttcgactgtggtccgatacgaaaattcacctggacggggacggaggctttagtgtctctactgccggtcggatgcatatctttaagcccgtctctgtgcaggcaatgtggagtgcactccaagttctgcacaaggcatgtgaggtggccagaaggcacaattattttccaggcggagtggctcttatctgggccacttactatgaaagctgcatctcgagcgaacagtcatgcatcaatgagtggaacgccatgcaagatcttgagagcacaaggccagacagtccagccctctttgtggacaagcctaccgagggtgagcggactgagcggctcatcaaggctaagctcagaagcatcatgatgtctcaggatctggaaaacgttaccagcaaggaaatccgcaacgagctggagaagcagatgaattgcaacctgaaagagcttaaagagttcatcgacaacgagatgctgttaatactgggccagatggacaaaccaagcctcatttttgatcacctatacctcggctccgaatggaacgcatcaaacctcgaagaattgcagggaagcggagtcgactatattctcaatgtaacgcgcgagattgacaattttttccctggactctttgcgtatcacaacatccgggtttacgatgaagagacaactgacctccttgcccactggaacgaggcctaccattttattaataaagccaagcgaaaccacagtaagtgcctggtacactgcaagatgggcgtatcaaggtctgctagcaccgttatagcctacgccatgaaagaatttgggtggccccttgaaaaagcctataactacgtgaagcaaaagagaagcatcacccgtcccaacgccggattcatgaggcagttatcggagtatgagggaatcctggacgcatcaaagcagagacataacaagctgtggcgtcagcagaccgacagctccctccagcagcctgtcgatgaccccgcaggccctggcgatttccttccggagacaccagacggcacgccagagagtcagctcccctttttggatgatgccgctcagcctggactgggacctccattaccttgctgttttcggagactgtccgaccccctgctgccaagccctgaggacgagaccggctccctcgtccacctggaggaccctgagagagaggcactcctggaggaggcggctccgcctgccgaggttcaccggccagcacgacagccccagcaggggtccgggttatgtgagaaagacgtgaaaaagaaacttgagttcggctctcctaaagggaggagcggatcactcctccaggtggaagaaactgaaagggaagagggcctgggggctggtcgatggggccagttgcctactcaactggatcagaacctcctcaatagtgaaaacctcaataacaactccaaacgatcttgtccaaatggaatggaagacgatgccatctttggcatcctcaataaggtcaagcctagttataaatcctgcgccgactgtatgtaccccaccgccagtggagcaccagaagcctctagggaaaggtgcgaagaccccaatgccccagccatctgcacccagcctgcattcctgcctcacatcaccagtagcccagtcgctcatctggcctctagatcccgggtccctgagaaacctgccagcggacccactgagcctccccctttcctcccgccagccggttcccgcagagctgacacgtctggccctggagccggagccgcattagagccacccgcatcccttctggagccatccagggagacgcccaaagtgcttccgaagtcactcctcctgaagaactcacactgtgacaagaatccaccgtccacagaggtcgttatcaaagaagaatcttcaccaaaaaaagatatgaagccggcaaaagacctgcgacttcttttttctaacgaatccgagaagccaaccaccaacagctatctcatgcaacaccaggagtccattattcagctgcaaaaggcgggtctagtcagaaagcatacgaaggagctcgagagactgaagtccgttccagccgaccctgcccctccctcccgcgatggccctgcatctcgactcgaggcctcaattcccgaagaatcccaggacccagctgctctccacgagttgggcccactggtcatgcccagccaggccggatcagacgaaaagagcgaggcggctcctgctagcctagaagggggatcactcaagtctcctcctccattcttttacagacttgaccatactagctcgttctctaaggacttcctgaagaccatctgctatacacctacctcaagctccatgagtagcaacctcacacgttcatcttcgagtgactcaattcattccgttcgcggaaaaccgggactcgttaagcagaggacccaggagatcgagaccaggctgcgactagccggtctcacagtgtcctcccctctgaagagatcacactcccttgccaagcttggttctctgaccttttccacggaggatctgagcagcgaagctgacccgtccacagttgctgactcccaggatactaccctgagcgaaagcagtttcctccacgagccccagggaacacctcgagatcccgcagctacgtccaagccttcaggcaaaccggctccagaaaaccttaagtcaccctcatggatgtcaaagtcttag

SEQ ID NO: 240686 - DNA, 2214 bp, Artificial Sequence
  Description of Artificial Sequence: Synthetic coding sequence
atgcgctgttatcttagctgggatcggtggacttcacctccactgtcatcaatcatcttcatctctgtggattatatcctgaatgtgacgcgagaaatcgacaattttttccccggtctgttcgcctaccataatattagggtttatgatgaggaaactacggatcttctggcccattggaacgaggcctatcacttcataaacaaggccaagcgaaaccattccaaatgtttggtgcattgcaaaatgggcgtgtctcggtcggcttcaactgtgattgcatatgccatgaaggaatttgggtggccattagagaaagcctacaattatgtcaaacaaaaaaggtctatcacccgtccgaacgcagggttcatgaggcagctcagcgaatatgagggaatcttagacgcttccaagcagagacataacaaactgtggcggcaacaaacggacagctcattgcagcagccagtggatgaccctgctgggcctggagactttctgcccgagacccccgatggtactcctgagtcgcagctccccttcctggacgacgctgcccagcccggactcggaccccctctgccttgttgcttccgaagattgtctgatccattattaccctctcccgaggacgaaacagggtcacttgttcatctggaggacccagagagagaggcactactcgaagaagccgcacccccagccgaagtgcaccgtcctgcaagacagccacagcaagggtcgggtctgtgcgagaaggacgtgaagaaaaagctcgagttcggctcccctaaaggtcggagcggctcactcctccaggttgaggagacagagcgagaggagggcttgggcgcaggaagatgggggcagctacctactcaactggatcagaatctgctcaactccgaaaatctgaacaacaacagtaagcgatcctgtcctaatggaatggaggatgacgccatcttcggcatcctgaataaggtgaagcccagctacaagagctgtgccgattgtatgtaccccacggcctcaggggctccggaagcctccagagagagatgtgaggacccaaatgctccggcaatctgcactcagcccgcttttcttccccacattacttccagcccagtcgcccatctggcaagcaggtctcgggttcctgaaaagcccgctagcggaccaactgagccgcctcctttcctccctccagccggttccaggcgcgcagatacttcggggccaggcgcaggcgctgccctcgagcctccagcgagcctgctggagccaagccgggaaactcctaaggtgctgcctaagtccctgctgctgaagaacagccactgtgacaaaaaccccccaagcaccgaagtggttattaaagaggagtccagtcctaagaaggatatgaaaccggcaaaagatctgcgactgctgttcagcaatgaaagcgagaagcctaccactaatagctatctgatgcaacaccaggagtctattatccaactccagaaggcaggcctggttcggaaacacactaaagaactggaacgactgaaatccgtgccagccgacccggcaccccctagtcgagacgggccagccagcaggctcgaggccagtattccagaggagtcccaagacccggctgcactgcacgaactgggaccactggtgatgccatcccaggcaggatccgacgaaaagtccgaagctgccccagcaagcctggaggggggaagcttaaagagccctccccctttcttttatcggttagatcacacgtcatctttctcgaaggattttctgaagactatctgttacactcccaccagtagcagcatgtcttccaacctcacccgtagcagttcatctgattctatacactcagtgagaggcaaacctggcctcgtgaagcaaaggacacaggaaattgagaccagacttcggctcgcaggccttacagtctccagccctctgaagcggtcccactctctggccaaactgggctctctgaccttctccacagaagatctctcctcagaggcagacccttccaccgttgccgactctcaggacactactcttagcgaatcaagttttctccacgaaccccaaggtactcccagggatcccgctgctacatccaagccttcgggcaagcctgccccagagaacctgaaatcccccagttggatgtctaaatcctag

SEQ ID NO: 240687 - DNA, 2079 bp, Artificial Sequence
  Description of Artificial Sequence: Synthetic coding sequence
atggctcttgtgaccctgcaacgcagtccgaccccatctgctgcttcctctagcgctagcaatagcgagcttgaagccggttccgaggaagacaggaagctcaacctctcactcagcgagtccttcttcatggtgaagggagccgcactattcctgcagcagggctcctccccacagggacagagaagtttacagcatcctcataaacacgctggcgacctcccccagcatttgcaggtcatgataaatctgcttcggtgtgaagacaggataaagctggcggttcggctggagtcagcatgggccgatagagtgcgctacatggtggttgtgtacagcagcggcaggcaagatacagaagaaaacattcttcttggcgtggacttctcgagtaaggagagcaagtcttgcaccattggcatggtcctccgcttgtggagtgatactaaaatccatctggatggcgacggaggtttttctgttagtacagcgggacgcatgcacatttttaaacctgtttctgtacaggcaatgtggtctgctctccaggtgttgcacaaggcctgtgaggtggcccgacgccataactatttccctgggggagtagccctcatctgggccacgtattatgaatcttgtatttccagcgaacagtcgtgtatcaacgagtggaatgccatgcaggacctcgagtccacacgtccagattcacctgccctttttgttgacaaacccaccgagggagagcggactgaaagactgatcaaagcaaaactgcgcagtatcatgatgtcccaggacctggagaatgtaacatctaaagagatccgaaacgaactggagaagcagatgaactgcaatcttaaggagttgaaggaatttatcgataatgagatgttgcttatcttagggcaaatggacaagccctcactgatattcgaccatttgtacctgggctccgaatggaacgcatccaacttggaagagctgcaggggagcggtgtggattatatcctgaacgtgactagagaaatcgacaacttttttcctggcctgttcgcttaccataatattagagtgtatgacgaggagacgaccgacctgcttgcacattggaacgaggcttaccacttcattaacaaagcaaagaggaatcattccaagtgtcttgtccactgtaagatgggcgtcagtcgctccgcgtcaaccgtgatcgcctatgccatgaaagaatttgggtggccgcttgagaaggcctacaattatgtaaagcagaaaaggtcaatcacccgaccaaatgctggttttatgcggcaactctctgagtacgaaggcattctcgacgcttcaaaacagaggcacaacaagctttggagacaacagacagatagcagcctgcagcagccagttgacgaccctgctgggccaggtgatttcttgcccgaaacacctgatggcacgcctgagtcccaacttcctttcttggatgatgcagctcaaccagggttgggaccacctctgccctgctgtttcagacgactgtccgatccactcctgcccagccccgaggacgaaactggaagcctcgttcatttggaggaccccgaaagggaagccttgctcgaggaagcagctcccccagccgaagtgcacaggcctgcacggcagcctcagcagggcagcggcttgtgcgagaaagacgtaaaaaagaaactggagttcggatcccctaagggacgctccggcagtcttttgcaggtagaggaaaccgagcgcgaggagggccttggagcgggtcgttggggacagctgccgacccaacttgaccagaatttgctgaactctgaaaatctcaataataatagcaaacgcagctgtccaaatggtatggaggtgggcagggccaggcctgctgggtggcacacaccctccttgccctcacatagcaattggcctacatccgcatctgtggttgggactaccgggacccggcaccatactcaactcatctttttttattgcctcctgtgggcaccatcttcccatctgcaggggcctgaggggtcctttacaggctag

SEQ ID NO: 240688 - DNA, 4272 bp, Artificial Sequence
  Description of Artificial Sequence: Synthetic coding sequence
atggcactggtgacggtccaaaggtccccaaccccaagtacgacgagttcaccttgcgcttccgaggccgattctggcgaagaagaatgcagaagccagcctagaagtatcagtgagtcttttctcaccgtgaaaggcgctgcactgttccttccacgaggcaatggctccagtacccctcgcatttcacacaggaggaacaaacacgccggagatttgcagcagcatctccaggccatgttcattctgttaaggccagaggacaatattcgtctggccgtgcgtctggaaagcacataccaaaacagaacaaggtacatggtggtggtgtcgaccaatggcaggcaggataccgaagagtcgatagtcttaggcatggattttagttccaacgatagcagcacctgcaccatgggccttgtgctgcccctctggtccgataccttgattcaccttgatggcgacgggggattctctgttagtacagacaacagggtgcacatatttaaaccagtgtccgtgcaagccatgtggtctgctctgcaaagtctacacaaagcctgcgaggtggctcgcgcacataattattatcccggaagtctctttcttacgtgggtctcgtattacgaatcgcatattaacagcgatcagtcgtcggtaaatgagtggaatgccatgcaggacgttcaatcacaccggcctgactctcccgcactgtttactgatatacccacggaacgcgaacggaccgaacgcctcatcaagactaaactccgagaaatcatgatgcaaaaggacttggaaaacatcacctcaaaggaaatcaggactgagcttgagatgcagatggtatgcaacttgcgggagttcaaagagttcattgataacgagatgatcgtaatcctgggtcagatggactctcccactcaaatcttcgaacatgtttttcttggttcagagtggaatgcaagcaatcttgaagatctgcagaaccgaggcgtgcgctacatcttgaacgttacccgcgaaattgacaacttcttccctggagtgttcgaatatcataatattagggtctacgacgaggaggctaccgatcttcttgcgtactggaacgacacctacaagttcatctccaaggctaaaaagcatgggtcaaagtgcttagtacactgtaaaatgggcgtctctcggtccgcttcgactgtgattgcctacgccatgaaggaatatggatggaatcttgaccgtgcctacgattatgttaaggaaaggaggaccgtgaccaagcctaatccatccttcatgcggcagctcgaagaataccagggcatactcctagcttccaagcagagacacaacaagctgtggcgatcccactccgattccgacttgtcagatcatcacgagcccatttgtaagcccggacttgagctgaacaaaaaggatatcaccacctccgctgaccaaattgctgaagtcaaaaccatggaatcacaccctcccatcccgccagtgtttgtggagcatatggtccctcaggacgccaatcaaaaaggtctttgtacaaaggagaggatgatttgcctggaattcacgagtcgcgaattccatgccggacagatcgaggatgagttgaatcttaatgatatcaacggttgttcaagcggctgctgtctgaatgaatctaaatttccactcgacaactgtcatgcatcaaaagcgctgatccagcctggacatgtcccggagatggcaaacaaatttcctgatcttaccgtggaagacctggagactgacgcactcaaagcggatatgaacgtgcacctgctgccaatggaggagctgacttcccctctgaaggatcccccaatgtccccggaccccgaatctccaagcccgcagccctcctgccagaccgagatctctgacttttctaccgataggatcgactttttcagtgccctggaaaaatttgtcgagctgagccaagaaaccaggagccgctcattcagccactctcgaatggaggagcttggcggtgggcgtaatgaaagctgcaggttgtccgttgttgaggtggcacccagtaaggtgaccgcagatgaccagcggagcagctccctaagcaacaccccccacgcgagcgaagagtcttctatggacgaagaacagtcaaaggctataagcgagttggtctcaccggacatcttcatgcagagccactcagaaaacgctattagtgtaaaggaaatcgtaacagagattgagagcattagccagggtgtggggcaaatccaactgaaaggcgacattctgcccaacccgtgccatacaccgaaaaagaactctatccatgagctcctactagaacgcgcacagacaccggaaaataagcccggtcatatggagcaagacgaggactcctgtaccgcacagccagaattggcaaaagactccggtatgtgtaaccctgaagggtgcctcacgactcacagctcaattgctgatcttgaagaaggagaaccggcagagggagagcaagagttacagggttcagggatgcaccctggcgcaaaatggtatccaggcagcgtaaggcgtgcaaccctggagtttgaggaacgtcttcgtcaggaacaggagcatcacggggcagcaccgacttgcacaagcctttcaacgcgaaaaaatagcaaaaacgattcatctgtcgctgacttagctccaaaaggcaagtccgatgaggcacccccagaacatagcttcgtgcttaaggagccggaaatgtctaaaggaaaaggcaaatatagtggatccgaggccggttccctgagccactctgagcagaacgccaccgtgccggctccacgtgtcctcgagtttgatcacctacccgacccacaagaagggccaggttcggatacggggacccagcaagaaggcgttctgaaggacctgaggaccgtgatcccctaccaggaatctgagacccaagctgtcccactgccactacccaagagggtggaaatcatcgagtatacacacatcgtaacctccccgaatcatacaggcccaggctccgaaatagccacaagcgaaaagtctggagaacagggattaaggaaggtgaatatggagaagagcgtcaccgtattatgcaccttggacgaaaatctcaacaggacattggaccctaaccaggtttctctccaccctcaggtcctccccttgcctcacagtagtagtcctgagcacaatcggcctactgaccaccctactagtatcctgagctccccagaagaccgcggatcttccctgtctacagctcttgagactgctgccccatttgttagccacactacccacttgctgtcggcaagcttggactaccttcaccctcagactatggttcatcttgagggcttcactgagcagtccagtaccactgacgagccctccgcagagcaagtgtcctgggaagaaagtcaggaatccccccttagttccgggtccgaggtcccctataaagattcacagctgagctccgccgatctgagtcttatctccaagctcggcgataatacaggagagctccaggagaaaatggatcctctgcccgtggcctgcaggcttccccatagttctagtagcgaaaatatcaagtctttgagtcacagcccaggagttgtgaaggaacgagcaaaagagatcgagtcacgcgttgtgtttcaggctgggctgacgaagccatctcaaatgaggagaagcgcctctctggccaagctaggatatctcgatctgtgtaaggactgtctccctgaaagagagccagccagttgtgagagcccgcacctcaagctccttcaaccgttcctgaggacggactcaggtatgcatgcaatggaggaccaggagtctctcgaaaatcctggcgctccacataatccagaacccacaaagtctttcgtggagcagttaacgaccacagaatgtatcgtgcagtcaaaacctgtggagcgcccacttgtgcaatatgctaaagaattcggcagctctcagcagtacctcctcccccgtgcgggactggaattgacatcgagtgaagggggactgcccgtgcttcagactcagggcctccagtgcgcctgtcctgccccaggcctcgcggtagctcctcgccagcagcatggcagaacccatccgctccgacggctgaagaaagctaacgacaaaaaacgcacgaccaaccccttttacaacaccatgtag

SEQ ID NO: 240689 - DNA, 609 bp, Artificial Sequence
  Description of Artificial Sequence: Synthetic coding sequence
atgactctgtccacattggcaaggaaacgcaaagcacctttagcctgcacttgcagcctgggagggccagatatgattccctatttctcagccaacgctgtgatctcgcagaacgccatcaatcagttaattagcgagtctttcctgacagttaagggggcagctctcttcctcccccgaggcaatggctcctccacccccagaatttcacacagacgaaataaacacgcgggtgacttacaacagcacctgcaggccatgttcatactcctcagaccggaagataatatccggctggccgtcagactcgaatcaacatatcagaatcgcactaggtacatggtagtcgtgagcacaaatggcagacaggatacagaggagtccatcgtgctgggcatggacttctcctccaacgactcatccacatgcaccatgggattagtgctgccactgtggtccgacaccctcatccatctggacggggatgggggtttttctgtttcgaccgacaatagagtccatatcttcaaacctgttagcgtacaggccatgtgggttgacagggactcaaggaacaagcactgcgatgtgctgctggttgaggaatag

SEQ ID NO: 240690 - DNA, 1350 bp, Artificial Sequence
  Description of Artificial Sequence: Synthetic coding sequence
atggctttagtcaccgtgcagagatctcctaccccctcaacaacttccagcccatgtgccagcgaggccgactcaggtgaggaggaatgcaggtctcagccacggagcatcagtgagtctttcctaacagtgaaaggagcagcactgtttctgccacgcggaaatggcagttccacccctagaattagccaccggcgtaacaaacacgccggagaccttcagcagcatctccaggctatgtttatcttgttacggccagaggataacataagacttgccgtccgattggagtccacctaccagaaccggactcgctacatggttgtagttagtacaaatggtagacaggacacagaagagagcatcgtgttgggtatggatttcagctcaaacgactcctctacctgcacaatgggactggtcctgcctctctggtcggacactctcatccatctggatggagatggcggatttagcgtcagcaccgataaccgagtgcatatctttaagccagtttcagtccaggctatgtggtcagctttgcagagcctccacaaggcctgcgaggtggccagggcccacaactactatcctggatcccttttcttgacctgggtttcttattacgaaagccacataaatagcgaccagtcaagcgtcaacgaatggaacgcaatgcaggatgtacaatcacacagacccgactcgcccgcactgtttactgacattccaaccgaacgagaaaggacagagaggctaatcaaaactaagcttcgggaaattatgatgcagaaggacctggagaacatcaccagtaaagagattcggacagagcttgagatgcagatggtttgtaacctgagggaatttaaggaattcattgacaatgagatgatcgtgattctggggcagatggatagtccaacccagatcttcgagcacgtgtttttgggttcggagtggaacgcatctaatctagaagaccttcagaacagaggcgtgcgctacatactcaacgtgacgcgcgaaatcgataacttcttccctggcgtcttcgagtaccacaatatacgagtgtacgatgaggaagccacagatttactggcgtactggaatgatacatataaattcatcagcaaagctaagaaacacggtagcaaatgtctggtccattgtaagatgggtgtcagcaggagtgcaagcaccgtgattgcttacgccatgaaagaatacggctggaacctcgatagggcgtatgattatgtgaaggagcggagaactgtgacgaaaccaaatccatcgttcatgagacagctcgaggaataccagggcatcctgctggctagatag

SEQ ID NO: 240691 - DNA, 4353 bp, Artificial Sequence
  Description of Artificial Sequence: Synthetic coding sequence
atggccctggtgaccgtccagcggtctcctactccatcaactacaagttcgccctgcgcttccagcagccatctcgaggactctgaatcggctgcattactgtgttgcgaatgcgaagagagcgaaatctttactgattccaatgaggcagattccggggaggaagagtgcaggtcccagcctcgctccatctctgagtcttttctgacagtaaagggagcggctctgttcctcccgcgagggaacggttcgtcaacccctagaataagccaccgcagaaataaacacgctggtgacctacaacagcacctgcaggcaatgttcattctgcttcgtcccgaggataacatccgtctggcagtgagacttgaatcaacttatcagaatagaacccgatacatggtcgtcgtatccacaaacggacgccaggatacagaagagtcaatagtcctgggaatggatttctcatctaacgactcctccacctgtactatgggtcttgtactccccttatggtccgacacactgatccacctggacggggacggcggttttagcgtctccacagacaacagggtacatattttcaagcctgtcagcgtccaggctatgtggtcagccctgcaaagtcttcacaaagcttgtgaggtggcgcgagcccacaactactaccctggtagcctgttccttacttgggtgtcctactacgagtcccatataaattccgaccagtcttctgtgaacgaatggaacgccatgcaggacgtgcagtctcatcgaccagatagtccagctctgtttacagatatcccaacagaacgggaaaggactgaaaggctcataaaaacgaaattgcgcgagattatgatgcagaaagacttggagaacattacttccaaggagatccgaaccgagcttgaaatgcagatggtgtgcaacctcagggagttcaaagaattcatcgacaatgaaatgatcgttatactcgggcagatggactcgcccacgcagatcttcgagcacgtatttttaggcagcgaatggaatgcatcaaatcttgaagatctgcagaaccggggagtacgctacatactgaacgtaaccagagagatcgataatttctttcccggagtcttcgaataccacaacatccgcgtttatgacgaggaagcgaccgacctgctcgcgtactggaacgatacgtacaagttcatttctaaagccaagaaacacggatctaagtgtctggtccactgcaaaatgggcgttagcaggtccgcaagcaccgtgattgcttacgccatgaaggaatatgggtggaatctggaccgggcttatgactacgtgaaggaacgacgtaccgtcacaaaaccaaacccatccttcatgaggcagctggaagaataccaggggatcctattggctagcaaacaacgccacaataaattgtggaggagtcacagcgatagcgatttgagtgatcatcacgagcccatttgtaaacctggtctggaactcaacaagaaggacattaccacctctgccgaccagatagcagaggtaaagacaatggagagtcacccaccaattcccccagttttcgtagagcacatggtgccccaagacgccaatcagaagggcttgtgtaccaaagagagaatgatctgtctagagtttacgagcagggaattccacgccggacagatcgaagatgaattaaacctgaacgacatcaacggctgttccagcggatgctgtctcaatgagtctaagtttcccctggataattgccacgcgagcaaggctttgattcaacccggacatgtccccgaaatggcaaacaagttccccgatctgaccgtagaggacctggagaccgatgccctgaaagctgatatgaacgtacacttgcttccgatggaggaattgaccagccctcttaaggaccctcccatgtctcctgacccggagagccccagcccacagcccagctgccaaaccgaaatctccgacttttccacagacaggatcgacttcttcagtgcccttgagaaattcgtcgagctatctcaagagacaaggagcaggtcctttagccacagcaggatggaagagctcgggggaggacgcaatgagagttgtcgccttagcgtggtggaggtagccccaagtaaagttaccgccgatgatcaaagatcctcttcactgtcaaacacccctcacgcttctgaggaatcctctatggacgaggaacagtcgaaagccatctctgaactcgtgagcccagacatctttatgcagtcccacagtgagaatgctattagtgtcaaggagatcgtgacggaaattgagtctatcagtcaaggcgttggtcagattcaactgaaaggggacatcctcccaaatccttgccatacccccaagaagaattcaattcacgaactactgctggaaagagctcagacacctgagaacaagccaggtcacatggagcaggatgaagacagttgtacagctcagcccgagttagccaaagacagcggtatgtgtaatcctgagggctgcctcacgacccactcctccatcgccgatctggaggaaggcgagcctgccgagggggaacaggagttacagggatctgggatgcatccaggcgctaagtggtatccgggatctgtccggcgtgcaaccctggaatttgaggagcgcctacgtcaggagcaggaacatcacggtgctgctcccacctgtacgtccctgtcaacaaggaagaatagtaagaacgattcctctgtcgctgatctcgctcccaaaggtaagagtgatgaagcacccccagaacactcttttgtgctaaaggagcccgagatgtccaaaggaaaaggcaagtatagtggttccgaagccggtagcttatcccactccgagcagaatgccaccgttcccgctcctcgggtgctggagtttgatcacttgccggacccacaggagggccctgggtctgataccgggacacagcaggaaggggtgctgaaggatctcaggaccgtcattccttaccaggagagcgagacgcaagctgtgcccctgcccctccccaagcgtgtggagataatcgaatacactcacatagttacttccccaaatcacactggcccagggtctgaaatcgctacctccgaaaagtccggcgagcaggggctgcgcaaggtgaacatggaaaaaagcgtcactgtcctctgcactctagacgagaacttgaatcgcactttggatcctaatcaggtgagcctccacccgcaggtcctcccactacctcatagctctagtccagagcataaccggccaacggatcacccaacctctattctctcttctcccgaagatagggggtcgtcactcagcaccgctctggaaaccgcggcaccgttcgttagccataccacccacctcttgtctgcctcattggactatttacaccctcaaacaatggtacatctcgaaggcttcactgagcagtctagcaccacagatgaaccaagtgccgagcaggtgagctgggaagagtcgcaggaaagccctttgagctctggctctgaagtgccatataaagacagtcaactgagctctgcagacctgagcctcatttccaaactgggggataacactggcgaactgcaggagaaaatggacccactgcctgtcgcctgccgcctgcctcacagcagttcttccgagaacattaaatccctgtcgcacagccctggagtggttaaggagcgagctaaggagatcgagtcacgggtggtcttccaggcgggactaactaaaccttcacaaatgagacgcagtgcaagcctggccaagttgggctatctcgacttatgcaaggattgcctccccgagcgggaacccgctagttgtgagtctcctcatctcaagctgctgcagccttttctgcgtactgactctgggatgcatgccatggaagaccaggagtccctggaaaacccaggagcccctcataatcctgagcctaccaaatcgtttgtggagcagttaactacaactgaatgtatcgtccagagtaaacccgtcgagaggcccttagtgcagtacgcaaaggagtttgggtcatcccagcaatacctattacctagagccggattagagctcacaagcagtgaggggggactgcctgtgttgcaaacacagggactgcagtgtgcctgccctgcgccagggttggcagttgccccacgccagcagcatgggaggactcaccccctgcggaggctcaaaaaagccaatgataaaaagcgcacaaccaacccattttataatacaatgtag

SEQ ID NO: 240692 - DNA, 1980 bp, Artificial Sequence
  Description of Artificial Sequence: Synthetic coding sequence
atggccctcgtaaccgtctcaagaagtcccccagggtccggagcttccacacccgttggcccatgggatcaggcggttcagagacggtctaggctccagaggcgtcagtcatttgcagttctgcggggtgctgtcttgggtttacaggatgggggtgataatgacgacgcagccgaggcctcttccgagccaactgaaaaagcgcctagtgaagaagaactgcatggcgaccagacagacttcgggcagggatcccaatcaccacagaagcaggaagagcagcggcagcatctccacctgatggttcagctgctccgtccacaggacgacataagactggctgcgcagctggaggctcctcgtccccctaggctaaggtacttactagtggtgtctaccagggaaggggagggccttagccaagatgagacagtgctactaggagtagactttcctgacagctctagcccgtcttgcacattgggactggttctccccctgtggagtgacactcaagtgtacctcgacggcgacgggggttttagcgtaacaagcggcggacagtctcgaattttcaagcctattagcatccaaactatgtgggccacgctgcaggtgctacatcaagcctgtgaggccgcactgggttccggcctagttcccggaggatccgccttaacatgggccagtcattatcaggagagactgaattcggaacagtcttgtctcaacgaatggactgctatggctgatctcgaaagcctgaggccgccatctgccgagcctggtggatcctctgaacaggaacagatggaacaggccatccgggcagaattgtggaaagtgctggacgtctctgacctggaaagcgtgactagtaaggaaatccgccaggcactggaactcaggctgggactgcctctacagcagtatcgggattttattgacaatcaaatgctgctcctggtagcccagcgagaccgcgcttctaggatctttccgcatttgtacctgggtagcgaatggaacgcagccaatctggaggagctccagcgcaatcgcgtgacgcatattctgaacatggcccgagagatagacaacttctaccccgaaaggttcacatatcacaacgtaaggctgtgggatgaagaatccgcccagttactgccgcattggaaagagacccaccggttcatcgaagctgctagggctcaggggacccatgtcctagtccattgcaagatgggggtgtcgcgaagcgccgctacggtcctggcctatgctatgaagcagtacgagtgttccctcgagcaagcactccgacatgtccaagaattaagacctattgcccgacctaatccaggatttctacggcagctgcagatttaccaaggtatactcacggcttcccgccagtcccatgtttgggagcagaaagtgggaggagtgagccccgaggaacaccccgcacctgaagtgtcgactccttttccccctctgccacccgaaccagagggcggaggcgaggagaaagtggtgggcatggaggaatcgcaggcagctcctaaggaagagcccggtccccgtccaagaattaaccttaggggagtcatgcggtccatttctctgctggagccttcccttgaactggagtccacgagtgaaacttcagacatgcctgaagttttctcttcgcacgagtcttcccacgaggagccattgcagccatttccacagttggccaggacaaagggtgggcaacaagtggataggggacctcagcccgcactaaaatctaggcagtccgtggttactctgcagggatctgccgtggtggctaaccgcactcaagccttccaggaacaggagcagggtcaaggccagggccagggagaaccttgtatctcttccacaccacgtttcagaaaggtggttagacaggcatccgttcacgattccggagaagagggagaagcctag

SEQ ID NO: 240693 - DNA, 2091 bp, Artificial Sequence
  Description of Artificial Sequence: Synthetic coding sequence
atgctgctctggatactgctactggaaacctctctctgcttcgccgctggcaatgtgacaggagatgtctgcaaggagaagatatgctcatgtaacgaaatcgaaggtgatctccatgtcgattgcgagaaaaagggctttacctcacttcaaaggttcaccgccccaacctctcagttctatcatctgttcctgcacgggaactccctcacaaggctgttcccaaacgagttcgcgaacttttataacgccgtgagcctgcacatggaaaataacggcttgcacgagatcgtgccgggagcttttttgggacttcagctggttaaacgattgcatatcaacaacaataaaatcaagtctttccgcaagcagacatttttaggcctggatgacctcgagtaccttcaggccgactttaatctgctgcgcgacatcgatccaggcgcattccaagaccttaacaagctagaagtcctcatcctaaatgacaatctcatctccacactgcccgctaatgtctttcagtacgtgcccatcacgcacctggatttgcgcggtaataggctcaagaccctgccatacgaggaggtgctcgagcaaattcctggcatcgcggagattctccttgaagataatccatgggattgcacttgtgatctactcagcctgaaagagtggctggagaatattccaaaaaacgctctcatcggccgagtggtctgtgaggctcctactaggctccaaggaaaagatttgaacgaaacaacagagcaggacctatgccccctgaagaatcgcgttgactcctctctgccagcccctcctgcacaggaggaaacattcgctcctgggcctcttccaaccccatttaagacaaatggccaggaggaccacgccacacccggttctgctcccaacgggggaacaaaaataccgggtaactggcaaataaagattcgccctactgctgccattgcgaccggcagtagtaggaataaacctctggctaattctttaccctgtcccggtggctgttcttgcgatcatattcctggaagtggactgaaaatgaattgcaacaaccgtaacgtgagcagcctggcagacctgaaaccgaagctttcaaatgtacaagagctgttcctcagagacaacaagattcacagtatcagaaaaagccacttcgtggactacaagaacttgatcctcctggacctcggcaataataatattgccactgtcgaaaataatacatttaagaacctgctggacttgagatggctctacatggatagtaattacctggatactctatcacgtgaaaagttcgctgggttacagaatcttgagtaccttaatgtagagtacaacgctatccagctgatactgccagggactttcaacgctatgcccaaactgcggatacttatcctgaacaacaacctgctccgctccctgcccgttgatgtttttgcaggtgtcagtctttccaaattgtccttgcataacaactactttatgtatctgcctgtggcaggtgttctcgatcagctgacatctatcatacaaatcgatcttcacggcaatccttgggagtgctcttgtaccatcgtcccttttaagcagtgggcagaaagactgggatcggaagtcctgatgtctgatttgaaatgcgagacacctgtaaatttctttaggaaggacttcatgctgcttagtaacgatgaaatctgtccccagctgtacgcaaggatttctcccactttgactagccacagtaaaaattccaccggactcgctgagaccggaacccatagtaactcctacctcgatacatcgcgcgtctctatttctgtgctggtgcccggtcttcttctcgtgttcgtgacgtcagccttcacagtcgtcggcatgcttgttttcattttacggaatcgtaaacggagtaaaagacgagacgccaattcatctgctagtgaaattaacagtctacaaaccgtctgtgattcttcatattggcacaacggcccatacaatgctgacggcgcacaccgcgtctacgattgcggctcacactctctgagcgactag

SEQ ID NO: 240694 - DNA, 2175 bp, Artificial Sequence
  Description of Artificial Sequence: Synthetic coding sequence
atgctgtcgggcgtgtggtttctctctgtcctgactgtggctggtatcctgcaaacagaaagtaggaagactgccaaggacatttgtaaaatccgctgtttgtgtgaggagaaggagaacgtgcttaacattaactgcgaaaacaaaggcttcaccactgtgtcactgttgcagcccccacagtatagaatctaccagttattcctgaatgggaatctgttgaccagattgtatcctaacgagttcgttaattattccaacgctgtcaccctgcatctcgggaataatggcctgcaggagattcggactggggcattttctgggctcaaaaccctgaaacggttgcatctcaacaacaacaaactggaaatccttagagaggatacttttttgggactcgaaagtctggagtatttacaggcagactacaactatatttctgccatcgaagcgggagccttctctaagcttaataagctgaaggtacttattctcaacgacaacctgctgctgtcactgcccagtaacgtgtttcggttcgtgctcttgacccacctggacctacgtggtaatagactaaaagtaatgcccttcgcaggagtcctcgagcacataggaggcatcatggagatacagcttgaggagaatccgtggaactgtacatgtgacctcctacctttgaaagcctggctggataccatcaccgttttcgtgggagaaattgtgtgtgagactccttttcggctgcatggcaaagatgtgacacaactaacgcggcaagacctgtgccctcgcaagtctgctagtgacagctctcagcgcggttcccatgctgacacacatgtacagaggctgagccctacgatgaacccggctcttaatcccaccagagccccaaaagcttcccgaccaccgaagatgcgcaataggcccacgcccagggtcaccgtgtcaaaagatagacagtcttttggcccaatcatggtgtatcagaccaagtcccctgtgccattgacctgcccctccagttgtgtatgcacaagtcagtcctccgataacggtttaaacgttaattgtcaggaaagaaagttcaccaacatttcggaccttcaacccaagcctacctcccccaaaaagctatacctgactgggaattacctgcagactgtttataagaacgacctgcttgagtattcttctcttgatctgttgcatcttggtaacaaccgcatagctgtgatccaggagggggctttcaccaaccttacttccctgcgcaggctgtatctgaatggtaattaccttgaagttctttatccttcaatgttcgacgggctccagagtctacagtacttatatttggagtataatgtgatcaaggagatcaagccactgactttcgatgccttgatcaaccttcagctactgtttctaaacaacaatcttctgcgctccctgcctgataatatcttcgggggaacagccttaaccaggctgaacctgaggaataaccatttctctcacctgcccgtgaagggggtgttggatcagctgcctgctttcatccagattgatttacaggagaacccttgggactgcacctgtgatataatgggcctgaaagattggactgagcatgcaaactccccagtcattatcaatgaggtgacatgtgagtcacccgcaaagcacgccggagaaattctcaaattcttaggaagggaggcaatctgtcccgactcccccaacctctccgatgggactgtactgagtatgaatcacaacacggacacacctcgctctctctctgtttctccaagctcctatcctgaactgcacactgaagttccgttgagcgtgctgatcttgggcctgcttgtggtgttcattctcagtgtctgtttcggggctgggctgtttgtgttcgttctaaagcgccgaaagggtgtgcccagcgtgccacggaacacgaacaatctggacgtcagtagctttcagctccaatatggcagctacaacacggaaacccacgataagactgacgggcatgtttacaactacatcccccctccagtcggtcaaatgtgccaaaatcccatctatatgcagaaggagggtgatcccgtcgcgtactatagaaatctgcaggagtttagctactccaatcttgagtag

SEQ ID NO: 240695 - DNA, 2538 bp, Artificial Sequence
  Description of Artificial Sequence: Synthetic coding sequence
atgctatccggggtgtggttcctgtccgtgctcaccgtagccggtatattgcagacagagtcacgcaagaccgcaaaagatatttgcaagatcagatgcctctgcgaggagaaagagaacgtcctcaatatcaactgcgagaacaaaggattcactaccgtgtcactgctgcagccccctcagtatcggatctaccaactgttcctgaacggaaatctgctgacacgcttatatccaaacgaatttgtgaactattctaacgctgtgactctccacctcggaaataatggattacaagagatcaggacaggtgctttcagcgggctgaagacactcaagcggctccacctgaataacaacaagctggagattctccgggaagacaccttcttggggctggaatcccttgagtacctccaggctgattacaactacatctccgctattgaggcgggtgcatttagtaagttgaacaaattgaaagtcctaattttgaatgataacctgctcctgagcctaccctccaatgtctttcggttcgttttgctgactcatctggatctacgcggaaacaggctcaaagttatgccttttgctggtgtgttggaacatattggaggcatcatggagatccagctcgaggaaaacccttggaactgcacatgtgacctgctgcctttgaaggcttggttggacaccatcaccgtcttcgttggggaaattgtgtgtgagactcctttccggctgcatggaaaggatgtgactcagttgactcgtcaggatctgtgccctcgcaagagcgcttcagactcaagtcagcggggttcccatgccgacacccacgtgcagagactaagtcctacgatgaatcccgcactgaaccctacccgggcacccaaggccagccgaccgccaaaaatgagaaaccgcccaactccacgcgtgaccgtgagcaaagatcggcagtcctttgggcctattatggtgtatcagaccaaaagcccagttcctctgacctgcccttccagctgtgtttgcacatctcagtccagtgataacggactaaacgttaactgccaagaaaggaaattcacaaatattagcgatctccagcctaagcccacctctcctaaaaagctctacttgaccgggaattatctccagaccgtttataagaatgacctgctagagtacagttctcttgacctgttgcatttgggcaataatagaatcgctgtaatacaggagggcgcattcactaatctgacctctctgaggcggctttatctgaatggaaactacctggaggtcctttatccctcgatgttcgacggccttcagagcttgcagtacctgtatctggagtataacgtcatcaaggaaattaagccgcttacctttgacgcgcttatcaatctacagctgctgttcctgaacaacaacttgctgcgcagcctcccagataatatattcgggggaaccgccttgaccaggctgaaccttagaaataatcatttctcacaccttcccgtgaagggggttctggaccagctgcctgcctttatccagattgacttgcaggagaacccctgggattgtacctgtgacatcatgggtctcaaagactggacagaacacgcgaactcaccagtaatcatcaacgaagttacttgcgaatctcccgctaaacacgccggagagattcttaaattcctgggcagggaggccatctgtcccgactccccgaatttatccgatggtactgtgctgtccatgaaccacaatactgacacgccgagatccctgtcagtgtcgccgagttcttacccagagctgcacacagaggtcccactttcagtgttgatcttggggttgctggtcgtgtttatcctaagcgtgtgttttggtgccggtctgttcgtgttcgtgctgaaacgtcgcaaaggagtacctagcgttccaaggaatactaataacctcgatgtctcctcttttcagcttcaatacggttcatacaacacagaaacacacgataagaccgacggccatgtttacaactacatccctccacccgtgggccaaatgtgtcagaatcccatctatatgcagaaagagggagatcccgtggcatattaccgcaatcttcaggaattttcatattcaaaccttgaggaaaagaaagaagagccggcaacccccgcatacactatttctgccacagagcttctagagaagcaggccactcctcgcgaaccggagctcctgtaccagaatattgccgagagggtcaaggagctgcccagcgcgggactggtgcactacaatttttgtaccttaccaaagcgccagttcgccccttcttatgaaagccgaaggcagaaccaggatagaatcaataaaactgtgctgtatggaacacccaggaaatgttttgttggacaaagcaagccaaatcatccattgctacaagcaaaaccccagtccgagcctgattatctggaagtgctggaaaagcagaccgctatcagccaactctag

SEQ ID NO: 240696 - DNA, 2538 bp, Artificial Sequence
  Description of Artificial Sequence: Synthetic coding sequence
atgctttcaggtgtgtggttcttgtcagtactgaccgttgctggtattctacaaacagagtccaggaagaccgcaaaggacatatgtaagatcagatgtctctgcgaggagaaggagaatgtgctgaacatcaactgtgagaacaagggcttcaccactgtgtcattgttgcaaccaccccaataccgtatttatcagctctttctgaacggaaatctgttaacccggttatatcctaacgagtttgtgaactacagcaatgccgtgactctgcatctgggcaacaacggcctgcaggagattcgtaccggggcattctctggcctgaagacactgaagagactgcatttaaacaataacaagctggaaatactcagagaagacactttcctcggattggaaagcctggagtatctgcaggcggactataactacatttcagcaatcgaagccggtgctttctcaaagttgaacaaacttaaggttctgatactgaacgacaacctgctattgagtctaccatctaatgtgtttcgatttgtcctgctaacccatctcgaccttaggggaaatcgcttgaaggtgatgcccttcgccggagtcctcgagcatattgggggtatcatggagatccagcttgaagaaaacccctggaactgtacgtgcgatctgctgccccttaaagcgtggctggatactatcaccgtattcgtcggagagattgtctgcgaaaccccgttcaggctgcacgggaaggacgtgacgcagttgacccgacaagatttatgcccgaggaaaagtgcctctgacagtagtcagcgtggcagccatgcggacacccatgtgcagcggcttagtccgactatgaaccctgccctcaaccctacccgagcgcctaaggctagtcgccctccgaaaatgagaaacagacctacccctagagttacggttagtaaagatcgacagagctttggacccatcatggtctatcaaacaaaatctccggtgccattgacgtgccccagctcctgcgtgtgtacgagccagtcttcagacaacgggctcaatgtgaattgccaggaacgaaaatttacgaacatatccgacctccagcctaagcccacttctcctaagaaactgtatctgactggcaattatctgcagacagtctacaagaacgacctattggagtatagctctctggatttgttacatctcggcaataaccgtattgccgtcattcaggagggtgcttttactaacctgacctcactgcgccgactctatctaaacggcaactacctggaggtgctgtaccctagtatgtttgacggcttacagtccctgcagtatctataccttgaatacaacgtgatcaaagaaattaaaccgctgaccttcgatgcactgattaacctccagctgcttttcctcaacaataacctgctccggagcttgccagacaacatctttggtggcacagcactgactaggctgaacttgcgcaataaccacttttctcacctccctgtgaaaggtgtgctcgaccagctgcctgctttcatccagatcgatctccaagagaacccctgggattgcacctgcgatatcatgggactgaaagactggaccgagcacgccaactcacctgttatcataaacgaggttacctgcgagtctccagccaagcatgcaggggagatcctgaaattcctcggaagggaagcaatctgtccagacagccctaacctgagcgacggcaccgtcctatcaatgaaccacaacacggatactcctcggtcactgagtgtgagtcctagttcctaccctgagctgcacacggaagtgccactctcagttcttattctgggcctgcttgtggtctttatcctgtctgtttgctttggcgcaggcctctttgtgttcgtactgaagagaaggaaaggagtgccttccgtcccgcgtaatacaaacaacttagatgtatcctcctttcagctccaatatggctcttataatacagagacgcatgacaagaccgacgggcatgtatacaactatattccaccacctgtggggcagatgtgccagaatcccatctacatgcagaaggaaggagatcccgtggcatactaccgaaacctgcaggaattctcatactctaatctggaagaaaagaaggaggaaccagccacaccggcttacaccatctccgccactgagctactggagaagcaggctacccctcgggaacccgagcttctgtatcaaaacatcgcagagcgtgttaaggagcttcccagcgctggcctagtccactataatttttgcactcttcctaagagacagtttgcacccagctatgaatcccgacgccaaaatcaagatcgtattaacaagaccgtgttatatggaacaccaagaaaatgtttcgtcggacagtccaagcctaaccacccccttctccaggcaaaaccccagtccgaacccgactatctggaggtgctggagaagcaaacagccatctcccagctgtag

SEQ ID NO: 240697 - DNA, 2538 bp, Artificial Sequence
  Description of Artificial Sequence: Synthetic coding sequence
atgctctctggggtatggtttttgagtgtgctgactgtggctggcatcctgcagaccgaatctcgtaagaccgccaaggatatttgtaaaatccgatgtctgtgcgaagagaaggagaacgtgctcaacattaactgcgaaaacaagggattcactaccgtcagcttgctgcagcctccacagtaccgaatctatcagctgtttctcaatgggaaccttctgacgcgcctctaccctaatgaattcgtcaattactctaacgctgtaactctgcaccttggtaacaatggtctgcaggaaattcggacaggggcattttccggcttgaaaaccttgaagcggctccatctaaacaacaataaattagaaattctccgcgaggacaccttcctggggttggaaagtctggaatacctgcaggccgactacaactacatcagcgcaattgaagcaggtgcgttctctaagctgaacaagctcaaagttctaatcctgaacgataacctgctcctctccctgcccagcaatgtctttcggttcgtcctgctgacacatctagacctccggggtaaccggctcaaggtgatgccatttgcaggggttctcgaacacatcggaggcattatggagattcagcttgaggaaaatccttggaattgcacatgtgacctgcttccactcaaagcctggcttgacaccatcacggtcttcgtgggcgagatcgtatgcgagaccccgttccggctccatggtaaggatgttacccagctgactcgtcaggatctttgccccagaaaaagtgcatcagacagctcccaacgcggatcacatgctgacactcacgtccagcggctgtcaccaacgatgaatccagccctaaatcctacaagagcgcctaaggcttctagacccccaaagatgaggaaccgtcccacacccagagtgacggtcagcaaggaccgtcagagcttcggaccgattatggtgtaccagacaaaaagccctgtgccgctgacatgcccgagtagctgcgtgtgcacctcccagtcgtccgataacggcctgaacgtgaactgtcaggaacggaagttcactaatatctccgacctgcagccaaagccaacaagccctaaaaaactctatctgacagggaactacttgcagaccgtatataagaatgatctcctcgagtattcttcacttgacctgttgcaccttgggaataacaggatcgcggtgatacaagaaggagccttcactaatctcacttccctaaggcgcctctacctgaacgggaactacctggaggtcctgtacccctccatgttcgacggattgcagtcgttgcagtatctgtacctggaatacaacgtcattaaagagattaaaccactgactttcgacgctttaatcaacttacaattgttgtttcttaacaacaacctgctgcgcagtttgcccgacaacatctttggtgggacagctctcaccagactgaatctgcgcaataatcacttttcacacctaccagtgaagggcgtcctggatcagttaccagcgtttatccaaattgatctgcaggagaacccgtgggactgcacctgtgatattatgggcctcaaagattggaccgagcacgccaatagtcccgtgataatcaacgaggtgacctgtgagagcccagccaaacacgccggagaaattttgaaatttctcggcagggaagcaatttgcccggactctcccaatctgtcagatgggacagttttgagtatgaatcataatacagatacccctcgttccttgtcggtatcaccaagtagttaccccgagctgcacacagaggtgcccttaagcgtgctgatacttggcctgctcgtcgtgtttatcttaagtgtgtgtttcggtgccggacttttcgtgtttgtgcttaaacgacgcaagggcgtcccttccgtcccccgaaatactaacaaccttgatgtgtctagcttccagttgcaatacggtagctacaacactgagacccatgataagacggacggtcatgtgtacaattatatccctcctcctgtcgggcagatgtgccagaaccctatttacatgcaaaaggagggtgatcccgtcgcatactaccggaacctgcaggagttttcctatagcaatctcgaggagaagaaggaggaacctgcaactccagcctataccattagcgccacagagctattagagaaacaagcaacaccaagggagcccgaattgttgtaccaaaacatcgctgagagggtcaaggaactgccttccgctggccttgtgcactacaatttctgtaccctgccaaaacggcaatttgccccttcttatgaatccaggcgtcaaaatcaggataggattaataaaaccgtcttgtacggaactcccagaaagtgctttgtagggcagtctaaaccaaatcaccccctgctgcaagccaaaccacagagcgagccagactatcttgaagtgctcgaaaagcagaccgccatctctcagctgtag

SEQ ID NO: 240698 - DNA, 2538 bp, Artificial Sequence
  Description of Artificial Sequence: Synthetic coding sequence
atgctgagcggggtatggttcttaagcgtgctcacagtcgccggaatcctgcagacagagagccggaagactgccaaagatatatgtaagatccgctgtctctgcgaggaaaaggagaatgtgctgaatataaattgcgaaaacaaaggcttcactactgtgagtctactccagccacctcagtaccgcatctaccagctgtttcttaatggcaacctccttaccagactgtatcccaatgaattcgtcaactattccaatgcagttaccctgcacctcggcaataacggcctgcaggaaataaggacaggagctttctccggattgaaaaccctcaagaggttgcacctgaataacaacaagctcgagatactgcgggaggacacattcttgggcctcgagtccttggaatatctgcaggcggattataattacattagtgccatcgaagcaggcgctttctccaaactcaacaagcttaaggtactcatcttaaatgataatcttctgttgagtctgccaagcaacgtttttcgtttcgtactcctgactcacctggacctccggggaaaccgtcttaaggttatgccattcgctggggtgctcgaacacattgggggaatcatggaaattcagctcgaagaaaatccctggaattgcacctgcgacctgttgcccctcaaggcctggttagacacaattacagtgtttgtaggcgaaatcgtatgtgagaccccattcagactccacggaaaggacgttacccaactgacaaggcaggacctgtgcccacgcaagagtgcctccgattcttctcagcgagggtctcatgcagacactcacgtgcaacgtcttagcccaacaatgaaccctgcactcaatcctactagagccccaaaggcaagtcgccctccgaagatgagaaataggcctacccctcgcgttactgtgtctaaggatagacagtctttcggaccaataatggtgtaccaaacgaagtctcccgtcccactcacgtgcccctctagctgcgtctgtacctctcagagctcagacaacggccttaatgtgaactgtcaggaaaggaagtttaccaacatctccgatctacagcctaaaccgaccagcccaaagaaactctacctgactggtaactatttgcagacggtttataagaatgacctgctcgagtatagcagtttagaccttctacacctgggaaataaccggattgcagtcattcaggaaggcgcttttaccaatcttacatctctccgtaggttgtatcttaatggcaactatctagaggtgctttaccccagtatgttcgacggactgcaatcacttcagtatttatacctcgaatacaacgtgatcaaagagattaagccgctcacctttgacgccctgatcaacttgcagttgctgttcttgaataacaacctactgcggagtttgcccgataatatctttggtggaacagccctgacaagactgaatttgcggaacaatcacttttctcatctccccgtgaagggagtgctggatcagctccccgcttttattcagatcgaccttcaggagaacccatgggactgcacatgcgacatcatgggacttaaggattggacggagcacgcaaactcccctgtcatcataaacgaagttacgtgtgagtctcccgcaaagcatgcgggtgagattttgaaattcctcggaagagaagcaatctgcccggatagtcccaatttgtccgacggcactgtgctgagtatgaaccacaacactgacactcctaggtccctctcagtgtctccttcaagctatccagagctgcatacagaagtgccactttctgtgctcattctcggactgctcgtggtatttattttgtctgtgtgtttcggtgcgggactgttcgtttttgttctgaagaggcggaagggcgtgccaagcgtccctcggaatacaaacaatcttgatgtgtcctccttccagctacagtatggtagctacaacactgaaacacacgacaagaccgatggtcatgtatacaattacatccctcccccagtggggcagatgtgtcaaaatcccatatatatgcagaaagagggggatccagtcgcttattaccgtaacctacaggaattctcctattctaacctcgaggagaagaaggaggaacccgctacccccgcttacaccatcagcgcaacggaacttctggagaagcaggccactccgagagagcctgaattactgtatcagaacatagctgaacgggtgaaagagctgccgagtgctggtttggtgcactacaacttttgcacactgcccaagcgacaattcgctccaagttacgaatcccggagacagaaccaagaccgcattaacaagactgtgttgtatggaacacctcgtaagtgctttgtgggccagtcaaaaccaaaccacccccttctacaggcaaaaccgcagtccgagcccgattacctcgaggtcttggaaaaacaaaccgcgatttcacaactctag

SEQ ID NO: 240699 - DNA, 2538 bp, Artificial Sequence
  Description of Artificial Sequence: Synthetic coding sequence
atgctttctggagtttggtttctgtcggtcttaactgttgccggaatcttgcagacagagagccgcaaaaccgccaaggacatctgtaaaattcgctgtctgtgtgaggaaaaggagaacgtactgaatattaactgcgagaacaaaggctttactactgtttcactcttgcagcctccccaatacagaatttaccaattatttctgaatggtaacctgctgacacggttataccccaacgagttcgtgaactacagcaatgcagtcacactccatctcggcaacaacggtcttcaggagattcgaacaggcgctttctctggactgaagacacttaagcgccttcatttgaataacaacaaacttgagatcctacgggaggatacttttttggggctggagagtctcgaataccttcaggctgattacaattacatctccgcaattgaagccggagctttcagcaaacttaataaactgaaggtgctcatcctcaatgacaatctgcttctgtctcttccatcaaacgtgtttaggttcgtgctgctaacacaccttgatctgcgcggaaatcggttgaaggtgatgcccttcgcaggggtgctggaacacatcgggggaatcatggagatccagctggaggagaacccgtggaactgcacatgcgacctgctgcccctcaaggcgtggctggacacgataaccgtcttcgtgggcgaaattgtttgtgagacgccatttaggctgcacgggaaggacgtcacgcagttgacacggcaggatctgtgtcccaggaagtcggcttctgactcatctcagaggggcagtcacgccgatacacatgtgcagaggctgagtccaactatgaaccccgcactgaatccaaccagggcacccaaggcgtccaggcccccaaagatgagaaacagacccacgcctagagtgacagtctctaaggacagacaatctttcggccctatcatggtctatcaaaccaagtcacctgtccccctcacttgcccttcatcatgtgtctgtacctctcaatcttctgataacggcctcaacgtcaattgtcaggagcgtaagttcacaaatatctctgacctccaacctaaaccaacctctcccaaaaaactttatctcactggcaactacctgcaaactgtatataaaaatgacctgcttgagtattccagtcttgacctcctacacttagggaacaatcggatcgccgtcatccaggagggggctttcacaaatctgacaagcctgaggagattatatcttaatggtaactacttagaagtgctgtacccctctatgttcgatggcctgcagtccctccagtacttgtacctggaatataatgtgatcaaagagattaaacctcttacatttgacgctctgatcaatctccagctgctgtttctgaacaataaccttctgcgctccctaccggacaacatctttggaggaacagcactgacaagattaaatcttagaaacaatcatttctcccacctcccagtgaaaggcgtgctggatcagctccctgcattcattcaaatcgatctgcaggagaacccatgggactgtacttgtgacatcatgggcctgaaagattggaccgagcacgctaattctcctgtgattatcaatgaagttacttgtgagtcccctgcaaagcacgcaggcgaaattttgaagtttctaggaagagaagccatctgcccagacagtcccaatttgtctgatggcaccgttctttctatgaatcacaatacagatacacctcgctctctgtctgtgagcccgagctcctatcctgagctacataccgaggtgcctctgagcgtgttgattctgggtctcttggtggtgtttatcttatccgtgtgctttggcgctgggctgtttgtctttgtgctgaagcgacgaaagggcgtaccatctgttccaaggaacactaacaatttggacgtctcttcgttccaacttcaatatggttcttacaacactgaaacacacgataagactgacggccacgtgtacaactacatccccccacctgtggggcagatgtgtcagaatccaatctacatgcagaaggaaggcgatcctgtcgcatattatcgtaatctgcaggagttttcctactcaaacctcgaagaaaagaaggaggaacccgcaacgcctgcttacacgatttccgctacagagctcctggagaagcaggccacccccagagaacccgaactgctgtatcagaatatcgccgagcgtgtaaaggaacttccgagcgccggtctggtgcattataatttttgcaccctgccaaagcgccaatttgcccctagttacgagtctcgcagacagaatcaggacaggattaataagactgtgctgtacggcacgcccaggaagtgcttcgtgggccagtctaaaccaaaccaccctctgctgcaggcgaaaccccagagtgagcctgattatcttgaggttctggagaagcagaccgccatttcacagctttag

SEQ ID NO: 240700 - DNA, 2934 bp, Artificial Sequence
  Description of Artificial Sequence: Synthetic coding sequence
atgaaaccatccatagctgagatgctgcaccggggaaggatgctgtggatcattcttctctctaccatcgctttaggctggacaacccccataccccttatcgaagactcagaggagattgacgagccctgctttgatccgtgttattgcgaggttaaggaatccctctttcatatccactgtgactcaaaggggtttaccaacatttcccagattactgaattttggagtcggccattcaaattgtatctccaacgcaacagtatgcggaagctgtacacgaacagtttcttgcacctgaacaatgctgtatccattaacttaggaaacaatgcacttcaggacatacagacgggcgcattcaatggcttgaagattttgaagagactgtatcttcacgaaaataaactcgacgtcttcagaaacgacacctttcttggactggaatcactcgagtatttgcaagcggattataatgttatcaaacgcatcgagtccggcgcttttcggaacttgagcaagcttcgagttcttatcttgaatgacaacctgattccaatgctgcctacaaacctgtttaaagcagtctcacttactcacctggacctgcgaggcaaccggcttaaagtgctgttctaccgtggtatgcttgaccacatcggacgatccctgatggagctgcaactggaggaaaatccctggaactgtacctgcgagattgtgcagctcaaaagctggcttgaacggattccatatacagctcttgtgggggatataacatgtgaaacaccctttcactttcatggaaaagatttacgcgaaatcaggaagaccgagttgtgtccattgctgagcgactccgaagtcgaggcttcacttgggattccccacagctctagcagtaaggaaaacgcttggccaactaagccatcttctatgttatcttcggtgcacttcacagccagtagcgtggaatataaatcaagcaacaagcagccgaagcccaccaagcagccacgtacccctcggcctccttccacatcccaggccttgtaccccggtcccaaccagcctcccatcgctccatatcagacgagaccacccatccctattatctgtcctacgggatgtacgtgcaatcttcacataaatgatctgggcttgacagtaaactgtaaggagcgcggatttaataacatttccgagctgctccctagaccccttaatgccaagaaactatatcttagttccaatctgattcaaaaaatttatcgctccgatttttggaattttagctcattggatttacttcacctggggaataaccggattagttacgtgcaggacggcgcttttattaacctgcccaaccttaagtctctgttcctaaatggaaatgacattgagaaactgaccccaggaatgtttcggggacttcaatccctccattatctgtactttgagttcaacgtcataagggaaattcagcctgccgcatttagcctcatgcctaatctcaagctgctttttctgaacaataacctgctccgcactctcccaacagacgcgtttgccggaaccagcctggcacggttgaacttacggaagaactatttcctgtacttgccagtggccggagtactggaacatctcaacgcaattgtgcagatcgatctgaacgagaatccatgggattgtacatgcgaccttgtaccctttaaacaatggattgaaaccatttcgagtgtgagtgtggtgggtgacgtcttatgccgctcaccagagaacctaacacaccgcgacgtgcgcacaatagagctggaggtactatgccccgagatgttacacgtcgcaccagccggtgagagcccggctcagcctggagattctcatctgattggagccccaacttcggcttccccgtacgagtttagtcctcctggcggtcccgtgccactctcagtgctcatcctttctctcctggttctgtttttctcagctgtttttgtggccgctggcctgttcgcatatgtcctgcggagaaggagaaagaaactgcccttccgctcaaagaggcaggaaggagtggacttaaccggcattcagatgcagtgccacagactgtttgaggatgggggtggcggtgggggtggatctggaggtggtgggcgtcccaccctctcttcgccagaaaaggctccaccagtgggacatgtttatgaatatattcctcacccggtgacccagatgtgcaataatcctatctacaaacccagggaagaggaggaagtcgcagtgtcgagtgcccaagaagctggatctgccgaacgcggtggccctggaacgcaacctccagggatgggcgaagctctgttgggcagtgagcagtttgccgaaacccccaaagaaaaccacagtaattatcgaaccctgctcgagaaggaaaaagagtgggctttggcagttagttcgtctcaattgaatactattgtcacggtgaaccatcatcacccccatcacccagctgtaggcggagtgtcgggtgtggtgggaggaactggtggcgaccttgccggttttagacaccatgagaaaaatgggggagtggtcctcttccccccagggggtggttgcggctcaggcagtatgctgctcgatcgggagagaccacaaccagcaccatgcaccgtgggatttgtggattgtttatacggcacggtcccaaagctcaaagaacttcacgtccatccacccggtatgcaatatcctgatcttcagcaggacgccaggctgaaagagactctcttgtttagcgcgggtaaaggctttaccgaccaccagactcaaaaaagcgactacctggagctccgagccaagctgcaaacgaaaccagattacttagaggtgcttgagaagaccacctacaggttttag

SEQ ID NO: 240701 - DNA, 2934 bp, Artificial Sequence
  Description of Artificial Sequence: Synthetic coding sequence
atgaagccaagcatagcagaaatgttgcatcggggtcggatgctctggataatcctgttaagcaccattgctttagggtggaccacgccaatcccacttatagaggattcagaagaaatcgatgaaccttgttttgatccctgctactgtgaggtgaaagaaagcttgttccatatccattgcgatagtaagggtttcactaatatctcccagattacagagttttggagtaggccttttaagctctacctgcagcgcaattccatgcgcaaactgtacaccaactcattcttacatctgaataatgcggtgtctattaaccttggcaacaatgcactccaggacatccagaccggcgcattcaatggcttaaagatattgaagcgtctttacctccatgaaaacaagttagacgtgtttaggaatgacaccttcctgggcctggaaagcctggagtatttgcaggcggattacaatgtgattaagcgaatcgagagcggagcctttagaaacctgagtaagctccgggtgctaatcctaaatgacaatttgatccccatgcttcccactaatctatttaaggccgtgtcgctgacgcatttagatttgagaggcaataggctgaaagttttattttatcgtggcatgttggatcacattggaagatccctgatggagttgcagctcgaagagaatccctggaattgtacgtgcgaaatagtccagctgaaatcatggttagagagaatcccatatacagccctcgttggcgatatcacatgtgaaaccccctttcacttccacgggaaggatctgcgagagatccgcaagactgagctgtgcccgctcttgtctgactccgaggtggaggccagcctcggcatcccccattcttcctcaagtaaggaaaacgcctggcctacaaaaccatcctccatgctctcttccgtgcactttacggcaagctctgtggaatacaaatcatcgaataaacaacctaagccaacgaaacaacctcggacgccaaggccaccttccacgagccaagccctatacccgggacccaaccagccccctattgctccatatcagaccagaccacccatccctatcatctgcccaaccgggtgcacctgcaatctccacattaatgacctgggtctcaccgttaattgcaaagagagggggttcaataatatatccgaacttctgcctcgaccccttaatgctaagaaactgtacctgagctccaatttgattcaaaaaatttaccgctccgacttttggaacttttcctccttggacctgctgcacctcggaaataacaggatctcctatgtgcaagacggtgcattcatcaacctgcctaacctgaaaagtctcttccttaacgggaacgatatcgaaaagcttacccccggaatgttccggggactccagtccctgcattatttatactttgaattcaatgtcatacgggagatccagccagccgctttctctctaatgccaaacctgaagctcctctttctcaataacaacttgttacgcactctccccacagatgcctttgcgggtactagccttgccaggttgaatctgcgaaagaactacttcctctatctccctgtcgccggagttctcgaacatctcaatgccatagtgcagatcgatctgaacgagaatccatgggactgcacatgcgaccttgtgcctttcaagcagtggattgagacaatatcctcagttagcgttgttggagatgtgctttgtagatccccagagaatctgacccatagggatgtgcggacaattgaactagaagttttatgccccgagatgttacacgttgcccctgctggagaatcccccgcacagcccggtgactcccacctgattggggcacccaccagcgcctccccctacgagtttagtccgcctggtggaccagtccctctatcagtgctaatcctctccttgctggtgttgttcttctccgcagttttcgtcgccgctggcctcttcgcttacgttctgcgacggaggcggaaaaagcttcctttccggtccaaaaggcaagagggagtggatctcactggtatccaaatgcagtgccataggctgtttgaggacgggggaggtggaggcggaggctcagggggtggtggacggccaacgctgtctagtcccgaaaaggcgcctccggttggacacgtgtacgagtacattccacacccagtgacccaaatgtgcaataaccccatctacaaacccagagaagaagaggaggttgcagtttccagtgcgcaggaagcgggaagtgccgaaagagggggaccagggacacagcctccagggatgggcgaggccctcctcgggtctgagcagtttgctgaaacacctaaggagaaccacagtaattacaggacactgttagaaaaggaaaaggaatgggcgttggcagtgtcctctagccagctcaacaccattgtcaccgtcaaccatcaccacccacaccatccagcagtcggtggagtctctggggtggtgggcggaaccggcggagacctagcaggatttcgccatcacgaaaagaatggaggcgtcgtgcttttccctcccggtggaggttgcggttctgggtctatgctgctcgacagggagcggccacaaccggctccctgtactgttgggtttgtcgactgtctctacggaaccgttccaaaactgaaggagttgcacgttcatcccccaggtatgcagtaccccgatttacagcaggacgccagactgaaggagacactgctgttctctgccggaaaagggttcacagaccaccagacccagaaaagtgattacctcgagctgcgggctaagctgcagactaaacccgactacctggaggtccttgagaaaaccacctatcgattttag

SEQ ID NO: 240702 - DNA, 492 bp, Artificial Sequence
  Description of Artificial Sequence: Synthetic coding sequence
atgaaaccctcaattgcagagatgttgcataggggaagaatgttgtggatcattcttctctccacaatcgccctagggtggaccaccccaattcctctaatcgaggactcagaggaaatcgatgaaccctgctttgacccttgctactgtgaggtgaaagaatcccttttccatattcattgtgactctaagggctttaccaacatcagccagataacagagttctggagccgccctttcaaactctacttgcagcgcaatagtatgagaaaattatacaccaactcatttttgcacctcaataatgccgtttctattaatctgggaaataatgccctgcaagacatccaaacaggcgcattcaatggcctgaagattctgaaaagactctacttacacgaaaataagctagacgtatttagaaatgatactttcctagggctcgagagtctagagtaccttcaggcggactacaacgttatcaagcgatag

SEQ ID NO: 240703 - DNA, 2514 bp, Artificial Sequence
  Description of Artificial Sequence: Synthetic coding sequence
atgttcctctggctttttctcatccttagtgctctgattagcagcactaatgcagattccgacatcagcgtcgagatctgcaacgtgtgttcttgcgtgtctgtggagaacgttctttacgttaattgtgaaaaagtgagcgtataccggcctaatcaactgaagccaccctggtcaaacttctaccatctgaacttccaaaacaattttttaaatattttgtaccccaacacattcctcaacttctcgcatgctgtctcacttcatctcggaaataacaagttacagaatattgagggaggcgcattcctggggctgtccgccctgaagcagctgcatctgaacaataacgagctgaagatcctcagggcggacaccttcctgggaattgaaaatctagagtacctccaagcagattataatttaatcaaatacattgaaagaggcgcatttaataaactccacaagctgaaggtgcttatcctgaatgataaccttatatcattcctccctgacaacatctttcgttttgcctcactgacacatctcgatatccggggaaatcggatccagaagctgccttacatcggtgtgctggaacacatagggagagttgtggagttgcagctcgaagataatccctggaactgtagctgcgacctcctgccactcaaagcttggctggagaacatgccatacaacatttatatcggtgaggctatctgtgagacaccctccgacctttatggcaggctacttaaagagacgaacaagcaggagctgtgcccaatggggaccggctcagatttcgatgtgcggatcctcccgccttcacagctggagaacgggtatactaccccaaatggacatacaacccagaccagtctacatcgcctggtcaccaagcctccaaaaactactaatccgtcgaagatttcgggcattgtcgctggtaaggcgctcagcaaccgcaatctcagtcagattgtgtcttaccagactcgggtcccccctttaacaccgtgtccagctccctgcttttgtaaaactcacccttctgatctgggcctcagtgtgaattgccaggaaaagaatattcagtccatgtcagaactgatccccaagcccctgaacgctaagaagcttcatgtcaacggaaactccattaaagacgtggacgtctctgactttactgatttcgagggcctggatttactccacttggggtcaaatcagatcaccgtgataaagggagacgtgttccacaatctgaccaatctgagaaggctttatctgaacggaaatcagatagagcggctgtatcctgagatcttctcaggactgcacaacctgcagtatctgtatctggagtacaatttgataaaggaaatatccgctggaaccttcgactcaatgccgaacctgcagctcctctacctaaacaataatctactaaaatctctccccgtttatattttctctggcgcacctcttgccagactcaatctccgaaataataaattcatgtatcttcccgtgagtggtgtcctggatcagctgcagtcactgacacagatcgacctggaaggaaatccatgggactgcacttgcgatctggttgcgctcaagttgtgggtggagaagctatctgacgggatcgtggttaaagaattaaaatgcgagacccccgtacagtttgctaatattgaactcaagagcctgaaaaacgagatcctgtgtcctaaacttctaaacaaaccctctgctcctttcactagtccagccccagcaattacgttcaccacgcccctcggccctataagatcccccccaggcggacccgtacccctgtccattctgattttgtccatcctggttgtgcttatcctgactgtgtttgtagctttttgcctgttggttttcgttcttcgtcgaaacaagaagccgaccgtgaagcatgaaggactgggcaatcctgattgtgggtccatgcaattgcaactgcggaagcacgaccataagaccaacaagaaggacggattgtctacagaggcgttcattccccagaccatagaacagatgtctaagtcgcatacttgtggcttgaaagagagtgaaactggtttcatgttcagcgaccccccaggacagaaagtcgtaatgagaaacgttgccgataaggagaaagacttgcttcatgtggatactcgaaaacgactttctaccatcgacgagctggacgagctgtttccttctagggactctaatgtctttatccaaaactttctcgaatccaagaaagagtacaactctatcggggtgagcggttttgagatcaggtacccagagaagcagcctgataagaagtccaaaaagtccttaattggtggcaatcacagcaaaattgtggtggaacaaaggaagtccgaatacttcgagctgaaggctaaactgcagtcatctccagattatctgcaggtgctcgaggaacagactgcactgaataaaatatag

SEQ ID NO: 240704 - DNA, 2514 bp, Artificial Sequence
  Description of Artificial Sequence: Synthetic coding sequence
atgtttctgtggcttttcctcatcctctctgccctcatcagttccaccaacgctgactccgacatctcagtcgagatttgcaacgtctgttcttgtgtgtccgttgaaaatgtgctttatgtgaactgtgagaaagtttccgtgtaccggcctaaccaacttaagccaccttggtctaatttttatcatctcaatttccagaataattttctgaacatactgtacccaaacaccttcctgaatttcagccatgccgtatctctgcacctgggtaacaataagctacagaacatcgaaggtggggcattcctgggcttatccgccctcaaacagctacacctgaacaacaacgaactgaagatcctgagggcagacactttcctcgggatcgagaatctagagtatctgcaggccgattacaatcttataaaatacatcgaacgaggcgcattcaacaagcttcacaaactcaaagtgttgattttgaacgacaacctgatctctttcctccccgacaacatatttagatttgcaagtcttactcacctggatattagaggcaatagaattcaaaagctgccatatattggcgtactggagcacatcggcagggtagtagaactgcaactggaggacaacccatggaactgtagctgcgacttacttcccctgaaggcctggctagaaaacatgccttataacatctatatcggtgaagcaatatgcgagaccccctccgacttgtatggacgcctgcttaaagagacaaacaaacaggagctctgtcctatggggacaggctccgacttcgacgtgcggatcctccctccatcccagctggagaacgggtatacaacgccgaatggtcatactactcagaccagtcttcaccggctcgtgactaaaccgccaaagacaacgaacccttcgaagatatccgggatagtcgccggaaaagccctgtccaatcgcaacctgtctcagattgtctcttatcaaaccagagtaccccctttgaccccttgcccggctccatgtttttgtaaaacccacccaagcgacctgggcctctccgtgaattgtcaggaaaagaacattcagtccatgagcgaactgatcccaaagccccttaatgctaagaagctgcatgtgaacggcaacagcattaaagacgtcgatgtctctgattttacagactttgaaggactcgacctgctgcatcttggatcaaatcagatcaccgtcattaagggggacgtgttccacaacttgacaaatctgcgcaggctgtatctgaacgggaaccagatcgaacggctgtatcctgagattttctccggcttgcacaatctccagtacctatatttggaatacaatctaatcaaggaaattagtgccggtaccttcgattccatgccgaacctgcaattgctatacttgaacaacaacctgctaaagtccttgccagtttatatcttttcaggcgctcctctcgctcggctaaaccttcgcaataataagtttatgtacttgccggtgagcggcgtgttagaccaacttcaatcattaacacagatcgacctggaaggtaacccttgggactgcacatgtgacctggtggccttgaaactgtgggtggaaaagctgagcgacggaattgtcgtgaaagaattgaaatgcgagacgcccgtacaattcgccaacatcgagctcaaatccctgaaaaatgaaatattatgtcccaagttactgaacaagccctcggcgccattcactagtccagcgccagccataaccttcacaaccccgctgggccctatccgctctcccccaggcggtccagtgcccctctccatcctgatcttgtctatcctcgtagttctgatccttacggtgtttgtcgcgttttgtttgctggtcttcgtgttaagaaggaataagaagcctactgttaagcacgaggggctggggaatccggactgcggctccatgcaacttcagctcagaaagcacgatcacaaaaccaataaaaaagatggcttatcaacagaagccttcataccccagacaattgagcaaatgagcaaatcacacacttgcgggctgaaggagagtgagacaggatttatgttctccgaccctcccggacaaaaggtagtcatgcgcaacgtggccgacaaggaaaaggatctgctccacgtggacactcgtaaacgcctgtctacgatcgacgaactggacgaattattcccctcccgcgactctaacgtttttatccagaatttcctggagagtaagaaagagtacaactctattggggtttctggctttgaaatcaggtaccctgaaaagcaacccgacaaaaagtcaaaaaagagtctgatcgggggtaaccattccaagatcgtagtcgagcagcgcaaatcagagtactttgagctgaaggcaaagctgcaatccagtcccgactacctccaggttctggaggagcagaccgccctgaacaaaatttag

SEQ ID NO: 240705 - DNA, 2514 bp, Artificial Sequence
  Description of Artificial Sequence: Synthetic coding sequence
atgtttctttggctgttcctcatcttatcagccttgatttctagcacaaacgctgactctgacatctctgtcgagatctgtaacgtctgctcatgcgtgagtgtggaaaacgtactgtacgttaattgtgagaaggtgagcgtgtatcgccctaatcagctgaaacctccttggtctaacttttatcacctcaacttccagaataacttcctgaacattttgtacccaaataccttcctgaactttagccacgcagttagtctacatctcgggaacaataagttgcagaacatcgagggtggtgcattcctaggtctcagcgctttgaaacaactacatctaaataacaacgaactgaagatccttcgggcagacacattccttggaatagagaacctcgagtacctacaggcagattataatttgatcaagtacattgagaggggcgcttttaacaagttgcacaagctgaaagtgctgattctgaacgacaacctcatttcgttcctgccagataatatctttcgtttcgcaagtcttacccacctggacatcagaggcaatcgcatacaaaaactaccctatatcggagtgctagagcacatcggtagggtggtagaattgcaattagaggataacccctggaattgcagctgcgaccttcttccgctgaaagcatggctcgagaatatgccctacaatatctatattggcgaggcgatttgtgagacacctagcgatctttatgggagacttttgaaggaaaccaacaagcaggaactttgccccatgggcacaggatcggactttgacgtgcgtatcctgccaccatcccagctggaaaacggctatacaacccctaacggccataccactcagacttcccttcataggctggtaaccaaaccacctaaaaccactaatccatccaaaataagtggaattgtcgccggaaaagctctgtcaaaccgaaacctaagccaaattgtgtcgtaccagactagggtacctccacttacaccttgtcccgcaccctgcttctgtaagacacatcccagtgatctcgggctgagcgttaactgccaggaaaaaaatatccaatctatgagtgagctaattcccaagccactcaacgccaagaaactccacgtgaatggcaacagcattaaagatgtggatgtgtcagatttcaccgactttgaaggcctggatttgctccacctcggaagtaaccagatcaccgtgatcaaaggagacgtcttccataacctcacgaatctcagacgactctacctgaacggcaatcagatagaacggctctacccagagatcttttctggtctccataacttgcaatacctgtatctggaatataacttgatcaaggagatctcggccggtacctttgactcgatgcccaacctacagctgctgtatctgaataacaacctacttaagagcctgcccgtgtacattttctcgggggctccccttgcaagactgaacttgcggaataataagtttatgtatttgccagtctccggtgttctcgaccagctccagagtctgacgcagatcgacctggaaggcaacccatgggactgcacctgtgacctagtggcccttaagctgtgggtggaaaaactttctgacggcattgtggttaaagagctcaaatgtgaaacgcccgtgcagttcgccaatattgagctgaagagtctcaagaacgaaatcctgtgcccgaagctgctgaataagccttcggcgccattcacatccccagctcccgctatcactttcaccacaccccttggccctatcagatccccaccgggtggcccagtacccctcagtatactgatcctatctatccttgtcgtgctgatcctaaccgtttttgtcgccttctgcctgcttgtcttcgtgctgcgaagaaataagaagcccacagtgaaacatgaagggcttggcaaccctgactgtggctctatgcagctgcagctccgaaagcacgatcacaaaactaacaagaaggacgggctgtccactgaggcgtttattccccagaccatcgaacaaatgagtaaatcccacacatgcggtctgaaagagtccgagaccggcttcatgttttcagatccgcctggccagaaagtggttatgcgcaacgttgcggataaagaaaaggacttgctgcatgttgacaccaggaaaagactgtcaaccatcgatgaactagacgagctgtttccgtccagagacagtaatgtgttcattcaaaacttccttgagtccaagaaagagtataactctatcggggtatctggattcgagattcgctaccccgagaagcagcccgacaagaaatccaagaaatcactaatcgggggaaaccacagcaagatcgtggtcgaacagagaaagtccgaatacttcgaacttaaagccaagttacagagctcccccgactatctgcaagtgctggaggaacagacagcactgaacaaaatatag

SEQ ID NO: 240706 - DNA, 2877 bp, Artificial Sequence
  Description of Artificial Sequence: Synthetic coding sequence
atgcatacctgttgtcctccagttacgctggaacaggatcttcacaggaagatgcatagttggatgctacagacactcgctttcgccgttacaagccttgtgctgtcttgcgccgagaccattgactattatggcgaaatctgcgacaatgcttgcccatgtgaggagaaagacgggatcctgactgtctcctgcgaaaatcggggaataatatctctgagcgaaatttcacctccacgctttcccatttatcacctgttgttaagcggcaacctgctgaatagactctaccctaacgagttcgtgaactatactggcgcttctatactgcacctgggatctaacgtgatccaagacatcgaaactggagcgtttcacgggctgcgcggactgaggcgacttcacctcaataataacaagctagaactgctccgggacgatacttttctgggactggagaacctggagtacctccaagtggattacaactacatttccgtgatcgagccaaatgcctttggaaaactgcacttattacaggtcctcattctgaacgacaatcttctctccagcctccctaacaatctgtttcgcttcgttcctctcacgcatctcgacctgagaggtaacagactcaagctcctcccttacgtgggtttgcttcagcatatggacaaggtcgttgagctgcagcttgaggagaatccctggaattgctcttgcgagcttattagtctgaaagattggctcgacagcatcagttattcagccctggtcggagatgttgtctgcgagactccttttaggttacatggacgggacctagacgaggtgagcaaacaggaactgtgtcctcgcagattgatttctgactacgagatgagaccccaaactcccctctctaccactggctacctgcacacaacacctgcctccgttaatagtgtggccacatcatcctctgcagtctacaaaccgcctttaaagcctcctaaaggaacccggcagcctaataaaccgagggtgcggcctactagtcgtcagccaagcaaggacctgggctactccaattacggaccttccattgcttatcagacgaagagccctgtgcctcttgaatgccctacggcctgcagctgtaacctgcagatctctgacttgggcttgaacgtcaactgccaggaacgaaagatagaatccatagcggaacttcagcccaaaccttacaacccaaaaaagatgtatctgaccgagaactatattgccgtggttagaagaaccgattttctggaggccacaggtttggacctcctgcacctgggaaataatcgaatctctatgatccaagacagagctttcggcgatctgaccaaccttaggcgcttgtacttgaatggaaatcggattgagagactctccccagagctattttacggtcttcagagtttacagtatctcttcctccagtataacctgattcgagaaatccagagcggaacctttgatccggttccaaacctgcaattattgttcctgaacaacaatttgctccaagccatgcccagcggtgttttttccggactgaccctgctgcgccttaacctccggagtaaccacttcacctccctgcccgtatccggtgtgctggaccaattgaaatctcttatacagattgatctgcacgacaatccatgggattgtacctgcgatatcgtgggtatgaaactgtgggtggaacagttgaaagtgggggtcctcgtggacgaggtcatttgtaaagccccaaagaagttcgcagagaccgacatgcgatcgatcaagtccgaattactctgcccggattactccgatgtggtggtcagcacccccactccgtcaagcattcaagttcctgcacggacgtctgccgtgactcccgctgtgagactcaattctacaggcgctccagcatctttgggcgcaggcggaggcgcaagcagcgtgccccttagtgtgctcatactctccctgctgctagtgtttataatgtcagtgttcgtcgctgccggactgtttgtcctggtgatgaagcgacggaaaaaaaatcaaagcgaccacacctctacaaataactctgatgtctccagtttcaatatgcagtactcagtttacggcggagggggaggcaccggcggacacccccatgctcatgtccaccaccggggacctgctctgcctaaggtaaaaaccccagccggtcatgtgtacgaatatattcctcatcccctggggcatatgtgcaaaaacccaatctatagaagccgagaaggaaattccgtggaagattataaagacctgcatgagctaaaagtgacgtattcttcaaatcaccaccttcagcagcaacagcagccacctcccccaccgcagcaacctcaacaacagcctccccctcaactgcagctacagccaggcgaggaggagcggagagagtcacatcatttgagatcccctgcctacagcgtgagtaccattgagccccgagaagacttactgtcgcccgtgcaggacgctgataggttttacaggggcatcctcgagcctgacaaacactgttccacaactccagccggaaacagcctgccagaatatcccaagtttccctgtagcccggctgcttacacgtttagtccaaattacgacttgcgtcgccctcaccagtacctgcacccgggagccggagactccaggttacgggagcctgttctgtacagccccccaagtgccgtgtttgtcgagcccaaccggaacgagtatctggaactcaaagccaagcttaacgtagaaccagactacctggaagtgctggagaaacagacaaccttttcccagttctag

SEQ ID NO: 240707 - DNA, 2154 bp, Artificial Sequence
  Description of Artificial Sequence: Synthetic coding sequence
atgggggctggaaaacacagggagggagggggaggggatcccacctcccttaacggatgcgcggacttaattcagcgaagaactgagatctcccgggacctggatgaagtgtctaagcaggagctgtgcccacggaggctcatcagcgactatgagatgcggcctcagacacccttaagcacgacagggtatctacataccactccagcgtcagttaactctgttgccacttccagtagcgctgtatataagcctcctctgaagcctcccaaggggacccggcagcctaataagccgcgagtacgacccacatcacgccagccaagcaaagacctgggctactccaattacgggccaagcattgcctaccagactaaatcgcctgtgcctttagaatgcccgaccgcctgcagttgcaatttacagatcagtgacttaggtctgaatgtcaattgccaggaacgcaaaattgagagcattgccgagctgcagccaaagccgtataaccccaaaaagatgtatctgaccgagaactacatcgccgttgtgcgcagaacagacttcctggaggccacaggcctggacctcctgcatctcgggaataaccgaatttctatgattcaggaccgcgcttttggtgatctcaccaatctcaggcggctgtacttgaatggaaatcgtatcgagcgtctgtcacctgaactgttttatgggttgcagagccttcagtatctgtttttacagtataacctgatcagagagatacagtcaggcaccttcgatccggtgccaaatttgcagctcttattcctgaataacaacttactgcaggccatgccatcaggagtgttctcgggcttgacattgctgcgattgaatctcagatccaatcacttcacgagcctgcccgtttcaggtgtcctcgatcaactgaagagtctgatccagatcgatctgcatgataacccttgggattgcacttgcgacattgtgggtatgaagctctgggtggagcaactgaaagttggggtgcttgtagacgaagtgatttgcaaggcaccgaaaaagttcgcagaaaccgatatgaggtctattaaaagcgaattgttgtgtcctgattactcagacgtcgtggtatccacgcccaccccgtcctccatacaggtccctgcccgaacgtctgccgtcacacccgcagtgaggcttaatagcaccggagctcccgctagtctgggcgcagggggaggagcctccagcgtgcccttgagtgtccttatcttgtccctgttgctggtatttattatgtctgtctttgtcgccgctggcttgttcgttctcgtgatgaaacggcgtaagaagaaccagtcagaccatacatccacaaataactccgacgtgagctcttttaatatgcaatactccgtgtacggcggagggggtggaactggcggtcacccccacgctcacgtacaccaccggggacccgcacttcccaaagtgaagacacctgcaggccacgtgtatgagtacatcccccaccccttaggacacatgtgtaagaaccccatttatagatccagagagggaaacagtgtagaggactataaagatctgcacgaattgaaggtgacctacagctctaaccaccacctacagcaacagcagcagcccccacctcctcctcagcaacctcagcagcagccccctccccagctgcaactccagccgggagaggaagagaggagagagtctcaccacctgaggagtcccgcttatagtgtgtccactatcgagcctcgggaggacctcctgtctcctgtccaggacgcagatcgattttacagaggtatactggaacctgacaagcactgcagtaccacacccgcaggaaactcactcccagaataccctaaattcccttgtagccccgctgcctacaccttttctcctaattatgatctccgtagaccccatcaatatctgcaccctggcgcaggtgatagccggctgagagaaccagtgctctacagcccaccgtcagctgtttttgtggaacccaatagaaatgagtaccttgagctgaaagccaaacttaatgttgaacccgattatctggaagtgcttgaaaagcagaccactttctcacagttctag

SEQ ID NO: 240708 - DNA, 2526 bp, Artificial Sequence
  Description of Artificial Sequence: Synthetic coding sequence
atgaagttgtggatacacctgttctacagctccctcttagcgtgtattagcctccactctcaaacccctgtgctctctagccgtggctcttgtgattcactttgcaattgtgaggagaaagatggaacaatgttgattaattgcgaagccaaagggatcaaaatggtctcggaaatctctgttccgccttctcgaccctttcagctgtctcttcttaacaacgggttaaccatgctgcacaccaatgacttctctggcctgaccaacgcaattagtatccatctgggttttaacaatatagccgatattgagatcggtgccttcaatggactcggactactgaagcagctgcatattaaccacaattcacttgaaatcctcaaggaggacacattccatggcctggaaaacctggaatttctccaggccgataacaacttcattaccgtcatagaaccctctgcattttccaaattgaacaggttgaaggttctgattctgaatgataatgctattgaatctctgccgcctaatatatttcgttttgtacctttgacccacctggacctgcgaggcaaccagctgcagaccctaccctacgtggggttcctggagcacattggacggatcctggatctgcaactagaagacaataagtgggcctgtaactgtgatctcttgcagctgaaaacctggttagaaaatatgcctccccaaagtatcatcggcgacgttgtctgcaattctcccccattcttcaaaggaagcattctgtccaggctgaagaaagaatctatctgcccaacacccccagtgtatgaagaacacgaggacccatcagggagtctgcacctggctgctacaagctcaatcaatgattctagaatgtcaacaaagactacatctatcctaaaattacccactaaggccccaggcctcatcccttatataacaaaaccaagtacacagcttcctggtccctactgtcccataccgtgcaattgtaaggtgctgagccccagcggactgctcatccattgccaggaaagaaatatagagagtttgtctgatctgaggcctccaccccagaatcctcggaagctaattctggcagggaatatcatccactccctcatgaaatccgacctagtcgagtatttcacattggagatgcttcaccttggtaataatagaattgaagttctggaggaggggtctttcatgaatctcacacgcctacagaaactgtatctcaacggtaaccacctcacaaaactgtcaaaaggcatgtttttaggactgcacaacctggaatacctttacctggaatataacgcaataaaggagattctgccgggaactttcaacccaatgcctaaactcaaagtgctttacctgaacaacaatctgctgcaggtcttgcccccacatatcttctccggtgtgcccctgacaaaggttaatctcaagactaatcaattcactcatttgccagtgtcaaatattcttgacgacctggatttgctgactcaaattgacctggaagacaacccctgggattgttcttgcgacctcgtagggctacaacagtggatccagaaactgtccaaaaacaccgtaactgacgatatcctctgtacaagccctggacatctcgataagaaggagctgaaagcactgaacagtgaaatcctgtgcccaggactcgtcaacaatccaagcatgccaacacagaccagctatctaatggtcaccacccccgctactacgactaacacagcggacaccatattgcggtcactgacagatgcagtgccactgtcggtcttgatcctggggctcctgattatgtttatcacaattgtattctgcgcagctgggatcgttgtgctggttctgcacaggaggcgaagatataaaaagaagcaggttgacgagcagatgcgtgacaacagccctgttcatctgcaatactctatgtacgggcataagacaacgcatcataccaccgagcggccatctgcgagcttgtacgaacaacatatggtcagtccaatggtgcatgtctaccgatcaccatccttcggtcctaagcacctcgaggaagaggaggaaagaaatgaaaaagaagggtccgatgccaaacatttgcagagatcactgctcgagcaagaaaaccattctcccttgaccggcagcaatatgaaatataagacaacgaatcagtccacagagttcctatcttttcaagacgccagcagcctctataggaatatcctggagaaagagcgcgaactccagcaactgggcatcacggagtatctccggaaaaacattgcccagctgcaacctgatatggaggcccactacccaggagcacacgaggaactcaagctaatggagactttgatgtattctagacctcgcaaggtcctggtcgagcagacgaagaatgaatatttcgagctgaaggccaaccttcacgccgagcccgattatttggaagtactggaacagcaaacttag

SEQ ID NO: 240709 - DNA, 4578 bp, Artificial Sequence
  Description of Artificial Sequence: Synthetic coding sequence
atgaggggggtgggatggcagatgctatctctgtccctgggactggtcttagctatcctgaataaagttgctccccaagcctgcccagcccaatgcagctgctccggctctacagtggattgccacggcctggccttacggtctgtcccccgaaacatcccacggaatacagagcggctggacctgaacggtaacaacataactaggataacaaagactgatttcgctgggttaaggcatctcagggtgctacagttgatggagaacaaaattagtaccatagagcgcggtgccttccaggatctcaaggagctggagcgcctcagactgaatagaaaccacttacagctgttccctgaactcctctttctggggaccgccaaactgtaccgactcgacctttccgaaaaccagattcaggccatacccaggaaagctttccgaggcgctgtcgacatcaagaatctgcagctggactataaccagatctcatgcattgaagacggtgcctttcgcgcattgagggacctagaagtgctgacacttaacaacaataatatcacgcgcctgtcagtggcctccttcaaccatatgccaaaattaagaacctttaggctccacagtaacaatctatactgcgattgccaccttgcatggctgtctgattggttgcgacagaggcctagggtgggcttgtacacccaatgtatgggcccttctcaccttcggggacacaacgtggctgaggtacagaaacgtgaattcgtctgcagtgggaagggtgaaggccaccagagcttcatggccccttcatgctcagtgctccactgtcccgctgcttgtacctgcagcaataacatagtagattgtcggggaaagggtctgacagagatcccaacaaatctgccagaaaccattacggagattcgtctcgaacagaacaccattaaggtgattcctccaggtgcattttcaccctacaagaaattaaggcggattgatttgagtaacaaccaaatttcagaattagccccagacgcctttcaggggctgaggagcctgaattcgctcgtcctgtatggaaataagattacagaactgccgaaatctcttttcgaggggctgttcagcctgcaactccttcttctgaacgctaacaaaatcaattgtctccgggtggacgcttttcaggaccttcacaacctcaacttgctctccctgtacgacaataagctacagacaatcgccaagggcactttctccccactgcgcgctatccagaccatgcatcttgctcagaatcccttcatctgcgattgtcaccttaagtggctggctgattacttacacaccaatcccatcgagacttccggcgctagatgtaccagtcctcggcgacttgcgaacaagcgaattggccagattaaatctaaaaagttccgctgttccggaacagaggactacaggagtaagcttagtggggactgttttgccgaccttgcctgccctgaaaaatgtaggtgtgaaggaacaacggttgactgttcaaaccaaaaattgaataagatcccagagcacatccctcagtatacagccgaactcaggttgaacaataatgaatttactgtgctcgaagcgactggcatttttaagaagctgccccaactcaggaagatcaacttctcaaacaataaaataacagatattgaggaaggggcattcgagggtgcatccggcgttaatgaaatccttctgacctctaataggctggaaaacgtgcagcacaaaatgttcaaaggcctggaatccctaaagacactgatgctccgctcaaatcggatcacctgtgtcgggaatgattcctttatcgggctgtccagcgtcagactgctgtcattgtacgataaccagattacaacagtggccccaggggcattcgacacactgcacagcctgagtacattaaaccttctggcaaacccatttaattgtaactgctatctcgcctggctcggagaatggctccgtaaaaaacggattgtaacaggcaatccaagatgtcagaagccttatttcttgaaagaaatccctatccaggacgttgctatccaggacttcacctgtgacgacggcaacgatgataattcctgttcacctctgtcaaggtgccccaccgaatgtacctgtcttgacacggtcgttcggtgctccaacaaaggattgaaagttctgccaaaaggcatcccgcgagatgtgacagagttgtaccttgacggaaaccagtttaccctcgtgccgaaggagctttctaattacaaacatctgaccttgatagacctctccaacaaccgaataagcacgctcagtaaccagtcattctccaatatgacacagctactgaccctgattctgtcctataacaggctgcggtgcatcccacccagaacttttgacgggttgaagtctctcaggcttctcagtctccacggcaacgacatctcagtcgtgccagaaggggcatttaatgatctctcagctctgtcccacttggccattggcgcaaacccactgtactgtgattgcaacatgcagtggctatctgactgggtaaagtcagaatacaaggagcctggaatcgcacgctgcgccggaccaggagagatggcagataagctgcttctgactactccgtctaaaaaattcacatgccaagggccagtggatgtgaatatcctggcgaagtgtaatccctgtctgagtaatccgtgtaaaaacgacggtacctgcaatagcgacccagtcgatttctacaggtgcacctgtccctacggctttaaggggcaggactgcgatgtgccaatccatgcctgtattagcaacccctgtaagcacgggggaacctgccacctgaaggaaggtgaggaagacgggttttggtgtatttgtgccgatggttttgaaggtgagaactgtgaggttaatgtcgatgattgtgaggataatgactgtgaaaataacagtacctgtgttgatggcatcaacaattacacatgtctttgtccaccagagtacaccggcgaactgtgcgaggaaaagcttgacttctgcgcccaggacctaaacccctgccagcacgattccaagtgcatcctcactcccaaggggttcaagtgcgactgcaccccaggctacgtaggcgaacactgcgatattgattttgacgattgtcaggataataagtgcaagaatggagcccactgtacagatgccgtaaatgggtatacatgcatatgtccggaggggtacagtggtctcttctgcgagtttagcccccctatggtacttcctagaaccagcccctgtgacaactttgattgccaaaatggcgctcagtgcatcgtgaggattaacgaaccaatttgtcagtgcctgccaggatatcaaggcgagaagtgtgaaaagcttgtctcagtgaattttattaataaagagagctacctgcaaatcccctccgccaaggtccggcctcagacaaatatcacgctccagattgcaaccgatgaagactccgggatattactctacaagggcgacaaagatcacattgcagtggaactgtaccggggacgtgtccgtgcctcttacgacactggctcacacccagcctccgcgatctattccgtggagactataaacgacggtaattttcatatagtcgagttgcttgcgctggaccagtcactgtccctgtctgtggatggtggaaacccgaagataattacaaacctctctaagcagtctacgctgaattttgacagccctctgtacgtgggcggaatgccagggaagagtaatgttgctagcttgaggcaagcacctgggcagaatggaacatcattccatggttgcatcagaaacctttatattaacagcgagttacaggattttcagaaggtgcccatgcaaaccgggattttgccgggatgtgagccttgccataagaaagtctgcgcccacggtacatgccagcctagttcccaggccggttttacctgcgagtgtcaggaaggatggatggggccactttgcgaccagaggactaacgacccttgcttaggaaataaatgtgtgcacgggacttgccttccaatcaacgcctttagctactcgtgtaagtgccttgaaggccatgggggtgttttgtgtgacgaggaagaggatctgttcaacccttgccaggccatcaaatgtaaacatggcaaatgcaggctctccggccttggccagccttactgcgaatgttcctctggttacaccggcgatagctgtgaccgggagatatcctgcaggggggaacgaatccgagactactaccagaagcagcaagggtatgccgcttgccagaccacaaagaaggtgagcaggctcgaatgcaggggcggatgcgcagggggacagtgctgtggcccactgagatcaaaacgaaggaagtactctttcgaatgcactgacggctcctcctttgtagacgaggtggaaaaggtggtcaagtgcggctgcacacggtgcgtgtcatag

SEQ ID NO: 240710 - DNA, 4566 bp, Artificial Sequence
  Description of Artificial Sequence: Synthetic coding sequence
atgagaggtgtgggctggcagatgctctctcttagtcttggcctcgtgctggcgattctgaacaaggtggcccctcaggcatgcccggcacagtgctcctgttccggatccactgtcgactgccacggactagccctcaggagcgtgccacggaacattccccgaaacactgagcggctggacctaaacggtaacaatatcacgcgtatcactaagaccgactttgccggtttgcgacacttgcgggttctccagctgatggaaaataagatctccactatcgaacgtggcgctttccaggatctgaaagagctagagaggttaaggctaaacagaaaccatttacagctgttcccggagcttctattcctcgggacagccaagctgtaccgactggatctaagtgagaatcagatacaggcaattcccaggaaagcttttcggggtgcagtggacatcaagaacctgcagctcgattacaatcaaatatcatgcatcgaagacggcgctttccgcgctctgcgagaccttgaagtcctcacactcaataacaataatataacacgtttatcagttgccagttttaatcacatgccgaagctgaggacctttcgactccactctaataatttgtactgcgactgtcatctggcttggctgtccgattggctgaggcagcggccacgggtgggactctacactcagtgcatgggcccaagccacctaagaggccacaacgtggctgaggttcaaaagcgcgagtttgtgtgctcgggacatcagtcctttatggctccctcatgtagcgttcttcattgtccagcagcatgtacctgctctaacaacatcgtcgattgtagaggcaaggggctgacagagatccccacgaatctacctgagaccatcaccgagattcgccttgagcagaacactatcaaagttattccccctggtgctttctcaccctacaagaagctgcggagaatcgacttaagcaacaaccagatatccgaactggcacctgacgcatttcaaggtctcagatctctgaatagtttggttctgtacgggaacaaaattacagaactgcccaaaagcctgtttgaaggcttgttttctctccagttgttactgttgaacgccaataaaatcaactgtctgcgcgtcgacgcattccaggatctccataacctgaacctgcttagcctctacgacaacaaactgcagacaatcgcaaagggcactttcagccccctgcgcgcaatacagacaatgcacctggcccagaatccattcatctgcgattgccacttgaagtggctggctgactatttacacaccaacccgatcgaaacctctggggcacgctgtacatctccacgcagactcgccaacaagcgtatcggtcagattaaaagcaaaaagttccgatgttcggggacagaagactatcgatctaaactcagcggagactgctttgccgatctggcatgtcccgaaaaatgccgctgtgagggcaccacagtggattgcagcaatcaaaaacttaacaagatccccgaacacatcccccagtataccgctgagctccgcctgaacaacaacgaatttacggtcctggaggccactggaatttttaagaagctccctcagctaagaaaaatcaatttttctaacaacaaaatcacagatatcgaagagggcgcatttgagggcgcatcaggtgtgaatgaaattttgttgacttctaatcgcctggaaaatgtgcagcacaaaatgttcaaaggacttgagtccctcaaaacactgatgctgcgtagcaaccggatcacatgcgtggggaacgactctttcatagggttgagctctgtaagactgttgagtctctatgataaccagatcactaccgtggcaccaggagcattcgatacccttcactccctgagcaccctgaacctccttgctaatcccttcaactgtaactgctatctggcgtggctcggggagtggctccgaaaaaagagaatcgtcacggggaatcctcgttgtcagaaaccttatttcttaaaagaaattcccatacaggacgtagccatccaagacttcacttgcgatgatggcaacgatgacaactcttgcagtcccttgtcccggtgccccacagagtgcacttgtctcgacactgtggtacgctgcagtaacaaaggccttaaggtcctccccaaggggatccctagggacgtaaccgaactctacctggatgggaaccagttcacactggtccctaaagaactgtctaactacaaacacttaacactaatcgatctgtctaacaaccgaatctcaacactctccaatcaatcctttagcaatatgacacagctgctgactctgatcttatcgtacaaccgccttcggtgcatcccgccacgaacattcgacggtctcaaatcactgcgcctacttagcctccatggtaatgatatttcagtggtccctgaaggggcttttaacgacctctctgctttatcccacttagccattggagctaatcccttgtactgcgactgcaatatgcagtggttaagcgattgggtaaaatcggagtataaagaaccgggaatagcccgatgtgcaggtcctggggagatggccgataaactgctcctgaccactccaagtaaaaagttcacctgccaggggccagttgacgtcaacattctggccaagtgtaatccgtgtttgtctaacccttgcaaaaatgacggcacttgcaacagcgaccctgtggacttctataggtgtacttgtccatacggattcaaagggcaagactgcgatgttcccattcatgcttgcatcagcaatccctgtaaacacggaggtacatgccacttgaaggaaggagaagaagatggcttttggtgcatttgtgccgatgggttcgaaggagagaattgcgaagtcaacgtggacgactgcgaggacaatgactgcgaaaataatagcacctgcgtggacggcattaacaactacacatgcctgtgtcctcccgagtacaccggagaactttgtgaggagaaactagatttttgcgctcaggatttaaatccatgtcagcacgacagtaaatgcatcctgacccccaagggctttaagtgtgattgtactccagggtatgtcggggaacactgcgatattgactttgatgactgccaggataataaatgtaaaaatggcgcacattgtaccgatgcagtgaatggatacacctgcatttgtcctgaagggtacagcggtctattctgtgagttctctccgcctatggtactgccacggacttccccgtgcgataacttcgactgtcagaatggagcccaatgtatcgttcggattaacgagccaatctgtcaatgcctgcccggataccaaggagagaaatgcgagaaactggtgtcggtcaactttatcaacaaggagtcctacctccagattcctagcgccaaggtgagaccccagactaacatcaccctgcagatcgccaccgacgaggacagcgggatactgttgtacaagggagacaaggaccacatagctgtcgagctctatagggggagggtgcgggcttcctatgatactggctctcatcccgcatccgcaatctactcagtggaaaccatcaacgacggcaacttccatattgtggagctgctggccttggatcagagccttagtctgtcggtggacggaggtaatccgaagatcattactaatctcagcaagcagtcaacacttaactttgattccccgctgtacgttgggggaatgcccggaaagtccaacgtagcaagccttcgccaggcccctgggcaaaatgggacgtccttccatggatgcatccgaaacctgtacatcaacagcgaactgcaagatttccagaaggtgccaatgcagaccgggattcttcctgggtgtgagccctgtcacaaaaaggtctgcgcgcatggcacctgtcagcctagctcccaagcaggattcacatgcgaatgccaggagggctggatgggcccactctgtgatcaacgcaccaacgacccctgcttgggcaacaagtgtgtgcacggcacttgcttgcctatcaacgcgttcagctacagctgtaagtgtctcgaaggccacgggggtgtgctgtgtgacgaggaggaggatttgtttaatccgtgtcaagctattaagtgtaagcacggtaaatgtagactgagcggcctaggacagccatattgtgagtgcagttccggatacactggagattcgtgcgatagggaaatatcgtgccgtggtgaacggatccgagactactatcagaagcagcaaggatacgccgcatgtcagaccaccaaaaaggtgtctagactcgagtgtaggggaggatgcgctggtggccagtgctgtggacccctgcgctctaaaagaagaaaatactctttcgaatgtacagatggtagcagcttcgttgacgaagttgagaaagtggttaagtgtgggtgcacccggtgcgtgagctag

SEQ ID NO: 240711 - DNA, 4578 bp, Artificial Sequence
  Description of Artificial Sequence: Synthetic coding sequence
atgcgtggtgtcgggtggcagatgctgtcactctccctaggacttgtcctggccatccttaataaggttgcaccccaggcatgcccagctcagtgctcgtgtagcggctctactgtggattgccatggtctcgctttaaggagtgtgccgaggaatattcccaggaacaccgaacggctggatctgaatggcaacaacatcacccggattaccaagaccgatttcgccggtctgcgccacctgcgagtgctgcaactgatggaaaacaagatctccactatcgaacgcggtgcttttcaggacctcaaggaactagaacgcctacgtctcaaccggaaccacctgcaactcttcccagaactgctcttcctgggaactgccaagttatatcgcctggacctatcggaaaatcaaatacaagctatacctagaaaggctttccgcggagctgtggacatcaagaacttgcagttggactacaatcagatttcctgcatcgaggatggagcctttagggccttaagggacctggaggtattaacattgaacaacaataacatcacacgtctgtctgtggcgtcttttaatcatatgccaaaattgcgtacctttcgactgcattctaataatctctattgcgattgccacctggcctggctctctgattggctgcgtcagaggccaagagtggggctctacacccagtgcatgggcccatcacacctacgaggccataacgtggcggaggtgcagaaacgggagttcgtgtgttccgacgaagaagaaggacatcagtccttcatggcacctagttgcagcgtcttgcactgtcccgctgcatgtacatgcagtaacaacatcgtcgattgcagagggaagggactgacagaaatccctacgaacctgccggagactatcacggaaatccgattggaacaaaacactattaaggtaatacctccaggggctttcagcccttacaagaaacttcggcgtatagacctgtccaacaaccagatatctgagctcgcacccgatgcgttccaggggctgcggtccctgaattccctagtcctctatggcaacaaaataaccgaattacccaagtcactgtttgaagggctgttctctctgcaactgttattactgaacgcaaataaaattaactgccttagagtagatgcgtttcaggaccttcataatctgaacttactgagtttatacgataataagcttcagaccattgccaaggggacattcagccccctgcgagccattcagaccatgcatctggcccagaatccatttatttgcgattgtcatttgaaatggctcgcggattacctgcatacgaaccccattgaaacatccggtgcaaggtgtacaagtccacggagattagctaacaagaggatcggacaaataaaatccaaaaagtttcgctgcagcgggactgaggattaccgcagtaagctgagtggagactgcttcgccgacttggcatgtcccgaaaagtgccggtgtgaggggaccactgtggactgctctaatcaaaagcttaacaaaatccccgaacacatcccacagtatacggccgaactccgattgaataataacgaattcaccgttctcgaagccactggaattttcaagaaactgcctcaactgcgaaagatcaatttctctaataataagattactgacatcgaggagggcgcattcgaaggagcctccggcgtgaatgaaattcttcttaccagcaatcggttagagaacgtgcagcacaagatgtttaaaggcctagaaagcctgaagactctgatgctaagatcaaaccgaatcacttgcgtaggaaacgacagtttcatcggtctgtcgtcagtgcgactgctaagcctctacgataaccaaattaccaccgtcgctcccggagcttttgacactcttcattcactgtccactctcaacttacttgccaaccccttcaactgtaactgttaccttgcctggctaggcgagtggctgaggaagaagcgtatagtcacaggaaacccaagatgtcaaaaaccatatttccttaaggaaattcccatccaagacgtcgctatccaagattttacctgcgacgatggtaatgacgacaactcctgctctcccctcagtaggtgcccgaccgaatgtacttgcttggacactgtcgtgcgatgcagcaataaggggctcaaggtcttaccaaaaggcattccaagggacgtcactgaactttacttggatggtaatcagtttacgttggtcccaaaggagctttccaactacaaacacctgaccctgatcgacctctccaacaaccgcatctctacactgtccaatcaatccttttccaacatgacacaactgctcacactgattctctcctataaccgcctccgctgcattcctccccgtacattcgatggtctaaagtccctgcgcctcttatctctgcacggaaacgatatctctgtggtcccggaaggcgcatttaacgatctatcagcccttagccatctggcaatcggcgcaaatccgctgtactgtgattgcaacatgcagtggctgagtgattgggtgaagtctgaatataaagagccaggaatcgctcggtgtgcgggacctggggaaatggctgacaagctgctattgaccacgcccagcaagaagttcacctgccagggtcctgtggatgttaacattctggcgaaatgtaacccctgcttgagcaacccatgtaaaaacgatggaacttgcaacagcgaccccgtcgatttttatcggtgtacctgcccttacgggttcaaggggcaggattgtgacgtcccaatacacgcttgcatttcaaatccttgtaaacatgggggtacttgtcacctcaaagaaggggaggaggacggcttttggtgcatatgcgccgatggcttcgaaggggaaaattgtgaagtaaacgtggatgactgtgaggataatgattgtgagaacaattccacctgtgtagatgggatcaacaactatacttgcctgtgtcctcccgaatataccggagaactatgcgaggagaagttggatttctgcgcgcaggatctgaacccttgccagcacgattctaagtgtatactcaccccaaagggcttcaaatgtgactgcactcctggatacgtgggtgaacattgtgacatcgacttcgacgactgtcaagacaataaatgcaaaaacggtgctcactgtacagacgccgtcaacggatacacatgtatttgtccagagggatactctgggttgttctgcgagttctcgccaccaatggtgttgcctaggacctcaccgtgcgacaatttcgattgtcagaatggagctcagtgtattgtaagaatcaacgaaccaatttgtcagtgcctcccaggatatcaaggggagaaatgtgagaaacttgtgtcagtgaacttcatcaacaaggagagctacctgcagatcccttctgctaaagtgaggccacagaccaatattacgctgcagattgctaccgatgaggattctggaatcctgctgtataagggcgacaaggatcacatcgcagtcgaactgtatcgagggagggtgcgggcttcttacgacaccggtagccaccctgcctctgccatatatagtgtagagactattaacgacgggaatttccatattgtggagctgctggcgttggaccagtccctttccctttcagtggatggaggcaaccccaagatcatcactaatctctcgaaacagtccactctaaactttgattcaccattgtacgtggggggtatgccaggcaagtccaatgtggcttctctgcggcaggccccagggcaaaatggcactagttttcatgggtgtattagaaacctctacataaactcagagttacaggacttccagaaggtgccaatgcagaccggcatcttgcccggttgcgagccatgccacaagaaggtgtgcgcccacggtacctgccagccttcttctcaggcaggctttacttgcgaatgtcaggagggctggatgggtcctctctgcgaccaaagaactaatgatccctgcctcgggaacaagtgtgtccacgggacctgtcttcccataaatgctttctcttactcatgcaaatgtctggaggggcacggtggtgttttgtgcgacgaggaagaggatctcttcaacccgtgccaagcgatcaaatgtaagcacggaaaatgtaggttgtctggactcggccagccctactgcgagtgctcctctggctatacgggagattcctgtgaccgcgagatttcgtgccggggagaaagaatccgcgactactatcaaaagcagcagggctatgccgcttgccaaacaaccaaaaaagtcagccggctggagtgtagaggagggtgcgctggaggccaatgttgcggaccactgagaagcaaacgtcggaagtactcattcgaatgtaccgatgggagcagcttcgtggatgaagttgagaaggttgtcaaatgtggttgcactaggtgcgtttcctag

SEQ ID NO: 240712 - DNA, 4590 bp, Artificial Sequence
  Description of Artificial Sequence: Synthetic coding sequence
atgaggggtgtggggtggcaaatgctctctcttagtttgggtctggtcttggccattctgaacaaggttgcccctcaagcttgccccgctcagtgctcatgctctggcagcacagtggactgccatggccttgcactgagatccgtcccaagaaatattcctcgtaacactgaacgtttggatcttaatggaaataatattacccgcattacaaagactgactttgctggcctgaggcaccttagagtgctgcagctcatggagaacaagatctcaaccatagaaagaggggctttccaggatctgaaagaactggagcggctgaggcttaaccgtaatcacctacagctgtttccggagctgttattcctggggacggctaaactctatcgtcttgacctgtcggaaaatcagatccaggcaattcctcgaaaagccttccgcggtgccgtggacattaagaatctgcagcttgactacaatcagataagttgcatcgaagacggtgcctttagggccctgcgggatttagaagttctcacactcaacaacaataatatcacccgcttgtcagtcgcgagcttcaaccacatgcccaagcttagaacattcagactacacagcaataatctctattgtgactgccatctggcttggctctcggattggctgagacaacggccacgcgttggactctatacacagtgtatgggaccgagccatttgcgtgggcacaatgtggcagaggttcaaaagagagagttcgtgtgctccggccaccaatctttcatggccccatcttgttctgtcctgcactgcccagccgcatgcacatgctcaaacaatatcgttgattgcagagggaaaggcctgactgaaatcccaaccaatctgcccgaaaccataacggagatacgcctggagcagaacaccattaaagtgattccaccaggcgctttcagcccgtataagaaattacgacgcatcgacttatcaaacaatcagatttccgaactcgctcccgacgcctttcaggggctacggtccctgaacagcttggtgttgtacggaaataaaatcacggagttgccaaagtctctcttcgaaggattgttcagccttcagctcctgctgctaaacgcgaacaagatcaattgcctccgagttgatgcctttcaggatcttcacaatttgaacttgctgagcctctacgacaataagctgcagactatcgcaaaggggacgttttcccctttacgcgcaatccagacgatgcatctcgcgcagaacccattcatttgcgactgccacttaaaatggctcgctgactatcttcacaccaatcccatcgaaacttctggggctagatgcactagccctcgcaggcttgcaaacaagcgcattggccagatcaagtccaagaagttccgctgctccgctaaggagcagtatttcattccgggtacagaagattatcgtagcaagctgagcggcgattgctttgccgacctggcctgtcccgaaaagtgtcgatgtgagggaaccactgtggattgctctaatcagaaacttaataagattcctgaacatatccctcagtataccgcagaacttagactgaacaacaatgaattcacagtgctagaagcaaccggtatcttcaaaaagttgcctcaactgcgcaaaatcaatttctctaacaacaaaattactgacatcgaagagggggctttcgagggggcaagcggcgttaatgaaatactcttgacaagcaataggttggagaatgttcagcacaaaatgttcaaaggcttggagtcccttaagacactgatgctgcggagtaataggattacttgtgtgggtaacgattcatttatcgggctgtcttccgttcgccttctaagtctttacgacaaccagatcactacggtagctcctggggctttcgatactctccatagtctatcgactcttaatttactcgcaaatcctttcaactgcaattgttacttagcctggctgggcgaatggcttaggaaaaagaggattgttacgggcaacccgaggtgccagaagccctacttcctgaaagagattcctattcaggatgtcgccattcaggactttacttgcgatgacgggaacgatgacaactcgtgttctccactgagtcgctgcccaactgagtgtacctgtctggacacggtagttcggtgcagcaacaagggcctaaaggtcctgcccaaaggaattccgagagacgtgacggagctgtaccttgacggcaatcagtttactctagtgccgaaggaactgtcaaactataaacacctgaccctgattgatttgtccaataatcggatctctacgttgtccaatcagagcttcagcaacatgactcagttactgacacttatactctcatataacagacttcgatgcataccaccacgcacttttgacggcctcaaatcccttagactgctgagcctccacgggaacgacatctccgtggtccctgagggcgcttttaatgacctgtctgcactatcacacttggcgatcggggctaaccctctctattgtgactgcaatatgcagtggctctcggactgggtcaaatcagagtacaaggagccgggtatcgccagatgcgccggacccggagaaatggcagacaaacttctactgacaaccccatctaagaagtttacttgtcagggcccagtggatgtgaacatattagcaaaatgtaatccttgtctgtctaatccatgcaaaaacgacgggacttgtaattctgaccctgtggacttctacaggtgcacttgcccttatgggttcaaaggacaagattgcgatgttcccattcatgcttgtatatcaaacccatgtaaacatgggggtacttgtcacctgaaagaaggagaggaggatggcttctggtgtatatgtgccgacggtttcgagggagagaactgtgaggtgaacgtggatgactgtgaagataacgattgcgagaacaactctacgtgtgtcgatggaatcaacaactatacttgcttgtgcccgccagaatataccggcgaactctgcgaggagaaacttgacttctgcgcgcaagatctcaacccctgccagcatgactctaagtgtatcctcaccccgaagggcttcaagtgcgactgcactcccggatatgttggcgaacactgtgacatcgactttgacgactgtcaggacaacaaatgcaagaacggggcacactgtactgacgccgtgaatggttatacatgtatatgccctgaaggctatagtggcctgttttgtgagtttagtccgcctatggtgctgcctagaacctcgccatgcgacaattttgattgccagaacggggctcagtgtattgtgcggattaatgaaccaatatgtcagtgcttgcctgggtaccagggcgagaaatgcgagaagttagtgtccgtcaattttatcaataaagagtcatatttacagatcccatcagccaaggtccggcctcagaccaacatcaccttgcagatagccaccgatgaggactctgggatactgttatataaaggggataaggaccatattgccgtggaactctacaggggaagagtcagagccagctacgacaccggctcccaccccgcttctgccatctacagtgtcgagactatcaacgatggcaattttcacattgtcgaattactggctctggatcagtcactgtcactctccgtggacggcggaaatcctaagattattactaatctttcaaaacaatccacactgaattttgacagtccgctctacgtcgggggtatgccaggaaaaagcaatgtcgccagtctgcgacaggcgccaggtcagaatggtacgtccttccacggttgtattcggaatctctacatcaactctgaactgcaggatttccagaaagtccccatgcagacagggattctgccgggatgtgagccttgtcataagaaagtatgtgcccacgggacctgccagccaagtagtcaggctggttttacatgcgagtgccaggagggctggatgggtccgttatgtgaccaacggaccaacgatccctgtctcggtaataagtgcgtacacggtacctgccttcccatcaacgcatttagttatagttgcaagtgtctggaagggcatggtggggtactctgtgacgaggaagaagacctgttcaatccttgtcaggccatcaagtgcaagcacggaaagtgccgcctcagcggactgggccaaccttattgtgaatgctcaagcggatacaccggagacagctgcgaccgggagataagctgtagaggggagcggatccgggactattaccagaagcagcagggctacgcggcttgtcaaactaccaagaaggtatctaggttagaatgcagggggggatgtgctggcggacaatgctgtgggcctctgcgcagtaaaaggaggaagtattccttcgagtgcacagatggaagttcattcgttgacgaggtcgagaaggttgtaaaatgcggatgcactcgttgtgtgtcttag

SEQ ID NO: 240713 - DNA, 4419 bp, Artificial Sequence
  Description of Artificial Sequence: Synthetic coding sequence
atggcgcctggatgggccggtgtgggcgcagcggttagagccaggctggcattagccctagccttggcctcagtgctcagcggtcccccagctgtggcatgtcccactaaatgcacatgcagtgcagctagtgtggattgtcatggcctggggcttagggccgtgcctagggggataccaagaaatgccgagcgcctagatttggaccgcaacaacatcactcgtatcactaagatggacttcgccggtttaaagaatcttcgtgtgctccacctggaagacaaccaagttagtgttatcgaacgcggagccttccaagatctcaaacagcttgagagactgaggcttaacaaaaataaactacaggtactcccggaactcctgtttcagtctacccctaaacttactagactcgatctaagcgaaaaccaaatacaagggattccacgaaaagcatttcgaggaataactgacgttaagaacctgcagctggacaataatcacattagctgtattgaggatggagcctttagggctctccgcgatcttgaaatcctgacgctgaacaacaacaacatttcacggatactagtcactagcttcaatcacatgcctaagattaggaccctgcggctgcattccaaccacctctattgcgattgccacctggcatggctgagtgactggctgcgtcagcgtcgcaccgtgggtcagtttaccctctgcatggcccctgtgcatctcaggggtttcaatgtagccgacgtacagaagaaagaatacgtgtgtcctgctccgcactctgaaccgccaagctgtaacgctaattccatctcctgccctagcccttgcacctgctcaaataacattgtggactgcaggggtaaaggactgatggagattcctgctaatctcccagagggtatcgtggaaattagactggagcagaattctataaaggcaatccctgcgggtgctttcacccagtacaagaagctcaaacgtattgacatctccaagaaccagatatccgatatcgctccggacgcctttcagggactcaagagcttaacctccctggtgctatacggtaataaaatcacggagattgtgaagggcctatttgacggcttagtcagtctacagctgttgctgctgaatgccaacaaaatcaattgcttgcgcgttaacaccttccaggacctgcaaaacctgaatctattgtccctatatgataataagctccagaccatcagtaagggcttatttgcaccactccagtccattcagacattgcacttagcgcaaaaccctttcgtctgtgattgtcacctcaagtggctggctgactaccttcaggataaccctattgaaacatcaggagccaggtgctcctcccccagacgcctcgccaacaaacgtatttcccagataaagtcaaaaaagttccggtgtagcgggtcagaggactaccggagccggttcagcagcgagtgctttatggacctggtctgcccagagaagtgcagatgcgagggaacaattgttgactgctcgaaccaaaaattggtcaggatccccagccacctacccgagtacgtgactgatctgagactcaatgacaatgaggtgtctgttttggaagcgacgggtatattcaagaagttgccaaatttgagaaagattaaccttagcaataataaaattaaggaggtgcgggaaggcgctttcgacggagccgcaagcgtacaagagctgatgttgacaggcaaccagcttgagactgtccatggcagggtgtttcgcggtctgtctggactaaaaacgttaatgttgcggagcaacctgattgggtgcgtgtccaatgacacctttgccggtctctcctccgtccggttgttatcactgtatgacaatcggataacaaccattacacccggtgcatttaccacccttgtgtcattgtcaacaatcaacctgctgagcaaccccttcaactgtaattgccaccttgcctggctgggcaaatggctccgcaagaggagaatcgtgtccggtaatccgcgatgtcagaagccctttttcctcaaagaaatcccaatccaggacgtcgcaatccaggactttacgtgcgacggaaatgaagagagtagttgtcagttatccccgagatgtcctgaacagtgtacctgcatggagactgtggtgaggtgcagtaataagggcctgcgcgctcttcctagaggcatgcccaaggatgtaacagagctgtacctggaaggcaaccacctgacagctgtgccaagagagctgtccgcgctgagacatcttacactgatcgacctgtcgaacaactctatatcaatgttgaccaactacacattcagcaacatgagtcacttatctacgcttatcctgtcttacaaccggctcagatgtattccagtgcatgcctttaacggcctgcggtcactgcgagtgctcacgctgcacggcaacgacatcagcagcgtccctgagggaagctttaacgacctcacgtccctcagtcatctagccctcggaacaaatcccctgcactgtgattgttccctgagatggctttcagaatgggtgaaagccggatacaaagaaccaggaatcgcacggtgctcgtccccagaacccatggcagatcgactgctgctgacaacccccacccacaggtttcagtgcaagggccctgttgacatcaatatcgtggctaagtgtaacgcttgtctatccagtccgtgtaagaacaatggaacctgcacccaggacccagtggagctgtatcgatgcgcatgcccgtacagctacaaaggcaaggactgcaccgtgcccatcaacacatgcatacagaatccatgtcagcacggcggaacatgccacctgtccgactctcacaaagacgggttttcatgttcatgccccctggggtttgagggccagcggtgcgaaataaacccagatgattgcgaggataacgattgtgagaataacgctacctgcgttgatggaatcaacaattatgtctgcatctgtccccctaattacacaggcgagctgtgcgacgaggtgattgatcactgcgtccctgaactgaacctctgccagcatgaagccaaatgcattccattagacaagggcttttcttgtgagtgtgtcccgggatatagtggcaagttatgtgagacagataacgacgactgtgtcgcccacaagtgccgacacggcgctcagtgtgtggacactataaatggttacacgtgcacctgcccccagggctttagcgggccattttgcgaacatcctccacccatggtgttgctccaaacatccccttgcgaccagtacgagtgtcagaacggagctcagtgcatcgtggttcagcaagagccaacctgtcggtgcccaccaggtttcgccggaccaaggtgcgaaaagttgattacagtaaactttgtgggcaaggactcttatgtggagctcgcctcagccaaagtgcggcctcaggccaatataagtttgcaggtggccaccgataaagacaatgggattttgctgtacaagggggataacgacccactggcactagaactgtaccaaggacacgttagactggtgtatgatagcctttcctctccaccaacaaccgtttacagcgtcgagacggttaatgatgggcagtttcactcagtagagctagttaccctcaaccaaaccctaaatttggttgttgacaaggggactccaaagtccctcggcaagctgcagaagcagccagccgttggtataaacagtcctctctatcttggcggaattccaacatcaacaggcctctccgctctgcggcaaggtactgaccgcccattggggggttttcatggctgcatccatgaggtgcgcatcaacaacgagctgcaggactttaaggctctaccccctcagtccttgggagtatctcccggatgcaaaagctgcaccgtgtgtaaacatggactctgtcggagcgttgagaaagactccgttgtgtgcgaatgcaggccaggttggacggggcctctgtgtgaccaggaggcccgagatccctgcctggggcatcggtgccaccacggtaaatgtgtggcgactggaacaagttatatgtgtaagtgtgcagagggatatgggggagacctctgtgataataaaaatgactcagccaatgcttgttcagccttcaagtgtcaccatggacagtgccacatctcagaccagggagagccctactgcctctgtcagcctggcttctcaggcgagcattgccaacaggtcttccgggctcaagtctttcaatcctcactgcccggtaattgcagttggagttgctggcctcctcgaccaccaatgccctag

SEQ ID NO: 240714 - DNA, 4571 bp, Artificial Sequence
  Description of Artificial Sequence: Synthetic coding sequence
atggctcccggttgggctggcgtgggtgcagccgttagggcccgacttgccctcgctttggctctggcgtccgtattgtctgggcctcccgctgtggcttgcccaaccaagtgcacctgctccgctgcgtcagtagactgtcatggccttgggcttagagccgtgccccgaggcatccctagaaatgctgagagactggacctggaccgaaacaacatcacccggattactaagatggactttgccggtttgaagaacttgcgggtgcttcacctcgaagataatcaggttagcgtgatcgaaaggggcgcattccaggacttgaagcagctcgagcggttaagactgaataaaaacaaactgcaagtccttccggaactgctgtttcaatccacgcccaagctgacaagactggacctttctgagaatcagatacaaggcataccacgcaaggctttccgcggaatcacagatgtgaagaacctccagctggacaacaatcacatttcctgcattgaggacggagccttcagggccttacgggatctggagattcttacactcaacaacaacaacatcagccggatcctcgtgacatccttcaaccatatgcctaagatccgcacgcttagactccactccaatcacctgtactgcgactgtcacctggcttggttatctgactggctccgccagaggcgtaccgtcggtcagttcacgctctgtatggcccctgtgcacctcagggggtttaatgtggccgacgtgcaaaaaaaggaatacgtttgtcccgcacctcactcagaaccccctagctgtaatgcaaatagcatcagttgcccctccccttgcacatgctctaataacatcgtggattgccggggaaagggtttgatggagatcccggcaaatcttcccgaaggaattgtggagattcgcctggaacagaattctataaaggctataccagcaggtgccttcacccagtacaaaaaactaaaaagaatcgacatcagtaaaaatcagataagtgatattgcaccagatgcgttccagggactgaagagcctcacatccctagttctttacggaaacaagattacagagatagtcaagggcctgttcgatggactcgtgtctctgcagcttctgttgttgaatgccaataaaattaattgtctccgggtcaataccttccaggatctgcaaaacctgaacctcctgagtttgtacgataataaactgcagaccatttctaagggcctcttcgctcccctgcagagcatacagacactccacctggcacaaaacccttttgtgtgtgactgccatctgaaatggctggctgattacctccaggataaccctatagagacgagtggagccaggtgttctagtccccgtcggctggccaacaaacggatctctcagattaagagcaaaaaatttcgctgctctgggtcggaagattatcggagccgtttctcctctgagtgcttcatggatctggtttgtcccgagaaatgtcgatgcgagggtacaattgtagactgcagcaatcagaaactcgtgaggataccgagccacttaccagagtatgtgacagatctcagactgaacgataacgaagtttccgtgcttgaagccacgggcatttttaagaagctaccaaatctgaggaagattaacctgtcaaacaataaaatcaaggaggtgcgcgaaggagcctttgacggcgctgcctccgtgcaggaattgatgctcaccggcaatcagttggagacggtgcacggtcgagttttccgcggactgtccgggctgaagacacttatgttgcggtctaatctgatcggctgcgtcagtaatgacacctttgctggtctttctagtgtcaggttgctgagcctgtacgacaaccgtattaccaccattactccaggggcattcacaactctggtgagtttgtctaccataaacctactttcaaatcctttcaattgtaactgtcatctggcctggctgggaaagtggttaagaaagcggagaatcgtgagcggaaacccgaggtgccagaagccctttttcttgaaagagattcctatccaggacgtcgcaatccaggattttacctgcgacggcaatgaagagagtagctgtcagctttcgcctcgttgccctgaacagtgtacctgtatggagactgtggtcaggtgcagtaataagggtcttagagctctgccacgcggtatgcccaaggatgtgactgagctgtatctggagggaaatcatttgaccgcagtgcccagagagctgtccgctctgaggcacctgacgttgattgacctgtcaaataatagcatttctatgctgactaactatacttttagcaacatgtcacacctcagcaccctcattctgtcctacaatagactgaggtgtatcccagtccacgcattcaacggccttaggagtcttagggtgctgaccttacacggaaacgatatcagcagcgttcccgaaggctcatttaacgatctgacctcactgagtcacctggctctcggaactaacccattacattgtgactgctccttaagatggctatccgagtgggttaaggccggatacaaggaacctggaatagcaagatgctcctcccccgagccaatggctgaccgtctcttgctcactacacccactcaccgcttccagtgtaagggacccgtcgacattaatatcgtcgccaagtgcaacgcttgtttgtcgtccccctgtaagaacaacggcacctgtacgcaggaccccgtggagttgtaccgctgtgcctgcccatactcctataagggcaaagactgcaccgttcccatcaatacatgtattcaaaatccttgccaacatggcggaacttgtcaccttagcgacagtcataaggacggattctcgtgttcctgccccctcggattcgaagggcagcggtgcgagatcaatccggacgattgtgaggacaatgactgtgaaaacaatgcaacttgtgttgacggtataaataattacgtgtgcatctgtccgccaaattacacaggcgaactgtgcgacgaagtgattgatcattgcgtacccgaactgaatctgtgccagcacgaggccaagtgtattcccttggacaagggtttctcttgcgagtgtgtccccggttactcaggcaagctgtgcgaaacggataatgacgattgtgtggcccacaagtgccgccacggagcacagtgtgtggatactatcaacgggtatacatgtacttgtccacagggattttccggacccttttgcgaacatccgccaccaatggtcctgctgcagacatccccgtgcgaccagtatgagtgccaaaatggtgctcagtgtattgtcgtgcagcaggagcccacctgcaggtgtccccctggcttcgccggacccaggtgtgaaaaactcatcaccgtgaatttcgtgggcaaggacagttacgtggaactggcaagcgcgaaggttagaccccaagccaacatttcattacaggtcgcgacagacaaagacaacggcatactgctatacaaaggggacaacgatccattggctttagaactgtatcaggggcacgttcgcttggtctacgactccctgagctcacctcctaccacagtttactccgtggaaactgtgaacgatggccagttccactctgtggaactggttacactgaatcagaccctgaatctggtggtggataagggaacgccgaaatcgctgggaaagttacagaagcagcccgctgtgggcattaactcaccactgtacctgggaggaattcccacttctaccggcctgtccgccctgaggcaaggcaccgaccgcccattaggcggattccatggctgtatccatgaagtcaggatcaacaatgagctgcaggatttcaaagctctccccccacagtctcttggagtctctcctggttgcaagtcctgcacggtttgcaaacatggattgtgtaggagtgtcgaaaaggacagcgtggtgtgcgagtgccgtcccggatggaccggaccactctgcgatcaagaagccagagacccctgtctggggcacagatgtcaccacgggaaatgcgtcgctaccggcacctcttacatgtgtaagtgtgccgagggatacggcggtgacctgtgtgacaataagaacgatagcgccaatgcatgctcggcctttaagtgccatcatggtcagtgccacattagcgaccagggagagccttactgcctttgtcagcctggtttctccggggaacactgtcaacaggagaatccttgccttggtcaagtggtgagggaggtaatccgcaggcaaaagggctacgcgagctgcgcaactgcgtcaaaggtgccaatcatggagtgtaggggtgggtgtggccctcagtgctgccaaccaacgaggtcaaaaagacggaagtatgtgtttcagtgcaccgacggctccagttttgtcgaagaggtcgagcggcaccttgaatgcgggtgcctcgcttgtagtta

SEQ ID NO: 240715 - DNA, 3258 bp, Artificial Sequence
  Description of Artificial Sequence: Synthetic coding sequence
atgtcaaccccgtctagattcaaaaaggacaaagagattattgcagagtacgagtcccaggtgaaggagatcagggctcaactcgtggaacagcagaaatgcctagagcagcagaccgaaatgcgggtgcagcttctgcaagatctgcaagatttctttaggaaaaaggccgaaatagagacggagtactctaggaatctcgagaaactggctgaaaggtttatggctaaaactcgctcaacaaaggatcatcagcaatacaaaaaagatcagaatctcttgtcaccagtgaattgctggtacctcctactgaatcaggttaggcgcgaatccaaagaccacgccactctgagcgatatatatctgaataacgtcatcatgcgctttatgcaaatttcagaggactccacacgcatgttcaagaaatcgaaggagatcgcctttcagctgcatgaggatctgatgaaggtgctgaacgagctgtataccgttatgaagacgtaccacatgtatcatgctgagtcgattagtgccgagtcaaaacttaaggaagctgagaagcaggaagagaagcagattggacgctccggcgacccagttttccatatcagactcgaagagagacatcagaggcggtcgagtgtcaagaagatagaaaagatgaaggagaaaagacaggcaaaatactccgagaataaactcaaaagcatcaaggctcgaaatgagtacctgctgactctggaagcgacaaacgcctccgtgttcaaatattacatacatgacctgtctgatctgattgattgttgcgaccttggttatcatgcttccttgaatagggccctgaggacatatctcagtgctgagtataacctcgagaccagtcgtcacgaggggttggacattattgaaaacgcagttgataatctcgagcccaggagcgacaaacagcgcttcatggaaatgtatccggctgccttttgtcctccaatgaaattcgagtttcaatctcacatgggagacgaagtctgccaggttagtgcccaacagccagtgcaggctgagttgatgctgcgataccagcaactacagagtcggttggccactctaaaaatcgagaacgaagaggtgaagaagaccacggaggccactctgcagaccattcaagatatggtgacaattgaagactacgatgttagcgaatgctttcagcattcaagatccacagagagtgtaaaaagcacagtctccgagacgtatctctccaagccctctatcgcaaaaagacgagccaaccaacaggagaccgaacagttctattttatgaagctcagagagtacctcgagggctccaatctcatcacaaagttacaggccaagcacgaccttttacaacgcacactcggtgaggggcaccgtgctgagtacatgaccacacggccacctaacgtccccccaaagccacagaaacaccgtaagagtaggcccagaagtcagtataacaccaagttgttcaacggcgacttggagaccttcgtgaaggattctggccaggtgatcccgctgattgtggagtcctgtattcgctttatcaacctatacggactgcaacatcagggaatcttcagagtgtccggcagccaggtcgaagtgaacgatatcaaaaactcatttgagcgcggtgagaacccgttagcagacgaccagagcaatcacgatataaactcagtagcaggggtccttaagctgtatttcaggggcctggaaaatcccttgttccccaaggagaggttcaatgacctgataagctgcattcgtatagataatctttacgagagggctcttcatatccggaagctcctgctgacattgcccagaagcgtgctgatcgtgatgagatacttgttcgcctttcttaatcatctgtcccagtattctgatgagaatatgatggatccgtacaacctggccatatgttttggacccactctcatgccggtccctgagattcaggatcaagtgtcctgtcaagcacatgtcaatgagatcatcaaaacaatcatcattcaccacgaaacaattttccccgatgccaaggaattggacggccctgtctatgagaagtgtatggccggtgatgactattgcgattcaccctacagtgaacatggaacgctggaggaggtggaccaagatgcaggcacagagccccacacctctgaagacgagtgcgagcccatcgaagctatcgcgaagtttgattacgtcggtagatcagctcgggagctctccttcaagaagggtgcttcactcttattgtatcacagagcatccgaagattggtgggagggaagacataatggaattgatggtttggtgccccatcagtacatcgtggtgcaagatatggatgacacctttagtgatacactctcgcagaaggctgacagtgaagcctcttcagggcctgtcacggaagacaagagctccagcaaggacatgaacagcccaactgataggcaccccgacggctatctggcacgacagaggaaacggggagagcctcctcccccagtacggaggccaggccgaacttcagacggccactgtcctttacatccaccccacgccctgtccaactcaagtgttgacttgggctctccttctctggcatcacatcctcggggactgctgcagaatagggggctgaacaacgatagcccagaacggaggcgcagacctggtcacggctcactcaccaacattagtaggcacgactcactcaagaagattgatagcccaccaattagacggagcacgagctccggccagtacactgggttcaacgaccacaaacctttagaccctgagacaatcgctcaagacatcgaggaaactatgaatacagccctcaacgaactccgggagctcgaaaggcagagcacagccaaacatgcgcctgacgtcgtcctagataccttggagcaggtcaaaaattcaccaaccccagccacgtccacggaatcattgagcccactccataatgtagctctccggtcctcagagcctcagatccgcagatccaccagctcctcctctgacacgatgtctacattcaagcccatggtggctcctcggatgggagtacagctgaagccacccgcactgcgacctaagcctgcggtcctgccgaaaactaatccaaccataggcccagctcccccaccgcagggcccaactgacaagagctgtaccatgtag

SEQ ID NO: 240716 - DNA, 3189 bp, Artificial Sequence
  Description of Artificial Sequence: Synthetic coding sequence
atgtcaacaccaagtcgattcaagaaggacaaagagataatcgcagaatatgaatcgcaggtgaaagaaattcgagcccaattggtggaacagcagaaatgccttgaacagcaaaccgagatgagggtacagttactgcaggacttacaggacttctttcggaaaaaagcagaaattgaaacagagtatagccgtaacctggagaagcttgcagagcgcttcatggctaaaacccggagtacgaaggaccaccagcaatataaaaaggatcagaacctgctgtcacctgtgaattgttggtaccttcttctcaatcaggtcaggagagagagcaaggatcatgcaaccctgtccgacatctatctaaacaatgtcatcatgcgattcatgcagatcagcgaagacagcactcgcatgttcaagaagtcaaaggagatcgcctttcagctgcacgaagatctgatgaaggtcctgaatgagctgtatactgtgatgaagacatatcacatgtaccatgccgagtccatttccgccgaaagtaagctgaaggaagccgaaaaacaggaggagaaacagataggcagaagcggggacccagtatttcatatcaggttagaagaacgtcaccagcgaagatcatccgtgaagaaaatagaaaagatgaaagaaaaaagacaggcaaaatattcagaaaataagttaaagtccatcaaagcacgcaacgagtatctgctgaccctagaagccactaatgccagtgtttttaagtattatatccatgacctgtccgatttaatcgactgctgtgacctgggctaccacgcgagcctgaacagagccttgcggacctatcttagcgccgagtacaacctcgaaacctccagacacgagggattagacatcattgagaacgctgtagacaacttagagccccgatctgacaaacagcgatttatggagatgtatcccgcagccttctgccccccaatgaaattcgaatttcagtcccacatgggtgatgaggtttgtcaagtatcagcccaacagccggtgcaggccgagctaatgctccgttaccagcagctccaaagtagactcgctacattgaaaattgagaacgaagaggtcaagaagaccaccgaggcaaccctccagacaatccaagacatggtgaccatcgaggactacgatgtgagtgaatgttttcagcactctaggagcaccgaatctgtgaaatccaccgtgtctgaaacctatctttccaaaccaagcatcgccaagcggcgtgccaatcagcaagagacagagcagttctacttcatgaagctacgcgaatacttggaggggtctaatctgatcaccaaactccaagccaaacatgatctgttacagcggactctcggggaaggccacagggccgagtatatgacgacctcccgaggaagacgaaatagccacaccagacaccaggactcggggcaggtgatccctttaatcgtggagtcatgtatcagatttattaacttgtatggcctccagcatcagggcattttccgcgtgtctggctcccaggtggaggtgaacgatattaagaattcattcgagagaggcgaaaatccgttagccgacgatcagtctaatcatgatataaattctgtggcaggcgtgctcaaactctatttcaggggcctcgaaaatccattgttccccaaggaacgatttaatgatctgatcagttgtatcagaattgataacctctacgagcgcgcattgcacatcagaaagctcctgctgacgctcccaaggagcgtccttatcgtaatgcgctacctgtttgctttccttaaccatctgtcacagtacagtgatgaaaatatgatggatccctacaatctcgcaatttgtttcggccctacgctcatgcccgtccccgaaatccaggaccaggtgtcctgtcaggcccatgtaaacgaaattatcaagactattatcatccatcatgaaactattttcccagacgcaaaagaactggacggccctgtttatgagaaatgcatggcaggcgacgattactgtgactctccctatagcgagcacgggactctggaggaggtcgaccaagacgccggaacagaaccacatacctcagaagacgagtgcgagccaattgaggcaatcgccaagtttgactacgtcggaaggagcgcacgtgagttgtcgtttaaaaagggggcatccctactcttgtaccacagggcctcagaggactggtgggaaggcaggcataatgggatcgacgggctagtgccccaccagtatatcgtagtccaggacatggatgataccttctccgatacattatcccaaaaggccgattcagaagcatccagcggcccagtgaccgaagacaaaagctcttctaaagatatgaattctcccactgaccgacatcctgacggttatttggctcgtcaaagaaagagaggcgaaccccctcccccagtgaggagacctggaaggacctccgacggccattgtccactgcacccgccacatgccctcagtaacagctccgtagacctgggctcccccagcttagcatcccaccccagaggactgctgcaaaatcgcggtcttaacaacgatagcccagagaggaggagacgcccagggcacggctccctcacaaatatatctcggcacgattcacttaagaaaatagacagccctcccatcaggcgcagtacatctagtggacagtacaccggtttcaacgatcataaaccgttggaccctgaaacaatcgctcaggacatcgaggagacaatgaatacggccctgaatgagcttagagaacttgagcgacagtcaacagccaaacacgcacctgatgtggtcttggataccttagagcaggtcaagaattccccgacccccgctacctctaccgagagtctctcaccactccacaatgtggctctgaggtctagcgaaccccaaatcagaaggtccacaagttcttcttccgatactatgtctacatttaagccaatggtcgctcctcggatgggcgtccagctgaagccacctgcactgaggccaaagcctgctgtattgcctaagacaaatccaacaattggacccgctccgccaccgcaaggccctactgacaagtcatgcaccatgtag

SEQ ID NO: 240717 - DNA, 2958 bp, Artificial Sequence
  Description of Artificial Sequence: Synthetic coding sequence
tgaaaggaccagaacgttttgtcccctgtcaactgctggaaccttctgctgaatcaggtgaagagagagagccgggaccacacgactttgtctgatatttatttaaacaacatcatccctcgttttgttcaagtgtccgaagactctggacggcttttcaaaaagtccaaagaggtagggcagcagctccaggatgacctgatgaaagttttgaacgagttgtactcggtgatgaagacatatcacatgtacaacgctgacagtattagtgcgcagagtaaactgaaggaggcggagaagcaggaggagaagcaaatcgggaagtctgtgaagcaagaagaccggcaaactcccaggagccctgactcgacagctaacgtgcgtattgaggaaaagcacgtgcggcgatcaagtgttaaaaagatcgagaaaatgaaggagaaacgacaggctaagtataccgaaaacaagttgaaagctatcaaagcaaggaacgagtatctactggcactcgaggcaactaacgccagcgttttcaagtactatatccacgacttatctgacctgattgaccagtgttgcgacctcggatatcacgctagcttgaacagggcgctgagaacattcctctccgcggagctcaaccttgaacagagtaaacatgaagggctagatgctattgagaacgcagtagaaaatctggacgccacctccgacaagcaacgcctgatggagatgtataataatgtcttctgtccacccatgaagttcgagtttcagccacacatgggcgacatggcctcccaactatgtgctcaacagcccgtccagtcggagctcgtgcagaggtgtcagcagcttcagagtcgcctgtccacccttaagattgagaatgaggaggtaaagaagactatggaggcaacgctacagacaatccaggatatagtcacagtggaagattttgatgtgagcgactgctttcagtatagcaatagtatggagtcggtcaagagcaccgtgagtgagacctttatgtctaagcccagcatcgctaaaaggagggccaaccaacaggagacggagcagttctattttaccaaaatgaaggaatacctggaggggcgtaacttgatcacaaagctgcaagcaaagcatgatctattgcagaaaaccctgggcgaatctcagcgaaccgactgctcactggctagacggtccagcacagtgaggaagcaggatagttcccaggctattccactggtggtcgaatcctgcatcaggtttatcagccgccatggtcttcagcatgagggaatttttcgcgtgtccgggagtcaggtagaagtgaacgatatcaaaaacgcattcgagaggggcgaggatccactggccggagaccaaaatgatcacgacatggattctattgccggtgtgctgaaattgtacttccgaggacttgagcatcctctgttccccaaagacatctttcacgacctaatggcgtgcgtgaccatggacaatctgcaagaacgcgctcttcatattcgaaaggtgttgctggtgctgccaaaaaccacactgatcattatgcgatatctgtttgcttttctgaatcaccttagccagttcagcgaggaaaacatgatggatccctacaacctggccatttgttttgggccatctttgatgagtgtgcctgaaggtcatgatcaggtatcatgtcaggcacacgtgaacgaactgattaagaccattattatccagcatgagaacattttccctagcccacgcgaactggaaggcccagtgtacagccgcggaggatctatggaagactattgcgattctccccatggcgagaccacatctgtggaggactccacacaggacgtgacagcagagcatcacacatcagacgatgaatgtgaacctatcgaagctatagctaaatttgactatgtgggaaggactgcaagagaattgtcctttaaaaagggggcttctttgttactttaccagagggcaagcgacgattggtgggaaggcaggcacaatggaatcgacggactgattccccaccagtacattgtggtgcaggatactgaagatggtgtggtggagcggtcttcccctaagtccgaaatagaagtaatctcggaacctcctgaagagaaggtcacagcaagggccggtgccagttgcccttccggagggcatgtggccgacatatacttagctaatatcaataaacagcggaagaggcctgagtcgggtagcattaggaaaacatttaggtcagacagccatggactaagttccagcttaactgacagtagttcacctggggtcggagcctcctgtcgtccctcgagtcagccaattatgagccagtccctcccgaaggagggcccagacaagtgctcgataagcggtcacggatctctgaattcaatatctagacacagctctttgaaaaacaggctcgatagcccacagattaggaaaactgctacggccggaaggagcaaaagctttaacaatcatcggccaatggatcccgaagtcattgcacaggacattgaggccactatgaactcagccctgaacgaattgagagagctggagaggcaatcttccgtcaagcacacacccgatgtcgttttagacacccttgaacccttgaaaacgtctcccgtggtggcaccgacttccgaacctagctctcctcttcacactcagttactaaaggatcccgaacctgcatttcaacgatcagccagcaccgctggggacattgcttgcgctttcaggcctgtgaagtccgtcaaaatggcggcacccgtcaaaccccctgctacccgcccaaaacccacagtattccccaagactaacgccacaagccccggagtgaactcaagcacctcaccgcagagcactgacaagtcatgtactgtgtag

SEQ ID NO: 240718 - DNA, 2796 bp, Artificial Sequence
  Description of Artificial Sequence: Synthetic coding sequence
cagagcaaggaagtgggccaacagctccaagacgatctgatgaaagttctgaatgagctgtactctgtgatgaaaacttaccatatgtacaatgcagatagtatctctgcacaaagcaaactgaaggaggccgaaaagcaagaggagaagcagatagggaagagcgtgaagcaggaggatcgccaaacccccaggtcacccgacagtactgccaacgttcggatcgaggagaagcacgtgaggaggagtagtgtcaagaaaattgagaagatgaaggaaaagcggcaagccaagtacactgagaataaactgaaggccattaaggcacgaaatgaatacctactcgccctggaggctaccaacgcaagtgtgtttaagtattatatccacgatctgtctgatctaattgaccagtgctgcgacctggggtatcacgcaagcctgaatagggcattgagaaccttcttatcagccgagctcaatctggagcagagcaaacacgaggggctagacgcaattgagaacgcagtcgagaacttagatgccacctccgacaagcagcgcttaatggaaatgtacaacaatgtgttttgcccaccgatgaaatttgagtttcaaccgcatatgggtgatatggcctctcagctctgcgctcaacagcccgtccagagcgagctggttcagagatgccaacagttgcagtcccgtctgtccaccctcaagatcgagaatgaagaagtgaaaaaaactatggaggctacgctgcaaacaattcaggatattgtcacagtagaggattttgacgtatcggactgttttcagtactctaactccatggagtccgtcaaatcaactgtgtctgagacatttatgtcaaagccctcgatcgccaagagacgggctaatcagcaggaaactgagcagttctacttcaccaaaatgaaggagtatttggagggccgaaacctgattacaaaactacaggcaaagcatgacctgctccagaaaacactcggggaatcccagagaacagactgttccctggctaggcgctcctctaccgtacgcaagcaggacagctcccaagcaatccctctcgtcgtggagagctgtattaggtttatcagccgccatgggctgcaacacgaaggcatcttccgtgtctcgggttcccaggtagaggttaatgatattaagaatgcatttgagagaggggaggaccctttggctggtgaccaaaacgatcatgatatggactcaattgcgggtgtactgaagctgtactttaggggtctcgagcatcccctcttccctaaagacatcttccatgaccttatggcttgtgtgaccatggacaacttacaagaacgggctctgcatatcagaaaggttctgctcgtgcttcccaaaactacattgattatcatgcgatatctttttgcattccttaatcacctctcccagtttagcgaggaaaacatgatggatccttataatctggctatctgctttggcccatccctaatgtctgtgcctgaggggcacgatcaggtctcatgccaggctcacgttaacgaactcattaaaacaatcatcattcagcacgaaaatatattcccatcaccacgcgaacttgagggaccagtgtactcacgtggcggtagcatggaggactattgtgactctccgcatggagagactacttcagttgaggactcaacacaggatgtgactgccgaacaccacacctcagacgatgaatgtgagcccattgaagctattgcaaaattcgattacgtcggccgaaccgcccgagaacttagctttaagaaaggagctagcctactcttgtaccaacgcgcaagtgatgactggtgggaagggcgacataacggcatcgacgggctcatcccccaccagtatattgtggtgcaagatactgaagacggcgttgtggagcgcagctctcccaagtccgagatcgaggtcatatccgagccgccagaggaaaaagttacagcccgtgctggggcttcgtgcccctccggaggacatgtggccgatatttacttggccaatataaataaacagcgcaaacggccagagtctggaagtatccgcaagacctttagaagtgattcccacggcttaagtagcagcttgacagatagttctagccccggtgttggggctagctgtcgacccagtagccagcctatcatgtctcagagtttgccgaaggaggggccagacaagtgcagtatctctgggcatggaagccttaactccatcagtaggcactcatctttaaaaaatagactggattctccacagataaggaagacggcaactgctgggagaagtaagagttttaataaccatcgaccaatggatcccgaggtgattgcacaggatatagaagccactatgaattcagcactgaatgaactgcgagaactcgagaggcaaagctccgtgaagcacaccccagatgttgtgctagacacgttagagccactcaagacatcccctgtggtagctccaacatctgagccctcctctcctctacacacgcaattactgaaggatccagagcctgcgtttcaacgctccgccagcacagccggagacatcgcatgtgccttcaggcccgtgaaatctgtgaaaatggcagccccagtgaagcctccagccacacgccctaagccgaccgtgtttcccaagactaacgcaactagccctggcgtaaacagttcaacatctccccagtcaactgacaagagttgtaccgtgtag

SEQ ID NO: 240719 - DNA, 2112 bp, Artificial Sequence
  Description of Artificial Sequence: Synthetic coding sequence
agaaaggaccagaacgtgctgagccccgtcaactgttggaatctgttactgaatcaggtgaagcgagagtcgcgcgatcatacaaccttgagcgatatttacttaaataacatcataccgagattcgtccaggttagcgaagattccggcaggctcttcaaaaaaagtaaagaggtgggtcaacagcttcaagatgacttgatgaaagtactgaacgaactgtatagtgtcatgaaaacctaccacatgtataacgccgattcaattagcgcacagtcgaagctcaaggaagctgaaaagcaggaggaaaaacagataggtaaatcggtgaaacaggaggatagacaaacccccagaagcccagacagcaccgctaacgtccggattgaagaaaagcacgtgcgcaggtcttccgtcaaaaagatagaaaagatgaaagagaagagacaggctaagtacaccgagaacaaattgaaagcaatcaaagcacgcaatgagtacctgcttgcactcgaggccacaaacgcttccgtatttaaatattatatccatgaccttagtgatttaatcgattgttgtgatctgggataccatgcctccctcaatagagctctccggacattcctttctgctgaattgaatctggaacagtctaaacacgagggcctcgacgctattgaaaacgctgtcgagaacctggatgctaccagtgataagcagcgcctcatggaaatgtataacaacgtgttctgtccccctatgaagttcgagttccagccacacatgggggatatggcaagccagctgtgtgctcagcaacctgtgcaatcagagctggttcagaggtgtcagcaactgcagagcagattgagtacgctaaagatcgagaacgaggaagtcaagaaaacaatggaagctactcttcagactattcaggatatcgttactgttgaggactttgatgtaagcgattgttttcagtactcaaattccatggagtccgtcaagtctacagtttcagagacctttatgtccaagccgagcattgccaaacgtcgcgctaaccagcaagagaccgaacagttttacttcactaaaatgaaagaatacctcgagggcagaaatttgatcacaaaactgcaggccaaacacgacctattgcaaaaaaccctgggagagtctcagcgcacagactgttccctggcacgaaggtccagcaccgtgaggaagcaggactcaagccaggctatcccactggtagtggagagttgtatcagattcatctccaggcatggcctgcagcatgagggaatcttcagagtgtcggggtcgcaggtcgaggtcaatgatatcaagaacgcattcgagagaggagaagaccctttggctggggatcagaatgatcatgatatggactccatcgccggagtgcttaagctttatttccgcggactggaacaccctctgtttccaaaggatattttccacgaccttatggcctgcgtgacaatggataacctacaagaacgagccctccatataagaaaggtactgcttgtcctcccaaagaccacactcattataatgcgatacctgttcgcattcttaaaccacctgtcacagttcagtgaggaaaacatgatggatccttacaacttggccatctgctttggcccatctctgatgagtgtgcctgaaggacacgatcaggtatcttgccaggcgcacgttaatgagcttatcaagactattattatccaacatgaaaatatcttccccagtcctcgggaactggaggggccagtttacagccgtggaggtagcatggaggactactgtgacagcccccatggtgagacaacatcagtggaggatagcacccaggatgtgactgcagaacatcataccagcgatgatgagtgcgagcccatcgaagctattgccaagtttgattacgtggggaggacagccagggaactatcctttaaaaaaggggcaagtttattgttataccagagagcatcagacgactggtgggaagggagacataacggtatagatggactgatcccccatcaatacattgtggtccaggataccctgataagctag

SEQ ID NO: 240720 - DNA, 759 bp, Artificial Sequence
  Description of Artificial Sequence: Synthetic coding sequence
atggaggattattgcgacagtcctcatggcgagactacatccgtggaggatagcacgcaggacgtgacagctgagcatcacacgagtgacgatgaatgcgaaccaattgaggcaatcgcaaaatttgactacgtaggaagaacagctagagaactgtccttcaaaaaaggggcttctctgttgctgtaccagagggcttccgatgactggtgggagggtagacacaacggcattgacggcctgattcctcatcagtacatcgtcgtgcaggacacggaggacggtgtggtggagcgaagttccccgaagagcgagatcgaagtgattagtgaaccacccgaggaaaaggtcacagcgcgagccggtgcgagctgtccttcaggcggacatgtcgcagatatctatctggctaacatcaataacaacttgcacttggacaacacgaagccagtgactaccaagcagcgtaagcgtcctgagagtggctccattagaaagacattccgctccgattcccatgggctgtcgagctcccttaccgactcttccagccctggagttggagcgtcttgtcgacccagcagtcagcccattatgtcacagagtcttcctaaggaaggcccagacaagtgttcgatcagcggacacgggtccctgaactcgatttcacgtcattcaagtctgaagaatcggctggactcaccgcagatccgaaagacagcgacggctggtcgtagcaaatcttttaacaatcattag

SEQ ID NO: 240721 - DNA, 693 bp, Artificial Sequence
  Description of Artificial Sequence: Synthetic coding sequence
taggcggagcaccacacgtctgacgacgaatgcgagcctattgaagcaatagccaaatttgactacgtgggaagaacggccagggaattatcctttaaaaagggagctagcctgttgctctatcaaagggcctcagatgactggtgggagggtcggcacaacggaatcgacggacttattccccatcagtatatcgtggtgcaagacacggaagatggggtggtggagagatcatcgcccaagagtgaaattgaggtgatctcagagccacctgaggaaaaagtaaccgcacgcgcaggcgcaagctgcccctccgggggacacgtcgcggatatttacctggccaacatcaataacaacctccacttggataatacaaaacctgttacgacaaagcagagaaaacggccagaatctggatccattagaaagaccttcaggtcggatagtcacgggctatctagctcactgacggattcaagctcaccaggcgtgggcgcatcttgcaggccaagctctcagcctatcatgtcacagtcactgcccaaggagggccctgacaagtgttcaatatctggccatggaagtctaaactctattagcaggcactcatctcttaagaaccggctggactcgcctcaaatcagaaagaccgctacagccggtcgctcaaagtcatttaacaaccattag

SEQ ID NO: 240722 - DNA, 1353 bp, Artificial Sequence
  Description of Artificial Sequence: Synthetic coding sequence
gtgaagaaaacgatggaagccaccttacaaactattcaagacatagtaacagtcgaagacttcgacgtcagcgactgttttcagtactctaattccatggagtcagtaaagagcaccgtcagcgaaacatttatgtctaaaccctctatcgcaaagcgtcgtgcgaatcagcaggagaccgagcagttctacttcactaagatgaaggagtatcttgaaggtcgaaatctgataaccaagcttcaagctaagcatgatctccttcagaagaccctcggtgaatcgcagcggactgattgctccttggcccgtcgctcatcaaccgtaagaaaacaagattcctcgcaggcgatcccccttgtcgtggagagttgcattagattcatctcccggcacggcctccagcacgaaggcatctttcgcgtgagtggttcacaggtggaagtcaatgatattaaaaacgcctttgagaggggcgaggaccctctcgccggagatcagaacgatcacgacatggactccattgccggagtcctgaagctgtacttccgaggcctggaacaccccctctttcccaaagacatcttccacgatctgatggcctgtgtaacaatggacaacctgcaggagcgcgcactgcacatcaggaaggttctgcttgtcctgccaaagactacactgatcatcatgagatatctgttcgccttcctgaatcatctctctcaattctctgaggaaaacatgatggacccctacaatctggcgatctgttttgggcctagcctaatgagtgtgccagaaggccatgatcaggtatcttgccaggcccacgtaaatgagcttataaaaacaattatcatacagcacgagaatatatttcccagcccgagggagttggaaggaccagtgtacagtagggggggtagcatggaggattattgcgacagtccgcacggcgaaacaacctcggtggaagacagtactcaggacgttaccgctgagcatcacacgagtgatgatgagtgtgaaccaattgaggcaatagctaagttcgactacgtcggcagaaccgcccgagaactttccttcaagaaaggtgcatcactgctgctgtaccaacgtgcgtctgatgattggtgggaaggccgacacaacggcatagacggtctgattccacatcaatatatcgtggtccaagatacagaggacggcgttgtggaacggagctctcctaaatccgagatagaagtcattagcgaacccccagaggaaaaggttacagcacgcgcaggcgctagttgcccatctgggggacatgtggccgatatatatctggctaatatcaacaagtag

SEQ ID NO: 240723 - DNA, 3228 bp, Artificial Sequence
  Description of Artificial Sequence: Synthetic coding sequence
atgagttctcagaccaaattcaaaaaagataaggagattatcgctgaatatgaggcacagatcaaagagatacggacgcagctagtagaacagtttaaatgtctggaacaacagagtgaatctcgcctgcaattattgcaggaccttcaagaattcttccggcgaaaagctgagatagaactggagtactctagatccctagaaaaactcgccgagcgtttttcatctaagattagaagctcacgcgagcatcaattcaagaaagatcagtatcttctgtctcctgttaactgctggtaccttgtgctccatcagacgcgtagagagtcaagggaccatgccacgctgaatgatatcttcatgaacaatgttattgtcagactctctcagattagcgaggatgtgatcagattgtttaaaaaatcgaaggagataggcctacagatgcatgaagaactgctgaaagtgaccaacgagctctataccgtgatgaaaacctatcacatgtaccacgctgagtccattagcgccgagtccaaacttaaggaggcagaaaaacaggaggaaaagcaatttaataaaagcggcgacctttccatgaacctgctccgccacgaagacagaccgcagagaagatcttccgtgaaaaaaatagagaaaatgaaggagaagcgccaggccaaatattctgaaaataagctcaagtgcaccaaagcccgtaacgattatctacttaacctggctgcaacgaatgccgcaatttcaaagtattacatacacgacgtctccgatctgatcgactgctgcgatctgggatttcatgcttcactagctaggacattcaggacctatctgtccgccgaatacaatctggagacctcacggcacgaaggattggatgtgatcgaaaacgccgtggacaacttggacagccgatcggacaagcacactgtaatggacatgtgtaaccaggtgttctgtcccccattgaaattcgaattccaaccacacatgggagatgaggtatgccaggtcagcgcccagcagccagtccaaaccgagttacttatgcgataccaccagctccagtctaggctagccacgctgaagatcgagaatgaggaggtgcgtaagaccctggacgccaccatgcagaccctgcaggacatgctcactgtggaagactttgacgtttctgatgcctttcagcacagtagatccactgaatccgtaaaatctgcagctagcgagacctatatgagcaagattaacattgcgaagagacgggctaatcagcaggagactgaaatgttttattttactaaattcaaggagtatgtcaacggatctaacctgatcaccaagttacaggcaaagcacgacctgcttaagcagactctcggagagggtgaacgcgcagaatgtggaaccacacgagggaggcggaacgctaggacccggaaccaagatagtggccaggctatcccgctggtggtggagtcttgtattagatatatcaatctctacggactacagcaacaaggcatcttcagggttccgggatcgcaggtggaagtgaacgatatcaagaatagttttgagcgaggcgaggaccccttggttgacgatcaaaacgaacgcgacattaacagcgtggcaggcgtgttgaaactctactttcgcggacttgagaaccccctctttccgaaggagcggtttcaagacctaatatctacaattaaactggagaaccctgcagagagggtccatcaaatccagcaaatcctcgtcacgctccctcgcgtggtcatcgtggttatgagatacttatttgccttcctgaaccatctatcgcagtactccgacgagaatatgatggatccatataacctggcaatttgttttggccctactctgatgcatatcccagacggacaggaccccgtgtcatgtcaggcgcacattaacgaagtcatcaaaaccattatcatccaccatgaagcaatcttccccagccccagagaattagaaggaccagtctatgaaaaatgcatggcagggggtgaagagtattgcgattcgccccatagtgagccaggcgctatcgacgaggtcgatcacgataacggcaccgagccccatacatctgatgaagaggtggaacagatcgaagctatcgccaagttcgactacatgggtcggtcccctcgtgagctctcttttaaaaaaggggcatccctgctcctgtaccatcgcgcttctgaagattggtgggagggcagacacaacggtgtcgacggattaatcccacaccagtatatcgtggtgcaggacatggacgacgccttcagcgactccctgtcacagaaagctgactcagaggcaagctctgggccactacttgatgataaagcctcctctaagaatgacttgcagtcccccaccgaacacatctcagattatgggttcggtggagtcatgggaagagtacgcctgcgaagcgatggggcagcaattcctagacggagatcagggggtgatacccattcaccccctcgaggcctggggccttcaattgacacgccgcctcgcgctgccgcttgcccttcatccccccataaaatcccccttacaagaggtaggatcgagagcccggagaaacgcaggatggccacttttggttctgcgggtagcattaattaccccgataaaaaggcactttccgagggacacagcatgcggtccacttgcgggtctacacgacatagttccctgggagatcacaaaagtttggaggctgaagccctcgctgaggatatcgaaaagaccatgtccactgcccttcacgagttaagggaactggagaggcaaaatacagtcaaacaggcacccgatgtcgtgcttgacacacttgaaccgctcaagaaccctccaggtccagtgagctccgaaccagcatcccctctccacaccatcgtgatcagagatccggacgctgcaatgcgtaggagttcctctagctccacagagatgatgactacattcaagccagcactttccgctcgcttggccggagcccaactgaggccccctccaatgaggcccgtcaggcctgtcgtgcagcaccgctcgagcagtagctccagcagcggggtggggtcccccgctgttacaccaaccgagaagatgtttccgaattcctccgccgacaaaagtggaacaatgtag

SEQ ID NO: 240724 - DNA, 3300 bp, Artificial Sequence
  Description of Artificial Sequence: Synthetic coding sequence
atgagcagccagacaaaatttaagaaagacaaggaaattatcgccgagtacgaggcgcagatcaaggaaattcggacccagctggtggagcagttcaaatgtcttgagcagcaaagcgagagtaggcttcagctccttcaggatctgcaggagttctttagacgaaaagccgaaattgaactggagtacagccgcagtctggagaagctggccgaaaggttctcctcgaagattcgtagcagtcgggagcaccagttcaaaaaagatcagtacctgctgtcccccgtgaactgctggtacttagtgctccatcagactcgtcgcgaaagccgcgaccatgccacgctgaatgacatattcatgaataatgtaatcgtgcgcctcagccaaatcagcgaagacgtgattagacttttcaaaaaatccaaggagataggattacagatgcatgaggagctcctgaaagtgaccaacgagctatacacagtgatgaaaacttatcacatgtaccacgccgaatcaattagcgctgagtcaaagctgaaggaggccgagaaacaggaggagaagcagtttaataagtcaggggatctctccatgaacctgcttcggcatgaggatagaccacagcgcagaagcagtgtaaagaagattgagaaaatgaaagagaaacgccaagccaagtattcagagaataagctgaagtgtaccaaggccagaaacgactacctcttgaacctggccgctaccaacgccgctattagcaaatattacatccacgatgtgtcggatctgattgattgctgcgatcttgggttccatgctagcctcgctaggacatttcgcacctatctaagtgcagagtacaatctggaaaccagtcggcatgaagggttggatgttatagagaatgctgtggacaatttggacagtagaagcgacaaacatactgtgatggacatgtgcaaccaggtgttttgccctcccctgaagttcgaattccagcctcatatgggtgatgaagtgtgccaggtgagcgcccaacaaccagtccagactgagctgttaatgcgataccaccagctgcagtcacggctggctacccttaaaatagagaatgaggaagtccgcaagactcttgatgcgacgatgcagacgctgcaggatatgctgacggtcgaggactttgacgtgagcgacgcctttcagcactctcgtagcacagaatcagtcaagtcggcggcaagcgaaacctacatgtccaaaatcaacatcgccaagaggagggctaatcaacaggagactgagatgttctatttcactaagttcaaggagtacgtgaatgggagcaatctgattacaaaactgcaggccaaacacgatttgctgaaacagacactcggcgaaggcgagcgggctgagtgtggtactaccagaccaccctgccttccccctaaaccccagaagatgaggcgtccgaggcccctgtctgtgtattcccacaagctcttcaacggctccatggaggcattcattaaggactccggacaggctattcctctcgtggtcgagtcctgcatccgctatatcaacctgtacgggctgcagcagcaggggatctttcgtgtgccgggttcccaggttgaggttaacgatatcaaaaactcattcgagcggggtgaggacccactggtcgacgatcaaaacgagagggacataaattcagtggcaggagttttgaaactgtacttcaggggcttagaaaatcccctatttccgaaggagcgcttccaggatctgatcagcactatcaaacttgagaaccctgccgaaagggtccaccagatacagcagattcttgtcactttgcctagagtggtgatagttgtcatgaggtatctgtttgctttcctcaatcatcttagccagtacagcgacgaaaatatgatggatccctataatcttgctatatgcttcggccctacattaatgcacatccctgacggccaggatcctgtgtcctgccaggcccatatcaacgaggtgataaagaccattatcatccaccacgaggcgattttcccgtccccacgcgaactcgaaggtcctgtttatgaaaagtgcatggccggtggggaagaatactgcgacagtccacactctgaacctggcgcaatagatgaagtggaccatgataatgggactgagccgcatacaagcgacgaggaagtcgagcagatcgaggcaattgccaagtttgattatatggggaggagccccagagagctgtcattcaagaagggggcaagcctcctgctgtatcacagggccagtgaggattggtgggaaggccgacataatggggtggacggattaatcccccatcagtacattgtagtacaagatatggatgatgcattcagtgattcacttagtcagaaggccgattcggaagcttcttctggccctctccttgatgataaagcatcttccaagaatgaccttcagtctcctaccgagcacataagtgactatggtttcggaggggtgatgggaagggtgcgtctccgaagtgatggggctgcaatccctagaaggcgctctggcggagacacccattctccccctagggggttgggaccatctatcgacacccctccgcgagccgcagcctgtcccagttcccctcacaagattcctctcactcgtggcaggattgaatccccggaaaaacgtagaatggcaacttttggatcagctgggtcaataaattaccccgacaagaaggccctttctgagggccacagtatgagatccacctgcggatccaccagacatagttccctaggcgatcataagtctctcgaggcagaggccttggcagaagatatcgaaaagacaatgtctacagctttgcacgaacttcgagagctggaaagacaaaacacggtgaagcaggccccagatgtcgtcctcgataccctcgaacccctcaaaaaccctcctggccctgtctcttccgagcccgcatccccactgcacaccatcgtaattagagacccagatgctgccatgaggagatcttctagctcctctacagagatgatgaccacttttaaacctgccctcagtgcaaggttggcaggcgcacagttgcggcctcctcctatgaggcctgtgaggcctgtagtgcaacacagatcatcgtcctccagttccagcggcgtggggtccccagcagtaactcctaccgaaaagatgtttcccaactcttcggctgataagagtggaaccatgtag

SEQ ID NO: 240725 - DNA, 1008 bp, Artificial Sequence
  Description of Artificial Sequence: Synthetic coding sequence
atgaacaacgttatcgtgagactctcacaaatttcagaggacgtgattcggctgttcaaaaaaagcaaagagattgggctgcaaatgcacgaggagctgctgaaagtaaccaatgagttgtataccgtcatgaaaacctatcacatgtatcacgctgagagtatttctgcagagtctaaactcaaggaagctgaaaagcaggaggagaagcagttcaacaagagcggggacctctctatgaacttgctgcgccacgaggacagaccccagaggcggtcgagcgtgaaaaagattgaaaagatgaaagagaaaagacaggctaaatattctgagaacaaactcaagtgtaccaaggcccgtaacgactaccttctaaacctggcggctaccaatgccgcaatctccaagtattacatccacgacgtgtccgacctgatcgattgttgtgatttaggattccatgcgtcacttgctcggacatttcgcacctatttatctgccgaatataatctggaaaccagccgtcatgagggcctggatgtcattgagaacgcggtcgataacttggatagtagatctgataagcatacagtgatggatatgtgcaatcaagtgttttgcccacccctgaagttcgagttccagccacatatgggagacgaagtttgccaggtatctgcacaacagccggtgcagaccgagctcctcatgcgctatcaccagttacagagcaggctcgcaacactgaagattgagaatgaggaggttagaaagactctggatgcgactatgcagactctgcaagatatgttaacagtcgaagactttgacgtgtctgatgcattccaacactccaggtctaccgagagcgttaagtcagctgcatctgagacatacatgagtaagatcaatatcgctaaacgcagggctaaccagcaggagaccgagatgttctatttcacgaaaggtccggatgatgtgttccccatatgccaccctagactgtag

SEQ ID NO: 240726 - DNA, 360 bp, Artificial Sequence
  Description of Artificial Sequence: Synthetic coding sequence
atgtcctggtggagaaacaatttttggattattctggcggtcgctattattgtggtgagcgtcgggcttggcctcattttatactgcgtgtgcaagtggcagcttagaagaggaaagaagtgggagatcgccaaaccactgaaacataagcaggtggacgaggagaaaatgtatgatttcctgctgctgagaaccgcctgcagtctgcctcccctgcctctgcactaccgcacctctatgaccgagacttatggggtgttattgtgccggcctggttggtcagctctcgctaggtcgcgcctgactgccgcatcagccagctgggtgcaggcgatcttgcttccccagccaccgaagtag

SEQ ID NO: 240727 - DNA, 438 bp, Artificial Sequence
  Description of Artificial Sequence: Synthetic coding sequence
atggacacatttacagtgcaggatagcactgcaatgagctggtggagaaacaatttctggatcattcttgccgtagcgatcatcgtggtctcagtgggactgggactcattctgtactgcgtttgcaagtggcagcttcgaagaggcaaaaagtgggagatcgctaaacccttgaagcataaacaggttgatgaagagaagatgtatgagaatgttctgaacgaatctcccgtgcagctgccaccccttccaccccgtaattggcctagcttggaggacagtagcccgcaagaggcaccgtcacagccaccagcaacctactctcttgtgaataaagtcaaaaataagaagaccgtgtctatcccgagctatatcgagcccgaggatgactatgacgatgtggaaatccctgccaatacggaaaaagctagtttttag

SEQ ID NO: 240728 - DNA, 438 bp, Artificial Sequence
  Description of Artificial Sequence: Synthetic coding sequence
atggatacgtttaccgttcaggattccactgctatgagctggtggcggaataacttttggataattctagccgtggcaattatcgtggtttccgtcggcttagggctgattttgtactgtgtgtgcaagtggcaattacgtaggggtaagaagtgggaaattgctaagcctctcaagcacaagcaggttgatgaagaaaaaatgtacgagaatgttctcaatgaatcgccagtgcaattaccaccattacccccacgaaactggccctccctggaagacagctcaccccaggaagccccaagtcagccccctgccacatactcacttgttaacaaggtcaagaataagaaaactgtgagtattccctcttacattgaaccagaggatgactacgacgatgtggagattcctgctaacacggagaaagctagtttctag

SEQ ID NO: 240729 - DNA, 1398 bp, Artificial Sequence
  Description of Artificial Sequence: Synthetic coding sequence
atgaacgtaacctctcttttttccttcacctccccagccgtgaaacgtttgctgggctggaagcagggagacgaggaagagaaatgggccgagaaggcagttgatgcgctggtgaaaaagctgaaaaaaaaaaagggagccatggaagagctggagaaagctctgagctgcccaggacagcctagcaactgcgttactattcccagaagtcttgatggccgtctgcaggtgtcacaccgaaaaggcctccctcacgtgatttattgtcgcgtgtggcgctggccagaccttcagtcacatcacgagcttaagcctctcgaatgctgcgaatttcctttcgggagtaagcagaaagaagtgtgtatcaacccttatcactataagcgcgttgaatctccggtgctgcccccagtgctggtacccagacactccgagtataacccccaacattctctacttgcacaattcaggaacttaggtcagaatgagcctcatatgcccttgaacgcgaccttccccgactctttccaacagcccaattcacacccctttcctcattcgccgaactcaagttacccgaactccccgggttcctcaagcagcacatacccccattccccaacttcatccgatccaggttcaccatttcagatgccagccgacacccctccccctgcgtaccttccaccagaggacccaatgacacaggatggttcacaacccatggataccaacatgatggcgccacccctgccttccgaaattaatagaggcgacgttcaggccgtcgcctacgaggagcccaagcactggtgttcaatcgtgtattatgaactcaataacagagtgggtgaggcctttcatgccagttccacctccgtgctcgtggacggtttcactgacccttctaacaataagaatagattttgcctaggactgcttagcaatgtgaacagaaattctacaatcgagaatacccgtcgccacatcgggaagggtgtacacttgtactacgtgggcggagaagtttatgctgaatgtctatctgattcgtccatctttgtgcagtctaggaattgcaattatcatcacggattccaccccactacagtgtgtaagatccccagcgggtgtagtctgaaaattttcaataaccaagagttcgctcagttgttggctcagagcgtgaatcacggattcgaaacagtgtatgagttaaccaagatgtgtaccatccgcatgagtttcgttaaaggttggggtgccgagtaccaccggcaagacgtgactagtacaccatgctggatcgaaatacacctgcacggaccgctgcagtggctggataaagttctaacacagatggggagcccacacaatcccataagcagcgtgtcctag

SEQ ID NO: 240730 - DNA, 1398 bp, Artificial Sequence
  Description of Artificial Sequence: Synthetic coding sequence
atgaatgtgacaagtttgttctcctttacatcccctgcagtcaagcggctgctcgggtggaagcagggagacgaggaggagaaatgggctgagaaggctgtagatgcacttgttaagaaattaaagaaaaaaaagggtgcaatggaagaacttgaaaaagcccttagttgtccgggtcaacccagcaactgtgtgacaatcccgagatctctggatggtaggctacaggtgtcccatcggaaaggcctccctcatgtgatttactgccgggtttggcggtggcctgatctgcagtctcatcacgaattgaagcccctggagtgctgtgagttccccttcgggtctaagcaaaaagaagtgtgtatcaatccctaccattacaagagggtggagtcccccgtgctgccaccagtacttgttcctcggcactcagaatataacccacagcactccctgctcgctcaattccggaacctcggtcagaatgaaccacacatgccgctgaatgctacttttccggattcttttcagcagccaaattctcatccctttccgcactcacccaattcttcatatccgaattctcccggtagtagtagcagtacttatcctcactctcccacctccagcgatccaggctcaccctttcagatgcccgcagataccccccctcccgcatatttgccacctgaggaccctatgacacaggatggttcccagccaatggataccaatatgatggcccctcctttgccatccgaaatcaaccggggagatgtgcaggccgtggcctatgaggaacccaaacattggtgtagcatcgtctactatgaacttaacaatagggtcggagaagcttttcacgcgagcagcacttccgtcctcgtggacggattcaccgaccctagtaataacaaaaacagattctgcctaggtttactttccaacgttaaccgtaactctactatcgaaaacaccaggaggcatatcgggaagggggtccatctctattatgtcggaggcgaggtgtacgccgagtgtcttagcgatagctcaatctttgtgcagtcacgcaattgcaattatcatcatgggtttcatcccacaactgtgtgtaagattccatcgggttgcagcttgaaaatctttaacaatcaagaattcgcccagctgctggctcagagcgtcaaccacggattcgagaccgtttacgagctcaccaagatgtgcaccatacgtatgtccttcgtcaaaggctggggcgcagaataccatcgacaggacgtgacaagcaccccctgctggatcgaaatccacttgcatggcccactccagtggctggataaggttcttacacagatgggtagtccacacaacccgatttcatcggtttcttag

SEQ ID NO: 240731 - DNA, 177 bp, Artificial Sequence
  Description of Artificial Sequence: Synthetic coding sequence
atgaacgtaacatccctgttctctttcaccagccccgcagttaaacgccttttggggtggaagcagggcgatgaagaggagaaatgggctgaaaaagccgtggatgccctcgtaaagaaactaaagaaaaagaaaggcgctatggaggaactcgagaaggcattgtcttgcccatag

SEQ ID NO: 240732 - DNA, 33 bp, Artificial Sequence
  Description of Artificial Sequence: Synthetic coding sequence
atgaatgtcacaagcttattctccttcacctag

SEQ ID NO: 240733 - DNA, 288 bp, Artificial Sequence
  Description of Artificial Sequence: Synthetic coding sequence
atgaatgtgacctccctgtttagttttacctctcccgcagtaaagcggctgcttggctggaagcaaggcgacgaggaggaaaagtgggcagaaaaggcagtagatgctctcgtgaagaaacttaagaaaaagaagggcgctatggaggaactggagaaggctctttcctgtcccggtcagccgtcgaactgtgtgacaatccccagatccctggacggtcgattgcaggtgtcacaccgtaagggattaccacacgtcatttactgtagagtatggaggtggccctag

SEQ ID NO: 240734 - DNA, 402 bp, Artificial Sequence
  Description of Artificial Sequence: Synthetic coding sequence
atgaacgtaacatcattgttcagcttcaccagccctgctgtgaaacgtctccttggctggaagcagggggacgaagaagagaagtgggcagaaaaggccgtggatgccctggtcaaaaaacttaaaaagaagaagggagccatggaggaactggagaaggcacttagctgtccagggcaaccctctaactgcgttaccatcccacgatcacttgatgggagactgcaggtaagccaccgaaagggactaccccatgttatctactgtagagtgtggaggtggccggacctgcagtcccaccacgaactgaagccactggaatgctgtgagtttccctttggcagcaaacagaaggaggtgtgcattaacccttatcactataaacgggtcgaatcaccctag

SEQ ID NO: 240735 - DNA, 321 bp, Artificial Sequence
  Description of Artificial Sequence: Synthetic coding sequence
atgaacgtgaccagcttgttcagttttacaagtcccgcagtaaagagactattgggttggaagcagggagatgaggaggagaagtgggcagagaaggcagttgatgcgctcgtcaagaagctgaagaagaagaagggcgcaatggaagaactggagaaagctctgtcatgtcccggacagcctagcaattgtgtgaccatccctcgatccttggacggaaggctgcaggtaagccaccggaaggggctaccccacgtaatttattgtagagtttggcgctggcccgacttacaatcgcaccacgagctgaaacctctctag

SEQ ID NO: 240736 - DNA, 339 bp, Artificial Sequence
  Description of Artificial Sequence: Synthetic coding sequence
atgaacgtgactagcctctttagctttacctctcccgctgtcaaacgattactggggtggaagcagggtgacgaggaggagaagtgggctgaaaaggcagtagatgcgctagttaagaaacttaaaaaaaagaaaggcgcaatggaggaacttgagaaggcattgtcttgccccggacagccgagcaactgtgtgaccatcccccgaagccttgacggcaggctgcaggtgtcacaccgcaaggggcttccgcacgttatctattgcagggtgtggaggtggcccgatctgcaaagccaccatgaattaaagcctctggagtgttgtgaattcccctag

SEQ ID NO: 240737 - DNA, 1398 bp, Artificial Sequence
  Description of Artificial Sequence: Synthetic coding sequence
atgaacgtcacgtcactgttctctttcacttcccctgccgttaagagactgctgggctggaaacagggcgacgaggaggagaaatgggccgaaaaagccgttgacgcgctcgttaaaaagttaaagaaaaaaaagggagcaatggaggaactggaaaaggccctgtcctgccctggacaacccagtaactgcgtgactatccctcgatcactggacggcaggctgcaggtgagccataggaaagggctcccacacgtcatttactgccgagtctggcgctggcctgatctccagtcccaccatgagctgaaacccctggaatgctgcgagtttccctttggcagcaagcagaaagaggtctgtatcaatccatatcattataaacgcgtggaatcccctgtgctccctccagtactggtgccacggcactccgagtacaatccccagcattccctgctagctcagtttaggaacctcggacagaatgagcctcacatgcctctgaacgccacttttcccgactcattccagcagccaaacagccaccctttcccacatagtcccaacagcagctaccccaacagccctggttctagttcatctacttatccccacagcccgacaagcagcgatcccggatccccttttcagatgcctgcagataccccccctcccgcttacctaccgcctgaagaccctatgacacaggacgggtctcagccaatggacacgaatatgatggctcctccactcccatctgagatcaaccgcggtgacgtacaggccgtggcttacgaggagccaaaacattggtgttcaatcgtatactacgaactgaataatagggtcggcgaggcattccacgcctcctccactagtgtgctggtagacggatttactgaccccagcaataacaaaaaccggttctgtttaggactgctgtccaatgtgaaccggaattctactatagagaacacccggagacatatcggaaagggagtgcatctgtattacgtgggcggagaggtctatgctgagtgtctctccgacagcagcatcttcgtacagtctaggaactgcaactatcaccatggttttcaccccactaccgtgtgtaaaattcccagcgggtgttctctgaaaatttttaacaaccaggagtttgcccagcttctcgctcagtccgtaaatcacggatttgagaccgtgtatgagctaacaaaaatgtgcacgattcggatgagttttgtcaagggatggggcgcagaataccaccgccaagacgtgacatcgacaccttgttggatcgaaattcacttacacggtcccctgcagtggttggacaaagttctgactcagatgggctcaccacataatccaattagctccgttagttag

SEQ ID NO: 240738 - DNA, 1659 bp, Artificial Sequence
  Description of Artificial Sequence: Synthetic coding sequence
atggataacatgtctataaccaacactcccacatctaatgacgcatgcctttcgatcgtgcactctctgatgtgccaccgtcagggcggtgaaagcgaaacattcgcaaaacgggctatcgagtccctcgtcaaaaagctcaaggaaaagaaagatgaactggatagcctgattacggccataaccaccaacggagcacatcctagtaagtgcgtaactatccagcgtacgcttgatggccgactgcaggtggctggacggaaaggattcccgcacgtgatctacgccagactctggcgttggcccgatcttcataagaacgagctcaagcacgtgaagtactgtcagtatgcctttgaccttaagtgtgacagcgtgtgtgtgaacccttatcactacgagagggtggtcagccccggtatagacctctccggcctcactctgcaatctaacgctccgtcatccatgatggttaaagatgagtacgtccacgacttcgagggccagccctctctcagcaccgaaggacattctatacaaaccatccagcaccccccttcgaatcgcgcatcgacagagacctactcaacacctgccctgctcgcaccctccgagtccaatgcgaccagcaccgccaattttccaaatatccctgtcgctagcacctctcagccagcctccattttgggcggttcgcactcagaaggattgttgcagattgccagcggaccgcagcctggccagcagcaaaatgggttcacaggacagcctgcgacctaccatcacaattctacaacaacttggaccggttcaaggaccgcaccatatacccctaacctgccacaccaccagaatgggcacctccagcaccaccctccaatgcctccccacccagggcactattggccagtccacaacgaattggcgttccagcctcccatctcaaatcaccccgctcctgaatattggtgcagcatagcttactttgagatggacgttcaggtcggggaaacgtttaaggtaccatcaagctgtccaatagtgacagtggacggatacgtagacccttccggtggcgatcggttttgcctcgggcagctgtcaaacgttcacagaaccgaagccattgagagggctagactgcatattgggaaaggtgtgcagctggagtgtaagggcgaaggcgatgtttgggtacggtgtctgtcggatcatgctgtgtttgtgcagagttactatcttgatagagaagctgggagggctcctggggacgccgtgcacaagatttatcccagtgcttatatcaaagtctttgatctacggcagtgccatagacagatgcagcagcaagctgctacagctcaggcggcagcagccgcacaggccgcagcagtggccggaaacatacctgggccagggtcagtgggcggaattgctcctgctatatctctttccgcagcagccggaattggcgttgatgacctcagaagactctgtattctgagaatgtcttttgtcaaaggatggggacccgactatccccgacaaagcatcaaggaaaccccgtgctggatcgaaatccatctccaccgcgcattacaacttctggacgaagtgttgcacaccatgcccattgccgaccctcagccgttagactag

SEQ ID NO: 240739 - DNA, 1659 bp, Artificial Sequence
  Description of Artificial Sequence: Synthetic coding sequence
atggataatatgtccatcaccaacacacctacctctaacgatgcatgtctatcaatagttcactcactgatgtgccaccgacaggggggagagagcgagacatttgcgaagagggcaatagaaagcctcgtgaaaaagctcaaagaaaagaaggacgaactggacagtctgatcaccgcaatcacaacaaacggggcacatccttccaaatgcgtgaccattcagaggacccttgatggcagactgcaagtagccggacgcaaggggttcccccacgtaatctatgcccgactatggcggtggccagacttacataagaatgaactgaaacatgtgaagtactgccagtatgcgttcgatctgaaatgcgattcagtttgcgttaacccctaccattacgaaagagtggtttccccaggtattgatctcagcggcctgaccttacaaagcaacgcaccaagcagcatgatggtcaaagacgaatatgtccatgacttcgaaggtcaaccttccttgtccaccgagggtcattctatacagaccatccagcaccccccttctaaccgcgctagtaccgaaacatattccactcctgccctgttggcacctagcgagtcaaacgctaccagcacagcaaatttccccaatatcccagtcgcctcgaccagccaaccagcatccatcttggggggaagccatagcgaagggttgttacagattgcatcaggcccacagccagggcaacagcagaatggtttcacgggacagcccgcaacttatcaccacaacagcacaacaacctggactggctcaagaactgctccctatacacccaacctccctcatcaccaaaatgggcatctgcagcatcatccaccaatgcctccacatcctgggcactattggcccgttcataacgagctcgcattccagcccccaatttccaaccatcccgcacctgagtactggtgttccatagcctactttgagatggacgttcaagtgggcgaaaccttcaaggtgccatcgtcatgtccaatcgtgacagtcgacgggtacgtcgacccttccgggggagatcgcttctgcctcggccagctgagcaatgttcatagaactgaagccatagaacgggcacggttgcacattgggaaaggggtacagctcgaatgcaaaggagaaggtgatgtttgggtacgttgcttgtctgaccacgccgtgtttgtacagtcatattaccttgaccgcgaagcagggcgtgctccaggcgacgccgtccacaagatttacccaagtgcctatatcaaggtcttcgatctgcgacaatgccaccgacagatgcagcagcaagctgctactgctcaggccgctgccgctgcacaggctgcagccgtggccggaaatattccaggccctggttcagtgggtggaatagcaccggctatcagcttaagtgcggcagccggtattggtgtcgacgatctgagaagactctgcatacttcggatgtcatttgttaaaggctgggggcctgactaccctagacagagcataaaggagacaccatgctggattgagatccacttgcacagggctctgcagctattagacgaagttcttcatacaatgccaatcgctgatccccagcctttagactag

SEQ ID NO: 240740 - DNA, 534 bp, Artificial Sequence
  Description of Artificial Sequence: Synthetic coding sequence
atggataacatgtcaataaccaatactcccacttcgaatgacgcctgtctgtctatcgtgcactcgctgatgtgtcaccgacagggtggcgagagtgaaacctttgctaagagggcaatcgaatctctggtcaagaagctcaaggagaagaaggacgagctggactcgttgataacagcaataacaacaaatggagcccacccatccaagtgcgtgactatccagaggacgcttgatgggagactgcaggtggccggacgcaagggattccctcatgtgatctacgcgcgtctgtggcggtggcccgacctgcacaagaatgaactaaagcacgtaaagtactgtcagtacgcctttgacctcaaatgcgacagcgtgtgtgtgaatccctatcattacgagcgggtagtgagcccgggtatagaccttagtggactgaccctgcaatctaacgaaaataattggtacttctctcaactgctactggaccttgacaagggtatgatacaagagcaggctatccatggcccatag

SEQ ID NO: 240741 - DNA, 1311 bp, Artificial Sequence
  Description of Artificial Sequence: Synthetic coding sequence
atggataatatgagcatcaccaacacccccacgagtaatgacgcatgtctgagcatagtccattccttaatgtgtcaccggcaggggggagagtctgaaacctttgcgaaacgggcaatagaatccctggttaagaaactgaaggagaaaaaagacgagctggacagtttaattacagccatcacaaccaatggggcacacccatctaaatgtgtcacgattcaacgcactctggatggtcggttacaggtggcaggcagaaagggttttcctcacgtgatctatgcccgactgtggcggtggcccgaccttcataaaaacgaattgaaacacgtcaagtactgccagtatgcctttgacctgaaatgcgattccgtgtgcgtaaacccctaccattatgagagggtggtttctcctggcatcgacctatctgggctgaccctgcagtccaatgcccctagtagtatgatggtcaaggatgaatatgtccatgattttgagggccagcctagtttgtctacggagggccacagcattcaaactatccagcacccgccttctaatcgtgcgagcaccgaaacttattcaacaccagcgctgcttgccccttcagagtcaaatgccactagtacagccaactttccgaacattcccgtcgcctcgacatcacagcccgcatctatcctaggtggctcccattcagaagggctgctgcagattgctagcgggccacagcctggccaacagcagaatggcttcacggggcaacctgcaacttatcaccataattccaccactacgtggactgggagcaggactgctccctacacacctaatcttcctcaccatcagaatggtcatcttcaacaccatccgcctatgccaccacaccccggacactattggccggtgcataatgaacttgcttttcagccgccaattagcaatcatccggcacccgagtactggtgctccatcgcatacttcgagatggacgtgcaggttggggagacctttaaggtgccttcttcctgtcctattgtcacagtagacggttacgtggatccgtcagggggtgacagattttgcctcgggcagctgtctaacgttcaccgcaccgaagctatcgagcgagccagacttcatatcggcaagggcgtgcagctagaatgcaaaggtgaaggtgatgtatgggttagatgcctctccgatcatgctgtctttgtgcagtcttattatttggatcgcgaagccggacgcgctccaggagacgccgtgcacaaaatttaccctagcgcttatattaagtag

SEQ ID NO: 240742 - DNA, 243 bp, Artificial Sequence
  Description of Artificial Sequence: Synthetic coding sequence
atgaccagtatggcctccttgttcagcttcacgtcccccgcagttaagcgcctgttgggctggaaacagggcgacgaggaggagaagtgggccgagaaagccgtggatgctctggtgaaaaagcttaaaaaaaaaaaaggggctatggaggagctggagaaagctctctcaagccccggacagccctccaagtgcgttacaattccgcgaagcctcgatggtcggctgcaagtgagccactag

SEQ ID NO: 240743 - DNA, 387 bp, Artificial Sequence
  Description of Artificial Sequence: Synthetic coding sequence
atgacaagcatggcgagtctcttcagctttacttcgcccgctgttaaacgcctgctcgggtggaaacaaggggatgaagaggaaaaatgggcggagaaagctgtcgacgcactggtcaagaagctcaagaagaagaagggcgctatggaggagctcgagaaggcgctgtcgtctcccggtcagcccagcaaatgcgtgactattccgaggtctctggatgggaggctgcaggtctctcaccgaaagggcctcccccatgttatttattgccgagtctggagatggccggatctccaaagccaccatgagctcaaaccgttagatatctgtgagttcccattcggaagcaagcagaaagaggtgtgcatcaatccatatcattattag

SEQ ID NO: 240744 - DNA, 6 bp, Artificial Sequence
  Description of Artificial Sequence: Synthetic coding sequence
atgtag

SEQ ID NO: 240745 - DNA, 405 bp, Artificial Sequence
  Description of Artificial Sequence: Synthetic coding sequence
atgacgtcaatggcttccttattttcttttacgtccccggctgtcaagcggctgcttggctggaaacagggcgatgaggaggagaagtgggctgaaaaggccgtcgacgcccttgtgaagaaactcaaaaaaaaaaaaggagctatggaagagctggaaaaggctttgagtagtcccggacaaccatccaagtgtgtgaccatccccaggtcactggatggtcgtttgcaggttagccaccggaaagggctcccccacgttatatattgcagggtgtggcgctggccagacctgcagtctcatcatgaactcaagccattagatatctgcgagtttcctttcggatccaaacagaaagaggtgtgtatcaatccctatcactataagcgggtggaatccccctag

SEQ ID NO: 240746 - DNA, 6 bp, Artificial Sequence
  Description of Artificial Sequence: Synthetic coding sequence
atgtag

SEQ ID NO: 240747 - DNA, 1395 bp, Artificial Sequence
  Description of Artificial Sequence: Synthetic coding sequence
atgacatctatggccagtcttttctccttcaccagcccagccgttaagcgtctcctgggatggaaacagggggacgaggaggagaaatgggcagaaaaggccgtcgacgccctggtgaagaagctgaaaaaaaaaaaaggggcaatggaagaactagaaaaagcactctcttccccagggcagccgagcaagtgtgtcacaattccccgtagcctagatggccgtctccaagtgtcccatcgcaaggggctgccccacgttatatactgccgagtgtggcgctggccagacctccagtctcaccatgagctgaagccgctggacatttgcgagtttccctttggctcaaagcagaaggaagtctgtatcaacccctaccactataagcgagttgagagtcccgtgcttcctcccgttttagtacctaggcataacgaattcaatccgcaacacagtttgctcgtgcaatttagaaatctcagccacaatgaaccacatatgccacagaacgctacctttcctgactcttttcaccaacctaataacacaccatttcccctcagcccaaacagcccatatcccccaagcccagccagcagcacctaccctaacagcccagccagcagcggccctggctccccgttccagttacctgcagacacacctccccctgcttatatgcccccagacgaccagatgggccaggataattcccaacccatggacacctcaaataatatgattccacagatcatgccctcgatcagttctcgagatgtgcagccagtagcttacgaggaacctaaacattggtgctccattgtgtattacgagcttaataacagagttggggaggcgtttcacgcctcgtctacatccgtgttggtagacgggttcaccgaccccagcaataataagagccgcttttgtctggggttgctgagtaacgtcaaccgcaatagtactatcgaaaatacacggcgtcacatcggaaagggcgtgcacctgtactatgttggaggagaagtgtatgctgaatgtttatcggatagtagcatttttgtccagagcagaaactgcaattttcaccacggatttcacccaacaacagtgtgtaagattccatctagttgctcgctcaaaatcttcaacaatcaggagtttgcccagctactggcccagtccgtcaatcacggttttgaggcggtctacgaacttactaagatgtgcacaatacgcatgagctttgtcaaaggctggggggctgagtatcatcgacaggacgtgacgtcaacgccctgctggattgaaattctccacggaccattgcagtggctggacaaggttctgacacaaatgggcagccccctgaatcctatcagcagcgtctcctag

SEQ ID NO: 240748 - DNA, 1395 bp, Artificial Sequence
  Description of Artificial Sequence: Synthetic coding sequence
atgacgtccatggccagtctcttctcgttcacttcgcccgcagttaagcggctgcttggctggaagcagggagacgaggaagagaaatgggccgagaaagccgtcgatgcactggtgaagaaactgaagaagaagaagggcgcaatggaggaactggaaaaggcgctgagctctccaggccaaccgagtaagtgtgtcaccatcccacgaagtttggacggaaggcttcaggtctcccataggaagggcctgccacatgtgatatattgccgggtgtggaggtggccagatctgcagtcacatcacgagctcaaaccacttgatatttgcgagtttccattcgggagcaagcagaaggaggtttgcataaacccttatcattacaaacgtgtcgaatctcccgttctgccccctgttcttgtgccccgtcataatgagtttaaccctcaacattccctgctcgtgcagttcagaaatttgtcacacaatgagccacacatgccccaaaacgctacattccctgattcttttcatcagcccaacaataccccttttccactgtctcccaattctccataccctcctagccccgcaagcagtacttaccccaattccccagcatcttcaggtcctggatccccttttcaactccccgcagacacacctccgccagcgtacatgccaccggacgatcagatgggtcaagacaatagtcagccaatggacacaagtaacaacatgattccacagataatgccctccatctcttccagagacgtgcagcccgttgcctacgaagaacctaagcattggtgcagcatcgtgtattacgaactgaacaaccgtgttggagaagcattccacgcttcctcaacctctgtcctggtggatgggttcactgaccccagcaacaacaaatcccgcttctgtctgggccttctgagcaatgtgaatcgcaacagtacgattgagaatacaaggaggcacattggcaagggggtgcatttgtattacgtaggtggagaggtctacgccgagtgtttatcagattcctcaatcttcgtccagagccggaactgcaacttccatcacggcttccaccccaccacagtatgtaaaataccttcttcgtgctctctcaaaattttcaacaatcaggaatttgcccagctgctggcccaatctgtgaaccatggtttcgaggccgtctacgagttgactaaaatgtgcaccattcgcatgagcttcgtcaaaggttggggcgcagagtaccatcgtcaggatgtaaccagcacaccttgctggattgagattctccatggaccattgcaatggctggacaaggtgcttactcagatgggaagccccctcaatcccatcagctccgtttcgtag

SEQ ID NO: 240749 - DNA, 1491 bp, Artificial Sequence
  Description of Artificial Sequence: Synthetic coding sequence
atgttccgctctaagcgatccgggcttgtcaggcggttgtggcgaagtcgcgtagtgcctgatcgggaagagggaggcagcggaggaggtggaggcggtgatgaggacgggagcctgggttctcgggcagaacccgctcctcgggctcgagaaggtggaggatgtgggcgatctgaggttcggcctgtggcccctcggagaccccgagatgctgtgggccagcgaggcgcacagggagcgggaaggcgacggcgagccggtgggcctccacgcccaatgagcgagcctggcgctggggctgggtcatctctgcttgacgtagcagagcccggaggaccagggtggctgcctgagagtgattgcgaaacagttacttgttgtttgtttagtgagagggacgcggctggcgcaccaagggacgccagcgatcctttagcaggagcagcactagagcctgccggaggtgggaggagtcgcgaagccagaagccgcttgttgttgctggaacaggaactgaaaactgtgacctactcattattgaagagactaaaggaaagatcactggacacacttctcgaggctgttgagtccaggggcggtgtgcctggaggttgcgtcttggtccccagagcggatctcagattggggggacagccagcccctcctcagctgctgctcggacgactctttaggtggccagatcttcaacacgctgtggagctcaagccactgtgcggatgccactcgtttgccgctgcagcggacggacccaccgtgtgttgtaatccctaccacttcagcagactgtgtgggcctgaaagtccccctcctccgtattcaagactgagtccacgcgatgagtacaaacccctcgatttatctgattccaccttaagctacaccgagaccgaagctaccaacagtttgataactgccccaggcgaattctccgatgcttctatgtctccggatgccacgaaaccttctcactggtgtagtgttgcctactgggagcaccgaactagggtaggacgcctttatgctgtgtatgatcaggccgtgtctatattctacgatcttcctcagggatccggcttttgtctgggccaactaaacttggagcagcgatctgagtctgttcgtcgtactcgatcaaaaataggattcgggatactgctttcaaaagaacctgatggggtctgggcctataataggggggagcatcccattttcgtcaattcgcctactctcgatgcccctgggggacgagccttggtggtccggaaggtgcccccaggttactccataaaggtgttcgattttgaacgctctggactgcaacatgcccctgagccagatgccgcagatggaccttatgatcctaattcagtgaggatttctttcgccaaaggctgggggccttgttattcccgacagttcatcacctcttgtccttgttggctggaaattctgctgaataacccccgatag

SEQ ID NO: 240750 - DNA, 708 bp, Artificial Sequence
  Description of Artificial Sequence: Synthetic coding sequence
atgtcgcgcatgggcaagccaattgagacccaaaagtccccgccacctccatattcgagattgagtcccagagacgaatacaagcctctggacctgtcggattcaactctaagctacactgaaaccgaagctactaatagcctcattaccgcaccaggggaatttagtgatgcttctatgtcaccagatgcaacgaagccatctcactggtgctcagtagcctactgggaacaccggacgcgagtaggccgactctatgccgtttatgaccaggcagtgtctatcttttacgacctgccacaaggaagcggcttttgccttgggcagttaaatttggagcaacggagcgagtcagtcagaaggactagatctaagattgggttcggcatacttctgtcaaaggaaccggacggcgtgtgggcttacaaccgaggcgagcacccaattttcgtcaattcaccaacacttgacgccccaggcggtcgcgctctggtagtgaggaaggtacctcctggctactccattaaagttttcgactttgagagaagcggacttcagcatgcccctgagcctgacgcggctgatggcccttatgatcccaactccgttcgcatctcgtttgcaaaaggctgggggccatgttatagtcgacagtttataaccagttgcccatgctggttggagatcctactaaacaacccaaggtag

SEQ ID NO: 240751 - DNA, 1017 bp, Artificial Sequence
  Description of Artificial Sequence: Synthetic coding sequence
atgttcaggagtaagcgaagtggcctggttcgacggctgtggagaagtcgggtggtgcccgaccgggaagagggcggatctgggggaggaggagggggtgacgaagatggcagcttagggtcccgcgctgaacccgcaccgagggctcgggaaggcggtggctgtggtcggtctgaagtgcggcctgttgcgcctagaaggccccgtgatgccgtggggcagagaggagctcagggagccggaagaaggcgcagggccggaggccctccaagaccaatgtctgagcctggcgcaggggctgggagtagtctgttggacgtggccgaaccgggagggcctggctggctcccggagtcggactgcgaaaccgttacctgttgtttatttagcgagcgggacgccgcaggcgctcctagggacgcttctgatcccttagcgggagccgcactagagcctgcgggagggggtcggtctagagaggccagatcccgcttattgctgctggagcaggagctcaagactgtgacctattcgctactcaagcgccttaaggaaagaagtttggatacccttttggaggcagtcgaaagtcggggaggtgtacccggtggatgcgtgttagttcctcgcgctgatctccgcctgggtggacagcctgcacctccacagttactgctgggaagactgtttcggtggccagacctgcagcacgcggtggaactgaagcctttgtgcggatgtcattcattcgcggctgcagccgacggcccaacagtgtgctgcaatccctatcacttcagtagactctgcggtcctgaatcaccccctcctccgtactctaggctcagccctcgcgatgagtataagcccctcgatcttagtgattctacactcagctacacagaaactgaggcgactaattcccttattaccgctcccggagaattctcagctgccgatgccggtatcggttcacggggtaaccggggacttgagtcctccgtcccatgtagctag

SEQ ID NO: 240752 - DNA, 1293 bp, Artificial Sequence
  Description of Artificial Sequence: Synthetic coding sequence
atgcactcaacaaccccaatcagctctctcttctcttttacatcgcccgcagttaagagactgctaggctggaaacagggcgatgaagaagaaaagtgggccgagaaggctgtggattcgctcgtgaaaaagcttaaaaagaagaaaggggctatggatgaattggagagagcgctcagttgccctgggcagccaagtaaatgtgtgaccatcccgagaagcctggacggtaggctgcaggttagtcacagaaaggggttaccccacgtgatctactgccgcgtttggcgatggccagaccttcagtcacaccacgagctcaagcccctggagtgttgcgaattccccttcggctcgaagcaaaaggaggtttgtattaacccttaccactacaggagggtggagactccagtccttccgcctgtgctggtgccaagacatagcgagtacaatcctcaattgtccctcctggctaaattccgctccgcctcactgcattcagaaccactcatgccacacaatgctacctatcctgactcattccagcagcctccctgttctgctctgcctcccagccccagccacgcgttttcacagagtccgtgcaccgccagctaccctcacagcccaggttcaccctcagaacctgagagtccataccagcacagcgacttccgacctgtgtgctacgaagagccgcagcattggtgcagcgtcgcatactatgagttgaataacagagtgggagagacttttcaggcctctagcagatccgtgcttatcgatggctttacagatcctagtaacaaccgcaataggttttgtttgggtctacttagcaacgtgaatagaaattcgaccatcgagaacactagaaggcatattggtaagggcgttcatttgtactatgttggtggggaggtctacgccgagtgcgtctctgactctagtatcttcgtgcagtctcggaattgtaattaccagcatggctttcatccagccaccgtctgcaagatcccttcaggttgcagcctgaaagtgttcaataatcagctgttcgcccagctcttggcccagagcgtgcatcacggctttgaagtagtctatgaactcacaaagatgtgcactattcggatgtcctttgtgaagggctggggggcagaataccatagacaagacgtgacatcaacaccctgctggatcgagatccatctccatgggcctctgcagtggcttgataaggtacttactcaaatgggaagtccgcacaaccctataagcagtgtatcttag

SEQ ID NO: 240753 - DNA, 1404 bp, Artificial Sequence
  Description of Artificial Sequence: Synthetic coding sequence
atgcactctaccactcccatatccagtttgttctcctttaccagtcctgcagtcaaacggctcctgggttggaaacagggtgatgaggaggagaaatgggccgaaaaggccgttgactcactagtaaaaaagttgaagaagaagaaaggggcaatggacgagctggaacgagctctcagttgtcctggtcaaccgtctaagtgtgttaccattcccaggtccctggacggacggttacaggtgagtcacagaaagggccttccccatgtcatttactgtagagtctggcggtggccggatctacaaagccaccatgagctgaagcctctggagtgttgcgaatttccgtttggaagcaaacagaaggaggtgtgtatcaacccttaccactaccgccgagttgagacccctgtgctgcctcccgttctagtccccaggcattcagagtacaatccccaactcagccttctggccaaattccgctccgcgagcctgcactccgaaccgctcatgccacacaatgcaacctaccccgactccttccagcagccaccatgcagtgccctccctccaagcccttctcacgcattctcccagagcccttgtactgcatcttatcctcacagtcccggatcccccagcgaaccagaatcaccttatcaacatagtgtggataccccgccactgccctatcacgccacagaggccagtgaaactcagtccggccagcccgtggacgcaaccgccgaccggcatgtggtgctttctatccctaacggagattttaggcctgtctgttatgaggagccgcaacactggtgtagcgtcgcatactacgaactgaataacagggtcggcgaaacattccaggcttcttcccgctctgtgctgatcgatgggtttacggatccaagcaacaatcgcaaccgcttctgtctggggctgcttagtaacgttaatagaaactctactatagagaacacaagacggcatatcgggaaaggagttcatctgtactacgtgggaggcgaagtgtatgcagaatgtgtgtcagattctagcatttttgtacaatcccgcaattgcaattatcagcatgggtttcacccggctactgtctgcaagatacctagcgggtgttccctgaaggtcttcaacaaccagctcttcgcccagttgctggcccagtctgtacaccatggctttgaagttgtgtatgagttaacgaaaatgtgtaccattagaatgtcatttgtgaaaggctggggagcagaataccatagacaggacgtcaccagcacaccctgctggatcgaaatccacctgcacggacctctgcagtggcttgataaggtgcttacgcaaatgggttcacctcacaatccaatatccagcgtgtcctag

SEQ ID NO: 240754 - DNA, 1404 bp, Artificial Sequence
  Description of Artificial Sequence: Synthetic coding sequence
atgcattcaaccacccccatatcgagcctgttcagttttacatcaccagccgtaaagagactattgggctggaagcaaggcgacgaagaggagaaatgggctgaaaaagcagtggattcgctggtaaaaaagctcaaaaagaagaagggggcaatggatgaactggagcgggctctgagttgcccaggccagccttctaagtgtgttacaattccacgttctctcgacggcagattgcaggtgtctcacagaaagggccttccacacgtgatctactgcagagtgtggcggtggcctgacctgcagtcacaccacgagctcaaacccctcgagtgctgcgagttcccattcggatctaaacaaaaagaggtctgcatcaatccctaccattatcggagagttgaaacacccgtcctgccacccgtgttggttccgaggcattctgaatacaacccacagctgagcttgttggccaagttcagaagcgcttctctgcattccgagcccctaatgccccataacgcaacctaccccgacagctttcagcagcctccttgttccgcactgccaccgtctccatcacatgcgttttcccaaagcccctgcacggccagctatcctcacagccccggatccccgtcagagcccgaaagcccctaccagcactctgttgacactccccctctcccttaccacgccactgaggcctcggaaacccagtcaggccagcccgtggacgccacggcagatcgccatgtagttctgtcaataccaaatggcgatttccgccctgtgtgttatgaggaacctcagcactggtgcagcgtggcttactacgagcttaacaacagggtcggggaaacttttcaagccagctcccgctcagtgttgattgacggattcaccgatcccagcaataataggaatcgcttttgcttgggccttctgtccaacgtcaatcggaattcaaccatcgagaatactaggcgtcacataggtaagggggtccacctctactacgttggaggtgaagtgtatgcagaatgtgtgagcgattcaagcatatttgtccagtcacgaaactgcaattaccaacacggatttcacccggcaactgtctgcaagattccgtcaggatgctctttaaaagtgttcaacaatcagctctttgcccagttgctggctcaaagtgtgcaccacgggtttgaggtggtgtacgaactcaccaaaatgtgcacaatccgcatgagtttcgtgaagggatggggggctgagtaccacagacaggacgtgacctccacaccatgctggatcgaaattcacctgcacggtcctttgcaatggcttgataaagttttaactcagatgggatcaccccacaaccctataagcagcgtgtcttag

SEQ ID NO: 240755 - DNA, 1191 bp, Artificial Sequence
  Description of Artificial Sequence: Synthetic coding sequence
atgaaggcggtgaaatccgagcgggagcggggttctcgtcggcgtcacagagatggcgatgtcgtcctgcccgcaggtgtggtagtcaagcaggagaggctcagtccagaagtggcaccaccagcacaccgaaggcccgatcatagcggcggaagcccttccccccctacctcagagcctgcccgatctggacaccggggtaatagagccaggggggtcagccggtctcctccaaaaaagaagaataaggcctccgggagacgttctaaatccccaaggagcaagcgcaatcgatccccccaccacagcactgtgaaagttaaacaggagcgcgaggatcaccccagacggggaagggaggatagacagcaccgggagccatctgaacaggagcacaggagagccaggaattccgacagagataggcatagggggcactcgcaccagcggagaacatcaaacgaacggccaggtagtggccagggccagggtagagatagagatacgcaaaatctgcaggctcaggaggaggagagagaattttataacgcgcgtaggagagaacaccgtcagcgcaacgacgttggtgggggaggatctgagagccaggagcttgtcccccgtccgggaggaaacaataaggagaaggaggtacctgctaaggaaaagcccagtttcgagctgtctggtgcacttctggaagacaccaatacctttcgtggcgtggtgattaagtattctgagccccctgaagccaggattcccaaaaaacgctggcggctctacccgttcaagaatgacgaagtgttgccagtcatgtatatccatcgacagtctgcctacctcttggggaggcatcgaagaatcgctgatatccccatcgaccacccgagttgttccaagcagcatgccgtgttccagtatcgacttgtggagtacaccagagcagacggaactgtggggcgtagggtgaaaccgtatattatcgatttgggctcaggcaatgggaccttccttaataacaaaagaatcgaaccacagcgatactacgaactcaaggagaaggacgttctcaaattcggattctcatctagagaatatgtgctgctgcacgaatctagtgatactagcgaaattgatcgcaaagatgatgaagatgaggaggaagaggaggaagtgagtgacagttag

SEQ ID NO: 240756 - DNA, 1143 bp, Artificial Sequence
  Description of Artificial Sequence: Synthetic coding sequence
atgaaggcggtgaaatctgaacgcgagggcgtggtcgtgaagcaggagcggctgagccccgaggttgccccaccagcgcatagaagacccgaccattctggaggaagtcccagcccacccacttccgagccggcaaggagcggtcatcgaggtaaccgggctcgtggcgtgagccggtctccacccaagaagaagaataaggctagtggccgtcgaagcaaaagccctaggtcaaagcggaatcggtctccccaccattcaaccgtaaaagtgaaacaggagcgagaggaccaccccaggcgtggcagggaagaccgacagcaccgcgagccgtctgaacaggaacacagacgggctcgtaatagcgatcgcgaccgccaccgcggacactcccaccagagacggacatctaatgaacgccctggaagcgggcagggccagggtcgcgatagggacacccagaatctgcaggcacaggaggaggagagggaattctacaatgcacggagaagggagcacagacaacggaacgacgtggggggtgggggatccgagtcacaggagctcgtgccccgtcccggaggcaacaataaagagaaagaggtacccgctaaagagaaaccatcgttcgaactcagcggcgcactgcttgaagataccaatacattccggggtgtggtcataaagtattccgaaccaccagaagcgaggataccaaagaaacgatggcgactttacccctttaagaatgatgaagtgctgcctgtcatgtatatccatcggcaaagcgcttacctgctaggaagacacaggcggatagccgacatccccatcgaccacccttcctgttctaaacagcacgccgtctttcagtatcgattagttgaatatactcgtgctgatgggaccgttggacgaagggtgaagccatacatcatagatctgggtagtggcaatggcactttcctcaacaacaaacgcatcgaaccacaacggtactatgagttaaaggaaaaagatgtcctgaagtttggtttcagctcaagggagtatgtgctgctgcatgagagttccgacacttctgagatcgatcggaaagatgacgaggacgaagaagaagaggaagaagtctcagattcttag

SEQ ID NO: 240757 - DNA, 2274 bp, Artificial Sequence
  Description of Artificial Sequence: Synthetic coding sequence
atgagcaaccccggtacaagaaggaacggaagctcaatcaaaattcggctcaccgtgctgtgtgcaaaaaacctggcaaaaaaggatttttttcggctgcccgatcctttcgccaagatagtcgtcgacggctccggccaatgccactccaccgataccgtgaagaacactctggatccgaagtggaatcagcactacgatttgtacgtaggaaagaccgactctatcacgattagtgtgtggaatcacaaaaagatccacaaaaaacaaggtgcaggctttcttgggtgtgtgcggcttttgtctaatgcaatttcaaggttaaaagatacaggatatcaaagactcgacctctgcaagctcaacccatccgacactgatgcagtccgcggacagatcgtggttagtcttcagacccgtgataggattggtactgggggaagcgtcgtggattgtcgcggtctgttggagaatgagggcacagtctacgaggactccggcccaggcaggcccttatcatgtttcatggaagaaccggcaccctataccgacagcacgggagcagccgcagggggtgggaactgccggttcgtcgagtcaccgagtcaggaccagagactccaggcccagcgactgaggaacccggacgtgagggggtccttgcagacacctcaaaataggccccatggtcaccagagccccgagttgcccgaagggtatgagcaacggaccactgtacagggacaggtatacttcctgcacacacaaactggggtgagtacatggcatgacccaagaatcccctcaccctcagggacaatccccggaggtgatgcggctttcctgtacgagttcctgctgcaggggcatacatctgagcctcgggatctgaatagtgtgaattgcgacgaactcggtccacttccacctgggtgggaggttcgctccaccgtctcggggagaatatacttcgtagaccacaacaaccgtaccacacagtttacagatccccgtttgcatcatattatgaaccaccagtgccagctgaaggaaccatctcagcccctgccactgccttcggaggggtctctggaagatgaggagctgcccgctcagagatacgagcgtgatttggtgcagaagctcaaagtcctgaggcacgaattaagcttgcaacaaccccaggccggtcactgtaggatcgaggtctcccgcgaggagatttttgaggaaagttatcggcaaataatgaaaatgagacctaaggacctcaaaaagcggctgatggtgaagtttcgcggagaggagggacttgattatggtggagttgccagggagtggttatatctactgtgccatgaaatgctaaatccctactacggcctttttcagtacagtaccgataatatatacatgctgcaaattaatcctgattcttccattaacccggaccacctgtcatatttccatttcgttggcaggataatgggactggccgttttccacggccactacatcaacggcggatttactgtccccttttataagcagcttctcggtaagccaatccagctatcagatttggagagcgttgaccctgagctccacaaaagtcttgtgtggattctcgaaaacgacatcacacccgtgctcgaccacacattttgtgtggaacataatgctttcggaaggattctgcagcatgaactgaaaccaaatggaagaaacgtgccggtcacggaggagaacaaaaaagagtacgtccggctgtatgtgaactggcgatttatgagaggaattgaagcccaatttctggccctgcaaaagggctttaacgaactcatcccgcagcacctgctgaaacccttcgaccagaaagagttggagctaatcattggaggactggataaaatcgatcttaacgactggaagtctaacacgcgccttaagcactgtgtcgctgacagtaatattgtgcgctggttctggcaagcggttgagactttcgatgaggaaagacgagcccgactcctccagttcgtcactggcagcacccgcgtcccattgcagggctttaaggcgctacagggatccacaggagcagcaggacccagactgttcacgattcacctcatagacgcgaacaccgacaatctgccaaaagcacatacatgcttcaaccggattgatatccccccttatgagtcatacgagaaactttatgagaagttgctgacagccgttgaggagacgtgcgggtttgccgttgagtag

SEQ ID NO: 240758 - DNA, 2196 bp, Artificial Sequence
  Description of Artificial Sequence: Synthetic coding sequence
atgtcaaatccaggcaccaggaggaatggctccagcattaaaataagactgactgtgttatgcgcgaagaatctggccaagaaagatttctttaggttacctgatcctttcgctaagattgtggtagacgggtccggccagtgtcactccacggacaccgtgaagaatacactcgaccccaagtggaatcaacactacgacttatacgttggtaaaacagattcaataacaatcagcgtgtggaaccacaagaagatacataaaaaacagggcgctggcttcttgggatgtgttagactgttgtcaaacgcaatcagtagactgaaggacacaggctaccagcggctggatctttgcaaactaaacccttcagatacagatgccgtgcgagggcagatcgttgtcagtttgcagacaagagatcggattgggacgggaggctccgtggtggattgcagggggcttttggaaaacgaggggaccgtatatgaagactcaggtccaggccgtcctctgtcgtgttttatggaagaaccggctccgtataccgatagcactggtgctgcggcaggagggggaaactgccggttcgtggaaagcccatcacaggaccagcgcctccaagcacagcgattgaggaatcccgacgtacgtggcagtctgcagaccccacagaatcgccctcatggacaccaatcgccagaactacctgaggggtacgagcagagaaccacagtccaggggcaggtgtactttctacacacccagacaggtgtatctacgtggcatgatccccgtatacccagagatcttaattccgtgaactgtgatgagctgggaccactccctccgggttgggaggttcgaagtaccgtgagcggaagaatctacttcgtggaccacaacaatagaaccacacagtttactgatcctagactgcaccacattatgaaccatcagtgccagctaaaagagccgtcgcaacccctcccacttcccagcgaaggttctctggaggacgaggaattgccggctcagcgctacgagcgtgacctcgtgcaaaagctgaaggtcctgcgccacgaactgtccttgcagcagccgcaggcgggacattgtagaatcgaggtatctcgggaagagatcttcgaagagagctaccgacagattatgaagatgaggcccaaggatctcaaaaaaaggcttatggtgaagtttaggggcgaagaaggtcttgattatggtggggtggcaagagaatggttgtacctgctgtgtcacgagatgctgaatccatattacgggctttttcagtatagcaccgacaacatctacatgctgcagattaaccctgactcctctattaacccggaccatctgtcttactttcattttgtcggcaggattatgggtttggccgtcttccacggccactatatcaatggcggattcacagtgccgttctataaacaactgttaggcaagcctatacagcttagtgacctggagtctgtcgaccccgagctccacaaaagcctggtttggattctcgaaaatgatatcactccggttctggaccatacattctgtgtggagcataacgctttcggaaggatcctgcaacatgaactcaaaccaaacgggagaaacgtgcctgtgacagaggaaaataaaaaagagtacgtgcgcctgtacgtgaactggcgttttatgcgcggaattgaggcccaatttttggcgctccaaaagggtttcaatgagctgatccctcagcacctgcttaagcccttcgaccagaaggagttggagctcatcatcggaggattggacaaaatagacctgaatgattggaagtctaatacacgcctgaagcactgcgtggcagattccaacatcgttaggtggttttggcaggccgtggagacctttgatgaggaaaggagagcacgcctgctgcaatttgtgaccggaagcacacgggtaccacttcagggttttaaagcattgcagggatctactggtgcagctgggccacgtttattcacaatccatctcatcgatgccaatacagataacctccctaaggcacacacatgttttaaccgaatcgacatcccaccatatgagagctacgagaaactctacgaaaaactgctgacggccgtggaggaaacttgcggcttcgctgttgaatag

SEQ ID NO: 240759 - DNA, 1323 bp, Artificial Sequence
  Description of Artificial Sequence: Synthetic coding sequence
atggctactcgatcttgccgggaaaaagcccagaaactgaacgagcagcatcagcttatcttgagcaaactactgagggaggaggataataagtactgtgcggactgcgaggccaagggaccaaggtgggcaagctggaatattggagtttttatctgcataaggtgcgccggaattcataggaatctgggagttcatatatcaagagtaaaaagcgtgaatctcgaccaatggactgcagagcagatccagtgcatgcaagacatggggaacactaaggccaggcttttgtacgaggctaatctgcccgagaactttaggcgccctcaaactgaccaggccgtggaatttttcatacgcgataagtatgaaaaaaaaaagtattatgataagaacgctatcgcgatcactaataaggaaaaagaaaagaagaaagaggaaaaaaagagagagaaggagcccgagaagccggctaagccactgaccgccgagaagcttcaaaagaaggaccaacagttagagcctaagaagtccacgagtccaaaaaaggcagccgagcccaccgtggacctgttaggcctcgacggccctgcggttgcacccgttacgaatggaaatactaccgtgccccctttgaatgatgatctggacatcttcggcccaatgatctctaatcctctgcctgcaacggtcatgccccctgcacagggaactccctcggcccctgcagccgctacgcttagcaccgtgacatccggagacttggacctcttcacggagcagaccaccaagagcgaggaggtggccaagaagcagctgagcaaggattcgatccttagtctctatggcacaggcaccatacagcagcagagcaccccaggagtcttcatggggcctactaacatcccgtttaccagtcaggctcccgctgcgtttcaaggcttccctagcatgggcgtccccgtcccagctgctcctgggctcattggcaacgtgatggggcagtcccccagcatgatggtgggaatgccaatgccaaatgggttcatgggaaacgcacagactggtgtgatgccgctgcctcagaatgtggttgggcctcagggaggtatggtcggtcagatgggcgctccgcagtctaaatttgggttaccacaagctcagcaaccacagtggtccctctcacagatgaatcagcagatggctgggatgagtatcagctccgccacgcctaccgctggattcggccagcctagtagcaccacagccggttggtccggcagctcatcaggccaaacactttcaacacagctttggaagtag

SEQ ID NO: 240760 - DNA, 489 bp, Artificial Sequence
  Description of Artificial Sequence: Synthetic coding sequence
atgggaaatactaaagcacgcctgttgtacgaggcgaacctgccggagaattttcgcaggcctcaaacggaccaggcagtagagttttttatcagagataaatacgaaaagaaaaagtattatgacaagaacgctatcgctatcactaacatctccagctctgacgcgccacttcagcccctggtgtcaagcccatccctccaggccgctgtggataaaaataagcttgaaaaagaaaaagagaagaagaaggaagagaagaagagagagaaggagcctgagaagcccgcaaagcctttaacggcagaaaagctgcagaagaaagaccagcagctcgaaccaaaaaagagtaccagccctaagaaggccgctgagcctactgtggatcttcttggcctggtctggcggaaaatcgagaaagaaaaaagtgagaggcagctggttgaggtggaggagctcactttcatgtattgctttccaaagaactag

SEQ ID NO: 240761 - DNA, 1311 bp, Artificial Sequence
  Description of Artificial Sequence: Synthetic coding sequence
atggccacccggagctgtagagagaaagcccaaaaattgaatgagcagcatcagctgatactgtctaagctgctgcgggaagaggacaacaagtattgtgctgactgcgaagctaagggtccaagatgggctagttggaatatcggagtcttcatctgcatccgttgtgcgggtattcaccgtaatctgggagttcatataagccgggttaagagcgttaacctcgatcagtggacagcagaacagatacagtgtatgcaggatatggggaacactaaggccagactgctttacgaagcaaatttgccagaaaatttcaggcgtcctcagaccgatcaagccgtggagttctttattcgagataagtatgaaaagaaaaagtattatgataagaacgcaatcgcaatcacgaacaaggaaaaagagaagaaaaaggaagagaagaagagagagaaggagcctgaaaagcctgcaaagccgctcaccgcagaaaagttgcagaaaaaggaccagcagctcgaaccaaaaaagtcaacttcgcccaaaaaggccgcagagcctacagtagatctcttaggcttggatggacccgctgtagcccctgtgactaacgggaacactactgtccctcccttaaacgacgacttggacatatttggccctatgatctcgaaccccttgcctgctaccgttatgcccccagcacaaggaactccttccgcacccgcagctgcgaccctgtccacagtgaccagcggagatcttgacctgttcactgaacaaacaaccaaaagtgaagaggtggccaagaaacagctgagcaaggattcaattttatccctgtacggaacagggaccatacagcaacagtcgacaccgggtgttttcatgggaccaaccaacattcctttcacttcacaagctcctgctgcattccagggcttcccatcgatgggggtccccgtccccgcagcccctggactgatcggcaatgtaatgggacagtcccctagtatgatggtcggtatgccaatgcctaacggatttatggggaacgcccagactggagtgatgcccctgccacaaaacgttgtaggaccacagggaggcatggtaggacaaatgggtgctccccagtctaagtttgggctgccccaggcacaacagccacagtggtcactgtcccagatcatgcagaagggtgatgctgtgctgcaacacagcatctccgcaatttactggccaatgacacgatggctgaagtgcccacttgttgacgaatctgctgatggctggcacgaataccagtag

SEQ ID NO: 240762 - DNA, 1404 bp, Artificial Sequence
  Description of Artificial Sequence: Synthetic coding sequence
atggccactcgctcgtgcagggaaaaagcgcagaaactgaatgagcagcaccaacttattctgtctaagcttcttcgcgaggaagataacaagtactgtgcagactgcgaggcaaaaggccctcgctgggctagctggaacatcggggttttcatttgtattcggtgtgccggaatccatagaaatttgggcgtgcatatcagccgagtcaaatcagttaatttagatcaatggaccgctgaacagatacagtgcatgcaggatatgggtaacactaaggctcggctattgtatgaagccaatctgccagaaaacttccgccgacctcagacggaccaagccgtcgaatttttcattcgggacaaatacgaaaagaagaagtattatgacaaaaacgccatcgcgattactaacatcagtagttctgatgccccactgcagccattggtaagcagtccaagtctgcaggctgccgtggacaaaaataagctcgagaaggagaaggagaagaagaaagaggagaagaagagggagaaggaacctgaaaagcctgccaagcctttgaccgctgaaaagctccagaaaaaagaccagcagctggaacctaagaaatccacatcccctaagaaggccgcagaacctaccgtggacttgcttgggctggacggtcccgcagtggcgcctgtgactaatggtaatactacagtccctcccctgaacgatgacctcgacatattcggcccaatgatctcgaatccactccccgctaccgtgatgcccccagcacaaggaacaccgagcgctcccgcagccgcaacgctgagcactgtgacctcaggggatttggatctgttcaccgagcagactaccaagagcgaggaagttgccaagaaacagctgtccaaagactcaatcttgtctctttatgggactggcaccatccagcaacagagcactcctggggtgttcatggggcctacaaatatcccgttcacctcccaggccccagccgcatttcagggcttcccaagcatgggagtccccgtgcccgcagctcctggccttatcggaaacgtaatgggtcaatcaccctccatgatggtggggatgccaatgcccaacgggtttatgggaaatgcccaaacaggggtgatgcccctacctcagaatgtcgtggggccacagggaggaatggttgggcaaatgggggcaccccagtccaaattcggcttaccacaggctcaacagccccaatggtccttaagtcagatgaatcagcagatggctggcatgagcattagcagcgctactcctacagcgggttttggccaacctagctccaccaccgctggctggtcaggcagctcttctgggcaaacactgtcaacccagttgtggaagtag

SEQ ID NO: 240763 - DNA, 414 bp, Artificial Sequence
  Description of Artificial Sequence: Synthetic coding sequence
atggccacgagatcttgtagagaaaaagcgcagaagctgaatgagcagcatcagttgattttgagcaaacttctccgcgaagaggataacaagtactgtgccgattgtgaggccaagggcccacgatgggcctcctggaatatcggggtctttatatgtatccggtgcgctggcatccacagaaatcttggggtgcatatctccagagtaaagtctgtgaatctggaccagtggaccgcagagcagatacaatgtatgcaagacatgggaaatacgaaagcccgactcctgtatgaggctaacttacccgagaacttcagaagaccgcagactgatcacgaagacataattctcgagactaccgcggtaattacactgctgcttaacaaatgccttccgtacgcaaagccgtag

SEQ ID NO: 240764 - DNA, 378 bp, Artificial Sequence
  Description of Artificial Sequence: Synthetic coding sequence
taaaagtactatgataagaacgctatagctataactaatatttcttcttccgatgccccactccaacctctggtttcttcaccgtcactgcaggccgcagtggataagaacaaacttgagaaagaaaaggaaaaaaagaaggaggaaaaaaagcgggagaaagaaccagaaaagcccgctaagccactcacagctgagaagctgcaaaaaaaagatcagcagctggaacccaaaaaatccacctcacctaaaaaagctgctgagcctaccgttgatttactggggctcgtgtggcggaaaattgaaaaagagaagagcgagcggcagctcgtagaggttgaggagttgactttcatgtattgcttccctaagaattag

SEQ ID NO: 240765 - DNA, 189 bp, Artificial Sequence
  Description of Artificial Sequence: Synthetic coding sequence
atgctttttctcaaattatcagtgtttagggccgtggaattctttattagggacaagtacgaaaagaagaaatattatgataagaatgccattgcaatcacgaacatctcatcctcagacgcccctttgcaacccctcgttagctcaccctccctacaggctgcagtcgacaagaacaagcttgagtag

SEQ ID NO: 240766 - DNA, 1200 bp, Artificial Sequence
  Description of Artificial Sequence: Synthetic coding sequence
atgatctttaagggaccgaggtgggcttcctggaatatcggggtctttatctgtatacgctgcgccggaatccaccgtaatctgggggtgcacattagtagggtgaagagcgtgaacttggatcaatggacccaggagcagatccaatgtatgcaggaaatgggtaatggcaaggcaaaccgtctgtatgaagcttacctcccagaaacatttcgtagaccgcagatcgaccccgcagtggaagggtttatccgggacaaatacgaaaagaagaagtatatggatcgctcgctggacatcaacgcctttcggaaggaaaaggatgataaatggaaacggggttctgaaccagtcccggagaaaaaactggaacccgttgtgttcgaaaaagtcaaaatgccacagaaaaaggaggatccccaattaccaagaaaaagctcccctaagagtacagcgcctgtcatggacttgttgggcctcgatgcaccggttgcatgctcaatcgctaattccaagacctccaatactctcgagaaggacctggatcttctggcgtccgttccttccccttcatcttccggcagccgtaaggttgttggatcaatgcccaccgccggatccgcgggtagcgtgccagagaacctgaacctgttcccggaaccaggatccaaatcagaggagataggtaagaaacaactctctaaagattccattctgtcgctctacggcagccagacacctcagatgcctacacaggcgatgtttatggcccctgcgcagatggcctaccccacagcttatccctcattcccaggagttaccccccctaactccatcatgggatccatgatgccaccccctgtagggatggttgctcagccaggggctagcggcatggtggcccctatggcaatgcctgccggatatatgggaggaatgcaagctagtatgatgggagtgcccaacgggatgatgaccacacagcaagccggttacatggccggaatggcagccatgccccagactgtatatggtgtgcagcctgcacagcagctgcaatggaacctcactcagatgactcagcagatggctggcatgaatttctacggcgctaacggaatgatgaactatggccagtccatgtcaggcggaaacgggcaggcggctaatcagacgctgtcaccacagatgtggaaatag

SEQ ID NO: 240767 - DNA, 1290 bp, Artificial Sequence
  Description of Artificial Sequence: Synthetic coding sequence
atgaccggcaaatcagtgaaagacgtggatcgctaccaggccgtgctggcaaatttgctgttagaagaggacaataagttctgcgcagactgccagtctaaaggacccaggtgggcttcctggaacattggagtgtttatctgcattcgttgtgctggcatccatcgcaatctcggagtgcatatttcccgagtcaaatccgtgaatttggaccagtggactcaggagcagatccagtgcatgcaagagatgggtaatgggaaagccaatcggctctacgaggcttatctgccagagacattccggcgaccccagattgaccccgctgtcgagggattcattcgtgataaatatgagaaaaaaaagtacatggacagatcccttgatattaacgccttcagaaaggagaaggacgataaatggaagcggggttccgaaccggtccccgagaagaaattggaacccgtggtctttgagaaagtgaaaatgccccagaaaaaagaggatccacagctaccgaggaaatcttcaccaaagtctaccgccccagtgatggacctgctgggccttgatgcgcctgtagcgtgcagcatcgccaactcaaagacctccaacactttggaaaaggacttggatctgctggccagtgtgccgagcccaagcagctctggaagcagaaaggtcgttggttctatgcccactgctgggtctgctgggtccgtgcccgaaaacttgaacctctttcccgagcccggaagcaagtcagaagagatcggaaaaaaacagcttagtaaagattccatactctccctatacggttctcagactcctcagatgccaacccaggccatgtttatggccccagcacagatggcctatcctacagcttatccctccttccctggcgtgacccctcctaacagcataatgggcagtatgatgccccctccggtcggcatggtcgctcagccgggtgcttccggcatggtagcacccatggccatgcccgcaggctatatgggcggtatgcaggcttccatgatgggggtccccaacggcatgatgacaacccagcaggccggttacatggccggaatggctgctatgccacaaacagtgtatggtgttcaaccggcacaacagctgcagtggaacctgacccagatgacccagcagatggccggaatgaatttttatggtgccaacggcatgatgaactatggccagtccatgagcggtgggaacggacaagccgctaaccaaactctttccccacagatgtggaagtag

SEQ ID NO: 240768 - DNA, 684 bp, Artificial Sequence
  Description of Artificial Sequence: Synthetic coding sequence
atgaccggcaagtcggtcaaggacgtagatcgctatcaggccgtgctggccaatctgctcctggaggaagataataaattttgcgcagattgccagagcaagggcccacgttgggccagttggaacattggcgtgtttatctgtataaggtgtgcaggtatccataggaatctgggtgtgcatattagccgtgtgaagtctgttaacctggaccagtggacgcaagagcagatccagtgcatgcaggagatgggcaatggcaaggccaaccggctctatgaggcttatctcccagagacgtttcgcaggcctcaaatagacccagccgtagaaggctttataagggataaatacgagaagaagaagtatatggacagatcccttgacattaatgcttttcgcaaagagaaggatgacaagtggaaacggggatctgagccggtccctgagaaaaaattggaaccagtggtgtttgaaaaggtgaaaatgcctcagaagaaggaagacccacagctgcccaggaagagcagcccaaaaagcacggcccctgttatggacctcctgggcctggatgcccctgtagcatgtagcatcgccaatagcaaaactagtaacaccctggagaaagatctggacctgctggcctctgtgccaagtccctcttctagcggaagtcggaaatag

SEQ ID NO: 240769 - DNA, 1050 bp, Artificial Sequence
  Description of Artificial Sequence: Synthetic coding sequence
atgcaggagatgggaaatggtaaagcaaatcgactctacgaagcatacttgcccgagacctttagacggccacaaattgatcctgcagttgagggtttcattcgggataaatatgagaagaagaagtatatggatagatctctggacataaatgcttttagaaaagagaaggatgataaatggaagcgcggttccgaacctgtgcctgagaagaaattagaacctgtagtattcgagaaagtgaagatgccacagaaaaaggaggacccacaacttcctagaaagagcagtccaaagtctacggctcctgtgatggacctcttgggactcgatgctcccgttgcatgtagcatcgctaactcaaaaacctcaaatacactggagaaagatctggatttgctggcctccgtgcccagtccatcctcgtctgggagtcgcaaggtcgtcggcagtatgcctacggcaggctcagcaggctcagtgcctgagaatctcaatctctttccagaacctgggtcgaaatctgaggagattggcaaaaagcagctgtctaaagattctatcctcagtctgtatggctcacagaccccacagatgcccacccaagccatgtttatggcacccgctcagatggcctaccccaccgcttatccttctttcccaggcgtgaccccacctaactccataatgggtagcatgatgcctcctcccgtgggtatggtggcccaaccaggagcgtcaggcatggtggcccctatggcaatgccagccggatatatgggcggtatgcaggccagcatgatgggagtaccgaatggcatgatgaccactcaacaggcagggtacatggcagggatggctgccatgccacagactgtttatggcgttcagcccgctcagcagcttcagtggaacctgacccaaatgacacagcagatggcgggaatgaacttttatggcgctaacggcatgatgaactacggccagagtatgagcggaggaaatggtcaggccgctaatcagaccctttcccctcagatgtggaaatag

SEQ ID NO: 240770 - DNA, 189 bp, Artificial Sequence
  Description of Artificial Sequence: Synthetic coding sequence
atggcacgaggaaaccagagggaactcgctagacagaagaatatgaaaaaaactcaggagatatcaaaagggaaaagaaaagaggattcattaacagcgagtcaacggaagcagcgggattctgaaatcatgcaggagaagcaaaaggccgctaacgagaaaaaatccatgcaaacaagggaaaaatag

SEQ ID NO: 240771 - DNA, 333 bp, Artificial Sequence
  Description of Artificial Sequence: Synthetic coding sequence
atggcccgtgggaaccagcgtgaattagcccgtcaaaagaacatgaagaaaacccaggaaatttccaaggggaaaaggaaagaggactcactgaccgcgtcccagcgcaagcagtcatcaggaggccagaaatcagaatccaagatgtcagccggtcctcatctgccgctgaaagcccctagggagaatccatgcttccctctgcccgcagcaggaggatcaagatattacctggcatacggctctataacgcccataagcgccttcgtttttgtcgtcttctttagtgtgttctttccttccttctatgaagatttctgctgctggatttag

SEQ ID NO: 240772 - DNA, 147 bp, Artificial Sequence
  Description of Artificial Sequence: Synthetic coding sequence
atgaaaaaaacacaggaaatctccaaggggaagaggaaagaggactctcttaccgctagccaaagaaagcaacgggacagcgagatcatgcaggagaaacaaaaagccgctaacgagaagaaaagcatgcagaccagggagaagtag

SEQ ID NO: 240773 - DNA, 63 bp, Artificial Sequence
  Description of Artificial Sequence: Synthetic coding sequence
atgaagaaaacccaggaaatatcaaagggaaagaggaaggaggattctctcacagccagctag

SEQ ID NO: 240774 - DNA, 291 bp, Artificial Sequence
  Description of Artificial Sequence: Synthetic coding sequence
atgaagaagacccaggaaatcagcaagggtaaacgtaaggaagacagccttactgcttcccagcggaaacagagttctgggggtcaaaagtccgaatcaaaaatgtccgcaggccctcacctgccactcaaggcgccaagagagaacccatgctttccgctgccagctgccggtgggtcccggtattaccttgcctacggaagcatcacaccaatttctgcctttgtgttcgtagtgttctttagtgttttcttcccctccttctacgaggatttctgctgttggatctag

SEQ ID NO: 240775 - DNA, 270 bp, Artificial Sequence
  Description of Artificial Sequence: Synthetic coding sequence
atgaaaaagacacaggagatctcaaaagggaagcgcaaagaagactcactgacagcgagccaaagaaagcaatctagcggcggacagaagagcgaatctaaaatgtcagcaggacctcatctgcctctcaaagcgcctagagagaatccctgctttcctttgccagcagctggcggttctcgttactacctcgcatacgggtctatcacccccatcagtgcctttgtgtttgtcgtgtttttttcagtgttttttccctcattttattag

SEQ ID NO: 240776 - DNA, 3156 bp, Artificial Sequence
  Description of Artificial Sequence: Synthetic coding sequence
atgggcagcgctgaggacgccgtgaaggagaaattgctgtggaatgtgaaaaaggaggtgaaacagatcatggaagaagcagttactaggaagtttgtccatgaggactctagtcacattatcgccctttgcggcgctgtggaggcgtgtctccttcatcagttacgcaggcgagcggctggcttcttgcggtctgacaagatggccgctctcttcacaaaagtcggaaaaacttgccctgtcgcaggggaaatctgccataaggttcaagagctacaacagcaggctgaggggaggaagccctcaggcgtctcacaggaggccctgcggagacagggaagcgcctcaggcaaggcccctgcacttagtcctcaggcacttaagcatgtgtgggtaaggactgcacttattgagaaagtgctcgataaggtcgtgcagtacctggcagagaactgcagcaaatactatgaaaaggaggcacttctggcagaccccgtgtttgggccaattcttgccagcctcttggtcggtccatgcgctctggagtatactaaattaaagacggctgatcattattggaccgaccctagcgccgacgagctggtccagagacacagaatccggggacctccgacgaggcaagattctccagctaaaagacccgcactaggtatccgtaaaagacatagttctggtagtgcaagcgaggatagactggcagcctgcgccagagagtgcgtcgagagcctgcaccagaattcacggacaaggcttctatacgggaaaaaccatgtactcgtccaaccaaaagaagacatggaagctgtcccgggatacctctcgctccatcagtccgctgagagtctgaccctcaaatggacccccaatcagctgatgaatggaacactgggggattctgaactagagaagagcgtgtactgggactatgcgttagtggtccctttcagccaagtcgtatgcatccactgtcaccagcagaaaagcggtgggacattggtgctcgtcagtcaggacggcattcagaggccacccttgcatttcccacaaggtggtcatctgctgagtttcctatcttgcctggaaaatggactgttgcctcgtggacagctggagcccccactctggactcaacagggtaaaggcaaagtgttcccgaagctgagaaaacgctcctccatcagatctgtggacatggaagaaatgggtaccggcagagctaccgattacgtattccggattatctatcccggacaccgccacgagcatattactatcaattaccatcatctcgccgcttcccgggctgcctccgtcgatgacgacgaggaggaagaagataagctgcacgcgatgctgagtatgatatgttcccgaaatctgacggcccctaacccgatgaaggacgccggtgacatgattgaaatgcaagggttcggccctagcttgcctgcctggcatctggaaccactatgtagccagggcagctcttgcctgagctgctcctcatcctcctccccccacgccacgccctcacactgttcctgcatccctgaccggctgccgcttcgactgctttgtgaaagcatgaagagacagatcgtgagccgcgcattctacggttggttagcgcattgcagacatcttagtaccgtacgcacccatctgagcgccttggtacatcattcggtgatccccccagaccgtccaccgggagcgagcgccggattgacaaaggatgtctggagcaagtatcagaaggacaagaagaactataaagagcttgaattactgcggcaggtttactacgggggtattgagcacgagattaggaaagacgtctggccattcctgctaggccattataagttcggcatgagcaaaaaggaaatggagcaggttgacgcagtggtcgcggctcgctatcagcaggttctggctgaatggaaggcctgcgaagttgtggtgcggcagcgtgaaagggaagctcatccagccacgagaaccaagttctcctccggttcctctatcgattcccatgttcagagactgatccatcgcgactcgaccatctctaacgatgtgttcattagcgttgatgatttagaaccgcctgaacctcaggatcctgaggattcccgtcctaagcccgagcaggaagcgggaccaggcactcccggaaccgccgttgtcgaacagcagcacagcgtggagttcgattccccagactccggattgcctagcagccgaaattactctgtggcctctggcattcagagctcattggatgaaggtcagtctgttggttttgaagaggaggacggaggaggcgaggagggatcaagcggcccaggaccagccgcacacacactgagggaaccacaagatccctctcaagagaagccccaagctggagaattggaggccggagaggagctagcagccgtctgcgccgctgcctatacaatagagctgctggacacagtcgctcttaatctccacagaatcgacaaggacgtccagcgatgtgaccgcaattattggtacttcacccccccaaatctcgagagactgcgggatgtgatgtgtagctacgtctgggagcatctcgatgtcggatacgtgcagggaatgtgtgacctcctggccccactgcttgttacactggataacgaccaacttgcttatagctgcttttcacatcttatgaaaagaatgtcgcagaattttcctaatggaggggctatggacacacatttcgctaacatgcgttcactgattcagatccttgacagtgagctattcgagttgatgcatcaaaacggagattacacacatttttacttttgctaccgatggtttttactggatttcaagcgagagctgctttacgaggatgtgtttgccgtgtgggaggtgatttgggctgcacgacacatatcctcagaacacttcgtgctgtttatcgcattggctttggttgaggcttacagggagatcatccgcgataataacatggattttaccgacatcattaagtttttcaacgaaagagctgagcatcatgatgcacaggagattctgcgaattgctcgggacctggtccacaaggtccagatgcttatcgaaaacaagtag

SEQ ID NO: 240777 - DNA, 3021 bp, Artificial Sequence
  Description of Artificial Sequence: Synthetic coding sequence
atgggctcagcagaggacgcagtcaaagaaaaactcttatggaacgtgaagaaggaagtaaaacagattatggaggaggctgttaccagaaagttcgtgcacgaggactcgagtcacataattgcactctgtggagcagtggaggcatgtctcctgcaccagctgaggcggcgtgcggctggttttctgaggagcgacaagatggccgctctcttcaccaaggtaggcaagacatgtcccgtcgcaggcgagatctgtcacaaggtgcaagagctgcagcagcaggccgaggggaggaaacctagcggggtgagtcaggaagcactgagacgccaggggtcagccagcggaaaggcccctgccctgtcgcctcaggcgctcaaacatgtgtgggtgagaaccgcgctaatcgagaaagtgttagataaagttgttcaataccttgccgaaaattgctctaagtattacgaaaaggaagccctcctggccgaccctgttttcgggcctatcttagcctcattgctcgttggtccctgtgctttggaatacacaaaacttaaaacagctgatcactattggaccgacccgtctgctgatgaattagtgcagagacaccgcataaggggcccaccaaccagacaggatagtcctgctaagaggcccgctctgggtatccggaagcgtcatagttctgggtccgccagcgaagatcgcctggccgcttgcgccagggaatgcgttgagtcgctgcaccagaatagccgcactagactgctctatggtaagaaccatgtgttagtccaacccaaggaggacatggaggccgtgccaggatacttaagccttcatcagtcggctgagagcctgaccctgaagtggactcccaaccaactcatgaacggcacactcggtgactccgagttggagaaaagtgtgtactgggactatgcactggtggtgcctttcagtcaggttgtgtgtatccactgccaccagcagaaaagtggcggtaccctggttctcgtttcgcaggacggcatccagcgaccgccacttcatttccctcaaggaggccatctgctttcctttctgtcttgcctggaaaatgggctgttaccgcgaggccaactggaacctccactatggactcagcaggggaagggcaaagtgttccctaagttaagaaagaggtcttctattagaagcgtggatatggaggagatgggtaccggccgagctactgactatgtgtttcggataatttaccccggacacaggcatgaacataacgcaggtgacatgatcgagatgcaaggcttcggcccatctcttccagcctggcatctagagcctctgtgcagtcagggcagttcttgtctgagttgctctagctcaagctccccccacgccaccccgtcacattgcagttgtattccggaccgcctcccgctgcgacttctctgtgagtcaatgaagcgccaaatcgtgagccgtgccttttacggatggttggcccattgtcggcatctgtccacagtgcggacccacttgtctgccctcgtccatcactccgttattcctcccgaccggccacccggagcgagcgcgggattgacaaaggatgtgtggtccaaataccagaaagacaaaaaaaattacaaggaactcgagctgcttaggcaggtatactacggcggtatagagcacgaaattagaaaggatgtctggccctttctcctcggacactacaagttcggaatgagcaagaaagaaatggaacaggtggatgctgtggtcgccgcacgttatcagcaggtactggccgaatggaaagcctgcgaggtggtcgtcaggcaaagagagagagaggctcatcctgcaacccgaaccaagttttcatctggctccagtatcgatagccatgtgcaacgtttgatccacagggattctacaattagtaatgacgtcttcatatccgtcgacgacttggagccacctgaacctcaggacccagaggacagcaggcccaagccagagcaggaggcaggacctggaacccccggtacagccgtggtagagcaacaacactccgtggagttcgacagtccggattcaggcctcccatcaagcagaaattattccgttgccagcggcatccaatccagtctggatgaggggcagtctgtagggttcgaagaggaggacggcggaggggaggaggggagttccggaccgggtcctgccgcacataccctgcgtgagccccaggatccaagccaggagaagccgcaggccggagagctggaagcaggcgaagagctcgccgcagtgtgcgctgccgcatacactatcgagctgctggacaccgtggccttgaacctgcacagaatcgataaggatgtccaacggtgtgatcgtaactattggtattttacaccaccgaacctggaacgactcagggatgttatgtgctcttacgtttgggaacaccttgatgttgggtatgtccaggggatgtgtgatctcctagcacccctgctggtcaccctcgataacgaccagctcgcctattcctgcttttctcacctgatgaaacggatgagccaaaactttcccaacggcggtgcaatggacactcatttcgcaaacatgaggagcctgattcagatcctggactccgaactgtttgagctcatgcaccagaacggcgattacacccacttttacttctgctataggtggttcctacttgatttcaaaagagaactgctctatgaggatgtgtttgccgtgtgggaggtcatatgggcagccaggcacatctcctctgaacacttcgtactcttcatcgcacttgctttggtcgaagcttatcgcgagataatcagagataataacatggacttcactgatataatcaagttctttaacgaacgcgcagagcatcatgacgcacaggagatcctgcgtatcgctagagatcttgtccacaaagtgcagatgcttatagaaaataagtag

SEQ ID NO: 240778 - DNA, 795 bp, Artificial Sequence
  Description of Artificial Sequence: Synthetic coding sequence
atgtgccacaaaaacgggtttcctcaggaagggggaataacagccgctttccttcagaagcggaagttacggctgagcaagaaccatcgacccgcacgagctaaggtcacagaacacgtcagaggcactcgtcccggtagagccaccgccggaccggctgccagtacccgagcggcagggtccctattctttgaccgctggggaaatcggggtccagcagggtgcagggggtcctctcacctgcctcagcagcttaagttcactacatcagatagttgcgatagaattaaggacgaatttcagttgctgcaagcacaataccactccttaaaactcgaatgtgacaaactcgcctcggaaaagagcgagatgcagcgccactacgtcatgtactatgagatgtcctacggattaaacattgaaatgcataagcaggcggagattgtgaagcgccttaatggcatatgtgcgcaagtcctgccctatctctcccaggagcaccagcagcaggtcctaggggcaatcgaaagagccaaacaggtgacagcgccagaactgaacagtataatccgccagcagctgcaggcccatcagctgtcgcagttgcaagcccttgccctaccactcacacccctgcccgtgggcctccagcctccaagtcttccagcagtcagtgctgggaccggcctcctgtctttgtcagccctggggagtcaggctcacctgtctaaagaggataaaaatggacatgacggagacacacaccaggaggatgacggcgaaaagtctgattag

SEQ ID NO: 240779 - DNA, 267 bp, Artificial Sequence
  Description of Artificial Sequence: Synthetic coding sequence
atgaacatgtctaagcagccagtgtctaatgtccgagcgatccaggccaatatcaacatccctatgggcgcttttcggccaggagcaggccagcctcctagacggaaagagtgtacaccagaagtggaggagggagttcccccaacatcagacgaggagaagaaaccaatccccggtgctaagaagctgcccggtccagcagtgaacctcagtgagatacagaatattaagagcgaactgaagtatgttcccaaggccgagcagtag

SEQ ID NO: 240780 - DNA, 6410 bp, Artificial Sequence
  Description of Artificial Sequence: Synthetic coding sequence
atggccgacgtaacagcccgtagcctccagtacgaatacaaggcaaattctaacttagttttgcaggcagataggagtctgattgacagaacacgcagggacgaacccacgggagaagtgttgtcccttgtgggaaagctcgagggcactcgtatgggagacaaggctcagcgcactaaacctcagatgcaagaggaacgaagagccaaaaggaggaagagagatgaggataggcatgatattaataagatgaaaggttacaccctgctatcagaagggattgatgagatggttggcatcatatacaagcccaagaccaaagaaacacgggagacttatgaggtactcctgtcttttatccaggccgctcttggggaccagccacgagacatcctctgtggtgcagcggatgaggtgctagcagtgctgaaaaacgaaaagctgagggacaaagagcggaggaaggaaatcgacctgctgctgggtcagactgacgacacacgataccacgtcctggtgaacttaggcaagaaaatcaccgactatggcggtgataaagagatccagaatatggatgacaacatcgacgagacctacggcgtgaatgtgcaatttgagtctgatgaagaggagggcgatgaggatgtctacggcgaagtgcgggaagaagcctctgatgatgatatggaaggggatgaggccgtggtccgctgtaccctcagcgccaacttagtcgcttccggggaactcatgtcctcaaaaaaaaaagacttacatccaagagacattgacgccttttggctgcagagacaactctcacggttctatgatgacgctatcgtttctcagaaaaaagccgacgaggtgctcgagattctcaagaccgcgtccgacgaccgggaatgcgagaaccagctagtgctgctgctgggtttcaacacattcgactttatcaaggtgcttagacagcatagaatgatgatcctgtattgtacactgcttgcttctgcgcagtcagaggctgagaaggaaagaataatggggaagatggaggctgacccggagctgtccaagttcttgtaccagctgcacgagacggagaaggaagacctgataagagaagaaaggtctaggcgcgagcgtgtgagacagagcaggatggatacagatcttgaaacaatggacctagaccaaggcggagaggcattagctcctcggcaagtactggatcttgaagacctggtctttactcagggttcccactttatggctaacaaacgttgtcagctgcctgatggcagcttcagacgtcagcggaagggctacgaggaagtacatgtgcctgcgctgaagcctaagccattcgggtcagaagagcagctgttgcctgttgaaaaacttccaaaatatgcacaggccggatttgaggggttcaagaccctcaatcgtattcagtcgaaactttatagagctgctttagagaccgatgagaatttactgctgtgtgcgccaacaggtgccggaaagacaaatgtggccctgatgtgcatgttgagggagatcggcaagcatatcaacatggacgggacaataaatgttgacgatttcaagatcatctatatagcccctatgcgcagcctcgtgcaggagatggtgggctcatttggtaagcgacttgccacttatggtatcaccgtggctgagcttaccggcgaccatcagctctgtaaagaagagattagtgccactcagattatagtgtgcactcctgagaagtgggacataattactcgcaaaggcggagagaggacttacacccaacttgtgcgactcatcatccttgatgagatacacctgctgcacgatgacagagggcctgtgctagaggcgctggttgccagggccatccgaaacattgaaatgacccaggaagacgtcagactgattggactgtccgcgacactgcccaattacgaggatgtcgccaccttcctgcgggttgacccagctaagggattattctactttgacaactccttccggcctgtccccctggagcagacctatgttggcatcactgaaaagaaggctatcaaacggttccagataatgaatgaaatcgtgtacgagaaaatcatggagcatgccggaaagaatcaggtcctggtgtttgtgcattctcggaaggagactggcaagactgccagagcaatcagagacatgtgcctggagaaagacactcttggattattccttcgcgaaggaagcgccagtactgaggtactgagaaccgaagcagaacagtgtaagaatctggaacttaaggacctcctgccatatggttttgccatacatcacgccggaatgactcgagtggatcgcacactcgtggaggacctgtttgccgacaaacatattcaagtgcttgtgagtaccgctacgttagcttggggggtgaatttgcccgctcacacagtgattatcaagggaactcaggtgtactctccagaaaagggccgttggacggagctcggcgcactcgacattctgcagatgttggggcgtgcaggtcgccctcagtatgacacgaaaggggagggaattcttattacctctcatggagaactgcagtattatctgagcttgctgaaccagcaactgcctatagagagccagatggtctccaaattgcccgacatgttaaacgctgagatcgtcctgggtaatgtgcagaacgccaaggacgcagtgaactggctgggatatgcctacctgtacatccgaatgcttcgcagtccaacgctgtatggaatcagtcatgatgatctgaagggagatcccctgctcgaccaacggaggctggacctggtgcacaccgccgcactaatgctggacaaaaacaatttggtaaaatacgacaaaaagactggcaacttccaggtgaccgagctcgggcgaattgcctcccactactacatcaccaacgatacagtgcagacctacaatcagctcttgaagcccacgctaagcgagatcgaactgttccgagtctttagcctgtcttctgaattcaagaacatcacggtgagggaagaggaaaagcttgaactgcagaagctcctggagagggtgccaatacccgttaaggaatcaattgaggagcccagcgctaaaatcaatgttctgctgcaggccttcatatcccagctgaagcttgaggggtttgcgctaatggccgacatggtgtatgtcacccagagcgcaggccgactgatgcgagccatcttcgaaattgttctgaatcgcggatgggcccagcttaccgacaagaccctgaacctgtgtaagatgattgataagcggatgtggcaaagtatgtgccccctgaggcaatttcgaaagctgcccgaggaggtggtcaaaaagattgagaagaaaaactttccgtttgagcgcctctacgacttaaaccacaacgagattggagagctgattagaatgcccaaaatgggcaagacgatccataaatacgtccatctttttccaaagttggaactgagcgtccatttgcagcctatcacacggtccaccttgaaggtggaacttactatcacacctgactttcaatgggatgagaaggtgcacggctccagcgaagccttctggatcctagtggaggatgtggatagtgaggtcattctgcatcatgaatacttcttgttaaaagctaaatacgcccaggatgaacatctgattactttcttcgtgcccgtgttcgagcccctaccaccacagtactttatcagggtggtgtctgacagatggttgtcctgcgagacgcagctcccagtttcatttaggcacctgatcctgccggagaaatacccaccaccaaccgaactgctggaccttcagccacttcctgtgtccgctctgagaaattcagccttcgaatccctataccaggataaattccccttttttaacccaatacagacgcaggtctttaacacagtgtacaattctgacgataacgtgttcgtgggggctccaacaggttcggggaaaacgatatgcgctgagttcgccatacttcggatgcttctgcagtcatcagaaggcagatgtgtgtacatcactcctatggaggccctcgctgagcaggtgtacatggactggtacgagaagtttcaggataggctaaacaagaaagtcgtactcttaacaggcgagaccagcactgacctcaagttactggggaaggggaatatcatcatctcgacccccgagaagtgggatattctgagtcgacggtggaaacaaagaaagaatgttcagaacatcaacctgttcgtggtcgacgaagtccacctgattgggggagagaatggtcctgtactcgaagtgatctgctcccggatgcggtacatctcttcacagatcgagaggcctataagaatcgtagccctttccagtagcctgtctaacgccaaggatgtcgcacactggttagggtgcagcgcgactagtacatttaacttccacccgaatgtgcgtcccgtacctctggagttgcatattcagggattcaacattagccacacccagactcgcctgctgtccatggccaagcctgtgtaccatgctatcactaaacatagtcctaagaaacccgtcattgtttttgttcccagccgcaaacagacacggctaacagcgatcgacattctgaccacctgtgcagctgacatacagagacaacgctttcttcactgtactgagaaggacctcattccctatctggaaaaactgagtgattccactctaaaagagactctcctgaatggcgtcggatacctccacgagggcctgagtccaatggaaagacggcttgttgaacagctttttagctctggcgctatccaggtggttgtggcaagcaggtccctgtgttggggcatgaatgtcgccgctcatctggtcataattatggacacccagtattataatggcaagattcacgcctacgttgattaccctatttatgacgtcctgcagatggtaggacacgctaatcggccactgcaagatgatgaggggcgatgcgttataatgtgtcagggatctaagaaagacttttttaagaaatttctttatgagcccctacccgttgagtcccacctagaccattgtatgcacgatcattttaatgcagagatcgtgaccaagactatcgaaaataaacaagatgcagtagactatctgacgtggaccttcctttaccgtagaatgacccagaaccctaattactacaatcttcagggcatcagccatcggcacctctcagatcatctctccgagctggtggaacagaccttatccgacttagagcagagtaaatgtattagcatagaagatgagatggatgtggcccctctcaatctcggaatgatcgcagcctactactacatcaactacactacaattgagctattctccatgtccctcaacgccaagactaaggtgaggggtctcatcgagatcataagtaatgcagccgagtacgaaaatattccaattcgacaccatgaggataatctgctccgccaactggcccagaaagtgccccataagctaaataacccgaaatttaatgatccccatgttaaaactaacctcctgttgcaagctcacctcagccggatgcagctatccgcagaactccagtcagatactgaagagatcctgtccaaagctataagactgatccaggcatgtgtcgacgtcctctcctctaacgggtggctaagccctgccctggccgctatggagcttgctcagatggtcacccaggctatgtggtctaaggattcttatctaaagcagctcccacacttcacttcagaacatattaaaagatgtacagacaaaggagtagaaagtgtctttgatatcatggaaatggaggatgaagaacgcaacgcactccttcagctcactgactcacagatcgccgacgtagccaggttctgcaaccggtaccccaacatcgagttatcctacgaagtggtcgacaaagactctataagatctggcggaccagttgtagttctagtgcagctagagagagaagaagaagtgaccggacccgttatcgccccactgttccctcaaaagagggaagaggggtggtgggtagtgattggagatgcaaagtctaactcgctgatcagcatcaagcgtctgaccctgcagcaaaaggccaaagtcaaactcgattttgtggcccctgccacaggggctcataactatacattatactttatgtctgatgcatacatgggctgcgatcaggaatacaagttctcggtcgatgttaaagaggccgaaacagactccgactctgacta

SEQ ID NO: 240781 - DNA, 1878 bp, Artificial Sequence
  Description of Artificial Sequence: Synthetic coding sequence
atggctgacgttaccgcaaggtccctccagtacgagtataaagccaacagtaacctggttttacaggctgatagatctctgatcgacagaacgcggcgagacgagcctaccggcgaggtgttatcccttgttggcaagctcgagggcacacgaatgggggataaagcacagcgtaccaagcctcagatgcaagaggagcgaagagccaagcggaggaaacgagatgaagatagacacgacatcaataagatgaagggttacactctcttatccgaggggatcgatgagatggtcggcatcatctacaagcctaaaaccaaggagactcgggaaacttacgaagtgctgctgtcttttattcaggccgctctaggagaccaacctcgggacatcctgtgtggcgctgccgatgaagtccttgctgttttgaaaaatgaaaagttacgtgacaaggagaggcgtaaagagattgacctgcttctggggcagactgacgacacacgttaccatgttctcgtgaacctcggaaagaaaattaccgattacggaggggacaaggaaattcaaaacatggatgacaatattgatgaaacgtatggagtcaatgtgcagttcgagagcgacgaggaagagggagacgaggacgtgtatggcgaagtgcgggaggaggctagtgacgacgatatggaaggcgacgaagctgttgttcgctgtacactgtcggcaaatcttgtcgctagcggggagctcatgtcaagcaaaaagaaggacctgcacccacgcgacatcgatgcattttggttgcagcgccagctgtcacgattctacgacgatgccatcgtgagtcaaaagaaggctgatgaagtgctcgagattctgaagactgcctccgacgaccgggaatgtgagaatcagcttgtgctgctgctcggtttcaacacatttgattttataaaagttctccgtcaacatcgcatgatgatactgtattgtactctgcttgcctccgcccagtctgaagccgagaaagaacggattatggggaagatggaggcagacccagaattgagcaaatttctttaccagctgcacgagactgagaaagaagatctcattcgggaggagcggtctcggagggaacgcgtacgccagtccaggatggatacagatctggagacaatggacctggatcagggcggtgaagccttggcccctcgacaggtgctggatcttgaggatctcgtgttcacccagggtagtcacttcatggccaataagcgctgtcagttgcctgatggctcatttcggagacaaaggaagggttacgaggaagtgcatgtaccagccttaaagcctaaaccctttggatctgaggagcagctgctcccagtcgagaaactgccaaagtatgcccaagcaggattcgaagggttcaaaacactcaatcgaatacaatccaaactctatcgcgcagccttggaaactgacgagaaccttctcttgtgcgctcccaccggtgccggaaagacaaatgtcgcccttatgtgtatgttgcgtgagattggcaaacacattaacatggacggtaccatcaatgtggacgacttcaagattatctacattgcacctatgcggagtcttgtgcaggagatggtgggctccttcggaaaacgagatgcaaagagtaacagcttaattagcattaaaaggcttacgttacagcagaaggctaaagttaaactggacttcgtcgcacctgctaccggcgcacacaattacacgctctattttatgtcagatgcgtatatgggctgcgaccaagaatacaagtttagtgtggatgtgaaggaggcagagaccgactctgactccgactag

SEQ ID NO: 240782 - DNA, 1788 bp, Artificial Sequence
  Description of Artificial Sequence: Synthetic coding sequence
atgaggtacatttcctcgcaaattgaaagacccattcggatcgtggcactttctagcagcctatcgaatgcgaaggatgtggcccattggttaggctgttccgcaaccagcacattcaacttccaccctaatgttagaccggtgcccctcgaactgcacatccaggggtttaatatatcccatactcagactagactgctatcgatggctaagcccgtttatcacgccattactaagcatagcccaaaaaaacccgttatcgtgtttgtgccttcgaggaaacagacaagattgactgctattgatattctgactacctgcgcagctgatattcagagacagaggtttctgcactgtacagagaaagatctgattccctacctcgagaagctgagtgatagcactctcaaagagacactactcaatggggtgggctacctccatgaggggcttagccccatggaacggaggctcgtcgagcaactcttttcaagcggcgcaatccaggtggtcgtagctagtaggtctctgtgctggggaatgaatgttgctgcccacttggttatcattatggatacccagtattataacggaaaaatacatgcatacgtcgattatcctatctacgatgttctgcagatggttggccatgccaatagaccacttcaggacgatgaggggaggtgtgtgattatgtgtcaaggctcaaagaaggatttctttaagaagtttctatacgagccgctcccagtcgaatcccacctggatcattgtatgcacgaccactttaatgccgagattgtgacaaaaactatcgagaacaagcaggacgccgtggattatcttacatggactttcctgtatcgtcgcatgacccagaacccgaactactacaacctgcagggaatttcccatcgccatctctccgaccacctctctgaactcgtggagcagacccttagtgacctggaacagagtaaatgtatcagcatagaggatgagatggacgttgcacctctgaacctcggtatgatcgccgcatattattatatcaactacacaaccatagagcttttttcaatgtcactgaacgcgaagactaaagttcggggacttattgagatcatttctaatgctgccgaatacgagaacatcccaatccgacaccacgaagacaatctgttgagacagttggctcaaaaagtgcctcataaactgaacaatcccaaattcaacgacccccacgtgaagacaaatctattgctccaagcccacttgtcgaggatgcagctctccgccgaactgcagtcggatacggaagagatcctgtccaaggccatccgcctgattcaggcctgcgttgacgtgctgagttctaatggctggctatcgcctgcccttgcggcaatggagctggctcaaatggtcactcaggccatgtggagtaaagatagttacttgaagcagttaccgcacttcactagtgaacacatcaaacggtgcacggacaagggcgttgagtccgttttcgatatcatggagatggaggacgaggagaggaacgcccttctgcaacttaccgatagtcagattgccgatgtggcaaggttttgcaataggtatcccaatatcgagcttagttacgaggttgtggataaggactcaatacgcagcggcggacctgtggtcgttctggtgcagttggagcgcgaggaagaagtaactgggccagtgatcgcaccattattcccgcagtttagggcaggtagaagcgggagccggctgtag

SEQ ID NO: 240783 - DNA, 1788 bp, Artificial Sequence
  Description of Artificial Sequence: Synthetic coding sequence
atggccaaaccagtctatcatgctattacaaaacatagtcccaaaaagccagttatcgtgtttgtacccagccggaagcagacccgcctgaccgccattgatatcttgaccacctgtgccgcagatatccagagacagcggtttctgcactgcaccgagaaggatcttatcccttatcttgaaaaattgtctgattcaacactgaaggaaacgctcctcaacggagttgggtacctacacgaaggactgtcccctatggagcggaggttagttgagcagctgtttagctctggagccatccaggtggttgtggcctcccgtagcctctgttgggggatgaatgtagccgctcatctcgtcatcattatggacacccagtactacaatgggaagattcatgcttatgtggattatcccatatacgacgtgctgcaaatggtgggtcacgccaatcggccacttcaggacgatgaaggcaggtgtgtcatcatgtgtcagggctctaagaaggattttttcaagaagttcctgtacgaacctctgcccgtggaaagccatctggatcattgcatgcatgaccacttcaacgcagagatagtcactaagaccatcgagaacaagcaagatgcagtggactacttaacctggactttcctctacaggcgcatgactcagaatcccaattactacaacctgcagggaattagccataggcatctctcggaccacctgagcgagctggttgaacagaccttgagtgatttggaacagagcaagtgtatcagtattgaagatgagatggatgtggctcccctgaatctcggtatgatcgccgcatactattatatcaattatacaaccatcgaactgttttcgatgagcctgaacgcaaagactaaggtaaggggactcatcgaaattatctccaatgctgccgagtacgaaaatattcccattcgccaccatgaggataaccttctgagacagctggctcagaaggttccccataaactcaacaaccctaagtttaatgatccccacgtcaaaacaaacctgctgctgcaggcacatctgagcaggatgcaactgagcgcggaactgcagtctgatacggaggagattctgagtaaggctattcggctcattcaggcttgcgttgatgtgctgtcatctaatggatggctgtctccagccctggccgctatggaattggcccaaatggtaacacaggctatgtggtctaaagactcttatcttaaacagcttccgcatttcacttctgagcacattaaaaggtgcaccgataagggcgtggagtctgtgttcgatatcatggagatggaagacgaggagcggaacgcccttcttcaacttacagattcccagatcgccgacgtggcacggttttgcaataggtaccctaacattgagctttcctatgaagtggtggacaaggatagtatccgtagcgggggacccgtagtggtgctcgtccagctggagcgggaggaggaggtgacaggccctgtgattgcgccactgttcccacagaagcgggaggagggctggtgggtggtgatcggagatgcaaagtcaaacagtctcatctccatcaagaggctcaccctgcagcagaaggcgaaggttaagttggatttcgtcgccccagccacaggtgcccataactataccctgtatttcatgtccgatgcttatatggggtgcgatcaggagtacaaattttctgtagacgtcaaggaggctgagaccgatagcgatagcgactag

SEQ ID NO: 240784 - DNA, 2325 bp, Artificial Sequence
  Description of Artificial Sequence: Synthetic coding sequence
atgatgatattatattgcaccctcctggccagcgctcagagcgaggcagaaaaggagcgcattatggggaagatggaagctgacccagagctgagcaagtttctgtaccagcttcacgagaccgagaaggaggacctgatccgggaggagcggtcaaggcgagagagagtgcggcagagcagaatggacaccgatcttgaaacgatggacctggatcagggaggggaggctttggccccacggcaagtactggacctggaagatctggtctttacacagggatctcatttcatggcaaataagcgctgccagcttcccgatggctcctttagacgccaacggaaaggatacgaggaagtgcacgtccctgccctcaagcccaagcccttcggtagtgaggaacaactgttgcctgtggagaagttgcctaagtacgcccaggctggctttgaagggttcaagactttaaacaggatccaatcaaagttgtacagggcggctctggagactgatgaaaaccttcttctttgcgcccctaccggagcaggtaagaccaatgtggcgctgatgtgtatgctgcgggagatcggcaagcatatcaatatggacggcactatcaacgttgatgacttcaagattatttacatagcgccaatgcgctctctggtccaggagatggtgggcagcttcgggaagcgactggccacttacggcattaccgtcgccgagttgactggcgatcaccagctctgcaaggaggaaatcagcgctacccagataattgtctgcacgccagagaagtgggatatcatcacccggaaggggggtgagagaacgtatacgcagctggtgcgcttaattatcctggatgagatccatctcctgcacgacgaccggggacctgttctcgaagccttagtggctagagctattaggaatatcgagatgacacaggaggacgtccgactgatcggactgagtgctaccctcccaaactacgaagatgtcgccacatttctgagggtcgacccggctaagggacttttttactttgacaacagtttcaggccagtcccactagaacagacatacgtagggatcacagagaagaaagctattaaacgctttcaaattatgaacgagatcgtgtacgagaaaataatggaacatgccggtaaaaatcaagtgctggtcttcgttcactcacgaaaagagactggcaaaactgccagagctataagggacatgtgcctggaaaaagataccttaggcttattcctccgcgaggggtcagcatccacagaggtcctcaggactgaagctgagcaatgtaagaacctcgaattgaaggatctgctgccttatgggtttgccattcaccacgctggaatgacccgagtggatagaacattggttgaggatctctttgccgacaagcacatccaggtcctggtaagcacggctaccctagcttggggagtgaacctgcctgcccataccgtgatcattaagggaacacaagtctactcacccgagaaggggaggtggaccgagctgggagccctggacatcctccaaatgctcgggagggccggaagaccccagtacgacactaagggcgagggcatcttgatcacttcccatggcgagcttcagtattacctgtcacttctgaatcagcagctccccattgaaagccagatggtctctaagctgccagatatgctgaatgctgagattgttctggggaacgtgcagaacgccaaagatgcagtcaactggctaggctacgcctacctttatatacggatgctgagatccccaacactgtatggaattagccatgatgacctgaagggggatcctctgcttgatcaacgccgtttagacctcgtgcacactgccgctcttatgctcgacaagaacaatctggtgaaatatgataagaagacaggaaactttcaagtcaccgagttaggaaggattgcatctcactactacataactaacgacactgtgcagacctataatcagctgcttaaaccaactctgtcagagatcgaactgttccgcgtgttttccctatcgagtgaattcaaaaacatcaccgtgagggaggaggagaagctagagttgcaaaagttgctcgaaagagtccctattcctgtgaaggagtcaattgaggaaccatctgccaagatcaatgtgttgctgcaggcgttcatctctcagctcaaactggaaggattcgccttgatggcagacatggtttatgtgacacaatccgctggacgcctgatgagagcaatcctgaagctgtcttag

SEQ ID NO: 240785 - DNA, 2160 bp, Artificial Sequence
  Description of Artificial Sequence: Synthetic coding sequence
atgctgcttcaaagcagcgagggaagatgtgtttatattacccccatggaagcactggctgagcaggtgtacatggactggtacgaaaagttccaggatcggctcaataaaaaagtggttctcctgaccggggaaaatggccctgtgttggaggtgatttgcagcagaatgcgctacattagctcacagatagaaagacctatccgaatcgtggcactcagctcaagtctgtctaatgctaaggatgtggcccactggctgggatgttccgccacttctactttcaatttccaccccaacgtgaggccggtgcctttagagctgcatattcagggatttaatattagtcatacacagactaggctcctttctatggccaagcctgtctatcacgcaatcacgaagcactcccctaagaagccggtgatagttttcgtcccatctagaaaacagactcgcctgaccgctattgatatcctgactacatgcgccgctgacatccagcgccaacgattcttacattgcaccgagaaggatctcattccctatctcgaaaagctttccgattctactctgaaagaaactctcctgaatggcgtagggtacctgcacgagggactgtcccctatggaacgaaggctggtcgagcagctgttcagctccggagctatccaggtcgttgtggcaagcaggtcactgtgctggggtatgaatgtcgctgcccacctcgtgataatcatggacacgcagtactataatgggaaaatccacgcctacgtggactacccaatttacgacgttctgcaaatggtgggccatgccaataggcctttgcaggacgacgagggcagatgcgtgatcatgtgccaaggaagcaaaaaggatttcttcaaaaagtttttatacgagcctctgcctgtggagtctcacctcgatcactgcatgcatgatcattttaatgccgagatcgttacaaagaccatcgagaataaacaagacgccgtagattacctgacatggacttttctgtatcggagaatgactcagaaccccaattactacaatctccagggaatctctcatagacacctgtccgaccacttgtcagagctggttgaacagacgttgagtgacctggagcagagcaagtgcattagtatagaagatgaaatggacgtcgcccctcttaacctcggcatgatcgctgcctactactacatcaattatacaactatcgaactgttcagcatgtcattgaacgccaagacgaaagtcagagggttaattgagataatcagcaacgcggcagagtacgaaaatatcccgattaggcatcacgaagacaacctcctgagacaactggcccaaaaagtaccccataagctgaataacccaaaattcaatgacccgcacgtaaagactaaccttttgttacaggcccatctttcgcggatgcaactctcagcggagctgcagagcgacacagaggagatactgtctaaggccatccgcctcatccaggcctgcgtcgatgtattatcaagcaacggttggctgagtccagcccttgccgctatggagttggcacagatggtcacacaggcaatgtggagtaaagactcgtacctcaaacagcttccacactttactagcgaacatatcaaacggtgcactgataaaggggtggagagcgtgtttgacatcatggagatggaggatgaggagagaaatgcactgctgcagctcaccgatagccaaattgcagacgtcgcacgcttctgcaaccgctaccccaatatcgaattgagttacgaagttgtggacaaagatagtatcagatcaggcggtccggtcgtggttctcgtccagttggagcgagaagaagaggtgaccgggcctgtgattgcacctctgttccctcagaaaagagaggaaggttggtgggtcgtgataggcgacgcgaaaagtaacagcctcatctccatcaagcggcttaccctgcagcaaaaagcaaaagtaaagctagacttcgtcgcacctgctactggggcacataattatactttatattttatgtcagacgcctatatgggctgcgaccaggagtataaattttctgtagatgttaaagaagcagagacagacagtgattcagactag

SEQ ID NO: 240786 - DNA, 1074 bp, Artificial Sequence
  Description of Artificial Sequence: Synthetic coding sequence
atgatagaacagcagaagcgaaaaggacccgagctgcctctggtcccggttaagaggcagagacatgaactgttgctgggcgctgggtccggtccaggcgctggtcaacagcaagcaacccccggagcactgctccaggctggccctcctcggtgctcatcgctgcaggcgcctataatgcttctgtctgggcacgagggggaagtttactgttgcaaattccaccccaacggttcaacattggcatcagctggcttcgaccgactgatactcttatggaatgtgtatggcgactgcgataattatgccaccctcaagggccatagcggggcagtcatggaactgcattataatacagacggaagcatgttgtttagcgcaagtaccgacaaaactgtggctgtgtgggactcagaaaccggagagagagtgaaacgactgaagggacatacatcattcgtgaactcttgctacccagccaggaggggccctcagctcgtatgcacgggctctgacgacggtaccgtgaagctatgggatatccgcaaaaaggccgcaattcagacctttcagaacacttatcaggtccttgcggtgacatttaacgacacatccgaccagatcatctcgggaggaatcgataatgacatcaaggtttgggatctgcgccagaataaactgacttacacaatgcgcggtcacgctgattccgtcaccggactatcattgtcctcagagggttcgtacctgctgtccaacgcaatggataatacggtgagagtctgggatgtgcgccctttcgccccaaaagagcggtgcgtgaaaatattccagggaaatgtccataacttcgagaagaacctacttaggtgctcttggagccccgacggatctaaaatcgccgcaggttctgcagatcgtttcgtctacgtctgggacaccacctctcggaggatactgtataaactacctggacatgccggatctattaacgaagtggccttccatcctgacgagcctattattatctctgcgtccagtgacaagcggctctatatgggagagatacagtag

SEQ ID NO: 240787 - DNA, 384 bp, Artificial Sequence
  Description of Artificial Sequence: Synthetic coding sequence
atgatcctcatatccgccggatgccccggtggcctatggcctattgtggtactggtcggcctgttcatttggatctgctttgctgtcagagtgtgggatgttcgaccctttgcgccaaaggagagatgcgtgaaaatctttcaaggaaatgttcacaacttcgaaaagaacctattgcgatgctcttggtctccggacggtagcaaaattgctgcaggatctgctgaccggtttgtttacgtgtgggacacaacttcacgaagaattttatacaaactacctggacatgccggaagtataaacgaagtggcctttcatcccgatgaaccaattatcatatccgcttcttcagacaaacggttatacatgggagagattcagtag

SEQ ID NO: 240788 - DNA, 1230 bp, Artificial Sequence
  Description of Artificial Sequence: Synthetic coding sequence
atgattgagcagcaaaaacgcaaagggcctgagctgccattggtgccggtgaagagacagcgccacgaactcttgctgggcgctggatccggacccggagcagggcagcagcaggcgacccctggggcactgctgcaggcaggtccccctcgttgcagctccctgcaggcacccataatgctgctttcagggcacgaaggcgaggtatattgttgtaagtttcaccctaatggatctacactcgccagcgccggttttgatcgtctgatcctgctgtggaacgtatatggagactgcgacaactatgctaccttgaagggacacagtggtgcagtgatggaattgcactacaataccgacggttccatgctgttttcagctagtacagacaagacagtcgccgtctgggactccgaaacaggtgagcgggtgaagagactgaaaggccacacttcatttgtcaacagttgctatccagcccgtagaggtcctcagctggtgtgcacaggatccgatgacggcaccgtcaagctgtgggacattcggaaaaaagcagcaattcagacctttcagaacacctatcaggtgcttgcagtgacgtttaacgatacttccgatcaaatcattagtggcggaatcgacaatgacatcaaagtgtgggatcttcggcagaacaaactcacgtacaccatgcgcggacacgccgatagcgtcactggcctgagtctgtcctcagaggggagctacctgctcagcaatgccatggataacaccgtcagagtgtgggatgtacggcctttcgcccctaaggagcgatgcgttaagatcttccaggggaacgtgcataactttgagaagaatctcctaagatgctcatggtctcctgacggatccaagatagccgcaggttcagccgacagatttgtgtatgtatgggatacgacatcacggaggattctctacaagctccctggccacgccggaagcatcaacgaggttgcctttcacccagatgagcctatcattgaaacaggatttcaccggatcgggcaggggggtcatgagctgctgacttcgagcaacccacccgcttcagccagccagtccgcgggaataacaggggtgtcccactgtgcccagcttcagacggtattcatgtgggttagcatgtcggtgtccccgctgctaattagcggcgaatcaaagagcaatgccccattctcttcctag

SEQ ID NO: 240789 - DNA, 849 bp, Artificial Sequence
  Description of Artificial Sequence: Synthetic coding sequence
atggcagtccctgagacccgccctaaccacacaatttatattaacaatctgaatgagaaaatcaagaaggacgaactaaaaaaatcgttgtacgccattttctctcagtttggtcagatcctggacattctggtctcacggtcactcaaaatgagaggacaagcttttgtgattttcaaagaggtttctagcgccacgaatgcactaagaagcatgcagggtttccccttctacgacaaacccatgcggatacagtacgcgaagactgactctgatatcatcgccaagatgaagggtacctttgttgaaagggaccgaaagagggaaaagaggaagccaaaatctcaggaaacccctgctaccaaaaaggctgtgcaggggggtggggctactccagtcgtgggagctgttcagggcccagtgcccggaatgccacctatgacccaagcccctaggatcatgcaccatatgcccggtcagccaccatacatgcctcctccaggcatgataccgcctccgggactggcaccagggcaaatcccgccaggggcaatgcccccacaacagctcatgcccggtcagatgccccctgctcagccattaagcgagaatccacccaaccacattctctttcttactaatctgccagaggaaactaacgaactgatgttaagcatgctcttcaatcagtttcccggattcaaagaagtgcgattggttccaggccgtcacgacattgcctttgttgagtttgataatgaagttcaagctggcgctgccagagacgcgctgcaaggctttaaaataactcaaaataacgctatgaaaatcagcttcgctaagaagtag

SEQ ID NO: 240790 - DNA, 612 bp, Artificial Sequence
  Description of Artificial Sequence: Synthetic coding sequence
atggccgtgcccgagactcggccaaaccatacaatctatattatcgccaagatgaaggggacattcgtggaacgagaccgcaaaagagagaaacgtaagcctaagtctcaggagacccctgctactaagaaagccgtgcagggagggggtgctactccagtggtaggcgcagtgcaggggcctgtgcctggcatgcccccaatgacccaagcccctaggattatgcatcatatgcccggacaacccccatacatgcctcccccaggaatgatacccccacctggtctggctccaggccaaattccccctggtgcaatgccaccgcagcagctgatgccaggacagatgcctccagctcagcccctttccgagaaccctccaaaccacattctcttccttacgaatttgcctgaggaaaccaacgaactgatgctgtcaatgctgttcaatcagttcccagggttcaaggaggttcgactggtgccaggtcgtcatgacatcgcttttgtggaatttgacaacgaagtgcaagctggcgctgccagagacgcactgcaaggattcaaaataacgcagaacaatgcaatgaagatctcttttgcgaagaaatag

SEQ ID NO: 240791 - DNA, 768 bp, Artificial Sequence
  Description of Artificial Sequence: Synthetic coding sequence
atggtcaaactgacagccgagctgatcgagcaagcagcccagtacactaacgctgttcgcgaccgggagctggatttgagaggatataagattcctgttatcgaaaacttaggggctactttggatcagtttgatgccattgacttttctgataatgaaattcggaagttagacggattccctctgctcaggagactcaagaccttattggtaaacaataaccgcatctgtcgcattggcgagggactggaccaggctctaccctgcctaactgaattgatcttgaccaataatagcttggtggagctgggcgacctggacccattggccagcctgaaatccctgacctatttaagcatcttaagaaatcccgtgaccaataagaagcactaccgcctttacgtgatctacaaagtgccacaggtccgggtgttagatttccagaaggtaaagctgaaagagcggcaggaagcagaaaagatgttcaagggaaagcgaggagctcagctagccaaggacatcgccagacggagtaaaacattcaatcctggagcaggcttgcctacagacaagaagaagggaggtccaagccctggcgacgttgaggcaattaagaacgccattgccaacgcctctacccttgcagaagtcgagaggctgaaaggtctgctgcagagtggccagatccccggtcgggaacgcagaagcggcccaaccgatgatggtgaggaagagatggaagaggatactgtcacgaacggtagttag

SEQ ID NO: 240792 - DNA, 480 bp, Artificial Sequence
  Description of Artificial Sequence: Synthetic coding sequence
atgccaaagttctattgcgactattgcgatacctacttgacccacgactcaccttcagtgaggaagacccactgttcgggccgaaaacacaaggagaacgtaaaagattattatcagaaatggatggaagagcaggcacaatccctcattgacaaaactacggcagctttccagcagggaaaaatccccccaacaccatttagcgcccctccccctgccggtgccatgattccacctccaccttctctgccaggcccaccacggccagggatgatgcccgctccacacatgggcggaccacctatgatgcccatgatgggaccgcctccgccaggcatgatgcctgttggacccgcacccggaatgcggccacctatgggcggacatatgccaatgatgccaggtcccccaatgatgcgaccaccagctaggccgatgatggtgccaacccggcctggaatgactcggcctgacagatag

SEQ ID NO: 240793 - DNA, 543 bp, Artificial Sequence
  Description of Artificial Sequence: Synthetic coding sequence
atgaacagcgctagtgttgatggacacctttctggctgccggctattcttgttcctttctccattgtttcgattttattgcgactactgcgatacatatctcacccatgacagtccgtccgtccggaagacgcattgctctgggagaaagcacaaagaaaacgttaaggattactatcagaagtggatggaggagcaggctcaatctctgatcgacaaaaccacagctgcttttcagcagggtaagatcccccctacccccttctctgctccaccacccgctggagcaatgatccccccaccgccaagtctgcctggcccacctaggcccggaatgatgcctgccccacacatggggggacctcctatgatgcctatgatggggcctcctccgcctgggatgatgccggttgggccagcccctggcatgcgtcccccaatggggggtcacatgcctatgatgcccggaccaccaatgatgcgacccccagcaaggcctatgatggtacccacaaggcccggaatgaccaggccggataggtag

SEQ ID NO: 240794 - DNA, 357 bp, Artificial Sequence
  Description of Artificial Sequence: Synthetic coding sequence
atggaggaacaggcgcagtccctgatcgacaaaacgacagctgctttccaacagggaaagatacctcccacccccttttccgcccctccaccagctggtgctatgatccccccaccccctagtctgccgggacccccaagaccaggtatgatgccagccccacacatgggagggccacccatgatgcccatgatgggacctccacctccagggatgatgcctgttggtccagcacccggaatgcgccctcctatggggggacacatgcctatgatgccaggaccacccatgatgagaccgccagccaggccgatgatggtaccaacacggccaggcatgacacgacccgataggtag

SEQ ID NO: 240795 - DNA, 159 bp, Artificial Sequence
  Description of Artificial Sequence: Synthetic coding sequence
atgcgcattgagggttgcattattgggtttgacgagtacatgaatctagttctcgatgatgccgaggagattcattcaaaaaccaagtccaggaagcaactcggcaggatcatgttgaagggagacaatattacactcttacagtccgtgtcaaactag

SEQ ID NO: 240796 - DNA, 279 bp, Artificial Sequence
  Description of Artificial Sequence: Synthetic coding sequence
atggcataccggggacagggacagaaagtgcaaaaagttatggttcagcctattaatctcatctttcggtatttgcagaaccgatcccgcatacaggtgtggttgtacgaacaggtgaacatgcgtatcgaaggttgcattattgggttcgacgagtacatgaacttggtgctggatgatgcagaagagattcatagtaagacaaaatcacgcaagcagctgggaagaattatgctgaagggggacaacatcaccctgctgcagtcagtctctaactag

SEQ ID NO: 240797 - DNA, 723 bp, Artificial Sequence
  Description of Artificial Sequence: Synthetic coding sequence
atgacagtggggaagtctagtaagatgttacaacatattgactaccggatgcgttgtatcctgcaagatggacgaatattcattggaactttcaaagcgttcgataagcatatgaaccttattctctgcgactgcgatgaatttcggaagatcaagcccaagaatgccaagcagcctgagagggaagaaaaacgggttctcggacttgtgcttttgaggggagagaatctggtaagcatgactgtcgagggacctccgcctaaggacacaggaatcgcccgtgtgccactcgccggtgcagccggaggtccgggagtgggaagggccgcaggccgtggagttcctgcgggagtgcccattccacaggcccctgccggtctcgcgggaccagttcggggtgtgggcggtccgtcacagcaagtcatgacaccacagggaagaggaacagtcgcggctgcggctgtcgcagccacagctagtatcgcaggagcgcctacacagtacccccctggaaggggtaccccgcctccacccgtcggccgagctacccctccccctgggattatggcccctccaccgggaatgcgtccaccaatgggccctcccataggtctgcccccagcacgcggaacccccattgggatgcccccacccggaatgaggccacctcctcccggaattaggggcccaccccctcccggaatgcggccacccagaccatag

SEQ ID NO: 240798 - DNA, 723 bp, Artificial Sequence
  Description of Artificial Sequence: Synthetic coding sequence
atgaccgtcggcaagagcagcaaaatgctgcagcacattgactatcggatgcgttgtatactacaggacggccgaatttttattggcaccttcaaagcttttgataagcacatgaatttaatcctgtgcgactgtgatgagttccggaagatcaaacctaagaatgccaaacagccagaaagggaagagaagcgtgtcctcgggctagtccttctcagaggtgaaaacctcgtgtccatgactgtcgagggccctcctccaaaggacactggcattgccagagtgcctctcgcaggcgctgccggaggcccaggtgttgggcgtgcagctgggaggggcgtgcccgctggcgttcccataccacaggctcctgctggacttgctggccctgtgcgtggcgttgggggtccttcgcagcaggtgatgaccccccaaggacggggaacggtagcagctgccgctgtcgctgcaacggctagcattgcgggagcaccaacccagtaccctccgggaagaggcacgccgcctcctcctgttggcagggcgaccccgccaccaggtattatggcacctccccctgggatgagaccaccaatgggcccacctataggtctccctcccgctaggggaactcctatcggaatgcctcctccgggaatgagaccaccccctccaggcattagaggccctccaccacctgggatgaggcctccaagaccttag

SEQ ID NO: 240799 - DNA, 723 bp, Artificial Sequence
  Description of Artificial Sequence: Synthetic coding sequence
atgaccgtcggcaagtcaagcaaaatgctgcagcacattgactacagaatgagatgtattctccaggacggcaggatttttatcggaacattcaaggccttcgataaacacatgaacctaatcctttgtgactgtgatgagttcaggaaaatcaagccgaagaatgccaaacagccggaaagggaggagaaaagggtgctgggacttgtacttctacggggagagaatctggtgtccatgactgtggagggaccccctccaaaagacacaggtatcgccagagtgccattggctggcgctgcaggcggaccaggtgtgggaagagctgccggtaggggcgttccggctggagtccctatcccgcaagcccctgccggactggccggaccagtcaggggtgttgggggtccttctcagcaagtgatgaccccacaggggagggggactgtggccgctgccgcagttgccgcaacggcgagtattgctggggctcccacacaataccctcccggacgtggcacaccccctcctcctgttggaagagctacccccccacctggaattatggcaccaccacccggtatgcgccctccaatgggccctcccataggactgccaccagcacgcggaacccctattggtatgccgcctcctgggatgcggcctccaccacctggcatcagggggccaccccctcctggcatgagacccccaagaccttag

SEQ ID NO: 240800 - DNA, 723 bp, Artificial Sequence
  Description of Artificial Sequence: Synthetic coding sequence
atgacagtaggcaaatcaagcaagatgctacagcatatcgattaccggatgcgatgtatcctgcaagatggcaggattttcattggtacgtttaaagccttcgataaacacatgaatctcatcctctgtgattgcgacgaattccgtaaaatcaaacctaagaacgccaagcaaccggagcgcgaggaaaaaagagtgctgggcctggtgttgctccggggtgagaatctggtgtctatgaccgtggaaggtcccccacccaaggatactgggatcgcccgtgtccctctggctggtgccgctggaggaccaggcgtggggagggcagcgggtcggggagtcccagccggtgtccctatcccccaggcccctgcaggcctggccggacccgtgcgtggcgtgggtgggccttctcaacaggtgatgacaccgcagggccgagggactgtggcagcagctgccgtggctgcgactgcctccatcgctggggcaccgactcagtacccacccggacgtgggactcctcccccacctgtcggacgggctactcctccacccggaattatggctcctccacccggtatgcggccaccaatgggcccacccattggcttgccgccagcacggggtacccctattggaatgccacccccagggatgaggccaccaccgcctggcatcagaggtccccctccgccaggaatgaggccaccgagaccttag

SEQ ID NO: 240801 - DNA, 735 bp, Artificial Sequence
  Description of Artificial Sequence: Synthetic coding sequence
atgatggattctcagactgtcgggaagagcagtaagatgttacagcacattgattaccgaatgagatgcattcttcaggacggcagaatctttataggcaccttcaaggcatttgacaaacacatgaacctgatcctgtgcgattgtgatgaattcagaaaaattaagccaaaaaacgctaagcaaccggagagggaagagaagagagtcctcggcctggtattgctgaggggcgagaacttagtgagcatgactgtagagggtccgcctcctaaggatacaggcatagcgagggtgcccttggcaggagcagctgggggacccggagtgggcagagcagcaggacgcggtgtccctgccggagtaccaataccccaagccccagcaggccttgctggtcccgttaggggcgtcggaggtcctagccagcaggtgatgacccctcagggcagagggacagtagctgccgcagcagtggctgccaccgcctccatcgcgggagctcctacccaatacccacccggtcgcggaactcctccaccacccgtcgggagggcaacaccccctccagggataatggcgcctcctccaggcatgagacccccaatgggaccacctattggcctcccccctgctcgagggactcccattggtatgccccctccagggatgcgtcccccaccccctggcattagaggcccaccacccccaggtatgcgcccacccaggccctag

SEQ ID NO: 240802 - DNA, 945 bp, Artificial Sequence
  Description of Artificial Sequence: Synthetic coding sequence
atgtctcgtgtgccagccttcctttcagctgcagaagtcgaggagcatctgagatcatctagccttttaatcccccctctagagactgcccttgccaatttctcaagcgggcctgagggtggggttatgcagcccgtaagaacagtggttcctgtgacaaagcaccgagggtaccttggagtgatgcccgcatatagcgcagccgaggacgcactgactacaaaacttgtgacattctacgaggaccgaggtattaccagcgttgtccctagccaccaggctacggtgctactcttcgaaccctccaatggtacactgctggcagtgatggatggaaacgttatcacagctaaacgaaccgcagccgtgtctgccatcgccactaagtttctaaaaccccctagcagcgaagtgctttgtatactgggtgccggtgtgcaggcctattctcactacgaaatttttactgaacagttttctttcaaggaggtgcggatctggaatcgcacaaaggaaaacgcagaaaagtttgcagatactgtgcaaggtgaggtgcgggtgtgctcatctgtacaggaagccgtcgctggcgcagacgtaattattacggtgacgctggccactgagcctatactatttggggagtgggtgaagcctggcgctcacattaacgctgtgggcgcatcacggcctgattggcgcgagctggatgatgagctcatgaaggaggcagtgttgtatgttgactctcaggaggccgctctcaaggagtctggggacgttctgctgagcggagcagaaatttttgcagagcttggcgaagtaataaaaggagtcaagcctgcccattgcgagaaaacgacagtttttaagtcccttggtatggcggtggaagatacagtcgccgcaaagctgatctacgactcttggtcctcaggcaaatag

SEQ ID NO: 240803 - DNA, 1248 bp, Artificial Sequence
  Description of Artificial Sequence: Synthetic coding sequence
atggctaccgtgggagaatggagctgcgtccgatgcacatttcttaatcccgcaggtcagcggcaatgctctatctgtgaagctccacgccacaaaccagatttgaatcacattctgaggcttagcgtggaagagcagaagtggccctgcgctagatgcacctttagaaattttctaggtaaggaggcatgcgaagtgtgcggcttcaccccggaaccggctcccggtgccgctttcttaccggtcctgaacggcgtgttgccaaaacccccagcaatcctgggagagcctaagggatcgtgtcaggaggaagcaggtcctgttcgcacagctgggctggtcgctactgaacctgcacgcggacaatgtgaggataaagacgaagaagagaaggaagagcaggaagaagaggagggggcagctgagccgaggggcggatgggcctgcccgagatgtacactccacaatacacccgtcgcttcctcatgcagtgtgtgcgggggtccgaggcgcctgtcgttaccacgcatccctcccgaggcccttgtcgtacccgaagtggtggcccctgctggcttccacgtggtgcccgctgccccaccccctgggcttcccggtgagggtgccgaggcgaatcccccagctactagccagggtcctgcagcggagcctgagcctcctcgggtgccaccattcagccctttttcctccaccctgcagaacaacccagtgcccaggagtaggagagaggtgccaccacagctccaacctccagttccagaagcagctcaaccctccccctccgctgggtgccggggagcccctcagggtagcggctgggccggagcttcgaggttggcagaacttctctctgggaaaaggttaagtgtgctcgaagaagaggccactgaggggggaactagccgcgttgaggcgggttcgtcaacatcaggttctgatattatcgacttagcaggggatactgtgaggtacacccccgcttcacctagctctcccgatttcaccacttggagctgtgccaaatgtacactacggaaccccagcccaccatcactgcagcccctcggcaggggcccagagtccctgccaagagccgcaggacccagggctgggtgtgtgcagttggaggcgggtcatgggggtgcacgcggaagccctgcagaccatgcgggaagacgtcatcatccggcacatagagagccacggcgtgccgcaagaggcccttag

SEQ ID NO: 240804 - DNA, 270 bp, Artificial Sequence
  Description of Artificial Sequence: Synthetic coding sequence
atgtcctcccaacagcagaaacagccttgcacacccccaccccagctgcagcagcagcaagtaaaacagccttgccagccgccaccccaggagccttgcatccccaagacgaaggaaccctgccacccgaaagtgcctgagccgtgtcaccctaaagttccagagccctgtcagcccaaggtccccgagccatgtcatcccaaggtgccagagccatgcccatcaatagtgacccctgccccagcccagcaaaagacaaaacaaaaatag

SEQ ID NO: 240805 - DNA, 222 bp, Artificial Sequence
  Description of Artificial Sequence: Synthetic coding sequence
atgtcctctcagcagcagaaacagccttgtaccccaccgcctcagttgcagcagcaacaggtcaaacagccttgccagcctccgccacaggaaccatgcattccaaagacaaaagagccatgtcaccctaaagtccctgaaccatgccaccctaaagtgcctgaaccatgcccatctattgtgactcccgctccagcccaacaaaagaccaagcagaagtag

SEQ ID NO: 240806 - DNA, 219 bp, Artificial Sequence
  Description of Artificial Sequence: Synthetic coding sequence
atgagttatcagcagcagcagtgcaaacaaccttgtcaacctcctcccgtttgtcctaccccgaagtgtcccgaaccctgtccaccccctaagtgccctgagccgtgtcctccacctaagtgtccacagccatgtcccccacagcagtgccagcaaaaatacccccctgtgactccatccccaccatgccagagtaaataccctccgaaaagcaagtag

SEQ ID NO: 240807 - DNA, 219 bp, Artificial Sequence
  Description of Artificial Sequence: Synthetic coding sequence
atgagttatcagcaacagcagtgcaaacagccttgccagccccctcccgtatgcccaacacctaagtgcccagagccttgccctccaccaaaatgcccagagccttgtccaccccctaagtgtccacagccctgcccccctcagcagtgtcagcagaaatatccgcctgtgacgcccagtccgccatgccagcccaagtaccctcccaagtctaaatag

SEQ ID NO: 240808 - DNA, 219 bp, Artificial Sequence
  Description of Artificial Sequence: Synthetic coding sequence
atgtcctatcagcagcagcagtgtaagcagccgtgccagcccccaccagtgtgtcctactcctaaatgccccgagccatgcccccctcccaaatgcccagaaccttgccccccacccaagtgccctcagccttgccctccacaacagtgccagcaaaaatatccgccagtgaccccttcaccaccttgccaacctaaatatccgccaaaaagcaagtag

SEQ ID NO: 240809 - DNA, 219 bp, Artificial Sequence
  Description of Artificial Sequence: Synthetic coding sequence
atgtcataccagcagcagcagtgtaagcagccctgccaaccaccgcctgtgtgtccaacgccaaagtgtccagaaccttgtccccctcctaagtgcccagagccctgtcctcctccaaagtgccctcagccatgtcctccacagcagtgtcaacaaaaataccctccagttaccccatctccaccatgtcaacctaagtatcctcccaaaagtaagtag

SEQ ID NO: 240810 - DNA, 510 bp, Artificial Sequence
  Description of Artificial Sequence: Synthetic coding sequence
atgagcagctaccagcaaaagcagacattcacccctccaccacagctccagcagcagcaggtgaaacagccaagccagcctccccctcaggaaatcttcgtccccaccaccaaggagccttgtcattccaaagtcccccaacctgggaatacgaagatcccagagcctggttgcactaaagtgcctgaacctggctgcactaaagttcctgagccaggatgcaccaaggttcccgaacccggttgcactaaagtgcctgagcctggctgcacaaaggtccccgagcccggttgcaccaaagttcccgaaccaggctacaccaaagttcccgaaccagggtcaattaaagtgcctgatcaggggttcatcaagttccccgagccgggagccattaaggtgccggagcagggatataccaaggtgccagtccctggatacacgaagctgccggaaccgtgcccttccaccgtgacgcctggcccagcccagcaaaaaacaaaacaaaaatag

SEQ ID NO: 240811 - DNA, 510 bp, Artificial Sequence
  Description of Artificial Sequence: Synthetic coding sequence
atgagctcttaccagcagaagcagacgttcactccgcctcctcagcttcaacagcagcaggttaaacagccttcacaaccccctccccaggaaatattcgtgcctaccactaaggaaccctgccattcgaaagtaccacagcctgggaataccaaaatccccgaaccaggctgcactaaggtacctgagccgggatgtaccaaagtgccggaacctgggtgcacaaaagtgccagagccaggctgcacaaaagtccctgagcccggttgtacaaaagtacccgagccagggtgcaccaaagtacccgagcctggttacaccaaggttcctgaacccggttcgatcaaagtgccagatcaaggttttatcaaattccccgaacccggtgctatcaaggtgccagagcagggctatacgaaggtgccagttcctggttataccaagctgcccgaaccctgccccagcacagtgacaccaggaccagctcagcagaaaacaaaacagaaatag

SEQ ID NO: 240812 - DNA, 480 bp, Artificial Sequence
  Description of Artificial Sequence: Synthetic coding sequence
atgtccagttatcagcaaaagcagactttcactcctcccccacagctacagcagcagcaagtgaagcagccttctcagcccccacctcaagaaattttcgtgcccacgaccaaggaaccgtgtcactcgaaagtccctcagcccggaaacaccaagatccccgaaccaggatgtaccaaggtgccagagcccggatgtaccaaggttcccgagccagggtgcacaaaggtccccgagccaggttgtaccaaagttcccgagccagggtgtacaaaagtgcctgagccgggttgcaccaaagtgcctgaaccaggatacacgaaggttccggagcctggttctatcaaagtgccagaccaggggtttattaagttccccgaacccggagctatcaaggtacctgagcagggctatacaaaggtccccgtgcctggttacaccaagctcccagaaccttgccctagcacagtgactccttag

SEQ ID NO: 240813 - DNA, 486 bp, Artificial Sequence
  Description of Artificial Sequence: Synthetic coding sequence
atgtcatcttaccagcaaaaacagacattcactcccccaccacagctgcagcagcaacaggtgaagcagccatcacagcctccgccacaggaaatctttgtgcccactacaaaggaaccatgccattctaaggtgcctcaacctggcaataccaagatcccagagcctgggtgtactaaggtgccagaacctggatgcaccaaagtgcctgagccaggctgtactaaagtgcctgaacccggatgtaccaaagtacccgaacccggatgtaccaaggtccctgaacccggatataccaaggtacctgagccaggtagcattaaggtcccagaccagggcttcattaagttcccggaacctggggcaatcaaggtccctgagcagggttacactaaggtcccagtacccggatacactaaactgcctgagccttgtccctctaccgtcaccccaggtccggctcaacagaagactaaacaaaagtag

SEQ ID NO: 240814 - DNA, 10989 bp, Artificial Sequence
  Description of Artificial Sequence: Synthetic coding sequence
atgtcaaggcgagcacctgggtcccgcttgtctagtggcggtggtgggggtggcactaaataccccagatcttggaacgattggcagccaagaaccgacagcgcatctgccgatccggacaacctgaagtactctagttccagggacagggggggatctagcagctacggcttacaaccttcaaattctgccgtggtaagcaggcagagacacgatgacacccgggtgcatgccgacatccagaacgatgagaagggaggctattcggtcaacggcggaagcggagagaacacttatggaaggaagtcccttggccaagagctgcgggtcaataacgtgaccagccctgagtttacctcagtacagcacggctctagggcactggccactaaggatatgaggaaatctcaggaacggagcatgagctactccgatgagagccgcttgagcaacctgctgcgcagaatcacccgggaagacgacagagacaggcgattagctacggtaaagcagcttaaagagttcatccaacagccggagaacaaactggtgctcgtcaaacagcttgacaacattctggccgctgtccatgatgtccttaacgaatcatccaaactactgcaagagctgaggcaggaaggagcctgttgtctgggcctactgtgcgccagccttagctatgaagccgaaaaaatctttaaatggattttttcaaagttttcttcatctgcgaaggatgaagtgaaactgctgtatctgtgtgccacttacaaagcgctcgagaccgttggggaaaaaaaggcctttagctccgtgatgcaactagttatgacgtctctgcagtcaatactcgaaaacgtcgacacaccagaattactctgtaaatgtgtaaagtgtatactactggtggccaggtgctacccgcacatcttctcgacaaatttcagggatacagtggatatccttgttgggtggcacatcgaccacacacagaagccatctttaactcagcaggttagcggatggctgcaaagcctcgagccattttgggtggctgatttggcattctcaacaaccctactgggacagttcctcgaggacatggaggcttacgcagaggacctgtcgcatgtcgcttctggggagagtgtagacgaggacgtgccgccaccatcagtgtccttgcctaagcttgccgctctcctgcgtgtgttcagtaccgttgtcaggagtatcggagagcgcttctcccccatccgcggtccgcctataaccgaagcttatgtcacagacgtgctgtatcgcgttatgcgctgtgtgaccgccgctaaccaagttttcttcagcgaagccgtccttacagctgctaatgaatgcgttggggtccttcttggctccctcgacccatcgatgactatccactgtgacatggtgatcacgtacggactagaccagctcgagaactgtcagacatgcggcactgactacattataagcgtcttgaaccttttgactctgattgtggagcagataaatactaagttgccgagctctttcgtcgaaaaattgttcatcccttccagtaaattgctgtttcttcgataccataaagagaaagaggttgtcgcagtggcacacgcagtgtaccaggcagtcttatctctaaaaaacatccctgtcctcgagactgcatataaactgattctcggcgagatgacttgcgctctgaacaatctgctgcacagcctccagctgcctgaggcctgtagtgagattaaacacgaagcttttaaaaaccatgtgttcaatgtggacaatgctaagttcgttgttatttttgacctgagcgccctcaccacaatcggcaatgcaaagaattcgttgataggaatgtgggccctgtccccaacagtgttcgccttactttccaagaatctcatgattgtgcattccgaccttgcagttcattttccggcaattcagtatgctgtgctgtatactctctattctcattgcactcgccacgaccattttatttccagctctctgtcctcctcaagtccgtcgctctttgatggggcagtcatcagcacagtaacaactgcgacaaaaaagcactttagcattattctcaatctgctggggatactcctgaagaaggataacctgaaccaggacactagaaagctcctaatgacctgggcgctggaagcagctgtgcttatgaaaaaaagtgaaacctacgcgcctctgtttagtctgcccagtttccataaattttgtaaaggcctgctcgcaaacacgcttgtcgaggacgtgaatatctgcctgcaggcatgttcatccctgcacgccttgtcttctagcctccccgacgatctgctgcaacggtgcgtggatgtgtgccgagtgcagttggttcactctggcactcggatccgtcaggcatttggcaagcttctgaagtcaatccctctcgacgtcgtactgtctaataacaatcacacagaaattcaggaaataagcttggcactccgcagccacatgagcaaagcccctagtaacacgtttcatcctcaagacttcagcgatgtgatttcgttcattctttacggtaactcccatcgcactggaaaggataattggttggagagactcttttatagttgccaacggctcgataagcgcgaccagtccactatcccaaggaatctccttaagactgacgctgtcttgtggcagtgggccatatgggaggctgcacaatttacagtcctctcgaaacttcgaacaccactggggagagctcaggacactttccagaccatcgaaggcatcataaggtccctggctgcccacactctgaaccctgaccaggatgttagccagtggacgacggccgacaacgatgaaggtcacggcaataaccagttgcgactggtactcctgctccagtaccttgagaatctagaaaagctgatgtataacgcttatgaagggtgcgctaatgccttgacgtcccccccaaaagtcattagaaccttcttctacacgaatagacagacatgccaagactggcttacgaggatcaggctgtctattatgcgagtcggcctgctggctggtcagccggcagttactgtgcgacacggcttcgatctgttgacagagatgaagacaacatcactcagccagggtaatgagctggaggttaccatcatgatggttgtcgaagccctatgtgagctacattgccctgaggcgatccaagggatcgcagtgtggtctagtagtatcgtgggtaagaacctcttgtggattaactctgttgctcaacaagcagagggccgatttgagaaagcatctgtggagtaccaggagcacctgtgtgccatgacaggtgtggactgctgcatttccagctttgacaagtccgtgctgacgctcgctaacgctggcaggaactctgccagtcctaaacatagccttaatggtgaatcgagaaagactgtgttaagtaagcccacggacagttccccagaagtgataaattacctgggtaataaggcttgcgagtgttacatttccattgccgattgggccgctgtccaagaatggcagaatgcgattcacgatttgaagaaaagtacctcttcaacaagtctcaatctcaaggctgacttcaactatatcaagtccttgagttcgttcgaatcagggaagttcgtcgaatgtacagaacagctggagttacttcctggtgaaaatatcaacttgctggctgggggatctaaggaaaaaatcgatatgaagaagcttttacctaatatgctgagccctgacccacgggaactccagaagagcattgaggtgcagctcctcaggtcgtcggtgtgtctggcgaccgctctcaatcctatcgagcaagaccagaaatggcaaagtatcacagagaacgttgttaaatatcttaaacagacaagccgcatcgccatcggccctttgaggctgtctaccctcacagtgtcacagtcattacctgtgctctctacactgcaactgtactgtagctcagcacttgagaacactgtgagtaatagattatcaacagaggactgcctcatcccgctcttttcggaagcccttaggagctgtaaacagcacgatgtccgcccatggatgcaggctttaaggtacaccatgtatcagaaccaactccttgagaaaatcaaagagcagacagtacccatccgatcccatcttatggagctaggattaaccgctgccaaattcgcgagaaagagggggaacgtctcactggcaacccgactgttggcacagtgttcggaggtgcagcttggcaaaactacaaccgcacaagatctagtgcaacacttcaagaaactgtcaacacaggggcaagtcgatgaaaaatggggcccagagctggatattgaaaaaaccaaactgctgtacacagcagggcagagcactcatgccatggagatgctcagtagctgcgctattagcttctgcaaatctgttaaagctgagtacgccgtcgccaaaagtattctgactctggctaagtggattcaagcagaatggaaggagatctctggccagttgaaacaggtctaccgggctcagcatcagcaaaatttcactggactaagtacactgagcaaaaacatcctgacgctgattgagctgccctctgttaacactatggaggaagagtacccgaggatcgaaagtgagtcaacagtgcatatcggagtgggggagcccgactttatccttgggcagttgtatcatctgagttcagtacaggcccctgaggtcgcaaaatcttgggcggcactggccagctgggcttatagatggggtagaaaagtagtcgacaacgctagtcagggggaaggcgtgaggttactgccgcgagaaaagtctgaggtgcaaaatctattaccagacactatcactgaggaggaaaaagagaggatttacggtatcttaggacaggcggtatgccgccctgcgggtattcaagatgaggacatcacgctgcaaatcaccgaatccgaggataatgaagaggacgacatggtagacgtgatctggcggcaactcatctcttcctgtccttggttgtcagaactggatgagtcagccaccgaaggcgttattaaggtttggcgaaaagtggtggacagaattttttctctgtacaagttatcctgttccgcatacttcacctttctaaaactcaacgcaggacagattcctcttgatgaggacgacccaagactgcatctcagccaccgggtggaacagtcaactgatgacatgatcgtaatggctacgctgcgcctgctgaggttacttgtaaagcacgctggggaactgagacagtacttggaacatggactggagaccacccctactgcaccatggcgaggcataattcctcagcttttctcaagactcaaccaccctgaggtctacgtccggcaatctatatgcaatctcctgtgccgcgtggcacaggactctcctcaccttatcttgtacccggcaatagttgggaccatttctctgtctagcgaatcccaggcctccggtaataaattctccaccgccatcccgacactgcttggtaacatccaaggcgaagaattactcgtgtccgaatgtgaaggcggatcccctcccgcaagccaggacagcaacaaagacgaacccaaatccggcttaaacgaagaccaagccatgatgcaggattgctacagcaagattgtggataagctgtccagtgccaatccaaccatggtgctgcaggtgcagatgctcgtggccgagctgagacgtgtcacggtgctgtgggatgagctctggctcggagtgttactccagcagcatatgtacgttctgagaagaattcagcagttagaggatgaagtgaagagagtgcaaaataacaacacgctcaggaaagaagaaaagattgcgattatgagggagaaacatactgctctgatgaagccaatcgtttttgccttggagcatgtcagatccatcacagcggcaccagcggagaccccacacgagaaatggttccaagacaactatggggatgctatagaaaacgcactcgaaaaactaaagacccctcttaaccccgctaaaccaggctccagctggatacccttcaaggaaataatgctgagcctgcaacagagggcacaaaagcgcgcatcttatattttgaggcttgaagagatcagcccatggcttgctgccatgacaaacactgagattgcattgccaggagaggtttcagcccgagatactgtgacaatccacagcgtgggaggtaccattacgatactgccaaccaagacgaagccaaagaagcttctctttcttggaagcgatggcaaaagctacccttacctgttcaagggtcttgaggacctacacttagacgaacgcatcatgcaatttctgtcaatcgtgaacaccatgttcgcaaccataaaccgccaggagactcctcggttccatgcaaggcactattccgtgacacccctgggcacaagatccggcctcatccaatgggtggatggggcaacccctctgtttgggctctataagcggtggcagcagagggaggctgccttgcaagcccagaaagcccaggatagctaccagaccccccaaaatccaggcatagtgcctcgacctagcgaactctactattctaagattgggccagccttgaagacagtgggactgtccctggacgttagcagaagagactggccactgcacgtgatgaaagccgtgttggaggaattgatggaagccacccccccaaatttgctggccaaagaactctggtcctcttgcaccaccccagatgaatggtggagggtgacccaaagctacgctagatctacagccgtgatgtccatggtgggttacataatcggcttaggagatcggcacctggataatgtgctgatcgacatgacgacaggcgaggtggtacacatcgattataatgtatgcttcgagaaagggaaaagtctgcgggtcccagagaaggtgcccttccgcatgactcagaacattgaaaccgctctaggcgtgactggggtcgaaggggtattccggctatcatgcgaacaggttctacacattatgcgccgtgggagagagaccctactgaccctgctggaggcctttgtgtacgacccactggtcgattggacagcagggggtgaggcaggctttgcgggagctgtttacgggggtggaggtcagcaggcagagtccaagcagtctaaaagagagatggaacgagaaatcactaggtcactgttcagcagccgggtggcggagattaaggtcaactggtttaagaaccgggacgaaatgctcgtcgtgctccctaagcttgacggtagcctagacgagtatctcagtttacaagagcaattgaccgacgtagaaaaacttcaaggcaagctgctagaggaaattgagtttttagagggcgctgagggcgtggatcaccctagccacactctgcagcataggtactccgaacatacccagcttcagacacagcaaagagcggtccaggaggctatccaggttaagctgaatgagtttgaacaatggatcacccattaccaggcagccttcaataatttagaggctacacaactcgcctcactgctccaggagatcagtacacagatggatttggggccaccaagctatgtaccagccactgcattccttcagaacgccggacaggcacatctgataagtcagtgcgagcaactggagggagaggtgggtgccctccttcagcagagaagaagtgtacttcgtgggtgccttgaacaactgcatcactacgctaccgttgcgctgcagtatcctaaagcaatatttcagaaacataggatcgagcagtggaaaacctggatggaagagctcatctgcaataccaccgtcgaacgttgccaagaactctataggaagtacgagatgcaatatgctccccagccacctccgactgtgtgccagttcattaccgctaccgagatgacgctgcagcggtacgctgctgatatcaattctcggctgatacgacaggtcgagaggcttaagcaggaggctgttacggtccccgtgtgtgaagaccagctgaaggagatcgaacgctgcattaaagtgttcctgcacgaaaacggggaagaggggagtctatccttggccagcgtcatcatttctgcactgtgcactcttacgagacgtaatctcatgatggagggtgcggcatcatcagcgggagaacagctggtcgatctgacctcacgcgacggggcttggtttctggaggaactatgttcgatgagcggaaatgtaacatgcctcgtccagctgttgaaacagtgtcatctggtgccgcaggacttagatattcctaaccctatggaagcctcagagaccgtgcacttagcgaatggtgtatacacaagtcttcaggagctgaattcaaatttccggcagatcatcttcccagaggcgctgcggtgtttaatgaagggagagtataccctcgaatcaatgctgcacgagctggacggcctgatagagcagaccaccgatggggtcccgctccagacccttgtggaatctttacaggcatacctgcggaatgcggcaatgggccttgaagaggagacgcacgctcactacattgatgtggcacgtctgctgcacgcacagtacggagagctgattcagccaagaaacggctccgtggacgagacaccaaagatgtccgcaggccagatgctcctggtcgcgttcgacggtatgttcgcgcaagtggaaaccgcattttcactgttggtggagaagctgaacaagatggagattcccatcgcctggagaaaaatagatataatccgggaagccaggtctactcaggtgaactttttcgacgacgataatcaccgccaggtactggaggagattttctttcttaaaaggcttcagactattaaagagttcttcagactctgcggaactttttccaagaccctcagtggctccagctcactggaggaccagaatactgtgaacggtccggtccagattgttaacgtgaagacgttgttccggaattcgtgtttcagtgaggaccagatggccaagcccattaaagcatttacagctgattttgtgaggcaacttctcatcggcctgcccaaccaagctttgggacttactctatgttcttttatctctgcacttggtgtggatatcatcgcccaagtcgaggctaaggacttcggcgctgaaagcaaggtaagcgtggacgatctgtgcaagaaagccgtcgaacacaacattcagattggaaagttttcgcagctcgtcatgaatagagcgaccgtcctggcttccagctatgataccgcttggaagaagcacgacttggtgagacgtctggaaacttccatttcctcatgtaagacttccctccagcgcgtccaattgcacatcgccatgtttcagcaatggcagcatgaagatcttcttattaatcgtccccaggccatgagcgtgacaccaccccctcggtcagcaattctcacttcaatgaaaaaaaaactccatacgctctcgcagattgaaacgtccatagcaacagtgcaggaaaaactggccgcattggagtcctccatcgagcagcgcttgaagtgggccggaggtgcaaatccggctctggcccctgttctccaggatttcgaggcaacaattgccgagaggagaaatctcgtgctgaaggaaagccagagggctagccaggtgacttttctgtgctccaacataatccattttgaatccctgcggacccgaaccgccgaggccctgaaccttgatgcagcgctgttcgagctcataaagcgctgtcagcagatgtgcagctttgccagccagtttaactcaagcgtctccgagttggaactgagactgctccagcgggtggatacaggcctagagcatcctatcggctcttctgaatggttgctaagcgctcacaagcagcttacccaagacatgagtacccagcgcgcaattcagaccgagaaagagcagcagatcgagaccgtctgcgaaacgatccaaaatctggtcgacaacataaaaactgtcctgaccgggcataatcgccagcttggagacgtgaagcacctactgaaagctatggcaaaggatgaagaggccgctttggcggatggggaggatgtcccatacgagaattcagtgagacagtttctgggggagtataagtcgtggcaggataacatccagacagtactttttaccctcgtgcaagctatgggtcaggtgagatctcaggagcacgtagaaatgctgcaggagatcaccccaactcttaaagaactgaagacacagagccagagtatatacaacaacttggtctcttttgcttcgccattggtgacagatgcaaccaacgaatgctccagccctaccagttctgcaacctaccaacccagctttgcagcggctgtccgctcaaacaccggtcagaaaacccagccagacgtcatgtcacagaatgctagaaaactgattcaaaaaaacctggccacaagcgccgacactcccccatccacagtgcccggtacgggaaaatccgtcgcctgctcgccaaaaaaggccgtcagagatcccaagaccggaaaggctgtgcaggaaagaaactcttatgctgtgtccgtgtggaagcgcgtgaaagccaagttagagggacgcgacgtggatccgaacaggagaatgtccgtggcagagcaagtggattatgtgattaaggaggctaccaacctggataatttagcacaattgtatgagggttggacggcctgggtgtat

SEQ ID NO: 240815 - DNA, 10986 bp, Artificial Sequence
  Description of Artificial Sequence: Synthetic coding sequence
atgtcacggagagcgcctggctctcggctctcaagcggaggcggtgggggtggtactaaatacccaaggagctggaatgattggcaacccaggacagactcagccagtgctgatcccgacaatttaaagtatagctcttcaagagaccgtggaggatcctcatcctatggtctccagcctagtaattccgcagttgtgagccggcagcgacacgatgatactcgcgttcacgctgatatccagaacgatgagaagggtggctactccgtcaacggcggttcgggggagaacacatacggaaggaaaagcctgggacaggaactccgcgtgaataatgtgacctcgcccgagtttacaagcgtccaacatgggtctcgggcactcgccacaaaggatatgaggaaatctcaggagagaagtatgtcttattccgatgagagcagactgtcaaacctcttacgccgaatcaccagagaggacgatcgcgatcggcgacttgccaccgttaagcagcttaaggaatttatccagcaacctgaaaacaagttggtgctggtgaaacagctggataatatcctggctgcagtgcacgacgtgttgaacgagtcttccaaactacttcaggagctgcgccaagaaggagcctgttgcctgggtctgctgtgtgcctcgctttcttatgaggcggagaaaatattcaaatggatcttcagcaagttctcatctagtgctaaggatgaggtgaaactcctttacctatgtgccacatacaaagctctggagactgtgggagagaagaaagctttcagtagcgtcatgcagttggttatgaccagtttgcaaagtatcctggagaatgtggacacaccggagctgctctgtaagtgcgttaagtgtatccttctggtggctagatgttatcctcatatcttctcaaccaactttcgagatacagtagatatcctagtgggatggcatatcgaccatactcagaagccaagcctcacccaacaggtgtcaggatggctgcagtcactggaacctttctgggtcgctgatcttgcctttagtactactctactgggacagttcctggaagatatggaggcatacgctgaagaccttagtcacgtggctagcggagaaagcgtggatgaagatgtgccaccacccagtgtcagcttacccaaacttgccgctcttctccgggtcttcagtacggttgtacggtcgatcggagaaaggttcagtcctattcgaggccctccgatcactgaggcctacgtgaccgatgtactgtaccgtgtcatgcgctgtgtgactgccgctaaccaagtcttttttagcgaggccgtcctaacagctgcgaatgaatgtgtgggggttctgctcgggtctctggacccatccatgaccattcactgcgacatggtcataacatatggcttagaccaacttgagaactgtcaaacttgcgggaccgattacattatctccgtcttgaacttactgactctgatcgtggagcagatcaatacgaagctgccatccagttttgtggagaaattgttcatcccctctagcaaactcttgtttctgaggtaccataaagagaaggaggtcgttgccgtggcccacgctgtgtatcaggcagtgctaagcctgaaaaacatccccgtcctagaaaccgcttacaagctgatcctgggggaaatgacttgtgctcttaataatttgctgcacagcctgcaactgccagaagcctgctccgaaattaaacacgaagcttttaagaaccacgtgtttaatgtcgacaacgcgaagtttgtggtgattttcgatctcagcgccctgacaactatcggcaacgcaaaaaactccctgatcggaatgtgggccctcagccctacagtgttcgctctcctgagcaaaaacctgatgattgtccactcagatttagcagtccacttccccgcaatacagtatgccgttttgtataccctatattcacactgtaccagacacgatcactttatctccagctcactttccagcagctcccccagtctgttcgacggagccgtcataagtacggtgaccacagccacgaagaaacacttctctattattttgaatctgctcggaatcttgctgaaaaaggataatctgaaccaggatacgcggaagctgttaatgacctgggccctggaggccgctgtcctaatgaaaaagagcgaaacttacgctcctctgttcagcttaccttctttccataagttttgtaaaggtctgctcgcaaatacactcgtagaagatgtgaatatctgtctgcaggcctgctcatctctgcatgccctaagtagcagcctcccagatgatttgcttcagaggtgtgtggatgtatgtcgggtgcagttggtgcacagcgggacgaggatcagacaagcctttgggaaattactgaaaagtatccccctggatgttgtgctcagcaataataaccacactgagattcaggagattagcctcgctctccgcagccacatgtccaaggccccatccaacacttttcaccctcaagacttttcagacgttatttcattcatcctctacggtaactcgcacaggaccggcaaggataattggctggagagactgttttacagctgtcagcgtctggacaaaagagaccagtctaccattccccgaaatctcctgaaaacagatgctgttctgtggcagtgggcaatctgggaagcagcacagttcaccgtgctttctaagctgcgaacgccgttaggtcgagcccaggacactttccagaccatcgaaggtataatacgaagcttagccgctcatacactgaatccagatcaggatgtctcccagtggacgaccgcagacaatgacgagggtcatggtaacaaccaactccgactggtgctcctgttgcagtacctggagaacttggaaaaactgatgtataatgcatacgaggggtgcgcgaacgctctgacctccccaccaaaggtgattagaaccttcttttacactaacagacagacatgccaggactggttgaccagaataaggctgagcatcatgcgcgttggcttattggccggacagccggctgtcaccgtcagacacggtttcgatcttttgaccgagatgaagactactagtctgagccaggggaatgagctagaagtgaccataatgatggtggttgaagcactgtgtgaactgcactgccccgaggctatccaaggtatcgccgtgtggagtagcagtattgtgggcaagaacctcctttggatcaacagcgtggctcagcaggccgaaggacgttttgaaaaggcttccgtcgagtatcaggaacacctgtgcgcaatgacaggcgtggactgttgcatcagttcttttgacaaatcagtgttgacattagctaatgcgggacggaattccgctagcccaaaacacagcctcaatggcgagtccaggaaaacagttttgtcgaagcctaccgattcttctccagaagttatcaattacttgggtaacaaggcttgtgaatgttatatctcgattgctgattgggccgctgttcaggagtggcagaacgcaattcatgacctgaagaaatcaacatcaagtacttcactcaacctgaaagcagattttaactatattaagtcactgtcaagtttcgaaagtggcaagttcgtcgaatgcaccgagcagctggaactactgcccggagaaaatatcaatctgttagccggaggcagcaaggaaaagatcgatatgaagaaactcctccccaatatgctttcccccgatcccagagagctgcagaagtcaatcgaggtgcaattgctcaggtcttctgtctgccttgcaacggcactcaatcctatcgagcaggaccaaaaatggcaatctatcacagagaacgtggtaaagtacttgaagcaaaccagtcgaatcgccattggaccgctgcggttaagtaccctcacggtttcacaatctcttccagtgctcagtacattgcagctctattgctctagcgctcttgaaaacactgtgtccaatcgactcagcactgaagattgtctgatacctctgttttctgaggcgctgcgaagttgtaagcaacacgatgtgcggccttggatgcaggccctccgctacacaatgtaccagaatcagttgcttgagaagatcaaagagcaaacggtgcctatccgatcacacctgatggagcttggtctcactgcagccaaattcgccagaaaacgaggcaatgtgagccttgcaaccagattgctggctcagtgcagcgaagtgcagcttgggaaaaccacaacagcacaggacctggttcagcactttaaaaaactctccacacaggggcaggttgacgagaaatgggggccagagctggacattgaaaagactaaattgctgtacactgccggacagtccacacatgccatggagatgctcagctcctgcgcaatcagcttctgtaagagcgtgaaagctgaatacgctgtggccaagagtatcttgactttagccaagtggatccaggccgaatggaaagagatctctggccagctaaaacaggtttatcgtgcccagcaccagcagaacttcaccggcctctccacactcagtaagaacattttaaccctgatagaactgcctagcgtaaacactatggaagaagaatatccccgtattgagtccgagagcactgtacatatcggcgtgggcgagcctgattttatcctcggacagctttatcacctgtcttccgtgcaggctcccgaagtagcgaagtcttgggcagctctggcatcctgggcctacaggtggggaagaaaagtcgtcgacaatgcctctcagggcgagggtgtgaggctgctacctagggagaagagtgaagtgcagaatcttcttccagacaccattaccgaggaggagaaagaacgcatctacgggattcttggacaggctgtgtgcagacccgcagggattcaggacgaggacatcacattacagatcaccgagagcgaggacaacgaagaagacgatatggttgacgtcatctggaggcagttgattagttcatgcccatggttatctgagctcgatgagtcagccactgagggggtcataaaggtatggagaaaggtggtcgaccgcattttctcattgtacaaattgagttgtagtgcttatttcacctttctgaaactaaatgctggacaaatcccactcgatgaggatgacccaaggctgcacttgtcacacagagttgagcagtctaccgatgatatgatagttatggccaccctcagactcttgagacttttggtcaaacacgcgggtgagcttcgccagtatttggagcatggcctcgagaccactccaacagctccatggaggggaattattccacagttattctcaagactcaatcacccagaggtatacgttagacagtctatatgcaacttattatgccgcgtggcccaggacagtcctcatctgattctttatcctgcaatcgtcgggaccatctcccttagcagcgagtcccaggctagtggaaataaatttagtacagcaatcccaactttgctggggaacatccagggcgaagagctgttagttagcgaatgtgaagggggatctcccccagccagtcaggactctaacaaggatgaaccaaaaagcgggctgaatgaggaccaggcaatgatgcaagattgctattcaaagatcgtcgataagctctcttcagcgaatcccacgatggtgctccaggtccagatgttagtcgccgaactgcggagagtgactgtgctctgggacgagctgtggctgggggttttactacagcagcatatgtacgttttgcgcaggatacagcagctggaggatgaggtgaagagggttcagaacaataataccctcagaaaggaggagaaaatagcaatcatgcgagaaaagcacacagccttaatgaaaccaattgttttcgcactagagcatgtgaggtctataaccgccgcacctgccgaaacaccacacgagaagtggttccaggataattatggagatgctatcgagaatgccttagagaaattgaaaacccctctgaatcctgccaagcccggatctagttggattcctttcaaggagatcatgttgtccctgcagcagagggcccaaaagcgggcttcctatattttaaggcttgaggaaatcagcccatggttagctgccatgactaatactgagattgcattaccgggagaggtaagcgctagggacactgtaaccatccactctgtggggggaacaatcactattcttcctacaaagaccaagccaaagaagttgctgttcttgggttctgatggaaaaagttatccatatctgttcaagggacttgaagacctccacctggatgaaaggatcatgcagttcctctcaatcgtgaacacaatgttcgccacgatcaacagacaggaaacaccacgctttcacgcacgacactactcagtgactccacttgggacacgatcaggtctgatccagtgggtcgatggagcgacccctctcttcgggctgtataaaagatggcagcagagagaagctgccttacaggcccagaaagcacaggattcctatcagacaccccagaatccaggtatcgtgcccaggccgagcgagctgtattatagtaagatcggcccagctctcaaaaccgtgggactatctttggacgttagccgcagggattggcctctgcacgtgatgaaagccgtcctggaggagctgatggaggcgaccccacccaaccttctcgctaaggaactgtggtcctcttgtacaacacccgatgagtggtggcgggtgacgcaaagctacgcccgatcaactgctgtaatgtccatggtgggttacataatcggacttggagataggcacttagataatgtcttgattgacatgacgacaggagaagttgtgcacatcgactacaacgtgtgtttcgagaagggcaagtccctgcgcgtgcccgaaaaagtgcctttccggatgacacagaacatcgagaccgctcttggggtaacaggcgtagagggggtcttccggttaagctgcgagcaagtcttgcacatcatgagacgtggcagagaaaccttattgaccctgctcgaagctttcgtgtatgacccgcttgtggattggacagctggtggcgaggcgggatttgcaggggcagtgtacgggggtggcggacagcaggccgagagtaaacagagcaagcgggaaatggagagggagataactagatccttgtttagcagcagagtggccgagattaaagtcaattggtttaaaaatcgcgatgagatgctggtggtgctgccaaagctggatggctcgttggacgaatatttgtcgctccaggagcagttgactgacgtcgaaaagctgcagggtaagctcttggaggaaatcgagttcctcgaaggggcagagggtgtggaccatccttctcacaccctgcaacataggtacagcgaacacacacagctgcagactcagcaaagggccgtccaggaggctatccaggttaaactcaacgagtttgaacagtggattacccactatcaagctgcctttaacaatttagaagccacccaactggctagtctgcttcaggaaatttcgacacagatggacttgggacccccaagttacgttccagcgactgcatttctgcagaacgccggtcaggctcacctcatcagccagtgcgagcagctcgagggagaggttggtgccctgctgcagcagcgtcggtcagtcctccggggatgtctggaacagctgcatcactatgctaccgtcgccttacagtaccccaaagccatctttcaaaagcaccggattgaacagtggaagacatggatggaggagctaatttgcaacacgacagtggagcgctgtcaggaattgtacaggaagtacgaaatgcaatatgctccacaaccccctcctaccgtttgtcaattcattactgccacagaaatgacactgcagcgctacgccgctgatataaactcgcggctcattaggcaagtggagaggttgaagcaggaggccgtgacagtgcctgtgtgcgaagatcagctgaaagaaatcgagcggtgcatcaaggtattcctgcacgaaaatggcgaagaaggttctctcagcctggccagcgtcattattagcgctctgtgtaccttgacccgccgaaaccttatgatggagggcgctgcatcgtcggccggtgagcagctcgttgacctgacttcacgcgatggcgcatggttcctcgaagagctgtgttcaatgagcgggaacgtgacctgtttagtgcagttactgaagcagtgccatttagtgccccaggacctggacatcccaaatcctatggaagcctccgaaactgtgcacctggctaacggggtttatactagcctacaagaactcaacagcaatttccgccaaatcatctttcctgaagctttgaggtgtctaatgaagggtgagtataccttagaaagtatgctgcacgaactggacggcttgatcgaacagacaactgatggtgtacccctgcagacactggtcgaatcactgcaagcttacttaagaaatgcagctatgggcttagaagaggagactcatgcacactacattgatgtggcccgtctgctgcacgctcaatacggagagctgatccagccccgtaacggcagcgtggacgaaacccccaaaatgagcgccggacaaatgctgttggtcgcgttcgatggaatgttcgcccaggtggaaaccgcattctccttgctggtggagaagctcaataaaatggagatccctattgcatggagaaaaatcgatattattcgcgaagcaagaagtacacaggtcaacttttttgacgacgataatcatcgacaggtcctggaggagattttcttcctgaagcgtctgcagacgatcaaggagttttttaggctgtgcggcaccttctctaaaaccctgagtggcagcagttcactagaagaccaaaacacggtgaatgggccagttcagatcgtaaacgtgaagaccctctttagaaattcatgtttctccgaggaccagatggctaagcccatcaaagccttcactgcagacttcgttcggcaactgctcattggtctgccaaaccaagccctgggtttgaccttgtgcagctttatttccgctcttggcgttgacatcatcgctcaggtcgaggccaaggatttcggcgcagagtccaaggtctccgtggatgatctgtgtaagaaagccgtggaacacaatatccagatcgggaaattttctcagctggtgatgaatcgagctactgtgctagcttcgtcttatgacactgcttggaaaaaacacgacctcgttcggcgtcttgagacttctatatccagttgcaagacatctttacaaagggtgcaactgcatattgcgatgttccaatggcagcatgaggatttactcattaacaggccccaggccatgtccgtgacacctccccctcggtcagcaatcctcaccagcatgaagaagaaactgcatacactgagccagattgagacgagcattgcaacagttcaggagaagctggcggcactggagagcagcatcgagcagaggttgaaatgggccggtggagccaatcctgctctcgcccctgtcttgcaagatttcgaagctactattgccgagagacgcaatttagtgctgaaggagagccaacgcgctagccaagtaaccttcctgtgtagcaatattatacatttcgagagtctcaggacccgtacagcagaggccctcaacctggacgctgccttgttcgagctcattaagagatgccagcagatgtgtagctttgccagccagtttaacagctccgtgagcgaattagaactccgacttctacagagagttgataccggcctggaacaccccatcggaagctctgaatggctcctgagtgctcacaaacaattgacccaagacatgtcaacccagagggccatacagacggagaaagagcaacagatcgaaactgtgtgtgagaccattcagaatcttgtggataatatcaagacagtgttgaccgggcacaaccggcagttaggcgatgtgaagcatttgctaaaagctatggctaaggacgaggaagcagccttggccgacggcgaggacgtcccctacgagaatagcgtccggcagtttttgggggagtacaaatcctggcaggataatattcaaactgtgctgtttacactcgtgcaggcaatgggccaggtgcgcagccaggagcatgtcgaaatgctgcaggagatcacgcctacccttaaagagctgaaaacccaaagtcaatctatctacaataacctggtcagcttcgccagccctctcgtcacagatgccacaaacgagtgtagttctccaactagcagcgcaacttatcaaccctcattcgctgcggctgtccggtcgaacacaggccagaaaacccaaccagatgtgatgtctcagaacgcgaggaaattgatccagaagaacctcgctactagtgccgatacgccccctagcacagtgcctggaactggaaagagtgtcgcgtgttctccaaagaaagctgttagagacccaaaaaccgggaaagctgtgcaggagaggaactcttacgccgtgtcagtgtggaaacgcgtcaaggcaaagctcgaaggacgggacgtcgaccccaaccgcaggatgtcggttgctgagcaggtggattacgtaattaaggaagcaaccaaccttgacaacttggcccagttatatgagggatggacagcgtgggtctat

SEQ ID NO: 240816 - DNA, 3051 bp, Artificial Sequence
  Description of Artificial Sequence: Synthetic coding sequence
atgagtcagggcccacccacgggcgagtctagcgagcctgaggcgaaggttctccacaccaagcgcctgtaccgggctgtcgtggaagctgtgcaccggttggacctgattctctgtaacaagacggcctaccaggaagttttcaagccagagaatatttcgttgcggaacaagctccgagaattatgcgtcaagttgatgtttcttcatcccgttgattacggcagaaaggccgaggaactgctctggagaaaggtctattacgaggtgattcagttaatcaagacgaataaaaagcatatacactctagaagtactctggaatgtgcctatcgaacacatctggtagcaggaattggtttttatcagcatctcctactctacatccagagccattatcagctcgagctacaatgctgcatcgactggacacacgttacggacccattgatcggctgcaagaagcccgtgtctgcatccggtaaagaaatggactgggctcagatggcgtgtcatcgatgtctcgtatacctgggtgacctgtccagatatcagaacgagctagccggtgtggatacagagctgctagctgagcggttctactatcaggcactgtcagtggctccacagatcggaatgccattcaaccagctgggcaccctggccggatccaagtactacaatgtagaggctatgtactgttatctgcgatgcattcagtcggaggtatccttcgagggagcttatggtaacctcaagaggttatacgataaggccgcaaagatgtatcatcagcttaagaaatgcgaaacgaggaagctgtctcctggcaagaagaggtgtaaggatattaagcgtctcctcgtgaatttcatgtacttgcaatctcttctccagcctaagagttcatcagtcgattccgaattaaccagtttatgtcagagtgtgttagaggatttcaatctgtgcctgttctacctgccaagcagcccaaacttgagtttagccagcgaggatgaagaagaatacgagagtggatatgcatttctgccggacctgctgatcttccagatggtgattatttgtctaatgtgtgtgcatagcttggagcgggctggatcaaaacagtactcagccgcaatagcattcaccctggctctgttttcccatctcgtgaaccacgttaatataagacttcaggcggagttggaggagggggagaatcctgtgcctgcttttcagtcagacggaacagacgaacccgagtccaaggaaccggtagagaaagaagaggagcccgacccagagccgccaccagtgaccccgcaggttggtgaagggagaaaaagccggaagttctctaggctcagctgtctacgaagacgcagacaccctcctaaggttggcgacgattccgatctgtctgaaggatttgagagcgattcgagtcatgacagtgcccgtgcctccgaaggaagcgactcagggtcagataaaagcctcgaaggaggagggaccgcctttgacgccgagacagatagcgagatgaatagccaggaatctcggtccgacctcgaagatatggaagaggaagagggaaccagatctccaactcttgaaccaccccgaggaaggtccgaggcccctgattctctcaacggccctttgggcccaagcgaggccagcattgccagcaatttacaggcgatgtccacccaaatgttccagaccaaaaggtgcttcaggcttgcgccaacctttagcaacctgctgcttcagcccacgaccaatcctcatactagcgctagccatagaccttgtgttaacggggatgtcgacaagcccagtgagcctgccagcgaagaaggctccgagtccgaggggagcgagtcctctggcagaagctgccgtaacgagagatccatccaggagaagctccaggtgctgatggccgaaggcttgttacccgctgtaaaagtgttcctagattggctcaggaccaaccctgatttgattatcgtttgtgcgcagtcttcccagtcactctggaacagactgtcagtcttattgaacctacttccagccgctggtgagctgcaggagtccgggctggccttatgtccagaggtgcaggacttgctcgagggctgcgagctgcctgatcttcctagttctttgctgctacctgaggacatggcactgcggaacctcccaccacttcgcgcagcccatcgcagatttaattttgataccgaccggcctctgctgtccacccttgaagagagcgtggtccgcatttgctgcatccggtcatttggccatttcatcgcgaggctacaggggagcattctgcagtttaaccctgaagtggggattttcgtgtccattgcacagagcgaacaagaatcactcctgcaacaggctcaggcacagtttaggatggcccaggaggaagccaggcggaatcgactgatgcgggacatggcgcagctccgcttacaactggaggttagccagttggaaggatccctgcagcagccgaaggctcaaagtgcgatgtccccatacctcgtccctgacacacaagctctttgtcatcacctgcctgtaatccgccagcttgcaacgtcaggaaggtttatcgtcattatccccaggactgtgatagacggtctcgacctgctgaagaaagagcatccgggtgcccgtgacggcatcaggtacctggaagctgagttcaaaaagggtaacaggtacatacgctgtcagaaggaggtaggaaagtcttttgagaggcacaaactgaagcggcaagacgctgacgcatggaccctctacaaaatcctggacagttgcaaacagctcaccctggcccagggcgcaggcgaggaagaccccagtggtatggttactataattaccggtctgcctctggacaacccatcagtgctgtcgggcccaatgcaggccgctctgcaggccgcagcgcacgcctctgtggacataaaaaatgtcctggacttttataagcagtggaaggagatcgggtag

SEQ ID NO: 240817 - DNA, 1125 bp, Artificial Sequence
  Description of Artificial Sequence: Synthetic coding sequence
atgtctcaggggcctcccactggggaatccagcgagcccgaagctaaggtgctgcatactaagcggctgtatagggctgtggtagaagcagtgcataggctcgaccttatcctgtgcaataaaacggcttatcaggaggtgtttaaacctgaaaatatcagccttagaaataaactgcgagagctgtgcgttaagctgatgttcttgcaccccgtagactatgggcgaaaggccgaagaactcctgtggcggaaagtctactacgaagtgatacagcttataaagaccaacaaaaagcacatccacagcaggtctacactcgagtgcgcataccgaacccaccttgtggctggcattggtttttatcagcacctgctgctgtacatccagtcccattatcagctggaactgcaatgttgcatagactggacgcatgttacggacccactgattggttgcaaaaagccagtcagcgccagcggcaaagagatggattgggctcagatggcttgtcacagatgtctggtgtatttgggtgacttgtcaagataccagaacgaattagcgggagtggataccgagctgctggccgaaagattttactaccaggcactctctgtcgccccacaaattggtatgccgtttaatcagctgggcaccctggccggatctaagtattacaacgtggaagccatgtactgctaccttagatgcatccagagcgaggtttcgttcgaaggtgcatacggtaatctgaagagattgtatgataaggccgcaaaaatgtatcaccagctcaaaaagtgcgagacacggaaattgtccccaggcaaaaaaaggtgtaaggatatcaaaagactccttgtgaattttatgtacctacaaagcctgctccagccaaagtcaagaggttgcacaagccactgccctacgagtgctctttgtcttcccctcagctcttttcagggaagggagcaggcaccgccacgggctgccggaagtctggcatgcgcgtcaactgttagttgtgcgcaccagccacaccgctgttgcgcactttgctcttggctgctgtgttgggacaggatgggctgccaagaggagaaaaaaggtggcgctgtctag

SEQ ID NO: 240818 - DNA, 417 bp, Artificial Sequence
  Description of Artificial Sequence: Synthetic coding sequence
taattcatagtgattatcccacggactgtgatcgacgggttagacctgctcaagaaggagcaccctggagccagggacggcattcggtatctggaagctgaattcaagaaaggaaatcgctacatacgatgccagaaagaagtgggaaagtctttcgagcggcacaagctaaagcgccaggatgccgacgcttggaccctctataagattctggactcgtgcaaacagctgactttggcgcaaggcgctggggaagaggacccaagtggtatggtgaccattattactggcctacccttggacaatcctagcgtactgtccgggccaatgcaggctgccctgcaggcggctgctcatgcttccgttgacataaagaacgtgttagacttttataagcagtggaaggaaatagggtag

SEQ ID NO: 240819 - DNA, 3438 bp, Artificial Sequence
  Description of Artificial Sequence: Synthetic coding sequence
atgttggtcacggacctagagtatgctttagacaaaaaagttgagcaggacttatggaaccatgccttcaagaatcagatcaccaccttgcaggggcaggcgaagaaccgagcaaaccctaaccgttccgaggtccaggccaacctaagtctgttcctggaagcagcctccggattctacacgcaactccttcaggagctttgcactgtgtttaacgtggatctgccatgcagagtgaaaagtagtcaactgggcatcatcagtaacaaacagacccacacaagcgctattgtcaagcctcagtcttcctcttgcagttatatctgtcaacactgtcttgttcatttaggcgatatagcgaggtataggaaccaaacgtcccaggctgagtcttattacaggcacgccgctcagctggtgccatctaacggtcagccatataaccagctggccattcttgccagtagcaagggcgatcacctgaccaccattttctactattgtaggtccatcgcagtgaaatttcccttccccgcagccagtactaacctacagaaagcactcagtaaggcactcgaatcccgcgatgaggtcaaaaccaaatggggggtctctgacttcataaaagccttcattaaattccatggccacgtttacttgagcaagagtctggaaaaattgagccccctgagggagaagctcgaagaacagttcaaacgcctgttatttcaaaaagcctttaactctcagcaacttgtgcacgtcacggtgattaacctgtttcaattgcatcatttgcgtgacttctcaaacgaaactgaacagcatacctatagtcaggacgagcaactttgctggacccagttactggccctgtttatgagctttctgggcattctttgcaagtgccccctccagaacgaatctcaggaggagtcttacaacgcatacccccttccagctgtcaaggtgagtatggactggcttcgccttcggcctagagtctttcaggaggccgtggttgatgaacggcagtacatttggccttggttgatttcacttcttaatagcttccaccctcatgaggaggatttatcctctataagtgctacgccactgcccgaggagtttgagcttcagggcttcctggcattacggccttccttccggaatctcgatttttccaaggggcatcaagggataacaggtgacaaagaaggtcagcagcggagaatcaggcagcagaggctgataagtatcggcaagtggatcgcagacaatcagccaagactaatccagtgtgagaatgaagttggaaaactgctctttatcaccgaaatccccgagctgatcttggaagatcccagcgaggccaaggagaacctcatcctgcaagagacatccgtgatagaaagcttagccgcagacggctcacccggactgaaaagcgtgttgtccaccagtcgtaatttgtccaacaactgtgatactggcgagaagcctgtggtgacgtttaaagagaacatcaagacccgcgaggtgaatcgtgaccagggtcgaagctttccccctaaagaggtccgcagggactactctaaagggatcaccgtgacgaagaatgatggcaagaaagacaacaacaaacgcaagactgagactaagaaatgcaccctggagaagctccaggaaactggcaagcagaatgtcgccgttcaggtgaaatcccagactgaattgcggaaaacaccagtgagcgaggccaggaaaacaccagtaacacagactccaacacaggcctctaattcccaattcattccaatacatcatccaggagcctttccgcctctgccctcccgaccaggctttccaccgcctacctacgtcatccccccaccggtggcctttagcatgggatctgggtacaccttccctgcaggagtgtccgtgccgggaacctttctgcagccgacagctcattctcccgctggcaaccaagtacaggctggtaaacagtcccacattccatattcacagcagcggccttctggtcccggacctatgaatcaaggcccacagcaatcacagcctcctagtcagcagcccttaacttcacttccagcgcagcctaccgcgcaaagcacaagtcagcttcaggtgcaggccctgacccagcagcagcagtcgcccaccaaggccgtgcccgcactcgggaagagccccccacatcattccggcttccagcagtatcaacaggcggacgcatccaagcaactctggaatccaccgcaggttcaagggcctttaggcaaaatcatgcccgtgaagcagccatactatcttcaaactcaggatccaatcaaactgtttgaaccctctttacaaccaccggttatgcagcaacagcccctggaaaagaaaatgaaaccctttcccatggaaccatataatcacaaccccagcgaggtcaaagtgcccgagttttactgggacagcagctactcaatggcagacaaccgatcagttatggcccaacaggccaatattgatcgccgagggaagaggtcacccggtgttttccggcctgagcaggacccggttccacggatgccattcgaggatcctaagagtagtcccctgctgccacccgatctgctgaagagcctcgccgcactagaagaagaggaggaacttatctttagcaatcctcccgacctgtatcctgcacttctgggtcccctggcctctctgcccggacgctcgttattcaaatccttgttagaaaagccgagcgaactgatgtcccactctagttcctttctgtccctgacaggctttagtctgaatcaggaacgatatcctaacaactctatgttcaatgaagtctacggcaaaaacctcaccagcagttctaaggccgagctctcaccatccatggcaccacaggaaacgagtctgtactcactgttcgaaggaactccttggtctccttctttgccagcctcaagcgaccacagcacacccgcatctcagagtccccacagctccaacccctcttcactcccatcctcacccccaacccacaaccataactcagtgccattctctaattttggccctatcggaactcccgataaccgcgatcggaggacagccgacagatggaagacggacaagccggctatgggcggtttcgggatagactacctgagtgccacaagttcaagcgagagttcttggcaccaggcgagcacacctagcgggacctggaccggccacggaccatccatggaggactccagcgctgtcctgatggaatcactgaaaagcatctggagcagctcaatgatgcatccaggcccttctgctctggagcagctgctgatgcagcagaagcagaagcagcaacgtggccaggggactatgaacccacctcattag

SEQ ID NO: 240820 - DNA, 3414 bp, Artificial Sequence
  Description of Artificial Sequence: Synthetic coding sequence
atgtccctgcagagcgcccagtatctccggcaggcagaggtcctgaaggcagatatgaccgattccaagttgggcccagcggaagtgtggaccagcagacaggctctgcaggacctgtatcaaaaaatgctggtgaccgatctcgagtacgccctcgataaaaaagtagaacaagatctgtggaaccatgcctttaaaaatcaaataaccacactgcaggggcaggcaaaaaatagggccaaccccaacagaagtgaggtgcaggccaacctcagcttgttcctggaggctgcgtctggcttttacacacagctgttgcaagagctttgtacagtctttaacgtggatctgccctgtagggtgaaatcaagtcagctgggaataattagtaacaagcaaactcatacttcagcgattgttaagccacagtcgtccagttgctcttatatctgtcagcactgccttgtgcaccttggcgacatcgccaggtatcgtaaccagaccagccaggccgagtcctattatcgccatgcagcacagcttgtgcctagcaatggtcaaccctataaccagctggccattctcgcaagttcaaaaggcgaccacctgacaacgatcttttactattgtagaagtatcgccgtcaaatttccatttccagccgcttctacaaacctccagaaggctctgagtaaagccttggaatccagggacgaggttaaaacaaagtggggcgttagtgactttatcaaggcctttatcaagttccacgggcacgtgtatcttagcaaatccctggagaaattatcgccccttcgagagaaactggaagaacagtttaaacggcttctcttccaaaaggccttcaacagccagcaattagtacatgttaccgtcataaacctctttcagctgcatcatttacgggatttttcgaacgaaactgagcagcatacctatagtcaggatgagcagctctgctggacccagctgctagctttgtttatgtccttcttgggcatactttgcaagtgtccactccagaacgagtcacaggaagagtcttataatgcctatcctctgccagcagtgaaggtgtcaatggactggttgcgcctgagacctagagttttccaggaagccgttgtcgatgaaaggcagtatatctggccttggctgatctctctgctgaatagtttccatccacatgaggaagacctatccagcatttctgcaaccccacttcccgaagagtttgaattacagggttttttggcccttcgaccaagcttcagaaaccttgatttctccaagggtcaccagggtatcacaggagacaaggagggccaacagcgacgcatccggcagcaacggctgatctctatcggcaaatggatcgctgacaatcagccaagactgatccagtgcgagaatgaggtgggcaagctgctgtttatcaccgagatcccagaactgattctggaggatcccagcgaggcaaaggagaacctgatactgcaggaaactagcgttatcgagtccctggccgctgacgggtctcccggattgaagtcggttctgtccaccagcagaaatctctcaaacaattgtgacactggtgagaagcctgtggtcaccttcaaagaaaatattaagactcgcgaagttaaccgggaccagggcagatccttccctcctaaggaggttcggagggattattccaaaggcatcactgtcaccaagaatgacggcaaaaaagacaataataagaggaagactgagacaaaaaagtgcacactagagaagctgcaggagacggggaagcagaatgtagctgtgcaggtgaagagccagactgaacttagaaaaactcctgtttccgaggccaggaaaactcctgtcacccagacccccacccaggcctcaaattcccaatttattccaatacaccaccccggtgccttcccccctctacctagccgtcccggatttccacctcccacgtatgtcatcccgcctcccgtggctttctcgatgggttctggatacacttttcctgcaggagtatcagtacccggaacgttccttcagccgaccgcccattcaccagcgggtaatcaggtgcaggcgggaaagcagagtcacattccctactctcaacaacgtccttccggacctgggcctatgaaccagggccctcagcaaagccagccaccatcgcagcaaccgttaacatcactgccggcacaacccacagcccaaagtacatctcagctgcaagtacaggccctcacgcagcaacagcaaagcccaaccaaagcagtgcccgctctgggcaaaagtccacctcatcactctgggttccagcagtaccagcaggctgacgcctctaaacagctatggaacccaccccaagtgcagggtcctttgggcaagatcatgcccgtgaaacagccttattatttacagacgcaggaccctattaagctgtttgaacctagcctacaacccccagtcatgcagcagcagccactagagaagaaaatgaagcccttcccgatggagccttacaatcataaccctagtgaggtcaaagtgcccgagttctattgggacagcagctattctatggcggacaaccggagcgtgatggcccagcaggcaaatattgatagacggggaaagagatcacccggtgtgtttcggcctgagcaagacccagtgccccgaatgcctttcgagaaatctctgctggaaaaaccttccgagctcatgtcccattcctcttcattcctttcacttactggctttagcctgaatcaggagcggtacccaaacaattccatgttcaacgaagtgtacggtaagaatttaacttcttcgtctaaagctgagctaagcccatcaatggctcctcaggagaccagtctatattcgctgttcgaaggcacaccatggtcacctagccttcctgcctcctcagatcattctacacctgctagtcagtccccccattctagcaacccaagctccttgccctcctcgcctcctacccacaaccacaattccgtacctttcagcaatttcggccctatcgggaccccggataatcgggatcggagaactgccgatcgctggaagacagacaaaccagcgatgggaggtttcggcattgactacctctctgccacttccagcagtgagagttcctggcatcaagctagtacaccgtcaggcacctggactggccacggaccctccatggaagatagctcagctgtcctgatggagtctctgaagagtatctggtcttcatcaatgatgcatcccggaccctctgccctcgagcagctcttaatgcaacaaaaacaaaaacaacaaaggggccagggaaccatgaatccgcctcactag

SEQ ID NO: 240821 - DNA, 3513 bp, Artificial Sequence
  Description of Artificial Sequence: Synthetic coding sequence
atgaggaactggatgttcctgcagattgtgattgttggcgagaatgtgagcttcaagtcccagatgagaacagagaatctaaagtcagaagaacacctgaagagtagcaacatccgccaggccgaggtactcaaagctgacatgacagatagcaagctgggtcccgcagaagtgtggaccagccgccaagccctccaggacctgtatcagaaaatgctggtgaccgacctggagtacgcactggataagaaggttgaacaggacctttggaatcatgcctttaagaaccaaattactactctccagggacaggccaaaaatcgggcaaatcccaaccggtcagaagtccaggctaacctgtctctgtttttggaggccgcatctggattctatacacagctattacaggagctttgtactgtgtttaatgtggacctcccatgccgtgtgaaatcatctcagctggggatcatttctaacaagcagactcacaccagtgcgatcgttaagcctcagtcctcatcatgtagttacatatgtcagcactgcttggtgcacctgggcgatatcgcgcgttatcgcaaccagactagccaagcggagagttattaccgacatgctgctcagctagtgcccagcaacggacagccatacaatcagctggccatcttggcaagctctaagggcgatcacttgactaccattttctactactgcaggtccattgctgtgaaatttccattccctgccgctagtacaaatctgcagaaggcattgtccaaggccttggaatcacgcgatgaggttaaaacgaagtggggtgtgtcggattttatcaaagccttcatcaagtttcacggccacgtgtacctcagtaagtcattggagaagctcagccccctcagagagaagctggaagaacagtttaaaaggcttttatttcagaaggcttttaacagtcaacagctggtacatgtgaccgtgataaacctgtttcagcttcaccacctcagggatttctccaacgagacagagcagcacacatactcgcaggacgagcagctatgctggacccaactgctggctctgtttatgtcgttcctgggcatcctgtgtaaatgtcctcttcagaacgaaagccaagaggaaagctataacgcatacccgctccctgccgtcaaggtctccatggactggctgcgcctgagaccgcgagtgttccaggaagccgttgtggatgagagacagtacatctggccctggctgatttcactgctaaatagctttcacccacatgaagaggatctatccagcatctcagctactcccctgccagaggaatttgagttgcaggggttcctagctctgcgcccttcatttagaaacctggacttctctaaaggacatcaagggattactggcgataaagaagggcagcaacggagaattaggcagcaacgcttaatcagcattggcaagtggatagccgataatcaacccaggctgatccagtgtgaaaatgaggtgggcaagctgctttttattacagagatccccgagttgattctggaggatcccagcgaggccaaggaaaacttgattctccaggaaacaagcgtaattgaaagtctggccgcagatggatcccccggtctgaagagcgtactaagcacaagccgcaacttgagcaacaattgtgacactggtgaaaaacccgtcgtcacatttaaggagaacattaagacgcgggaggtgaatagagatcagggccgaagctttccccctaaggaagtgaagagccagacagaactcagaaaaacacccgttagcgaggccagaaagactccggttacccaaacacctacgcaggccagtaattcacaatttatacctatccatcaccccggagcttttccacctctgcctagtagacctggattcccgcctccaacctacgtgattccccctcccgttgcttttagcatgggatctggctacaccttccctgctggcgtgtccgtccctggaaccttcctacagccaacggcccacagtcctgcaggcaatcaggtgcaggcagggaaacaatcccatatcccttactctcaacagcgtccaagcggccctgggcctatgaaccagggacctcagcagagccagcccccatctcagcaacctctgacatctctgcccgcacagcccactgcacagtctacatctcaattgcaggtgcaggcactgacccaacaacagcagagccccaccaaggccgtccctgccctggggaagagcccgccacatcactcaggctttcaacagtatcagcaggcggacgcctcaaaacaactgtggaacccacctcaggtgcaaggcccattaggaaagataatgcccgtgaaacagccttattatctgcagactcaggaccctattaaactgtttgagccatctcttcagccccctgtgatgcagcaacagcccctcgagaagaaaatgaaaccttttccaatggagccgtataatcacaacccttcagaggtcaaggtgcctgagttctactgggactctagctattccatggccgataatcgctcagtgatggcgcagcaggccaatatcgataggcgcggaaaaaggtcgccaggtgtattccgaccagaacaggatcctgtgccccgaatgccatttgaggacccaaagagctctccgttgctgccccctgacctgttgaagtcactcgccgcactggaggaggaggaggagctgattttctcaaacccgcctgacctttaccccgcattgctgggcccactggccagcctccccggaaggtccttgttcaagagcctgcttgagaaaccgtccgaactgatgtcacactcttcttcctttctgtctcttacaggattttcccttaatcaggagcggtatccgaataactctatgtttaacgaggtgtacggaaagaatctgaccagctcaagcaaggcagaactttcgccgtcaatggctcctcaggagacatccctgtattctctgttcgagggtacaccttggtcccccagtctcccggctagcagcgaccacagcacccccgcttcccagtctcctcactcttccaacccttctagcctgccttccagcccgcctactcacaatcacaatagcgtcccatttagtaacttcggaccaataggcactccagataatagagatagaaggactgccgacagatggaagacagacaagccggctatgggcggtttcggaattgattatctgtccgcaacgtcttctagtgagtcgtcgtggcaccaagcctccaccccctctggcacgtggacaggccatggcccttccatggaggacagctccgctgttcttatggaatcccttaaaagcatttggtcttctagtatgatgcacccaggcccttcggctcttgagcagcttctcatgcagcagaagcaaaagcagcagcgtggacagggaaccatgaatcctccacactag

SEQ ID NO: 240822 - DNA, 2274 bp, Artificial Sequence
  Description of Artificial Sequence: Synthetic coding sequence
atgctggtaacagatctggaatatgcgctggataaaaaagttgaacaggacctgtggaaccatgcctttaaaaaccagattacaactcttcagggtcaggccaagaatagggctaatcccaatcgcagcgaagttcaggctaacctgtcactcttccttgaagcagcgtccggattctacacccagttgctgcaggagctgtgcacagtcttcaatgtggatctcccctgccgtgtgaagagctctcagctgggaatcatctccaacaagcagacacacacatcagccattgttaagccacaatcctccagctgcagctacatttgccagcattgcctggtccacttaggggacatcgctcgctatcgcaatcaaacttcccaggccgagtcttactaccgacacgccgctcagctcgtgccttcaaatggccagccctacaatcagctggctatcctagcttctagcaaaggcgatcatttgaccacaatcttttattactgtagatccatcgctgttaaatttccttttccagccgctagcacaaatctgcagaaggccctatccaaagccctggaatcgagagacgaggtgaagacaaagtggggggtatccgattttattaaggctttcatcaaatttcatggacatgtttatctctcaaaatccttggaaaagttgtctcctttaagagaaaagcttgaggaacaattcaagagactcctcttccagaaagcatttaattcccagcaactcgtccacgtcactgttattaacctattccagctgcatcacctgcgggactttagcaacgagacagaacagcatacatactctcaggatgagcagctctgttggacacaactactggctctgttcatgagcttccttgggattctctgcaagtgccctttgcagaacgagtcacaagaagagtcctataacgcatatcctcttcctgcagtcaaagtgtccatggactggctgcggctcagaccacgagtattccaggaagctgtggtcgatgagcggcagtatatctggccgtggcttatcagtctgctcaattcattccacccgcatgaggaagacctatcgtcaattagcgcaacgccccttcctgaggagtttgaattgcaaggctttctggctctgagacctagcttccggaacctggacttctctaaagggcatcagggtattactggagacaaggagggacagcagaggagaattaggcaacagcgtctcatctcaatcggcaaatggattgccgataaccaaccaagactgattcagtgcgaaaacgaggtggggaaattactgttcatcaccgaaatccctgagcttattttagaagacccaagcgaagccaaggaaaacctgattctgcaggaaacatcagtgatcgaatcattggcagccgatggaagccccggtctgaagagtgtgctatccacatcgaggaacttaagcaataactgcgacacaggcgaaaagcccgtggtcacatttaaagagaacattaagacaagagaagtgaaccgggaccaagggaggtcctttccacctaaagaagtgaagagtcagacggagctccggaaaacacctgttagtgaagccaggaaaactcccgtgacccagacccctacacaggcgagcaactcacagttcatcccaattcaccaccctggcgcttttccccctctgcctagccgccctggatttccaccgcctacctatgtgatccccccacccgtggcttttagtatggggtcaggttacacattccccgctggggtctcagtgccgggaactttcctgcagcccaccgctcactccccagcgggaaaccaggtgcaagcagggaagcagtctcatatcccctactctcagcagaggccatctggcccaggtcctatgaaccaggggcctcagcaaagtcagcctccatcccagcagcctctcacctctctgcccgctcaaccaacagcccagagtacctcccagttgcaggtgcaggctctgacccaacagcagcaatctccaaccaaagctgtcccagctctaggcaaaagcccccctcaccacagcgggtttcaacagtaccagcaggctgatgcatctaaacaactgtggaacccaccgcaggttcagggtccattgggtaagatcatgcctgtgaaacaaccatactacctgcagacccaggatcccataaaactcttcgaaccatcactgcagccccctgtcatgcaacagcagcctttatag

SEQ ID NO: 240823 - DNA, 3150 bp, Artificial Sequence
  Description of Artificial Sequence: Synthetic coding sequence
atgctcgtcaccgacttagaatatgctttggataaaaaggtcgagcaggatttatggaaccacgcctttaagaaccagatcactacattacaaggccaggcgaagaacagggccaatcctaataggtctgaggtgcaggcaaatttatctctctttcttgaggctgcgtcgggcttttatactcagcttctccaagagctgtgtacggtttttaatgtcgacctgccttgtcgcgttaaatcctcccagctgggcatcatctccaataaacagactcatacttccgccatcgttaagccacagagttcatcatgtagctacatttgccagcattgtctcgtgcatctcggtgacatagccagatataggaaccagacgtctcaggccgaatcctactacaggcatgctgcgcagttggtaccgtcaaacggacagccctacaaccaactggcgatcctggcttcatcaaaaggcgaccaccttacaacaatcttctattactgtaggtctatcgcagtcaagtttccctttccagcggctagtaccaatctccagaaggccctgtctaaggcactcgaaagcagagacgaagttaaaacaaagtggggggtttccgacttcattaaggccttcataaaatttcatggccatgtctatctttcaaaaagcttggagaagttatccccactgcgggagaaattggaggagcagttcaagagactgcttttccagaaggcctttaactcacagcagctagtgcatgtgaccgtcatcaatctgtttcagttacaccacctgcgcgatttcagtaatgaaacagagcagcacacttacagccaggacgagcagttgtgttggactcagctgctggctctctttatgtcatttctgggtattttgtgcaagtgtccactccaaaacgaaagccaggaggagagttataacgcttatccactccctgccgttaaggtgagcatggactggttgaggctgcggcctagagtctttcaggaggccgtcgttgatgagagacagtatatttggccatggctgatttctttgctcaactcattccatccccatgaagaggacctgtcaagcatctctgcaacaccattacccgaggagtttgaactgcagggatttctggccctgcggccatcctttaggaatttggacttttcaaaaggtcaccagggaatcaccggagataaggaaggccagcagaggcgtatcaggcagcaacgattgatctccattggtaagtggattgctgacaatcagcccaggttgatacagtgcgaaaacgaggtcggcaagctgctgtttatcactgaaataccagagctaatccttgaggacccgtcagaagcaaaggaaaatcttatcctgcaggagacctccgtgattgaaagcttggccgctgacggcagccctgggctcaagtccgtgttgtctacatcccgcaatttaagtaacaattgtgataccggggaaaagcccgtagtcaccttcaaggagaatatcaagacacgagaagtgaaccgtgaccaggggagatcttttccaccaaaagaggtaaagtctcagactgaactgcgaaagacccctgtgtccgaggctcggaaaacacctgtgactcagacgcccacacaagcatccaactcgcagttcattcctatccatcacccaggtgcgtttccacctctgccctctaggcctggctttcctcccccaacttatgtcatcccccctccagttgcgttcagcatggggtctggctacacctttccggctggagttagcgtgccagggaccttccttcagcccaccgcccatagtccagctggtaatcaggtccaagccggtaaacaaagccatatcccctacagccagcagcggccatcgggcccagggccaatgaatcaggggcctcaacagtctcagcctccttcccaacagcctctgacttctcttcccgctcaaccgacagcacagagcacaagccagctgcaggttcaggccctcacccagcaacagcagtcgcccaccaaggctgtgccagccctggggaagtctcctccccaccatagtgggtttcagcagtaccagcaagcagacgcctccaagcaattgtggaacccccctcaagtccagggacccctgggcaagattatgcccgttaagcagccatactatttgcagactcaggacccaattaagctgttcgagccaagcctccagcctccagttatgcagcagcagcccctcgagaagaagatgaaaccttttcccatggaaccttacaaccataacccatctgaagtgaaggtgcccgagttctactgggactcctcctattcaatggcagacaacaggtccgtcatggcccagcaggccaacatcgatcgtcggggaaagaggtcaccgggtgtctttcggccagagcaggaccctgtacccaggatgccatttgagaaaagccttcttgaaaagcccagcgagctgatgtcacacagtagtagttttctcagtctcactggcttctcccttaatcaagagcggtaccccaataacagcatgtttaacgaagtttacggtaagaatctgacatcttcttccaaggctgagctctcaccatcaatggcgccacaggagacttccctgtattcgctattcgaggggacaccatggagcccttcactccctgcttcatcagatcatagcacacctgcctcccaatccccccatagttcaaatccaagctccctgccatcttctccgcctacgcacaatcacaacagcgtcccattttctaattttgggcctattggaactccagacaatagagatcgacggactgcggaccgctggaaaactgataagccagccatgggcggttttggaatcgattacctctccgcaacatcttcatcggagagtagttggcaccaggccagcactccctcggggacatggaccggccacggcccttcgatggaggatagcagcgccgtgcttatggaaagccttaagagtatatggagttcctcaatgatgcacccaggcccttccgcactggagcaactgttaatgcagcagaagcagaagcagcagcggggtcaagggaccatgaatccaccacactag

SEQ ID NO: 240824 - DNA, 3537 bp, Artificial Sequence
  Description of Artificial Sequence: Synthetic coding sequence
atgagcctccagagtgctcagtacttaaggcaggccgaagttttgaaagctgacatgaccgactcaaaactgggccctgcagaggtgtggacatcccgtcaagccctgcaggatctttaccagaaaatgctggtgactgacctggagtacgccctagataaaaaggttgagcaggatctgtggaatcacgccttcaagaaccagatcaccacactccagggacaagccaagaatagagccaaccctaataggagcgaagtgcaggcaaatctgagtctgttcttggaagcggcaagtggcttttatacccagctgctgcaggagttatgcaccgtgtttaacgtggacctgccttgccgggttaagagcagtcagttggggataattagtaacaaacaaacacatactagcgccatcgtgaagccccagtccagtagctgcagttatatttgccagcactgtctggttcatttgggggacatcgccagatacagaaaccagacctctcaggccgagtcctactacaggcacgccgcacagttggtgccaagtaacggacagccctacaatcaactcgctatcctcgccagctccaagggggatcacctgaccacaatcttttactattgccgatccattgccgtgaaattcccatttcccgctgcctcaacaaacctgcagaaggccttatccaaggccctcgaaagtcgagacgaggtaaagactaagtggggcgtgagtgactttattaaggcatttataaagttccacggccatgtgtatctgtcaaaatccctggaaaagctgtccccgctgagagagaaacttgaggagcagttcaagcgcctcctatttcagaaggccttcaacagccagcagctcgtgcatgttaccgtaattaacctgtttcaactgcaccatctgagggactttagcaacgaaacggagcagcacacctactcacaggatgagcagctgtgctggactcagctcctggccctgtttatgtccttcttgggaatactgtgcaagtgccccctccagaatgaatctcaagaggaatcctataacgcctacccactgccagctgtgaaggtgtctatggattggctacgacttagacctcgcgtttttcaggaagccgtggtcgacgagcggcagtacatctggccctggctgattagcctgcttaacagtttccatccccatgaagaggacttgtcatcaattagcgctacgcctcttccagaagagttcgagctgcagggttttctggctcttcggccatccttccgcaacttagacttcagcaaggggcaccaaggcataaccggtgacaaagagggacaacagcggaggatacggcaacagcgtctaatcagcatcggtaaatggattgcagacaatcagcccaggctcatccagtgcgaaaacgaagtaggaaaacttctgttcattactgaaattcctgagctgattttggaagacccaagcgaggccaaggaaaacctgattttgcaagaaaccagtgtgatcgaaagtttggctgcagacggcagtccaggcctcaaaagtgtgctgtccacttccaggaatctctccaataactgcgatacaggggaaaaaccagttgtcacttttaaggaaaatataaagacccgcgaagtgaatagggaccagggacggtctttcccccctaaggaggtgaagagccagacagagctgaggaaaaccccagtttcagaagctcggaagacgccagtcacccagaccccaacacaggcatctaactcgcagtttatccccatccaccaccctggagcatttcccccattgccaagtcgacccggtttccctcctccgacatacgtgatccctccacccgtggccttcagcatggggtccggttatacgttccctgctggtgtctcagtcccaggaacgtttctccagcctacagctcattccccagcgggtaaccaggtgcaggctggtaagcaaagtcatattccatacagtcagcagcggccttccggcccaggtcctatgaatcaggggcctcagcaatctcagcccccaagtcagcaacctctcacatccctacctgcccagccaacagcacaaagtacgtcccaactccaggtccaagccttgacacaacaacagcagtcgcccacaaaggcagtgcccgcacttggcaaatccccgcctcatcattcgggcttccagcagtaccaacaggcggatgcatccaagcagctgtggaacccgccacaggtacagggacctctggggaagataatgcccgtaaagcagccttattacctccagacccaggacccaatcaagctgttcgagccctcgttgcagcctcctgtgatgcagcaacagcccttggaaaaaaaaatgaagccatttcccatggagccttacaatcacaacccatccgaagtcaaagtgcctgagttctattgggacagctcttactccatggctgacaaccggagtgttatggcccaacaagctaatattgatcgccgtggtaaacggtccccaggggtttttagacccgagcaggatcccgtgcctcggatgcccttcgaagaccccaagtcctctccattgctcccacctgacctgctgaagtccctcgcggctctggaagaggaagaggagctgattttctcgaatccgcctgatctgtaccccgcactgctggggcctctcgcctcgctacccggaagaagcttatttaaatcactgctggagaagccgagtgagcttatgtcccattcgtctagtttcttatcccttacaggctttagcctcaatcaagagagatatcctaataattccatgtttaacgaagtttatggtaagaacctgacaagctcaagcaaggccgaacttagcccctctatggctccacaggagacttccctctattccctgtttgaaggtacaccctggagcccgtcactccccgcatcaagcgaccatagcacacccgcatcccagtccccccatagtagtaacccgagctccctgcctagtagccctcctacccataatcacaattcagtgcccttcagcaatttcgggccaataggtacaccagacaaccgtgacagacggaccgcagaccgatggaagacagataagccagcaatgggcggttttggcattgattacctttcagcaacgtcgtcttcggaatcttcttggcatcaagctagtaccccatccggtacctggactgggcatgggccttcaatggaggatagtagcgccgttcttatggaatctttgaaaaaacagcagcacggtgtgcagcagcttggccctaaacgccagtcagaggaggagggatcctcctccatctgcgtggcacacagaggtccccgtcctctcccctcttgtagcctgcctgcatctactttccgtgtcaaattcaaggcagccagaacttgtgcgcatcaagcccaaaagaagactaggcggcgacctttttggaagcggcgaaagaaggggaagtag

SEQ ID NO: 240825 - DNA, 3276 bp, Artificial Sequence
  Description of Artificial Sequence: Synthetic coding sequence
atgagtttgcagtctgctcaatatttgcggcaggcagaggtgctcaaggcagatatgacagatagcaagttggggcctgcggaagtgtggacaagcagacaagctctgcaggatttgtaccagaaaatgttagtaacagacctggagtatgctttagacaagaaggtagaacaagacctgtggaatcatgcctttaagaatcagattactacactgcagggccaggctaaaaacagggctaatcctaataggtctgaagttcaagccaatttaagtctctttctcgaagcagcttccgggttctatacacaacttttgcaggaactgtgtacggtctttaacgtggatctgccctgccgagtgaagtcatctcagctggggatcattagcaacaagcaaactcatacatcagcgatcgtcaagccgcagtcgagctcatgcagctacatttgccagcattgtctggtgcatctgggggatattgcacgttataggaaccagacaagccaggcagaaagctactatagacacgcagcccaacttgtgccctccaacggccagccgtataatcaattggctatcctggcctcatcgaaaggggaccacctaactaccatcttctattattgccgaagcatcgctgtgaaattcccctttccagcagcgagcacaaacttacagaaagctttaagtaaggcactagaaagccgggatgaggttaaaacgaagtggggagtcagtgacttcataaaagcctttatcaagtttcatggccatgtctatctgagcaaaagcctggagaaactgtcgcccctgagagagaaattggaagaacagtttaagagactcttgttccagaaggcattcaactcacagcaattagtgcatgtgacggtcatcaatctgtttcagctccaccatctccgcgatttttcgaacgagacagagcaacacacatactctcaagacgagcagctttgctggacgcaacttctggcccttttcatgtccttccttggaatcctctgcaagtgtcccctgcagaatgaatcacaggaagagagttacaacgcatatccgttgcctgctgtcaaggtgtcaatggattggctgagattaaggcctagagttttccaggaggccgtagtagatgagagacaatacatatggccatggctaattagcctgctgaactctttccacccacatgaagaagacctgtccagcatcagtgccacacccttgcccgaagagtttgaacttcagggattcctggccctaagaccgtcttttagaaacctcgattttagtaaaggtcaccaaggtattaccggagataaggaggggcagcagcgacgaatcaggcagcaacgactgatttctatcggaaaatggatcgccgataaccagcctcgtctgatccagtgtgagaacgaagtggggaaactgctgttcatcacagaaatccctgaacttatcttggaggaccccagtgaggctaaagagaacctcatcttacaagagacctccgtcatcgagagtctagctgccgatggtagccccggtctgaaaagtgtgttgtcaacatctcggaacttgtctaataattgtgatacgggcgagaaacctgttgtgacattcaaagagaacatcaagactagggaggtaaatcgagaccagggacgcagcttcccacccaaagaagtcaagtctcaaactgaacttcggaaaacccccgtgagcgaagctcgaaaaactcctgtgacccagacgcccacccaggcttctaatagtcaatttatccctattcatcaccccggagctttcccacctcttccttctcggcctgggttccctcccccaacctacgtgattccaccccctgtggctttcagcatgggctcgggctacaccttcccagccggagtctccgtccctggcacattcctacaacctactgctcatagtccggcagggaatcaggtccaagccggaaagcagtctcatataccctattctcaacagagaccctccgggcctggtcctatgaatcagggtccccagcaatctcagcccccttctcagcagcccctcaccagtctgccagctcagcctacagcacagagcacctcacaactgcaggtgcaggcactgacacagcagcagcagtcccccaccaaagcagtgcccgctctggggaagagccccccacatcacagcggcttccagcagtatcagcaggctgatgcctcaaaacagctttggaatccaccacaagttcaagggcctctggggaagataatgccagtgaagcaaccatattatctacagacccaggatcctatcaaactctttgaaccctccctgcaacctccggtgatgcaacagcagcccctagagaaaaagatgaaacccttcccaatggaaccctacaaccacaacccctcagaagttaaagtacctgaattctactgggactcaagctacagcatggcagataatcggtctgtgatggcacagcaggccaacattgaccggaggggcaagaggtcccctggggtattccgcccagaacaggatcccgtgccaaggatgccctttgagaaaagtctgttggagaaacctagtgaattgatgtcccattcaagttcttttctgtcccttaccggtttcagtttaaaccaggaaagatatccaaacaacagcatgtttaatgaagtgtacgggaaaaacctgacctcaagtagtaaggcggagttgagcccatctatggccccacaggagactagtctctactccttatttgaaggaacaccttggtcgccaagtttgcctgcctcctccgaccactcaactcctgccagtcagtcccctcacagctcaaacccttctagcctgcctagctccccgccaacccacaaccataacagcgtgcctttttcaaattttggcccaatcggtactccagacaacagggacaggcgtaccgccgaccgctggaagaccgataagcctgctatggggggattcggaatagactatttatccgctacgtcaagctctgaatcctcctggcaccaggcctccacaccaagtggcacttggaccgggcatggcccttctatggaagattcttcagcagttctcatggaatctcttaagtccatctggagttctagcatgatgcaccctggcccttcggccctggaacaattactgatgcagcagaagcagaagcaacagagaggccagggcactatgaaccccccacattag

SEQ ID NO: 240826 - DNA, 2976 bp, Artificial Sequence
  Description of Artificial Sequence: Synthetic coding sequence
atggctggccctgtgtctttacgggatctcctgatgggtgctagtgcatggatgggctctgagtctcctggagggagcccaactgagggaggcggatctgcagccggtggcccagagcccccttggcgcgaggacgaaatctgcgtggtaggcatatttgggaagacagcactgcgcctgaacagtgagaagttctccttggtgaataccgtgtgtgaccgacaagtattccctctgtttagacaccaggacccaggcgatccgggtcccggaatccgcacagaggccggagccgtgggcgaagccggaggcgctgaggatcctggcgcagccgctgggggatcggtgagaggaagcggcgctgtcgctgagggcaatcggaccgaggctgggagtcaggattattctctgctgcaggcctactatagccaggaaagtaaagtcctgtacctactcctgacctctatttgtgataattcacagctacttcgggcatgcagggcactgcagtctggcgaggccggagggggtctctcacttcctcacgctgaggctcatgagttctggaaacaccaggaaaaactgcagtgcctaagtctactttacctcttcagtgtctgtcacatcttattgttggttcatcccacctgctcctttgatatcacttatgacagggtgttcagagctctggacggactgagacaaaaggtcctacccctcttgaaaacagccattaaagactgtcccgttggaaaagactggaaacttaattgcaggccatgtcctcccagactgttgtttctattccagttgaacggagcattaaaagtggagcctccaaggaatcaggatccagcacatccagacaaacctaagaagcactccccaaaacgcaggctccaacacgctctagaggaccagatttatagaatctttcgcaaatcccgcgtcttaacaaaccagtctatcaattgtttatttactgtcccagctaaccaggcctttgtgtatattgtgcccggttctcaagaggaggaccctgtgggaatgcttttagatcagctgaggagccactgcactgttaaggacccagaatctcttctggttccagcacctctatcaggacccaggcggtaccaggtgatgagacaacattctcgccagcagttgagtttccacatagattcttccagcagttcttcaagcgggcaactggtcgacttcacactgcgagagttcctttggcagcatgtagaattggtcttgagtaagaagggatttgatgactctgtcggcaggaaccctcagcctagccactttgagctgccaacctatcagaaatggatctctgccgcttccaaactgtacgaggtcgccatcgacgggaaggaagaggacttgggatcccctacaggcgagctgacaagcaagatactatccagcataaaagtcttggaaggattccttgacatcgacaccaagttctccgaaaaccggtgccagaaggcccttcctatggcccacagtgcttatcagtccaatttgcctcacaactacactatgaccgtccacaagaaccaattagcccaagccctaagagtttacagccagcacgcaagggggccagctttccacaagtatgccatgcagcttcacgaggactgttataaattctggtctaatggacaccaactgtgcgaggagcggagcttaacagatcaacactgcgtacacaaattccacagtctcccaaagtccggcgagaaacccgaagccgatcgcaatccaccagttctctatcacaattctagggccaggtccactggagcgtgcaattgtggcagaaagcaagccccaagagacgatccattcgatattaaagctgcaaactacgacttctatcagcttcttgaagaaaagtgctgtggtaagttggatcatattaatttccccgtcttcgagccaagtacccctgaccctgctcctgccaagaatgaaagctccccagcgccacccgactccgatgctgacaaactcaaggagaaagaacctcagacccaaggagaatcaacatctctgtccttggccctgagtttggggcaaagtacggactccctgggcacctatccagcggatcctcaagcaggaggcgataacccagaagtccatggccaagtggaggtaaagacggagaaacgacctaacttcgtggatcgtcaggcctcaaccgttgagtacctgcctggtatgttacactccaactgccctaaaggcctgttacctaagttttcctcgtggtctttggtcaagttgggacccgcaaaatcctataactttcatactgggttagatcaacagggcttcatcccaggtactaactacctgatgccttgggacatcgtaattaggactcgagccgaggacgagggggatctggataccaattcctggcctgctccaaacaaggcaataccaggcaagaggagtgctgttgttatgggaaggggcagacggagggatgatatcgcccgagcattcgtggggttcgagtacgaagactcaagggggcgaagatttatgtgttcaggaccagacaaggttatgaaagtaatgggcagcggcccaaaagaatctgcactcaaggctctgaattccgatatgcccctctatatccttagctcctctcagggaagaggactgaagccccattatgctcagctgatgcgccttttcgtggtcgttccagatgcccctctgcagatcattctgatgcctcaagttcagcccggacccccaccatgcccagtcttctaccccgaaaaacaggaaattaccttaccgccagacgggctttgggttctgcgttttccctacgcctatgtaactgagaggggcccttgttttcctcccaaggaaaacgtgcagctaatgagttataaggtgctgcgcggtgtgttgaaagccgtgactcagtag

SEQ ID NO: 240827 - DNA, 2925 bp, Artificial Sequence
  Description of Artificial Sequence: Synthetic coding sequence
atggccggaccggttagcttgagggacctcctcatgggcgcttctgcttggatggggagtgagtcacccggaggctctccaacagagggcggtgggtctgccgctggaggccctgaacccccatggcgggaagacgagatctgtgtcgtcggcatcttcggaaaaaccgccttacgtctgaattccgagaaattttcactcgtgaatactgtctgtgaccggcaagtgttccccctgttccggcatcaggatcctggggatcccggaccgggtattcgaaccgaagcgggtgctgtgggtgaggcaggcggagccgaagacccgggtgccgctgctggtggttctgtcaggggctccggcgcagtagcggaaggaaaccgcacagaggccggatcccaggactatagtttactgcaggcctactacagtcaagaaagtaaggttttatacctccttctcactagcatctgcgataactcccagctgctcagagcctgtcgagccctacagagtggtgaagctggcggtggcctctcactcccccacgccgaagctcacgaattttggaaacaccaggagaagcttcagtgcctgagcctgctctatctcttctctgtgtgccatattttattgctcgtccatcctacttgctcctttgatattacctatgatcgcgtgtttagagccctcgacggactcaggcaaaaagtacttccattgttgaagacggctatcaaggactgtcccgtgggaaaagattggaagctcaactgcaggccgtgtccgccacgcctgctgttcctgttccagcttaacggcgctctgaaggtggagccacctagaaatcaggacccggcacaccccgataagccaaagaagcactcacctaagcgacgtctgcagcacgcactggaggaccagatttatcgcatcttcagaaagtctagagtgcttaccaatcagtccatcaattgcctgttcactgtgcctgccaatcaggcatttgtttatattgtcccaggatcacaggaggaggatccagtgggcatgcttctagaccagttgaggagccactgtacagttaaagaccctgagagcctactggtgcctgcacccctctcagggccacgccgatatcaggtgatgcgtcagcatagcaggcagcagctctcatttcatattgatagttcttcttctagtagttcaggccaactggttgacttcacgttgagggaatttctgtggcagcacgtggagctcgtgctgtcaaaaaaagggttcgatgattccgtaggacgtaaccctcagcctagccacttcgagctcccaacgtatcagaaatggattagcgcagcaagcaaactgtatgaggtggctattgacggaaaagaggaggaccttggctctcctaccggtgagctgactagcaaaattctgtcatcaatcaaagttctggaaggatttctggacatcgatactaagttcagtgagaataggtgtcagaaggctctgccgatggcccattcagcttaccaaagcaacctacctcataactacaccatgactgtacacaagaatcagctagcacaggcattgcgcgtttatagtcagcacgccagggggcctgcgttccacaagtacgcaatgcagctgcacgaagactgttataaattttggtctaacggccaccagctatgtgaggaacgctccctgactgatcagcactgcgtgcacaaattccattccctgccgaaaagcggagagaagcccgaagccgatagaaatccgcctgtcctataccacaattccagagccagaagcaccggagcttgcaactgcggacgtaagcaggcccctcgcgatgatccattcgatattaaagctgccaattatgacttctaccagttgctagaagagaaatgctgcgggaaactggaccacatcaattttcctgtgtttgaacccagcacccctgatcccgcaccagctaagaacgagtctagcccagccccacctgattcagatgccgacaaactgaaagagaaggaaccccaaacacagggggagtctacgtcgctttcattagcattgtctcttggccaatccaccgattctctcggcacctaccccgcagacccacaagctgggggagataaccctgaagttcacggccaagtggaggtcaaaacagaaaagcgcccaaatttcgttgaccggcaagcctccacagtcgagtacctccccggaatgctccacagcaactgtcccaagggcctgctgcctaaattctcctcatggtctctggtgaagttgggtcccgcaaaatcttataactttcatacaggactcgaccaacagggattcatcccaggaacgaattacctaatgccctgggatattgtgattcgaacccgagcagaagatgagggtgacctcgatacaaattcctggcccgctccaaacaaagccatcccaggcaagagaagcgccgtcgttatggggagaggaaggagaagggatgacatagctcgcgcatttgtgggcttcgagtacgaagattccaggggcagacggttcatgtgttccggcccagacaaggttatgaaggtgatgggcagcgggcctaaggagagtgcgcttaaggcactgaacagcgacatgcctctgtacatcctctccagttcgcaagggcgaggacttaagcctcactatgctcagctcatgagattatttgttgtagtgccagatgctcctcttcagattatcctcatgcctcaggtacagccgggacccccaccatgtcccgtgttctatcctgaaaaacaagagatcactcttccaccggatgggctttgggtgttaagatttccttacgcataccttcgcgaggatctggtgagtccgctgaggaagatgtgtagttag

SEQ ID NO: 240828 - DNA, 1563 bp, Artificial Sequence
  Description of Artificial Sequence: Synthetic coding sequence
atgtcagagagcggacactcccagcccggactctatggtattgagcgaaggaggagatggaaagaacctggctctggaggcccacagaatctgagtggacctggagggagagagcgggattatatcgcgccttgggaaagggagcggagggacgcctcagaagaaacctcaacatccgttatgcagaaaaccccaataattctgtccaagccaccagcagagaggtcgaagcagcctccaccccctaccgcccctgctgcccctccagccccagctccgctggaaaagccaattgtgctgatgaagccacgcgaagaaggcaaaggtcccgtcgccgtcacgggggcttctactcccgaaggaacagctcctcctccgcctgccgcacccgcacctcctaaaggcgagaaagagggccagaggccaactcagccagtgtatcagattcagaatagggggatgggcacagcagcccctgcagccatggaccccgtcgttggtcaggccaagttgttacccccagagcgaatgaaacattcaataaaacttgtcgacgaccaaatgaactggtgtgacagcgccattgagtatctgctagatcagacagacgtgctcgtcgtcggagtacttggcttgcaagggacaggcaaaagcatggtgatgtccctgctgagcgcgaacacccccgaagaagatcagcgaacctacgtgttccgcgctcagtcggctgagatgaaggagagaggcggtaaccagactagcgggatcgacttcttcatcacacaggagcgaattgttttcttggacacgcagccgattctgtcaccaagcatcctggatcacctgatcaataatgacaggaaactgccccctgaatacaatcttcctcacacatacgtcgaaatgcagagtctgcagatagcagccttcttattcacagtttgccatgtggtgatcgtggtccaagactggttcacagatctatcgttatatagattcctacagaccgcggagatggtcaagccaagcaccccaagcccatcgcatgagagttcttcttcatcgggttctgatgaggggactgagtattaccctcacttggtcttcctgcagaacaaggctcggcgtgaggacttctgcccacggaagcttcgccagatgcacctgatgatcgatcaactgatggcccacagtcatctgcggtacaaaggaacccttagcatgctgcagtgcaacgtctttcctggtctgccccctgattttcttgactcggaagtcaacctcttcttagttccgtttatggacagcgaagcggaaagcgagaaccctcctcgagccggtcccggatccagtccgctcttttcactgttgccgggataccgagggcatccaagctttcagagtttggtatcaaagcttaggtcccaagtgatgagcatggccaggcctcagctgagtcacacaatcctgaccgaaaaaaactggtttcattacgctgcccgaatctgggacggtgttcgcaagagcagtgctctcgcagagtattctcgtttgctggcctag

SEQ ID NO: 240829 - DNA, 2742 bp, Artificial Sequence
  Description of Artificial Sequence: Synthetic coding sequence
atggcagacgaggcgctggcagggctcgatgagggggcactgcggaaactgctcgaagtcaccgctgacctagctgaaaggagacgcataaggagtgcaattcgtgagctgcagcggcaggagctggaacgggaggaggaagcactagcctcaaagaggttcagagccgaacgacaggacaacaaggagaactggctgcacagtcagcaaagagaggctgagcagcgagccgcactggccagactggcaggccagttagaaagcatgaacgatgtggaggagctgaccgcacttcttcggtccgctggagagtacgaagaaagaaagctgatccgagctgcaatcaggagggtgcgtgcacaagaaattgaggctgccacacttgcagggaggctgtattcagggcgaccaaactctggcagtcgcgaggactcaaagggcctggcagcgcatcgcctggaacagtgcgaagtgcccgaacgggaggagcaggagcaacaggcggaagtcagcaaacctacacccacgccggaaggtacttctcaggatgtcacgaccgtgacattgctccttcgggcacccccaggctctacttcctccagtcctgctagtccaagcagctccccaacaccagcgagccctgagccccctctggagcccgctgaggcccagtgcctgaccgccgaggtgccaggtagccccgaaccgccaccttcaccgccaaagactacttccccagaaccacaggagtctcctaccctgccaagcacagaggggcaagtggttaacaagttgctgtcggggccaaaggaaacacccgcagctcagtctcctacccgaggaccaagcgacacaaagcgtgccgatgtcgcaggcccaagaccttgtcagaggtctctctcagtgttatcacctagacagcctgcccaaaaccgggaaagtactcccctcgcttcaggccctagctctttccagcgggcaggcagcgtccgggatagggtgcataagttcacctctgactcgccaatggccgcacgcttgcaggatggcacgccacaggccgcactctcaccgttacccaggaaggctcccggacctctccctcaccagcatcacccgtgcctccttctccagaggcttcttctgtccggaccagatacctcttcacgtttttctaaggagcagcgcggtgtcgctcagccacttgcccaactccgcagctgcccccaggaagagggtcctaggggtagggggctggccgctaggcctctggaaaatagggctggcggacctgtggctcgaagtgaggagcctggcgcaccgctccctgtggcagttggcaccgccgagccgggtggcagtatgaagaccacctttacgatagagataaaagacgggcgtggacaggctagcactggacgggtcctgctgcctacaggcaaccagcgagccgaactgaccctgggtcttcgcgcacccccaaccctcctgagcacctctagcggtggcaaatctaccataactcgagtcaatagtccagggacactcgccaggctgggatcagtcacccatgtcacatcgtttagccacgctcccccatccagtagaggaggctgtagcattaaaatggaagctgagccggcagagcctctggctgcggctgtggaggctgccaacggagcggaacagactagagtaaacaaagccccagaggggaggagccccctttccgcagaggaacttatgaccatcgaagatgagggggtgctggataagatgctcgaccagagcactgactttgaagagcgaaagctgatccgtgcagccctgcgcgagctccggcagagaaaaagggatcagagagacaaggagagggagcgtcgtctccaggaagcgaggggacgtcccggtgaaggtcgaggaaacactgccactgagaccaccacacgacattcccagcgcgctgccgacggaagcgccgtgagcacagtcaccaagactgaaagactggtccactccaatgatggcacaaggaccgccaggactacgacagtggagtctagctttgtgaggcgatccgagaacgggtcaggaagcacaatgatgcagaccaagaccttctcttccagcagcagcagcaagaagatgggcagcattttcgatagagaagatcaagctagccccagagcagggagcctcgccgctctggaaaagcgccaagctgagaagaagaaggaactcatgaaagcccagtccctgcccaagacatcagcttcacaggctcgaaaagctatgatcgagaagttagagaaggagggcgctgcagggtctcctggtgggcctcgagctgccgtccaacgctccacctcgtttggcgttcccaacgcaaattctatcaagcagatgctgttagattggtgtcgggcaaagactaggggatacgaacacgttgacatccagaacttctctagctcttggtccgatggtatggccttttgcgccctcgtccataactttttccccgaggctttcgattacggtcagttgtccccccagaataggaggcagaattttgaggtcgctttctcgtcagccgaaacccacgccgactgcccccaactcttagatactgaagacatggtgcgcctgcgcgaacctgattggaagtgtgtgtatacatatattcaggaattttacaggtgccttgtgcagaagggcctggtgaaaacgaagaaaagctag

SEQ ID NO: 240830 - DNA, 2748 bp, Artificial Sequence
  Description of Artificial Sequence: Synthetic coding sequence
atggccgatgaggccctcgccggactggacgagggagcccttcgtaagttgctggaggtaacagcagacctcgccgagagaaggcggatacgcagtgcgatcagagaattgcagaggcaagaactggagcgcgaggaggaagctctcgccagcaaaaggttccgtgccgagaggcaggataataaggagaactggttgcacagccaacagagagaggcagagcagcgggcagcgcttgccagattggccggtcagcttgaaagtatgaacgacgtcgaggagcttactgccctccttcgatccgccggagagtacgaagaacgaaagctgattagggccgcaatcaggcgtgtaagggcgcaggagattgaagcagctacactggctggcaggctgtatagtggcaggcctaattcagggtccagggaggactccaaaggcctggccgcacacaggctagaacagtgtgaagtgcccgagagggaggagcaggaacaacaggcagaggttagtaaaccaacccctacacccgaggggacttcacaggatgtaacaaccgtgacacttctgcttcgagccccaccaggcagtaccagctcctcccccgcaagtcccagcagctcacccactcctgcgagccccgaaccccctctcgaaccggctgaagcacagtgccttacagcagaggtgcccggaagccctgaaccgcctcccagcccccctaagaccaccagcccagaaccacaggaaagtcctactctgccttccacagagggccaggtggtcaacaagctgctatctggacctaaggagacccccgctgcgcagtctccgactagggggcctagcgatacaaagagggcagacgtcgctggaccaagaccatgccagcgcagtctgagtgtcctctcgccacggcaaccagcacagaaccgtgagtcaacaccactggcgagtggtccgagcagcttccagcgcgctggctcagtgcgcgaccgggtgcacaaatttacatctgactccccgatggcagccaggcttcaagacggaactccccaggccgctttaagcccgcttactcccgcacggctgctggggccatctctgacttccacgacaccggctagttcgtcatccgggagctcttctagaggacctagcgatacaagcagcagattctcgaaagaacagcgcggtgttgcacaacctctggctcagctgcggtcttgtcctcaagaggaaggtcccaggggccgagggctggctgcccgtccactcgagaacagggccggaggaccggtagcaaggtccgaagagcctggcgcacctttaccagttgctgtgggtacagccgagcccggaggttcaatgaaaacaacattcaccattgagattaaggacgggcgaggtcaagcttccacaggaagagttcttcttccgaccggaaaccaacgggcagagctcacgttgggcctacgcgcaccgccaactttattgtcaacgtcttcggggggaaagtcaacaatcactcgggtcaacagccctggcactctcgccagacttggctcggtgacccatgtgacttcgttctcccatgcaccaccttctagtaggggtggttgcagtataaagatggaagccgagcctgcagaacctctggctgcagctgtagaagcagctaacggcgcagaacagacacgcgtaaataaggcacccgagggacgctcacctctgtccgcggaagagctcatgaccattgaggacgagggcgtactggataagatgttagaccaaagtacagattttgaagagaggaagctcatcagggccgcacttcgagaactaagacagcggaaaagggaccaacgggacaaggagcgcgaacgaaggctacaagaagcgagggggaggcccggagaagggaggggtaataccgctacagaaacaactactcggcactcacaacgcgctgctgacggatccgctgtgtcaacagtaaccaaaacagagcggctggtgcattcgaatgatggcactcgaaccgcccgaaccactaccgtggagtcctcttttgtaagaaggagcgagaatggatcgggctcaacaatgatgcaaaccaagaccttctcgtcttcgagtagttccaaaaagatggggtcaatcttcgatcgagaagatcaggcctccccacgcgctggcagcctcgccgcattagagaaacgccaggctgaaaagaagaaagaacttatgaaggctcagtccctgccaaaaaccagcgccagccaggccagaaaagctatgatcgaaaagctcgagaaggaaggagctgccggatctcctggcggacccagagctgcagttcaaagatcaacaagttttggggttccgaacgccaacagcataaagcaaatgctgctggattggtgcagggcaaaaacgcgcggatatgaacatgtcgatatccagaacttttcctcctcttggagcgacggcatggccttttgtgctcttgtccataatttctttcccgaagctttcgactacggccaactgtctccacagaacaggagacagaactttgaggtagctttttcctctgccgaaacgcatgctgactgtcctcagctgctggacaccgaggatatggtgaggttacgggagccagactggaagtgtgtgtatacttatatccaggaattttataggtgtttggtgcaaaaaggactcgtgaagactaaaaagtcttag

SEQ ID NO: 240831 - DNA, 2754 bp, Artificial Sequence
  Description of Artificial Sequence: Synthetic coding sequence
atggctgatgaagccctcgctggcctggacgaaggagcactgagaaaactgctggaggtcaccgccgacctcgctgaaagacggagaatccggagtgctattcgagaattgcagaggcaagaactggagcgggaagaagaggctctcgccagcaaaaggtttcgtgccgagcgtcaggacaacaaggagaactggttgcattcacaacagcgcgaggcagagcaacgcgcagcgctagccagactggcaggacaactagagagcatgaatgatgtggaagaactcacagccctcctacgttccgcaggcgaatatgaagagcggaagctcattagggcagctataaggagagtgcgcgctcaggaaatcgaggcagccactttggccggtaggctgtactctggtcgtccgaattccggctcacgggaagatagcaaaggcctggcggcacacaggctggaacagtgtgaagtccccgagcgcgaggaacaggaacagcaggccgaagtcagtaagcctaccccaacacccgagggcacttcacaagacgtgacaacggtgactctcttgctcagggcacccccagggtcaacaagctcaagccctgctagtccgtctagctcacccactccagcttctcctgaacccccactcgaaccggcagaggcacagtgtctaaccgctgaagtaccaggtagccccgagccaccaccgagtccgccaaaaacaacatctccggaacctcaggaaagccccaccttgccatccacggagggacaggttgtaaataaactgctgtcagggcctaaggaaacacctgcagcacaatctcctacgcgcggaccctccgacaccaagagggcagatgtggctggcccacggccatgtcaacgatctctgtctgtgcttagtccacggcaaccagcccagaaccgggaatctactcctctggcaagcggaccctcaagcttccagcgagcgggttcggtgcgggatcgggtccataagttcacctccgactcccctatggccgcaaggcttcaggacggaaccccgcaggctgccctcagcccacttacgcctgccaggctccttgggcctagtctcacatcgaccacccctgcctcctcctcttcgggtagctcaagcagaggtccttccgatacatcttctcggttcagtaaagagcagcggggtgttgcccagccattggcacagctgcgaagctgtcctcaagaggagggacccaggggaagaggactcgctgcacggcctctagagaatcgtgctgggggacccgtggctaggtccgaggaacctggtgccccattgccagtcgctgtgggcacagcggagccaggcggaagtatgaagactacctttaccattgagataaaagacgggcgtgggcaggcctcaactggtcgggtgctgctacccaccggcaatcagcgagccgaactcacgttgggtctacgggctcctcccacacttctgagcacctcctcaggcggtaagagcactattactcgggttaactcaccagggaccctggccagactcggtagcgttacacacgttaccagcttcagccatgctccacccagctctcggggaggctgctctatcaaaatggaagctgaacctgcggagcccctggcggcagctgtggaggcggcaaatggtgcggagcagaccagagtcaacaaagctcccgaaggccgtagcccactgtccgcagaggagctgatgaccatcgaagacgagggcgttttggataaaatgctcgatcagagcactgatttcgaagagcgcaagctgatacgagcagctttacgcgagctgcggcaaaggaagagagaccagagagataaggaacgggaaaggaggctgcaggaggcccgtggacggccaggggaaggccgaggcaacaccgccacagagacaaccacgcggcactcgcagcgagccgctgatggatctgcagtcagcacagtaacgaaaactgaacggctcgttcactcgaacgacggcacacgtacagccaggactacaacagtcgaaagctcctttgtgaggcggagtgagaacgggagcggtagtaccatgatgcagacaaaaactttcagctcatcgagcagctcgaagaaaatgggttcaatcttcgacagagaggatcaagcctctccccgagcgggttctctggcagctctggaaaagcggcaggctgagaagaagaaagagcttatgaaggcccagtccctcccaaaaacaagtgcctcacaggctcgcaaggcaatgattgagaaactcgaaaaggagggcgcagccggatctcctggaggcccacgtgccgcagtccagcggtcaacttccttcggcgtgcccaacgcgaactctatcaaacagatgctcctggattggtgccgcgcaaagactcggggatatgagcatgttgacatccaaaacttttcaagtagctggagtgacggtatggctttctgcgcccttgttcataatttcttcccagaggcgttcgactacgggcagctcagtccccagaatagaagacagaatttcgaagtggcattcagcagtgctgagatgctggtggactgcgtccctctagtggaggtggatgatatgatgattatgggaaagaaacccgatcccaaatgcgtgtttacatacgtccagtccctttataaccacctccggcgacacgaactgcgattgaggggtaaaaatgtgtag

SEQ ID NO: 240832 - DNA, 888 bp, Artificial Sequence
  Description of Artificial Sequence: Synthetic coding sequence
atggaggctgagcccgcagagcctcttgccgcagcggtagaagccgctaatggtgccgaacagactcgcgtgaataaagcaccagagggcaggtcacctctgtcagccgaggagctcatgacaattgaggatgagggggtgctggacaagatgctggatcagtccacggacttcgaagagcggaagctcatacgtgctgccctcagagagttgcggcagcggaaacgcgacggtagtggcagcaccatgatgcagacaaaaacgtttagttccagcagctcatctaagaagatgggttccatcttcgatagagaggaccaggcttcgccaagggccggatcgctagcagcacttgaaaaaagacaggcagagaagaaaaaagagctaatgaaggcacagagcctcccaaaaacgtccgctagccaggctcggaaagccatgattgagaaacttgaaaaagagggcgcagcaggctctccgggagggccacgggcagcagtccagaggtctacctcattcggggtccctaacgccaactcgattaagcaaatgctcctggattggtgtcgtgctaaaaccagaggatatgagcacgtggacatccagaatttcagttcctcatggagcgatggcatggccttttgcgctctagtgcacaatttctttccagaggcatttgattacggccaattgagtccccagaatcgaagacagaacttcgaagtggccttcagctccgctgaaacacatgccgattgtccccaacttctagataccgaggacatggtccgcttacgtgagccagactggaaatgtgtgtacacatatatacaggagttctacaggtgtttagtgcagaaaggtttagtaaagacaaagaagagctag

SEQ ID NO: 240833 - DNA, 2817 bp, Artificial Sequence
  Description of Artificial Sequence: Synthetic coding sequence
atgacttgtctctcacaccctttgcaactggaagttacagcggacctagcagagagaagacgaattcgaagcgcaattcgggaacttcagaggcaggaactggagagagaagaggaagcactggcgtccaaacggtttcgcgctgaacggcaggataataaggaaaattggctccacagtcagcagagagaggctgagcagagggcagctctcgcccgtctagccggacaattggagagcatgaatgacgtggaggagctcacagcattactgcgatcagctggggagtacgaggaaaggaagctgatcagggcagccatcagacgcgttcgcgcacaagagattgaagcggcaactctggctggcagattgtattccggaagacccaacagcggttcccgggaagacagcaagggattagctgctcacaggctggagcaatgcgaggtccccgaaagagaggagcaggaacagcaagctgaggtgtctaagccaactccaaccccagagggaacaagccaggacgtgaccacagtcacgctcttgttgcgcgctcctccaggaagcacatcctcaagccccgcttcgccttctagtagtcccacccccgctagccctgaacccccactggaaccggcagaagctcagtgcttaactgccgaggtgcctggcagccccgagccgcctcccagcccaccgaaaaccacttcgcctgagccgcaagaaagtccaacattaccaagtacagagggacaagtcgtcaacaaattgctctcggggccaaaagagacccccgctgcccagagcccaacccgtgggcctagcgacacaaagcgggcagacgtggcaggcccacggccttgtcagagatccctgagtgttctgtccccccgacagcctgcccagaatcgggagagtactcctttagcaagcggcccatccagcttccaaagggcaggatcagttcgggaccgagtgcataaattcacatccgattcaccgatggccgcaaggctgcaggatggcaccccacaagccgctttgagcccattgacacctgccaggctccttggaccaagccttacaagcacaacccccgcaagcagttcatcgggaagttcatcccgaggaccctcagatacatcctcacgcttctccaaggagcaacgcggagtggctcagccgctggcgcagttgcgatcttgtccacaggaagaagggcctcgtggcagagggctagccgcacgaccacttgagaatcgcgctgggggtcccgtggcgagaagcgaggaacccggagcccctctcccagtggcagtgggcaccgcagaacctggcggatccatgaagacgacctttaccatcgaaatcaaggatggacgaggccaggcatccacggggagagtgctgctccccacaggaaatcaacgggctgaactcactcttggacttcgcgctccccctaccctcctgtccacatcttcagggggaaagagcactataactcgtgtgaattcccccggaactctggctcgactcggttccgttacgcatgtgacatccttcagccacgcccctcctagttcacgcggtggttgtagtattaaggcagccgaagacgccggtacccccgttgctcatccccctgcgttctccaccagaagaaggtcctcaaccggcactactcgttctacaagcctcatggaagcagagcccgcagaacccctggcggctgccgtagaggctgccaatggagccgagcagacacgtgtcaacaaggctcccgaaggccgaagtccactctctgccgaggaactgatgaccatcgaagatgaaggcgttctcgataaaatgttagaccagagcactgacttcgaggagaggaaattaattagggccgcactgagagagctgcgacagcggaagcgggatcagcgcgacaaagagagagaaaggaggttgcaggaggcaaggggccgacccggtgagggcagggggaacacagccaccgaaaccacaacgcgtcattctcagcgggcagcggacggctcagctgtgagcaccgtcacaaagacagagcgcctcgtccattcaaatgacggcacacgaaccgccagaactaccacagtcgagtccagcttcgtccggagatctgagaatggcagcgggagcaccatgatgcaaactaagactttttcctctagcagttcttccaagaagatgggtagcatattcgatagagaggaccaagcatcccctagggccggatcccttgctgcacttgagaagcgacaggccgagaaaaagaaggaactcatgaaagcccaatcccttccaaagaccagcgccagccaagccagaaaagctatgattgaaaaattggaaaaggagggtgcggcaggctctcccggagggcctagggccgctgtccagagatctacgtcattcggcgtgcctaatgcaaattcaatcaagcagatgctgctcgattggtgtagggcaaagacgcgaggctatgagcatgtcgatatacaaaacttctcctcttcttggtctgacgggatggctttttgcgctctggtgcacaacttttttcccgaagccttcgactatggtcagctctccccccagaaccgtagacagaattttgaggttgctttctcttctgctgagacacatgcagactgccctcaactcctcgatacagaagatatggtgcgcctccgggaaccagattggaagtgcgtctacacttacattcaggagttctatcggtgtcttgtgcagaaaggactcgtgaagacgaaaaagagttag

SEQ ID NO: 240834 - DNA, 114 bp, Artificial Sequence
  Description of Artificial Sequence: Synthetic coding sequence
atggccgacgaagcactggcagggttagatgagggtgcattgaggaaattgcttgaggtgactgctgatcttgcagagcgtcgacgcattcgcagcgctatccgtgagctttag

SEQ ID NO: 240835 - DNA, 2823 bp, Artificial Sequence
  Description of Artificial Sequence: Synthetic coding sequence
atggccgatgaggccctggccggactcgacgaaggtgccttgagaaagctgcttgaggttacagccgatctcgcagagagaaggcgaataagatccgccattcgggagctccagagacaggagctagaaagggaagaggaagcgctcgcttctaagcgattcagggccgagcgacaagacaacaaggagaattggcttcatagccaacagagggaagccgaacaacgggcagccctggccaggctggccggacagctcgaaagtatgaacgatgtggaggagctcactgccttgctgcgcagcgcgggagagtacgaagaaaggaagctcatcagggccgcaatccgcagggtgagagcacaggagatagaggcagcgacactagccggacggctctactccggacgtccaaattccggttctcgcgaggatagtaagggtcttgccgctcacagactggagcagtgcgaagtgccggaaagagaggagcaggagcagcaggcggaagtgtcgaagcctacacccaccccagagggaacctcacaggatgtcactactgtgacgctccttctgcgcgctcctccaggctccaccagctcctcccccgcaagccccagctcatcccccacccctgccagtccagagccccctttagaaccagctgaggcccagtgccttactgcagaggtccctgggtcaccagaaccccctccatctcccccaaaaacaacctcaccagagccacaagagagtccaaccctaccatccactgaaggtcaggtagttaacaaactgcttagcggccctaaggagacacctgccgctcaaagcccaacacgtggcccttctgacacaaagagggcggacgtcgctggaccgagaccctgtcagagatccctttctgtcctctccccaaggcaaccagcgcagaaccgggagtccaccccgctggcgagcggtccgtccagtttccaacgcgctggatcagtccgagatcgggtgcacaaatttacttccgatagccccatggccgcacgactacaggacggtacccctcaagctgctttgagcccgctcactccagccagacttcttgggccatccctcacttcaaccacccctgcatcttcctcatcaggaagttctagccgagggccatccgacacctccagcagattcagtaaggagcagcgaggcgtggctcagccactggctcagttgagatcgtgcccacaggaggaagggcctcgcggtcggggactcgcagccaggcctctagaaaacagagccggtggacccgtcgcgcgttctgaggagcctggcgcacctctgcccgtcgcggtcggtaccgccgagcccggtggctccatgaaaactacctttacgattgaaattaaagacggaagagggcaggcttcaactggaagagtgctccttccaacagggaatcagcgagcggagctcactctgggccttagggcaccccctactcttctgagtacatccagcggagggaagtccacaatcactagggtaaattctcctggcactttagccaggcttggttccgttactcacgtgaccagcttttcacacgctccaccatcttccagaggcggttgctccattaagatggaagcagagcctgcggaaccgctggctgctgctgttgaggccgcaaatggtgccgaacagacccgggttaacaaagcccctgaaggcaggagtcctcttagtgctgaagaattgatgacaatcgaggacgagggtgttctggacaaaatgctggatcagagcactgactttgaggagaggaaactgatccgcgcagctctgcgagagctgagacagcggaaaagggatcagcgggacaaggaaagggaacgacggttgcaggaggctaggggaagacccggtgagggtcgaggcaacacagcaacagaaactacgacccgccattcacagcgcgcagccgatggctccgcagtttccactgtcactaaaactgagcggttagttcactcaaacgatgggacaagaacagcaaggacaacgaccgttgaaagtagtttcgtgagacgatctgagaacgggtcgggctcaacaatgatgcagaccaaaactttctcctcctcctcttcgagcaaaaagatgggtagcatcttcgatcgagaagaccaggcctcacctagggccggaagcttagctgccctggaaaagagacaggcagaaaagaagaaagagctgatgaaagcgcagagccttcctaagacaagcgctagccaggcgcgaaaggcaatgatagaaaagctggaaaaggagggcgctgcaggatcacctggcggtcccagggcagccgtgcagagatccaccagctttggtgtgcccaacgcgaatagcatcaagcagatgttgcttgattggtgtcgtgccaaaacaaggggatatgaacacgtcgacatccagaatttcagctcctcctggtccgatggcatggctttctgtgctttggtgcacaattttttccctgaggcgtttgattacggacagctttcaccccagaaccgtagacagaacttcgaagttgcgttttcaagcgccgaaacgcacgctgattgcccgcagctgctcgacactgaagacatggtgcggctccgcgagcccgactggaaaatgttagttgattgcgtgcccctggtggaggtggacgatatgatgataatgggaaagaagcctgaccctaaatgtgtctttacctacgtccagtcactgtacaaccacctccggagacatgagctgagattaagaggtaaaaacgtttag

SEQ ID NO: 240836 - DNA, 1374 bp, Artificial Sequence
  Description of Artificial Sequence: Synthetic coding sequence
atggagcagaaagagggaaagctgtctgaagatggcaccaccgttagccccgcagcagacaaccctgaaatgagtgggggaggcgctcctgctgaagaaaccaagggcactgccggaaaggctataaatgaaggacctcctacggaaagtggcaagcaggagaaggcccctgccgaggatgggatgtctgctgaattacagggcgaagcaaatggtcttgacgaggttaaagtagaatcccagcgggaagccggaggaaaggaagacgctgaagcggagctgaagaaagaggacggcgaaaaggaagaaacaactgtgggctcccaggagatgacgggacgcaaggaggagacaaagtcggaaccaaaggaggctgaggaaaaagaaagtacgttggcctctgaaaagcaaaaggccgaggaaaaagaggccaaacctgagtccggacagaaggcagatgcaaatgatagagacaaaccggagccaaaagcgactgtcgaggaggaagacgccaagacagcctcgcaagaggagacagtcgtggaggacgaagcaaaggcggaacccaaagaaccggatgggaaagaggaggccaaacacggtgccaaggaagaggccgatgaaccaggctctccttcggaggaacaggaacaggatgttgagaaggaacctgaaggtggagcgggtgtgatcccttcttcacctgaggagtggccggagagccccactggggaggggcacaacctctctacggatggccttggacccgattgtgttgcttccggccagacaagtccttctgcctccgaatccagcccctccgacgtcccccagtctccacccgagtccccatcgagcggcgaaaagaaggagaaggctccagagaggagggtttcagccccagctagaccacgcggacccagagcccagaatcgcaaggcaatagtggacaaatttgggggtgcggcaagcggaccaactgctctgtttagaaacacaaaggctgccggtgcggcaattggcggtgtgaagaatatgctcctcgagtggtgtagggccatgacaaagaagtatgaacatgtggatatccagaactttagtagctcatggtcaagcgggatggctttttgcgccctcattcacaaattttttcctgatgcatttgattatgccgagctggatcccgctaaacgacggcacaactttaccctggccttctcaactgctgagaagctggccgactgtgcacagctacttgacgtggacgatatggttcgtttggctgtccctgattcaaagtgcgtgtacacatacatccaggagctgtataggtccctcgttcaaaaaggcctggtgaagaccaaaaaaaaatag

SEQ ID NO: 240837 - DNA, 1539 bp, Artificial Sequence
  Description of Artificial Sequence: Synthetic coding sequence
atgctgcccggagctgtgggtgagagtgattgctcagcggaggcccgagagaaaatggagcagaaagagggcaaactgtctgaggatggcactactgtatcccctgcagccgataatcctgaaatgtccgggggaggagcacctgccgaagagaccaagggaactgccggtaaagccatcaacgagggccctccaacggagtctgggaagcaagaaaaggcccctgctgaggatggtatgtctgctgagctccagggtgaggccaacggattggacgaagtgaaagttgagtctcaacgagaagcgggaggtaaggaagatgctgaagctgaactaaagaaggaggatggggaaaaagaagaaaccactgtggggtcgcaggagatgacggggcgaaaggaagagactaaatctgagcctaaggaagccgaggagaaagaatcgacactcgcttccgaaaagcagaaagccgaggagaaggaggctaaaccagaaagcggacagaaagccgatgctaacgacagagacaaacccgagccgaaagcaacagtagaagaagaggacgctaaaacagcttctcaagaggagactggacagcgaaaagagtgtagtacagaacccaaagaaaaagcaacagatgaagaagccaaggctgagtcccaaaaagcagttgtggaggatgaggccaaagccgaacctaaagagcccgacggaaaagaagaggcaaagcacggtgcaaaggaggaagcggacgctaaggaggaggcagaggacgctgaagaagccgagccaggcagccctagtgaggagcaagaacaggacgtagaaaaggaacccgagggaggtgctggagtcataccctcctcgcctgaagaatggcctgagtcacccactggcgagggtcacaatctttcaactgatggcctgggaccagattgtgtcgctagtggacagacttcccctagcgcttctgagtcctcaccatctgacgttcctcagtctcctccggagagcccctcaagcggcgagaagaaagagaaagcacccgaaaggagagtgagcgccccagccaggcctcggggacctcgtgcccagaatcggaaagctattgtggacaagttcggcggagccgcatcgggtcccaccgcacttttcaggaacacgaaagctgccggtgcagccatcgggggagtaaagaacatgcttctggagtggtgcagagcaatgaccaaaaaatacgaacacgtcgatattcagaattttagctctagttggagttctggaatggcgttttgcgcactgatccataagtttttccccgatgcgttcgactacgctgagctggacccagccaaacgtcggcacaacttcacacttgccttctctacagcggagaagttggctgactgcgcacagctgctggacgtggatgacatggtgcggctagcagtcccagactccaagtgcgtctatacctatatccaggaactctatagatccctggttcagaaaggcctggtcaagaccaagaagaaatag

SEQ ID NO: 240838 - DNA, 1485 bp, Artificial Sequence
  Description of Artificial Sequence: Synthetic coding sequence
atggagcaaaaggagggcaagctgtctgaggatggcaccactgtatctcctgccgcagataatcccgagatgtctgggggaggcgcacctgcagaggagaccaaaggtactgccggaaaggccataaacgaggggcctcccaccgaaagcgggaaacaggagaaagctccagccgaagatggcatgtcagccgagctgcagggcgaagccaacggactggatgaggtcaaggttgagtctcagagggaggctgggggtaaagaggatgccgaggccgagctgaaaaaggaagacggcgagaaggaggaaaccacagtgggctcccaggaaatgactggaaggaaggaggagacgaagagtgagccgaaggaggccgaggaaaaggaatctaccttagcctcagagaaacaaaaagccgaagagaaagaggccaagcctgagagcggacagaaagctgatgccaatgatcgagacaagccagaaccaaaggccacagttgaagaggaagatgcaaaaactgccagtcaagaagaaaccggccagcgcaaggagtgtagcacagagccaaaggagaaagcgacggacgaggaggcaaaagccgagagtcagaaagctgttgtggaggacgaggccaaggcagaacctaaagagccagatggaaaagaggaagcaaaacacggtgctaaggaggaggctgatgccaaggaggaggcagaagacgcggaggaagctgaaccgggaagcccatcagaagaacaggaacaggacgtcgagaaggaacccgaaggcggtgccggtgtgatacctagttctcccgaggaatggcccgagtccccaaccggcgaaggacacaacctgtcgacagatggtctgggtcctgactgtgtcgcatctgggcagaccagtccctcagcttcggaaagctcacctagcgatgtgccacagtctccgccagaatctccatcttctggcgagaagaaggaaaaagctcctgagaggcgggtatccgccccagcacgacccagaggaccgcgagcgcagaatcggaaggccattgtggacaaatttggcggtgccgcttccggccctacggctctcttccgcaatactaaggccgctggagccgcaatcgggggagtgaagaatatgctgctggaatggtgcagggcaatgactaaaaagtatgagcatgtcgacatccagaattttagcagctcatggagcagcggcatggccttttgcgctctgattcataagttctttccagacgcctttgactacgctgagctcgatcccgcaaagcgcagacataattttaccttggcattttcaaccgcagaaaaactcgcagactgcgctcagctcctggacgtcgacgatatggtcaggctggccgtgcctgattctaaatgcgtgtacacctacatacaggagctgtatcgatccctggtacagaagggtctggtcaagactaagaaaaaatag

SEQ ID NO: 240839 - DNA, 312 bp, Artificial Sequence
  Description of Artificial Sequence: Synthetic coding sequence
atgagtgaagaaaagcccaaggagggcgtgaagacagaaaacgatcacattaacctgaaagtggcagggcaggatggcagtgtagttcagttcaagattaaacgccacacacccctgagcaaactcatgaaagcctactgtgagcgccaaggattatctatgagacagattagattccggttcgacggccagccaatcaatgagaccgataccccagctcagctggaaatggaagatgaggacacgatcgacgtttttcaacagcagaccggaggagtcccagagagctccctggcaggacatagcttctag

SEQ ID NO: 240840 - DNA, 426 bp, Artificial Sequence
  Description of Artificial Sequence: Synthetic coding sequence
atgtcagaggaaaagcctaaagagggcgtgaagaccgaaaatgatcacatcaatttaaaggtggcgggtcaggatggctccgttgtgcagtttaaaatcaagcggcacacccctttgtccaaactcatgaaggcttattgtgagcgacaggttagacatctcgctcctccacagtccctccccgtgtgcgctctggtcttgtgcgtacctggcatacccagggccagggctagtagggggtggacacaaatgcagctgcccgagggtttgtccatgaggcaaattcggttccgctttgatggccaacccattaatgagaccgacacacctgctcagctggagatggaggacgaagacactatcgatgtatttcagcagcagacaggcggagtgcctgaatcttccttagctggtcattccttctag

SEQ ID NO: 240841 - DNA, 288 bp, Artificial Sequence
  Description of Artificial Sequence: Synthetic coding sequence
atggccaacgagaaaccgacggaggaggtgaaaacagaaaacaacaatcacatcaacctcaaggtcgcaggccaggacggttctgtagtgcagtttaagatcaagagacagaccccactgtcgaagctgatgaaagcgtattgtgagcccaggggtctgtctgttaagcagatcagattccggttcggaggccagcccatttccggtacagacaagccagcacagctcgaaatggaagacgaagacacaatagatgtgttccagcagcctaccggaggcgtttattag

SEQ ID NO: 240842 - DNA, 411 bp, Artificial Sequence
  Description of Artificial Sequence: Synthetic coding sequence
atggcgggagccggaagcgctgccgtatccggagcaggaacacctgtggccggtccaacgggcagagatctcttcgcagagggactcctcgaatttctgcgacctgccgttcagcagctcgattcccacgtgcatgctgtgcgggaatcgcaggtcgagttgcgagagcagatcgacaatcttgcaaccgaattgtgcagaattaatgaggatcagaaagtcgccctagatcttgacccatatgttaagaaactcctgaacgcaagaaggcgcgtggtacttgtcaacaatatcctacagaatgcccaggagagactcagaagacttaatcacagcgtggccaaggagactgcccgacggagggctatgctcgattctggcatctatccccctggtagcccaggcaaatag

SEQ ID NO: 240843 - DNA, 2298 bp, Artificial Sequence
  Description of Artificial Sequence: Synthetic coding sequence
atggccggattcaaacgtggttacgacggaaagatcgccggtttgtacgacctggacaaaacactaggcagaggtcattttgccgtggtcaagctcgctcggcacgtcttcactggcgaaaaggtggccgtaaaggtgatcgacaagactaagttagatacgttagcaaccggccacctatttcaagaagtgaggtgtatgaaactcgtgcagcatccaaacatagtgaggctctacgaggtgatcgatacccaaaccaaactttaccttattctggagcttggggacggcggtgacatgttcgactacatcatgaaacatgaggaaggtctgaatgaagacttggctaagaagtattttgctcagattgtgcatgcaataagctactgtcacaaactccatgtcgtacatagggaccttaaaccagagaacgtggtgttcttcgagaaacaagggcttgtgaaactaactgacttcgggttctcaaacaaatttcagcccggaaagaaactgaccactagttgtggatccctggcctactccgccccagagattctattaggcgatgaatacgatgcacctgcagttgatatttggagcctgggggtgatactatttatgttggtgtgcggccagccaccatttcaggaagccaatgactccgaaactctgacgatgattatggattgcaagtacacagtcccaagtcatgtgtcaaaggagtgcaaggatttgatcacccgcatgctccagcgggatcctaagcgacgcgcttcactggaagagatcgaaaatcacccgtggctgcagggagttgatccctcaccagcaactaagtacaatatccccctggtttcatacaaaaatctgagcgaggaggaacataactccattatccagcggatggtcttgggcgatattgccgatagagacgcgattgtcgaggctctggagacaaacaggtataaccatatcaccgctacatatttcctactagcagaaagaatcttgcgggaaaagcaggaaaaggaaattcagactcgctctgcctcaccgtctaatattaaagcccagttcaggcagtcttggccaacaaagatagatgtgccccaagacctcgaggatgatttaacagcaacaccactgtcgcatgctaccgtgcctcagtcacctgctcgggcagcggactctgtgctgaacggccatcggagcaaggggctgtgcgattcggcaaagaaagatgacctcccagagctagctgggcctgccctgagtacagttcctcccgcatcacttaaaccgacagccagcgggagaaagtgcctgttccgggtggaagaagacgaagaggaggacgaagaggacaaaaaaccaatgtccctatccactcaggtcgtactgcgtaggaagccaagcgtcacgaacagattgaccagtaggaagtcagcaccggtcttgaatcaaatttttgaggagggggaatccgacgacgagttcgatatggacgagaaccttcctcctaaacttagtcgcttgaaaatgaacatcgcctcccctggtacggttcacaaacgttaccaccgccgaaagtcccaaggaaggggctcatcctgctcttcgagcgaaacttctgatgacgactcggaaagtcggaggagacttgataaggattccggcttcacgtatagttggcaccgcagagactcaagtgagggcccaccgggttcggaaggcgatgggggaggccaaagcaagcccagcaatgccagcggtggagttgataaagcttcgccctcagaaaacaacgccggaggaggctcaccttctagcgggtccggcggaaacccaactaacacctcaggtacaacccgacgctgtgctgggccatctaacagtatgcagttggctagccgaagtgcaggggagctggtcgaaagcttaaaactcatgtctctctgcctgggaagtcagctgcacggtagtaccaaatacatcattgacccccagaacggcttatccttttcttctgtcaaggtacaggagaaaagcacatggaagatgtgtatttcctctactggaaatgccggacaagtaccagccgtgggagggatcaaatttttctcagatcatatggccgatacaaccaccgagctggagcggattaaatcaaagaacttgaagaataatgtgctccagctgccactgtgtgaaaaaacgatttctgttaatatccagcggaacccgaaagagggactcttatgtgctagctcccccgcttcgtgttgccatgttatctag

SEQ ID NO: 240844 - DNA, 2298 bp, Artificial Sequence
  Description of Artificial Sequence: Synthetic coding sequence
atggccggattcaaaagaggctatgacggaaagattgctggcttgtacgaccttgacaagacacttgggagagggcactttgcagttgttaaattagccaggcacgtcttcacgggggaaaaggttgctgtgaaggtgattgataaaaccaagctcgacacactggcaactggtcaccttttccaagaagtcaggtgtatgaagttagtgcagcatccaaatattgtgagactttacgaggttattgacacccagactaagctctacctgatcctcgagcttggcgatggaggagacatgttcgattacataatgaagcatgaagagggactgaatgaggatctggccaaaaagtactttgcccagatagtgcacgccatatcttattgtcataaacttcatgtagtacacagggacctgaagcccgaaaatgtggtttttttcgaaaagcaaggtctggtgaagctcactgactttggattttcgaacaaattccagcccggaaaaaagcttaccacatcatgcgggtctctcgcctactccgccccagagattctcctgggcgatgaatacgacgcccctgcagtagacatttggtccttaggcgttattctgtttatgttggtctgcggccagccacccttccaagaagccaacgactctgagaccttgactatgatcatggactgtaaatacactgtgccttcacatgtctcaaaagagtgtaaagatctgatcacgcgcatgctgcagagggatccgaagaggagagcttcactggaggaaattgagaaccacccatggctgcaaggcgtggacccctcccctgcaacaaagtacaatatacctctggtgtcctataagaacctgtccgaagaagagcataattctattatccagcgcatggtgcttggcgacatcgcggatcgcgacgctatcgtggaggccctcgagacaaaccgctacaatcacattactgccacctacttcctgctagctgagcgtattctgcgtgagaagcaggagaaggaaattcaaacacggtctgccagcccttctaacataaaagctcagttcaggcaatcttggcccaccaaaatcgacgtgccacaggaccttgaggatgatctgactgccacccccctgagccatgcgacggttccccaaagcccagctcgtgccgctgatagtgttctgaatggacaccgtagcaaaggcctttgcgacagcgcgaagaaggacgacttgcccgagttagcaggaccagctctctctaccgttccaccggctagtttgaagcctacagcgtccggcagaaagtgtctgtttcgggtggaggaagacgaggaagaggacgaagaggataaaaaacctatgtccttgagtacccaggttgtgctgcgccgaaaaccttcagtgacaaataggctgacgtctaggaagtctgcccctgtgttgaatcaaatcttcgaagagggagagagcgacgacgagtttgatatggatgaaaaccttccccctaaactctctcgcctcaagatgaatatcgcctctcctggaacggtgcacaaaagataccatcgcagaaagtcccaggggagaggctccagctgtagctccagcgaaacctctgatgacgactctgagagtaggagaaggctagataaagacagtgggttcacttatagctggcataggagagactcttcagaaggtccacctgggtcggaaggcgacggcggtggccagtccaagccaagcaatgcaagtggaggggtagataaggcttcaccatctgagaataacgccggaggcggaagcccatcatcgggatcgggtggtaacccaaccaacacgtccggtactactagaaggtgcgccggtccctctaacagcatgcagctcgctagtcggagtgctggagaattggtcgagagccttaaactcatgagtctctgcctgggctctcagttgcacgggtccacaaaatacattattgacccccagaatggcctgtctttctcgtcagtaaaggtgcaggaaaaatccacctggaaaatgtgtatcagctctacaggcaatgccggacaggtgcctgccgtgggcggtattaaatttttctccgaccacatggccgatacgactacagaactggaacgcattaaaagtaaaaaccttaagaacaatgtacttcagctgccattatgtgagaagaccatttccgttaacatccaaagaaacccgaaagaaggcttgctctgtgctagttcccccgcatcttgttgccatgtcatctag

SEQ ID NO: 240845 - DNA, 2298 bp, Artificial Sequence
  Description of Artificial Sequence: Synthetic coding sequence
atggctgggttcaaacgcggatacgacgggaaaattgctggcctgtacgatctggataagacactgggcagaggtcacttcgcggtagtaaagctggctcgccatgttttcactggcgagaaagtcgctgtgaaagtgatcgacaagacaaagctagacaccctggcgaccggccacctttttcaggaggtgcgatgcatgaagctggtacagcacccgaacatcgtgagactctacgaggtgatagatacccagacaaaactgtacctgatactcgaactgggtgacggcggtgacatgttcgactacatcatgaagcacgaagagggccttaatgaagacttggctaagaagtatttcgcccagatcgtacacgccatttcctattgccataagctccacgtggtgcaccgtgacctgaaaccagagaatgttgtttttttcgagaagcaaggcctggtgaaacttacagacttcggcttttcaaacaaatttcagcccggtaagaaacttactacctcctgcgggagcctggcctacagtgcccctgaaatcctcctgggagacgagtatgatgctccggctgtcgacatctggtcacttggcgtgatcctcttcatgcttgtgtgcggacagcccccatttcaggaggcaaacgactcagagacacttacaatgattatggactgtaaatatactgttccttcacacgtgagcaaagaatgtaaggaccttatcaccagaatgctgcaaagggacccaaaaagacgcgcatcactggaggagattgagaatcatccctggttgcagggtgtcgatccctcacctgcaacaaagtacaatatccctctggtgtcttacaagaatctgtccgaagaggagcataatagcatcatccaacggatggtcctaggagacatcgccgacagagacgcaatcgttgaagctttggaaaccaatcggtataaccacattactgccacttacttcctcttggcagaaagaatcttgcgagagaagcaagaaaaggaaattcagacgcgaagcgctagccccagcaacattaaagcgcaatttcggcagagctggcccacaaaaatcgatgtgcctcaggacctcgaggatgatcttacagccacgccgctatcacatgcaactgttccacagagccctgctagggcagctgactcagtcctgaatgggcatcgctcaaaaggcctatgtgactcagccaagaaggatgacctgcctgaactcgcaggaccagctctgtcgaccgtgcccccagccagcctgaagcctactgcatccggacggaagtgtctgttcagagttgaggaagacgaagaagaagacgaagaggacaaaaagcctatgtctctgagcacccaggtggtgctgcgccgaaagccctctgtgaccaaccgactaacctcaaggaaatcggcacctgtactgaaccagattttcgaagagggggagtcagacgacgaatttgatatggacgaaaaccttcctcctaagttaagtaggctaaagatgaacattgcctcccctggaaccgtccacaaaaggtaccatcgaagaaagtcgcaggggcgtggctcttcctgctcctcttctgagacctccgacgacgactctgaaagtcggcgacgccttgacaaagatagcggtttcacttactcgtggcacagacgagacagtagcgaggggccacctgggtctgagggcgacggaggcggacagtctaaaccatccaatgcatctggtggcgtggataaggcaagcccatccgaaaacaatgcaggagggggatcaccttccagcggtagcgggggaaatccaactaatactagcggcactacaaggcgatgcgccggaccttcaaatagcatgcagcttgcgtcaagatcagctggagagctggttgagtcactgaaattgatgagcctctgcttaggctcccagctgcacggctcgactaaatacatcatagatccccagaacggtctatccttctcatccgttaaagttcaggagaagagtacgtggaagatgtgcatcagcagcaccgggaatgccggtcaggtgccagccgtcgggggaataaagttttttagtgaccatatggctgacaccaccaccgagctggagcggatcaaatccaagaatcttaagaataacgtcctgcagttacccctgtgcgagaaaactatatctgttaatatccaaagaaaccccaaagagggtctgttatgcgccagcagtccggctagttgctgtcacgtgatctag

SEQ ID NO: 240846 - DNA, 9693 bp, Artificial Sequence
  Description of Artificial Sequence: Synthetic coding sequence
atgcagtcttccccaagtcctgcccacccacaactgcccgtattgcagacgcagatggtcagcgacggcatgaccgggtctaaccctgtatcccctgcttctagtagctcaccggcttcatccggcgcagggggtatttccccacagcacattgctcaagactcttccctcgatgggcctccgggaccacccgacggagcgaccgtgccactggagggctttagcctttcccaggcggcagacctggccaataaggggccaaagtgggagaaatctcatgccgagatcgccgagcaggccaaacacgaagccgaaattgaaactcggatcgccgagctcaggaaggaggggttctggtcattgaaaagactgcccaaggtgcccgagcctccccgaccaaaaggacactgggattacctttgtgaagagatgcagtggctatctgccgacttcgctcaggaacgccgatggaaaaggggagtcgcgcgtaaagtggtcagaatggtgatccgccaccatgaggagcagaggcagaaagaggagcgagcccgtcgtgaggagcaggcaaagctcagacgcattgcttctacgatggctaaagatgttcgacagttctggagcaacgtggagaaagtggtgcaattcaagcaacagagtcgcctcgaagagaagcgcaagaaagcacttgatctgcaccttgactttatagtgggtcaaactgagaagtacagcgatttgttgtctcagagcttaaaccagccgcttacatcaagcaaggccggatcaagtccttgcctgggttcttcaagcgccgcatcatctccgcctcctccagctagcagactggatgatgaggatggcgacttccaacctcaagaggacgaagaggaggatgacgaagaaaccatcgaggtggaggagcagcaggagggaaatgacgcggaggcgcagaggagggaaattgaactcctccggagagaaggcgagctgccgttggaagaactcttacgcagcctacctccacagctgctcgagggaccctcttctccctctcagacgccatcgagccatgacagcgataccagggacggtcccgaagagggcgcagaagaggaaccgcctcaagtcttagagatcaaacccccaccaagcgctgtaacccaaaggaataagcagccttggcatcccgatgaggacgatgaggaatttacagccaacgaagaggaggctgaggacgaggaggataccatcgcagccgaagaacagttagaaggcgaggtggatcacgcaatggagctgtcggagttggctcgtgaaggcgaattgagtatggaagaactcttgcagcagtacgctggcgcttatgcgccaggcagtgggagttctgaagacgaagatgaggacgaagtcgatgctaattcatccgactgcgagcccgaggggcctgttgaggccgaagagccacctcaggaagattccagcagccagagtgactcagtggaggatcggtctgaagacgaagaagatgaacattcagaggaagaggaaacgtctggaagctctgccagcgaagagagcgagtccgaggaatcagaagacgcccagtcacagtcccaagccgatgaggaggaagaagatgacgattttggggtggaatacctgctggccagagatgaggagcagtctgaggcggacgctgggtccggcccacccacgcctggtccaaccacccttggccctaaaaaggagatcaccgacatcgcagccgctgcagaatcgctgcagcccaagggctacacattggctactactcaggtgaagacccctatcccgctgctgctccgtggccagttacgagagtaccagcacataggcctggattggctggttaccatgtacgaaaagaaactgaacggaatacttgccgatgagatgggcctgggaaagaccatccaaactatctctctcctggctcatctcgcatgcgagaaaggtaattggggtccgcacttaatcattgtgcctaccagcgtgatgctgaactgggagatggagctgaaaagatggtgcccttctttcaagattctgacatactacggagctcagaaggagcggaaactgaaacggcagggttggaccaagcctaatgcctttcatgtgtgtataacgtcgtataaactggtgttgcaggatcaccaagcattcagaagaaaaaattggagatacttgatattggacgaagctcagaacatcaagaattttaaatcgcagcggtggcagtcactcttgaattttaactcacaaagacgcctgcttcttaccggcacaccactccaaaactccctcatggagctgtggtccctcatgcatttcctgatgccacatgtgtttcaatcgcatcgtgaatttaaggaatggtttagtaaccctctcactggcatgattgagggctcccaggaatataacgagggattggttaagaggctgcataaggtgctaaggccttttttgctgaggcgggtcaaagttgacgtggagaagcagatgcccaaaaagtacgagcatgtgatccggtgtaggctctctaaaagacagcggtgcctatacgacgactttatggcacaaaccacgactaaggagaccctggcaactggccacttcatgagcgtcataaacatactgatgcagctgcggaaagtctgtaaccatccaaacctcttcgatccacggccagtaaccagcccctttatcacccctggcatttgtttttctaccgcctctttagtcttgagagcgaccgatgtacacccccttcagaggatcgacatgggtagattcgacttaatcgggctggaaggtcgtgtcagtagatatgaggccgataccttcttgcctaggcaccgacttagccgccgagtgctgctggaagtggccaccgccccagaccccccacctcggccaaaacctgttaagatgaaagtgaacaggatgctacaacctgtgccaaaacaggaagggaggacggtagtggtcgtcaataacccacgggctcctctgggcccagtaccagtcagacccccacccggacctgaactgagcgctcagccaactcccggtccagtccctcaagttttgcctgcctctttgatggtcagtgcctcccccgctggacctccgctgattcccgctagtcgaccccctgggccagttctgctgccaccgctacagcctaatagcgggtctctgccacaggtgctcccttctcctctcggtgtgctgtcaggtacatctcggcctcccaccccgaccctgagcctgaagcccacacccccagcgcctgtgcgtctctccccagcacccccacctggcagttctagccttctgaagcccttgactgtgccgcctggctatacctttcccccagccgctgctaccaccacctccacgacgaccgccactgctacaaccacagccgtgccagctcccactcccgctccacagcgcctcattctgtctcctgacatgcaggcgagacttccgagtggcgaagttgtgtcgattggacagctagcctccctggcacagaggccagtggcaaatgcaggcggaagtaagcccctgacgtttcagatccaaggcaacaagctgaccttgacgggtgcccaggtgagacagctggcagtgggccagccaaggccactgcagaggaatgtcgtgcacctggtttctgcgggagggcagcatcacctgatctctcagcctgcgcacgtggctctgatacaggctgtggcccctacaccaggccctactcccgtgagcgtgctgccttcatccaccccctccacaactcctgcaccaaccggcctgtccttgccactggcagcaaaccaggtgcctcccactatggtcaacaatacaggcgtcgtcaagattgtagtccggcaagctcccagagatggacttacgcccgtgcctcctctggctccagccccaaggccaccgagctcaggactgccggctgtgctaaatcctcgacccacactgactcctgggcgtttgccgacacctactctgggcacagccagggcccctatgccaactcctaccctagttcgcccacttctgaaactggtccacagtccgtccccagaggtgtcagctagtgctccaggtgcagcacccttgaccatttcctctcccctgcacgtgccttctagtctgcctggacctgctagttcccccatgcctatccctaatagttcaccactcgcctctcccgtgagtagcacagtcagcgttccactgagctcaagcctgcccatcagcgtgccaacgaccctgcccgcacccgcttcagctcccctgacgatccctattagtgctccacttacagtctccgccagcgggcctgctttgctcaccagtgtaacgccacctctcgcacccgttgtccccgcagcccctgggcctcctagtttggctccatcgggtgcttcacctagcgcttccgcccttacactaggcctcgctacagccccttcattgagttcctctcagactccagggcacccgctgttgcttgctcccaccagctcccacgttccaggattgaatagtacagtagcccctgcctgctctcctgttctggtaccagcatctgcactcgcttccccctttccaagtgcccctaacccagcaccagcccaggcttccttgttagcgccagcttcatcggcttcccaagccctggctactccattggctcctatggcggcaccacagaccgccattttggcaccaagcccagcccctcccctggccccacttccagtgcttgcaccctcgcctggggcagccccagtgctggcctcttctcagactcctgtgcccgtgatggcaccaagtagcactcctggaaccagtctcgccagcgcgtctccggttccagcacctacccctgttttggcacccagctccactcaaaccatgctcccagctcccgtcccttcccctctgccaagtccggcatccactcagactctggctctagccccagcactcgcccctacattgggcggatcaagcccaagtcagactctgagcctgggcacgggtaatcctcaaggacccttccccactcagaccctttctctcacacccgcttcttcactggtgcccacgcctgcccaaacactttcacttgctccaggaccaccgctaggccctactcagacactgtcactggctcctgcccctccgctcgcccctgcctcccccgtcgggccagccccagctcacaccctcaccctcgccccagcctcctcaagcgcgtcactcctggcgcctgccagcgtccagactctgacgttgtcacccgctcccgttccaaccttgggcccagccgcagcccagacactcgccctagctccggcttccacccagtcgccagcttcccaggcttcctctctcgtggtgtctgcgtctggggctgctcccttacccgtaaccatggtgtcaagactgcccgtgtcaaaggacgaaccggatacactcactctcagaagcgggccaccctccccaccaagtacggcaacaagctttgggggtcctcggcctcggagacagccccctccgcctccccgatctcctttctacctcgactcgctggaggagaaaaggaaacgccaaagatctgaacgcctcgagcgcatatttcagctgagcgaggcacacggcgctcttgcacctgtatatggtaccgaggtgctggacttttgcactctcccacaacccgtagctagtcccatcggacctaggtcacccggaccaagtcacccaaccttttggacgtatactgaggccgctcaccgcgctgtgcttttccctcagcaacgtctcgaccagttatcggaaatcatcgagaggttcatctttgtcatgcccccagtcgaggcccctcccccttcactgcacgcctgtcatccccctccctggcttgcccctaggcaggctgcatttcaagagcagctcgcatccgaactctggcccagagcaaggcctcttcatagaattgtgtgtaatatgcggactcagtttcccgaccttcggctgatccaatatgactgcgggaaactgcagactctggccgtgttgttacggcagctgaaagctgagggtcacagagttcttattttcacccaaatgactcggatgttggacgtgctggagcaattccttacttaccacgggcatctgtatctacggttagacgggtcgactcgggtggagcagcgccaggccctgatggaacggttcaatgcggataaacgtatcttttgcttcattctgagcactagatctgggggagtaggcgtgaatctaaccggagcagacaccgttgtcttctacgatagcgactggaacccgaccatggatgcccaagcacaggatagatgtcaccgtattgggcagactagagacgtgcatatctaccgattgatttccgaaaggactgtggaggagaacatccttaagaaggctaaccagaaacgcatgttgggcgacatggcaattgaggggggaaactttaccacggcctacttcaagcagcaaactattcgggaactgttcgatatgcccctggaggagccctcctcgagctcagtgccctctgccccagaggaggaagaggaaactgtagcctccaaacagacacatatcttggaacaggcgctgtgccgggctgaggacgaggaggatattcgagctgcgacccaggcaaaagcagagcaggttgcagaactggccgaatttaatgagaatgatggatttcctgcaggggagggtgaagaagccggtaggcccggagccgaggatgaggagatgtcccgggctgaacaggagattgccgcactggtcgaacaactcactcctatcgaaaggtatgcaatgaagttcttagaggcctccctagaagaggtgtccagagaagaactgaaacaggccgaagaacaggtggaagcagcaaggaaagaccttgatcaggctaaggaagaggtttttcggttgcctcaagaggaagaggaaggccctggtgctggggacgagtcctcttgcggcacaggtgggggaacacaccgacgatcaaagaaagctaaagcccctgaacggccaggcacaagagtcagcgaaaggctgcggggagctagagctgaaactcagggggctaaccacacaccggtgatctcggcgcaccagactagatctacaaccacaccccctcggtgctcacccgctcgtgaacgggtgcctagacctgcacccagaccacgacctaccccagcgtccgccccagcggctatacctgcactcgtccctgtccctgtttcagcacctgtacctatctccgctccaaaccccataactatcctgcctgtccacattctgccctctccgcctccaccttcacaaattcccccttgcagcagccccgcttgcacccctccccctgcctgtacacctccacccgctcacacccccccacctgctcagacctgtcttgtcacacccagctcccccctgttgcttggtccaccctccgtgcccattagcgcctcagtgactaacctccctctgggcttgagaccagaggccgaactctgcgcccaggcactggcttcgccagaaagcctggaattagcgtccgttgcctcttcagagacgtccagcctgtccctcgtgcctcctaaagacttactccctgtggccgtggagattctgcctgtgagcgaaaaaaacctgagcctgaccccttccgcgcctagtctcactcttgaagccggttccatccccaacgggcaagagcaggaggccccagacagcgcagaaggaactacactgacggtgctgccagagggcgaggaactccctctttgcgtttctgagagtaacggccttgaattaccgcctagtgctgcatcagatgagcccctacaggaaccactggaagccgatcgtactagcgaagaacttacagaggctaagaccccaacctctagccccgaaaagccccaggagctggttactgcagaagtggcggcaccctccactagctctagtgcgactagcagccccgaggggccttctcccgctcggccacctcggcgacgcacctctgcagacgtggaaattaggggacagggaacagggaggcctgggcagcctcccggacccaaagtattgaggaaactgcctggaaggctggtaactgtggtggaggagaaagagctcgtgcggaggcgccgacagcagagaggcgcagctagtactcttgtacccggagtgtctgaaaccagcgcatcacctggcagcccctccgttagaagtatgtctggaccagaatcgagcccccctattggtggtccatgcgaggctgcccctagcagctctcttcctacaccgcctcagcaaccgtttatcgccaggcggcatattgaactgggggtcactggcggtggcagccccgagaacggtgacggtgcattgctcgccataactcctcccgctgttaagagacgcaggggcagaccccctaaaaagaacagaagccctgcagatgctggtaggggggtggacgaggctccttctagcacccttaagggaaaaactaacggcgcagacccagtgccaggccctgagaccctgatcgttgctgacccggtccttgagccgcaactgataccaggaccccaacccctggggcctcagcccgtgcacaggcctaaccctctcctgagtcctgtcgaaaaacgcagaagaggtaggccaccaaaggcccgagatctgcctattcccggaacaataagcagcgcaggcgacggtaatagtgagtcacgtacacaaccccctccccatccctctccactgacacctctgcctcccctgttagtctgccccaccgctaccgtggcgaacacggtgaccacagtgacaataagcacaagcccgccaaagagaaagagaggacgaccacctaagaaccctccttcccccagaccctcccagctcccggttctggaccgagatagtactagtgtactggaaagctgtggtctcgggagaagaagacagccacagggtcagggcgaaagtgaaggctcaagcagcgacgaggatggtagccgacctctgacacgcctagcccgactcaggttggaggcggaggggatgcgcggaaggaaaagcgggggttcaatggtggtggccgtgattcaagacgacttggacctggccgactccgggccaggcggattggagctgacccccccagttgtctctctcactccgaagctgagatccacccgtctcagaccgggatccctcgttccccctttggagaccgagaaactaccacgtaagagggctggagctcctgtgggcggaagcccaggcctcgccaagaggggtcgcctgcaacctccctctcctctgggacctgaaggcagcgtggaggaaagtgaagcagaagccagtggggaggaagaagaaggcgatggcacccctcgcagaaggcccggtccacggcgactggtgggtacgacgaatcagggagatcagcgcatactacggagttccgcccctccctcccttgcaggcccagcggtgagccacaggggacgcaaggccaagacctaa

SEQ ID NO: 240847 - DNA, 9218 bp, Artificial Sequence
  Description of Artificial Sequence: Synthetic coding sequence
atgcagtcctccccaagccctgcccatcctcagctccctgtcttgcagacccagatggtttccgatggcatgacaggctctaatcctgtcagccctgccagctcatcatcacctgcgagtagtggcgctgggggtatcagcccgcaacacatcgcccaggattccagtctggatggccctcccggtccgccagatggagccactgtgcctctggagggattttccctgtcccaggcagcagatctggctaataagggccctaaatgggaaaagagccatgccgaaatagcagaacaggccaagcacgaagctgaaatagagacccgcattgcggaactaagaaaagagggattctggtccttgaagcggctcccaaaggtaccagagccgccaagaccgaagggacattgggactatctttgcgaagaaatgcagtggttaagtgccgatttcgcccaagaacgcagatggaagcggggtgttgcgaggaaagtcgtgcggatggttatacgccatcacgaggagcagcgccagaaagaagaaagagcaaggcgagaggaacaggctaagcttcgacgaatcgcctcaaccatggcaaaggatgtgaggcagttctggagcaacgtggagaaagtggtacagtttaaacagcagagccgcctggaggaaaagcgcaaaaaggccctcgacctacatctcgacttcatcgtcggccagacagaaaagtactccgacctcctgtctcagtctctgaatcagccacttacttcctcaaaggctggaagttccccgtgccttggctccagcagcgctgcttcttccccccctcctcctgccagcagactcgatgatgaggacggcgattttcagccccaggaggacgaagaggaggatgatgaagagacgattgaggtggaagaacagcaagagggaaacgacgccgaggctcaaagaagagagattgagctgctcagaagggaaggcgaactgccgttagaggaactgctgaggagcctgcctcctcagctgttggagggcccttcatctccaagccaaaccccaagttcacacgactcagacacgagagatggcccagaggagggagccgaggaggagccccctcaggtgctggagatcaagcctcctcccagtgccgtgacacaacggaacaaacagccttggcacccagacgaggacgacgaggagtttaccgcaaatgaggaggaggctgaagacgaggaggacacaattgccgcagaggagcagttggagggagaggtggatcatgccatggagctgagcgagcttgccagggagggagaactgtctatggaagagttgctgcagcagtatgcgggtgcctacgccccaggttctgggtcttctgaggacgaggacgaggacgaggtggacgcaaacagctcagattgtgaaccagaaggtccagtagaggccgaggaacccccacaggaggatagcagcagccaaagcgacagcgtcgaagatagaagtgaagacgaggaagacgagcattcagaagaggaggaaacaagcgggtcctctgcatcagaggaatctgagagtgaggagtcagaggacgcccagagccaaagtcaggcggacgaggaggaggaggacgacgatttcggcgtcgagtacctgctcgcacgagacgaagagcagtcagaggcagatgcaggctctggccctccaaccccaggaccaacgacgcttgggccaaaaaaagagatcaccgacattgccgctgcggctgagagcctacagccaaagggttatacactcgctactactcaagtgaagacgcctattcccctgctgttgcgaggccagctcagagaataccagcatatcgggctcgactggctggtgaccatgtacgaaaagaagctgaacgggatcctcgccgatgaaatgggcctgggcaagaccattcagactatcagcctgcttgctcaccttgcctgcgaaaagggtaattggggtccccacctgatcatagtgcctactagcgtgatgttgaactgggaaatggagctgaaaaggtggtgccccagcttcaaaatactgacgtactatggtgcacagaaagagcgcaagcttaaacggcagggctggaccaagccaaatgccttccatgtttgcatcacaagctacaaactggtcctccaggaccaccaggcttttcggcgaaagaactggcgctaccttattcttgacgaggcccagaacataaagaacttcaagtcccagagatggcagtctttactgaacttcaattctcaacgtaggttgttgctcaccggaactccgctgcagaatagcttgatggagctgtggtccctgatgcattttttaatgccccatgtgtttcagagccaccgggagtttaaagagtggttctcaaatcctctaaccggaatgatcgaagggtcacaggaatacaacgaaggtcttgtgaagcggctacataaagtcctccgaccttttctgctaagaagagtgaaggtggacgtcgagaagcaaatgccgaaaaaatacgaacacgtaatccgctgccggctttctaaaaggcagcgatgcctgtacgatgacttcatggctcagactaccactaaggaaacacttgctaccgggcactttatgtctgtcattaacatcctgatgcagttaagaaaggtgtgtaaccacccaaacctctttgacccaaggccagttactagccccttcatcactcctggcatctgcttcagcacagcatctctggttctccgggctacagatgtgcatccactgcagaggatcgacatgggacgcttcgatctcattggcctggaaggtcgagttagtcgctacgaggcggatacttttttacccaggcacagactgtctcgcagggttcttctcgaggtggccacagccccagacccgcctcctagacccaagcccgtaaagatgaaagtgaatagaatgttacaacccgtacccaaacaggaggggagaaccgttgtcgttgtgaacaacccacgcgctccgctggggcctgtgcccgtacgtccccctccagggccagaactcagtgctcagcctactccgggaccagtgccccaggtgttacccgcatcacttatggtttcagcctcccccgcaggaccgccactgatcccagccagtcgcccacccggtccagtgttgctgccccctctgcagcctaactctggatctctgccacaggcgggagaggtggttagcataggacagctggcctccctggcgcagcgaccagtggcaaacgccggtgggtccaagcctctcacatttcagatccagggcaataagctgacgcttaccggggctcaagtgcggcagttggccgtgggccaaccgcgacccctgcaaatgccacccacgatggtgaacaatactggagtggtcaaaattgtggtgcggcaggccccacgagatggactcactcccgtcccccctctggcccctgcgcctcgcccacccagctctggacttccagcagtgctaaaccccagaccgactctgacaccaggtagactcccaacacccaccctcggcacagccagggccccaatgcctacacccactctggtacgcccactgctgaagttggtgcactccccatcacccgaagtgtcagcaagcgctccgggtgcggctcctctgaccatcagttctcccctccatgtcccatctagtctgcctgggccagcttcaagccccatgccgatccctaactcttctcccctggcctcaccagtgtctagcaccgtgtccgtccctcttagctccagcctgccaatttcagtacccacaacactacctgcaccggcatcggctccacttacaattccaatctctgcaccactcaccgttagtgcttctggccctgctctgttaacctctgtcactccaccactggcaccagttgttcctgctgctccgggacctcctagtctggccccaagcggcgcatcacccagcgccagcgccctcactctaggattagctacagctccaagtttaagctcgagtcagaccccaggccacccattactgctggcaccaacatcctcacatgttcccggattgaacagcaccgtagccccagcttgctcaccagtcctggtgccagcctcagcactggcttccccgttccccagcgccccaaatcccgcaccagcccaggctagcctgctcgcaccagcctctagcgcttcacaggccctggccacgccgctggccccaatggcagcccctcagacagctattctggcaccttctccggctcctccactggcccctctgccggtgctcgctccctcacctggggctgcccctgttctggccagttcccaaacaccagtgcctgtgatggccccatcttctacccctggcacgtctcttgccagcgcctctcccgtgccggctcccactcctgtcttggccccttcttctacacagaccatgttgccagccccagtgcccagccctctgcccagtcccgcatctacccagacattagccctcgctccggctcttgcacctactttggggggtagtagcccctcccagacgctgagtctcggaaccggcaatccacaaggtccatttcccactcagacgctgtctctgacaccagccagcagtctggttccaacccccgcacagaccctctccctggccccaggccctcccctcggtcctactcaaactctgtctctagccccagcaccaccgctcgcacccgctagtcccgtcggacctgccccagcccacacactgacactcgccccagcctcctcctccgctagcctgcttgcgcctgccagtgtgcagacgttaactctgtccccagcaccagtgcctactttgggaccagccgcagcccagaccctcgcactggcccctgccagtacacaatccccagccagccaagcatcaagtctggtggtgtccgctagtggagctgccccattgcctgtgactatggtgtctcgcctgcccgtgtctaaggacgaaccagatacccttaccttgagatcagggccaccctctcctccatctaccgccaccagcttcggaggacctcgtcctcgcaggcagccaccgcctcctccaaggagtcctttctacctggactccctcgaagagaaacgcaaacgtcaaagaagcgaacggctggagcggatctttcagctgagtgaagcacacggtgccctagcgcctgtgtatgggaccgaggtgctagacttttgtacgctgcctcagcctgtggcctctccaattggcccacgatcccctgggccttctcaccctaccttttggacttataccgaagccgcacaccgggctgttctgtttccccaacagcgcctcgaccaactgtccgaaatcatcgagagattcatctttgtaatgcccccagtggaagcccctcccccatctctgcacgcatgtcacccaccaccctggctggcgcctcggcaagctgccttccaggaacagctggcttcggagctgtggcctagggcccgtcccctgcatagaattgtatgtaatatgcgcactcagttccctgatctgcggctgatccagtatgactgtggtaaactgcaaacacttgctgttctcctcaggcagttaaaggcagagggtcaccgtgtcttgatttttacacagatgacaaggatgctcgacgtactcgagcaatttttaacctaccatggtcacctgtatctcagactggacgggtccaccagggtggaacaacggcaggccttgatggagagattcaacgccgacaaacggattttctgttttattctgtcgacacgctccggcggtgtgggtgttaatctaactggtgcggacaccgtggtgttctatgacagcgactggaaccctaccatggacgcgcaggctcaggaccgctgtcaccggatcgggcagactagggatgtgcacatctatcgtctcatctccgagcgaaccgtagaggagaacattctgaagaaggcaaaccagaagcgaatgctgggtgatatggccatcgaagggggaaattttaccaccgcctatttcaagcaacagactattagagagctctttgatatgccactggaggagccttcctcttcaagcgtacctagtgcaccagaagaggaggaagagaccgttgcctcaaagcagacacatattctggaacaggctctctgccgcgctgaagatgaggaggacatccgcgcagcaactcaggctaaagcagagcaagtcgcagagcttgctgaatttaatgaaaacgacggcttcccagccggtgagggagaagaggctggaagaccaggcgctgaggacgaggaaatgtctcgcgcagagcaggaaatagccgcactggtcgagcagttaaccccaatcgagagatatgcgatgaaatttcttgaagcttccctagaagaggtatccagggaggagctcaagcaggctgaggaacaggtcgaggcggctaggaaggatctggatcaggccaaagaagaggtctttcgcttgccccaggaagaggaggaaggccctggagctggcgacgaaagctcttgcggcactggtggcggaacacaccgcaggagtaagaaagccaaagctcctgaacgacccggtaccagggtgtctgagcggctgcgaggagccagagcggaaacacagggcgctaatcatacccctgttatatcagcccaccagactagatcaacgacgactccccctaggtgctcacctgctcgcgaaagagtaccacggcctgcgcctcggccaaggcccacaccggcatccgcccctgccgcaatcccggctttggttccggtccctgtgtccgcgcctgtcccaataagcgccccaaatcccatcactatccttccagtgcatattctgcctagcccccctccaccatcccagatacctccttgtagctcacctgcatgcacccctcccccagcctgcactccaccacccgctcacacgccacccccagcccagacttgcctcgtaacccctagcagccctctgctgttgggcccaccatccgttccaatttccgcgtccgtcacaaacctcccactcgggctaagacctgaagccgagctgtgcgcacaggccttggcttcacctgaatctctggagctggcaagcgtggccagctcagaaacatcctcactcagtctggttcctcccaaggacctactcccagtggcagtggaaattctcccagttagcgagaagaacttaagtctgactccttcagctccatcgctgaccctggaagcaggctcaattccgaatggccaagaacaggaggcccctgattctgccgagggaaccacgcttacggtcctgcccgagggagaagaattgcctctatgcgtctctgagagcaatggtctggagctgccacccagtgctgcatctgacgaaccattacaagagccactcgaagctgacagaacctcggaagagctgactgaagctaaaactccaacctcgagcccagagaagcctcaggagcttgtcactgctgaagtagccgctccaagcacttcctctagcgccacaagcagccccgagggtccgtctcctgctagacccccaaggagacgaacaagcgccgatgttgaaattcggggacagggcactggccgtcccggacaaccacccggtccgaaggtcctccgaaaattacctgggagactagttacagtggtcgaagagaaggaactggtacggcgtcgcagacagcagcgaggcgctgctagtacattggttcccggagtgagcgagacttccgcctcacccggaagtccgtctgtgaggtctatgagtggaccagaaagctccccgccaattggaggtccttgtgaagccgctccgagctcgtccctgcctaccccaccgcagcagcctttcatcgcacgacgccatatcgagcttggggtcaccggagggggatcgccggaaaacggagatggggctttgttggcaataacgccacctgcagtaaagcgccgaaggggcagaccgccaaagaaaaatcgtagccctgcagacgccggtcgtggcgtagatgaggccccatcctctactttgaaggggaaaaccaacggagccgatccagtcccaggtcccgagaccctgatcgtggccgacccagtactggaaccccaattgattccagggcctcagccactcggccctcaaccagtgcaccgcccaaacccattactgtcccctgtggagaagcggcgacggggaagacctcccaaggccagggacctgccaattcctggtacaatatcaagcgctggtgatggcaattctgaaagccgcacgcagccacctccgcacccaagcccactgactcctctgccacctttgctcgtgtgcccaacagcgacagttgctaacactgtgacaaccgtcaccattagcacgtcacctccaaagcgtaaacgtggcagaccccctaagaacccaccaagcccgcgacctagtcagctcccagtgctggacagggatagcacatcagtgcttgagagctgtggtcttggacggcgtcggcagccgcagggccagggtgagagcgaaggaagcagctccgatgaagatggctctagacctctgacccggctcgcacggttgcgccttgaggcagagggcatgcggggaaggaagtctggaggctctatggtcgttgctgtgatccaggacgaccttgacctggccgactctggccctggcggactcgagttaacacctccagtcgtctcgctgaccccaaagttgcggagtaccagactcagacctggttctttggtacccccactagagaccgaaaagctcccccgaaaaagagccggtgctcctgtagggggttctccaggattggccaagcggggacgcctccaacccccttctccccttgggcctgaaggatccgtagaagaatcagaggctgaggcctcaggggaagaggaagagggagatgggaccccacgcagacgcccaggaccccgaagactggtggggactacgaatcagggtgaccaaaggatcctccggtcctctgcccctcccagcctggccggacccgcagtgtcccaccgtggtagaaaggctaaaaccta

SEQ ID NO: 240848 - DNA, 9506 bp, Artificial Sequence
  Description of Artificial Sequence: Synthetic coding sequence
atgcagtccagcccaagcccggctcacccacagttgccagtgctgcagacccagatggtcagtgatggtatgaccgggagcaaccctgtaagcccagctagtagctccagcccagcttcctccggagcgggagggatcagtccccaacacatcgcgcaagactcatccctagacggcccacctggcccacctgacggagccaccgtccctttagaggggttttcgttgtcgcaggccgcagatctggccaataaagggcctaaatgggagaaatctcacgctgaaatcgccgaacaggcaaagcacgaagcggaaattgagactaggatcgccgaattgagaaaggaaggattctggagcctgaagcgcctgcccaaagtccctgagccccctaggccgaagggtcactgggattatttatgcgaggagatgcagtggctgagcgcagactttgctcaggaacgtcggtggaaacgaggcgtggcaaggaaggtggtccgcatggtgattagacaccacgaggaacagaggcagaaagaggagagagctcggagagaggagcaggccaagctgcgcaggattgcgtccactatggctaaagacgttcggcagttctggtctaatgttgaaaaagtggtacaatttaagcagcaatcccgtctggaagagaagcgtaagaaagccctagacttacatctggacttcatcgtcggccagaccgaaaagtactccgatctgctgtctcagtccctgaatcagcccctgacctcttcaaaagctgggagcagtccatgtctcggttcaagctctgcggcatcatctcctccccctccagccagcagactggacgacgaggacggcgacttccagccccaagaggacgaggaggaagatgacgaagaaacaatcgaagttgaagagcaacaggagggcaatgacgcagaggcacagcgccgagaaatcgagcttctgcgccgagagggagaactgccgttggaggaactcctgcgtagtctcccaccccagctcttggagggaccatcctccccttctcagacaccttcctcccatgacagtgatacacgcgatggaccagaggaaggcgcagaggaagagccccctcaggtgctagagattaaaccccctcccagcgctgtgacccagcgcaacaagcaaccatggcaccccgacgaagacgatgaggagtttaccgctaatgaagaggaagcggaggacgaggaagacaccatcgccgctgaggagcagcttgaaggcgaagtggatcatgccatggaactctctgaactggccagggaaggggaactctccatggaagagttgcttcagcagtacgccggtgcatatgctcccggatccgggtctagcgaagatgaagatgaggacgaagtggatgctaatagcagcgattgcgagcctgagggacctgtggaagccgaggagccgccacaggaagattcctcttcacagagcgattcggtggaagatcgctcagaagacgaagaggacgagcatagcgaggaggaggaaacctcaggcagttcagcgagcgaagagagtgagtccgaggagagtgaagacgcacagagccagtcacaagcagacgaggaagaggaagatgatgatttcggggtcgaatacttgttagcgcgagacgaggaacaatcggaggccgacgctggatccggccctccaacacccggaccgaccacactgggacccaaaaaggagataaccgatattgccgctgctgccgaatctctccagcctaaaggctatactctcgctaccacgcaggtcaaaacccctatcccattgcttttacgtggccagctccgagaataccagcacataggtctggactggctcgtgaccatgtacgaaaagaaattgaatgggatcctggccgatgaaatgggcctgggaaagacgatccagactatcagtctgctggcccatcttgcttgtgagaaaggcaactggggacctcacctcattatcgtgccgaccagtgtgatgttgaactgggagatggagctcaaaaggtggtgtccttcttttaagattctgacgtattacggagcccagaaggaacgcaagctgaaaaggcagggctggactaagccgaacgcattccatgtgtgtatcacaagttataagctggtgctccaagatcaccaggccttccgcaggaaaaattggcggtacctaatcttggacgaggcccagaatattaagaactttaaatcacaaaggtggcaatcccttctcaacttcaatagccagagacgcctgctgctgacgggcactccactgcagaattctcttatggagctatggagcctaatgcacttcttaatgccccacgtgttccagtcacaccgcgagttcaaggaatggttttctaacccactcaccgggatgatagaagggtcacaggagtataacgagggccttgtcaaacgcctacacaaagtccttcgaccatttcttctgcggagggtgaaggttgacgtggagaaacagatgccaaaaaaatatgagcacgtgattcgctgccgtctgtcaaagaggcagagatgcctgtatgacgactttatggcccaaactaccacaaaagaaacattagccaccggccactttatgagcgtaatcaacattctgatgcagctccggaaggtttgtaatcaccctaacctgtttgaccccaggccggtgactagcccattcattacacccggtatttgtttttcgaccgcttcacttgtgctgcgcgctacagatgtgcatcccttgcagcgtattgacatggggcgattcgaccttataggacttgaaggcagggtgtctaggtacgaagctgatacattcctccctagacatcgactgagcaggagggtgttgctcgaagtggccaccgcacccgatccaccacctagacctaagcctgtgaaaatgaaggtcaataggatgttgcagccagtacctaagcaggagggcaggacggtagtggtcgtgaacaacccccgagcccctcttggacctgtccccgtacgacctccgcctggccctgaactttcagcacaaccaacacccggtcctgtacctcaggtgcttcccgcaagcctgatggtgtctgcatcccccgcagggccacccctgatcccagcgagccgtcccccagggcctgtgctgcttccaccactacagcccaacagcgggtctctgccacaggtgctgcctagccctctgggcgttctcagtggtacctccagacccccaactcccacgctgtctctaaaacctactccacctgcccctgtgcggctctccccagctccccctcctggctccagctctctgttgaaacctcttaccgtcccccctggatacacatttccccctgctgctgcgacaacaactagcacaacaaccgctactgctaccaccaccgccgtgcctgcccctactccagcgcctcagagactgatcctcagccctgacatgcaagcccgtctgccctcaggcgaggtggtgtcaattggtcaactggcctccctcgcccagcgcccagtcgccaacgctgggggatctaaacccctgaccttccagatccagggaaataagttgaccttaacaggagctcaggtgcggcagttggcagtggggcagcctcgtcccctacagatgccaccaacaatggtcaataatactggcgtggtgaagatagtcgtgagacaggctcccagagacgggctgacacccgtgccccctctcgcaccagcccctcgcccaccctcttcaggtctgccagccgtcttgaatcccagacccacgctcacaccgggaagacttccaacccccaccctgggaactgcaagagcacctatgccaacgccgaccttagtcaggccactcctgaagctggtgcacagccctagtccagaagtgagcgcaagcgcacccggtgcagctcccctgactatctcatccccattgcatgtaccaagctccttacctggtccggcaagtagccctatgcccatcccaaatagtagtcctctggccagtcctgtgagtagtactgtgagcgttccactgagctcatccttgcccatctctgtgccaaccacgttacccgctcctgctagtgctccactgacaatccccatttcagccccactgacggttagcgcctctggacctgcgctgttaacatccgtgacccctcctctggctccagtggttcccgcagccccaggcccaccctccctggcaccctctggggcatcaccttcagcctcagccctgaccttggggctcgccactgcgcctagtctgtcatcctcgcagaccccgggacaccctctcttgttggcaccaacttccagtcacgtccctggactcaacagcactgtggccccagcgtgtagccccgtgctggtgcctgcctcagcgctagcttctccatttccaagcgcccctaaccccgctccagcccaggcctcacttttggcgccagccagctcagcaagccaggccctggccaccccactagcccctatggccgctccacagaccgcaatactggcaccttcccctgccccaccattagcccctctccctgtgctggcgccttcccccggagccgcacctgttctcgcttccagccagacaccagtgccggtaatggcaccatcaagcaccccgggaacatcattggctagcgcttcccccgtacccgcaccaacgccagttcttgccccttcctcgactcaaacgatgttaccagcgccagtgcctagtccgctgccaagtcctgctagcacccagaccctggccttagcaccagccctggccccaacgcttgggggaagcagtcccagccaaacactgtccctgggaacaggtaatccgcaggggccatttccaacacagacactgtctctgaccccggcatcttcactggtcccaactcctgcacaaaccctctccctggcacccggtcctcctctcgggccaacacagactctttccctggcgccagctcccccattagctccggcttctcctgtcggtcctgctcccgcacacacactgaccctcgctcccgcttccagttctgcctctctgctcgctccagcaagcgtgcaaaccctaacattgtctccagcccctgtacctaccctgggcccagccgcagcccaaaccctcgccctggccccagccagtacccagtcccctgcttcccaggcctcttccctcgtggtgtctgcctccggcgcagcacccctaccagtgactatggtgtctcggctcccagtttccaaggacgaacccgatacactgacacttagatcagggcctccatcaccaccttcaaccgctaccagttttggaggcccacgtccgagacggcaacccccaccacctcctcggagcccgttttacctcgactccctcgaggaaaagcggaagcggcagcgcagcgaacgactggaacgaatctttcaactttcagaagcccatggggcactcgcccctgtctatggaacagaggtgctggatttctgcactttaccccagcccgtagcctccccgatcggaccacgctcacccggtccaagccacccgactttttggacttataccgaggcggcacatcgggcagtcctatttccccagcagagactggatcagctgagcgagataattgagcgctttattttcgtgatgcccccagttgaggcgcctccccctagccttcacgcctgtcatccccctccctggctggcccctcgccaggccgctttccaggagcaactcgctagtgagctgtggcccagggcgaggcctcttcatcgcattgtatgtaatatgaggacccagttccccgacctccgcctcatccagtacgattgcggcaagttacagaccctggccgtgctcctgcggcagctgaaggccgaagggcacagagtgctgatattcacccaaatgactcgcatgctggatgtgctggaacagttccttacctaccacggtcatctttacctgaggctggatggtagcaccagggtagaacaacgacaggcgctgatggagcgattcaacgctgacaaaaggatattttgtttcatcttatctacccggtctggtggagtgggagtaaacctgactggagccgatacagttgtgttttatgacagcgactggaacccgactatggatgcccaggctcaagacaggtgtcatagaatcgggcagaccagggacgtgcacatctaccgccttataagtgaaaggacagtcgaggagaacatcctgaagaaggctaaccagaaaagaatgctgggcgacatggcaatcgaagggggaaattttaccactgcgtacttcaaacaacagactattcgcgagttgttcgacatgccgctcgaagaaccaagttccagtagcgtacccagcgccccagaagaggaggaagagacggtagcaagtaagcaaacccatattctggagcaggccctgtgtagggctgaagatgaggaggacattagggctgccacccaggctaaagcagaacaggtcgcagaactggcagagtttaacgaaaatgatggctttcccgctggtgagggggaggaagccggtcgaccgggagccgaggacgaggaaatgtctcgtgctgagcaggagatcgctgcactggtggagcagttgacccctattgagcggtatgctatgaaatttttggaagcctccctcgaggaagtgtccagggaggaattgaagcaggcagaggagcaggtcgaggccgctaggaaggacttggatcaggccaaagaagaggtgtttcggctcccacaagaagaggaggaaggacccggagctggtgacgagagcagctgcggcacaggaggcggtacgcacaggcgctctaagaaggcaaaggccccagagagacccggtactcgagtctcagaacgactccggggtgcgagggctgagacccagggggctaaccatacacctgtgatatccgcccaccaaactcgatctactacaaccccacctcggtgctcaccagcccgagagcgtgtacctcggcctgccccaaggccaaggcccacaccagcttccgcccctgcggctatccccgctttggtgcctgtgccagtgtctgcgcctgtcccaatatccgctcctaatccgatcacgattctccctgtgcatatactcccatcccctcctcctccatcccaaatacctccatgctcttcgccagcctgcacacctcctcccgcatgcacaccccctcctgcccacacaccgccacccgcacagacttgcctagtcactccgtcctcaccactgctactcggaccgccatcagtccctatttccgccagtgtgactaaccttcctctaggactgaggcccgaggctgagctatgcgctcaggccctggcaagccccgaaagcctggaactcgcatcagtcgcttcaagcgagacctcgtctctttcactagtaccaccaaaggatctgctccccgtggccgtcgagattttaccagtgtccgaaaaaaatctctccttgacaccgtcagctccaagtctgacacttgaggccggatccatccctaatggacaggaacaagaggcaccagactcagccgaggggacgacactgactgtgctccccgagggcgaggagctgccattgtgcgttagcgagtccaacgggctggaactcccgcctagcgccgcttcggacgagccgctgcaggaacctttggaggcggaccggacctctgaagagttaacagaggccaaaactccaacttctagtccggagaagccccaggagctggtgaccgcagaggtagctgccccaagtacatctagttctgcaacctcatctcctgagggcccatccccagcccgacctcccagaagaagaacctcagcagacgttgaaatccgtggtcaagggactggaaggccaggccaacccccaggtcccaaggtattacgcaagcttcccggaaggttggtgacggtcgttgaggaaaaggagcttgtgaggaggaggagacaacagcgcggagcggcaagtacccttgtgccaggagtgtcagaaacttcggcctccccaggtagtccttcagtgagaagcatgtccggtccagaatcgagtcctcccatcggaggtccttgtgaagccgctcccagtagttctctccccactcccccacaacaaccatttattgcacgtcgccatatcgaactgggcgttaccgggggaggcagtcccgaaaacggtgacggggctctcttggcaatcactcctcccgcagttaaacggcgacgcggaagaccgccaaaaaagaacagatctccagccgatgcaggaagaggagtggatgaggcgccatctagtactttgaaggggaaaacaaatggtgcagaccctgtaccagggcctgagactctcatcgtggccgatccggtattggaaccccaacttatcccaggcccacaacccctgggaccccaacctgttcaccgtcctaacccgttgctctctccagtggaaaagagaagacggggaagaccgcctaaggctagggatctccccatcccagggaccatcagctcggccggagatggtaatagcgaaagtcggacccagcccccaccacaccctagccctctaacacccctcccccctctgctcgtgtgccccacagcaactgtggccaatactgttacaacagtgacgatttctacttctccacccaagcggaaacgtggaaggccacctaagaaccccccttcacctcgtccttcccaacttcccgttttggacagggactcgacaagcgtgttagagagttgtgggctgggacgtcgcagacagccacagggacaaggggagtcggagggctcatctagcgacgaagacggatcccggccattgaccaggctggctagattgaggttggaagcggagggcatgagagggcgtaaatctgggggatccatggtggtagccgtgatccaagacgacctggatttagcagactcaggaccaggaggtctggaattgacccctccagtggtgtctctgacaccgaagctaaggtcaacaagattgagacccggtagtcttgtcccaccactcgaaaccgaaaagctccccaggaagcgggctggggctccggtggggggttcacccggactggccaagagaggcaggcttcagcccccttctccactggggccagagggctcagtggaggaaagcgaagctgaggcctcaggcgaggaggaggagggggatgggactcccaggcgtcgccctggacccagaagactggtcggaactaccaaccagggcgaccagaggatcctcaggagcagcgcccctccctctcttgctggtcctgcagtcagccaccgcggaaggaaggctaagacata

SEQ ID NO: 240849 - DNA, 180 bp, Artificial Sequence
  Description of Artificial Sequence: Synthetic coding sequence
atgcagagttctccatcacctgcccatccccaactcccagtcctgcaaacccagatggtgagcgacggcatgaccggcagcaaccctgtgagccctgcttcaagctcatcacctgctagctccggtgctgggggaatctcacctcagcacattgcccaggattcgagcttggatggctag

SEQ ID NO: 240850 - DNA, 774 bp, Artificial Sequence
  Description of Artificial Sequence: Synthetic coding sequence
atgcatcgccgtggggtgggtgcgggagccatcgccaaaaagaagttggccgaagctaagtacaaagaaagaggtaccgtcctggccgaagaccagctggcccagatgagtaagcagctggacatgtttaagacaaacctggaggaattcgcttctaaacataagcaggagattaggaaaaatcccgaattccgcgtccagtttcaggatatgtgtgcaactattggcgtggatccactggcatctggcaaaggcttctggagcgagatgttgggcgtgggcgatttctattacgagctgggggtccagataattgaagtttgcctcgcccttaaacaccgcaacgggggactgattactcttgaagagctccaccagcaggtgttgaaaggccgtggcaaattcgcccaggacgtgagtcaagacgatctcatacgtgcgattaaaaagctgaaagcacttggcactggtttcggtatcattccagtgggcggtacttaccttatccagtctgtcccagctgagctcaacatggatcatacggtggttctgcagctcgccgagaatggatatgtgacagtgtctgagattaaggcctcattaaaatgggagacagagcgagcaagacaagtccttgagcacttgctcaaggagggcttggcctggctggatttacaggctcccggagaagcccattattggctccctgcccttttcactgacctctactctcaggagatcaccgccgaggaagctcgcgaggccctcccttag

SEQ ID NO: 240851 - DNA, 777 bp, Artificial Sequence
  Description of Artificial Sequence: Synthetic coding sequence
atgcaccgtcgaggggtgggtgccggagcaattgcgaaaaaaaaactcgctgaagctaaatacaaagagaggggcacagtcctagctgaagaccaactggcgcagatgtccaagcaactggatatgtttaagactaacctggaagagtttgctagtaagcacaaacaagaaatccggaagaatcctgaattccgagttcagttccaggacatgtgcgccacaatcggggtagatccattggcgtcaggcaagggattctggtcagagatgctgggggtcggagacttctactacgaactcggggtccaaatcatcgaggtgtgcctcgccctgaagcaccgtaacggaggtttgatcactctagaggagcttcaccagcaggtgctgaagggccgtggaaaattcgctcaggacgtgagtcaagacgacctgatccgcgctattaagaagttaaaggccctagggacgggttttggaattattcctgttggcggtacatatttaatccagtcggtacctgcagagctgaacatggatcatacagttgtcctgcagctggctgagaaaaacggctatgtaacagtgagcgaaattaaagcttctcttaaatgggagactgagcgcgctcgccaagtgcttgaacacctcctcaaggagggtctggcatggctagacctgcaggccccaggagaagctcattactggctgcctgccctgttcacagacttatacagccaagagattacagctgaggaagctcgcgaggctctcccctag

SEQ ID NO: 240852 - DNA, 1611 bp, Artificial Sequence
  Description of Artificial Sequence: Synthetic coding sequence
atgagctcgtctctcgggaaggaaaaggactcgaaggagaaggatcctaaggtacctagtgctaaggaaagggagaaggaagctaaggccagcggcggatttggtaaggagtctaaggagaaagagccaaagaccaaagggaaggatgccaaagacggaaagaaagattccagtgcggctcaaccgggtgtcgccttctcagtcgataacaccatcaaaagacccaatcccgctcccggaacacgcaagaaatctagcaatgcagaggtgatcaaggagctgaataagtgcagagaagagaatagtatgagattggatctgtcgaagaggagtatccacatccttccctcgtcaataaaagaactgacccagctgacagagctctacttatacagtaataaactgcagtctctcccagccgaagtgggttgtttggtgaaccttatgaccctggccctcagtgaaaactctctgacttctctgcctgattcgctggacaacctcaagaagttacgcatgctggacctgcgccataataaactgcgggagattccaagcgtagtgtaccggctggacagcctcaccactctttacctcagatttaacaggattacgacagttgagaaggacatcaaaaacctcagcaagctttctatgctttctatccgagagaacaagattaaacagctgcccgctgagatcgggaacttatcctctctttctcgcttgggtttgcgatataatagactctccgcaatacctcggagcctggctaagtgctcagcattggaggaactcaacctggagaataataacatttccacactccccgagtcactgctttcctccctggtcaaactgaattccttgactctggccagaaactgtttccagctataccccgttggcggtccgtctcaattcagtactatttattctctgaacatggaacataacagaatcaacaaaatacccttcggtattttttcacgcgctaaagtcttgtcaaagttaaatatgaaagacaatcaactgacctctttacctctcgacttcggaacgtggactagtatggtggagttgaatttggcgactaatcagctgaccaagataccggaagacgtgtcgggcctggtctcactcgaggtgttgatcctatccaacaatctgcttaagaaactgcctcacggacttggtaacctgagaaaattgcgagagttggacttggaagaaaacaaactggaaagcttgccgaacgagattgcgtacctgaaggacctccagaagctggtgttgaccaataaccagttgacaaccctaccgaggggtataggccatctcaccaaccttactcatcttggactgggcgagaatttgttgacccatctgcctgaggagattggtactctcgagaacctggaggagctgtacctgaatgataacccaaatctgcatagcctgcctttcgagcttgccctgtgctccaaactttctataatgtccatcgaaaactgccccctgtctcacttgccaccacagatcgtagcgggaggaccaagtttcatcatccaattcttaaaaatgcagggaccatatcgggctatggtctag

SEQ ID NO: 240853 - DNA, 1749 bp, Artificial Sequence
  Description of Artificial Sequence: Synthetic coding sequence
atgtcatctagcttgggaaaagagaaggactccaaggagaaggatccaaaagttccctctgcaaaagagcgggaaaaggaggcgaaagcctctgggggatttgggaaggagtcaaaggagaaggaacccaagacaaaggggaaagacgccaaggatgggaagaaagattcatccgctgctcaaccaggcgtggctttttccgttgataacaccataaagcgcccaaacccggcacctggaacacgcaaaaagtcatcaaacgctgaagttatcaaagagctgaataagtgtcgcgaggagaattcgatgcgcctcgatctgtcaaagagatctatacacatactgcctagcagtatcaaagaactcacccaattaacagagctgtatctctacagtaacaagctgcagagtctgcctgcagaggtcggatgtctagtaaatctgatgacattagccctttcagagaattctctaacctcccttcccgattccctagataatctaaaaaaactcagaatgctggatctgagacataataagttgcgcgaaattcctagcgtagtgtatcgcttagatagcctgaccacactgtatctgaggttcaacagaattacaacggtcgagaaagatatcaaaaacctgtccaaacttagcatgctttccattcgcgaaaacaagattaagcagctgccagcagaaattggagagttgtgcaatcttatcacccttgatgtggcccataatcagctcgagcacctgccaaaagagatcgggaattgtacccagattacgaacttggacctacagcataatgagctgctcgatctcccagacactatcggaaatctatccagcctatctcgactcggcctaaggtataatcggctgagcgccattccaagatccctggctaaatgtagcgctctcgaggagctcaacctggaaaacaacaacatctccacgttgccggagtccctgttgtcatctctggtgaagcttaacagtttgacgctggctagaaactgtttccagctctacccagtgggtggaccaagtcagttcagcaccatctacagtctgaacatggaacacaacagaattaacaagataccatttggaatcttcagccgcgcaaaggtgctgtccaagctgaacatgaaggataaccagttaaccagcctccctctggatttcgggacctggacgagcatggtcgaacttaatctcgcgaccaatcagctaaccaaaataccagaggatgtcagcggtctagtgtctttggaggttctgatcctgagcaacaatctgttgaaaaaactgccacatggccttggaaatctgcggaaactccgcgaactggatttggaggaaaacaagttggagtcactgcctaacgaaatcgcctacctgaaagacctccagaaactagttcttaccaataaccagcttaccacacttcctagaggtattgggcatcttaccaatttaacccacctgggtttgggcgagaatctgcttacgcacctcccagaagagattggcactttagagaaccttgaggagctttacctgaatgacaaccctaacttacacagcctcccatttgagctcgccctgtgttcaaaattgtccattatgtccatagagaattgtccactgagccatctaccccctcagatagtggctgggggtccctcatttatcattcaatttcttaaaatgcaggggccttatagagcgatggtttag

SEQ ID NO: 240854 - DNA, 1119 bp, Artificial Sequence
  Description of Artificial Sequence: Synthetic coding sequence
ctcgacaatctgaaaaaactgagaatgctagatttacgccataataagctccgcgaaataccaagcgtagtatatcggctagattctttgaccactctgtacctcagattcaatagaataacgacagtagagaaggacattaagaacctctcaaagctaagcatgctgtcgataagagagaataagatcaagcagctgcccgctgaaatcgggaatctcagcagcctgagcaggcttggcctacgctacaatcgcttaagcgctatccctcggtctctagcaaaatgctcagccctggaagagctgaacttggagaacaacaacatatccacacttcccgagtctttactgtccagccttgtgaagctgaattcccttaccctcgccaggaattgctttcaactctatccggttgggggtcctagccaatttagcacaatttattctttaaatatggaacacaatagaatcaataaaattccctttggtattttttcccgagccaaagtgctgtctaaacttaacatgaaagataaccagctcacttctttgcctctggactttggcacctggacctcaatggttgagctgaatctggcgaccaatcagctgacaaagatcccagaagatgtgtcaggcctcgtctcactggaagtgcttatcttgtccaacaatttacttaaaaagctcccacacgggcttgggaatctccgcaagctccgcgagttggacctcgaagagaataaactcgagtccctcccaaatgaaatcgcttacttaaaggatctccagaaactagtgctgaccaacaatcagctgaccacccttcccagaggtattggacatctcaccaatttaacacacctggggctgggcgagaatcttctgactcatctgccagaagaaattgggactctggagaacctggaggagctgtatttgaatgacaatcccaatctgcactcattaccttttgaattggctctgtgtagtaagttgtcaatcatgagcattgaaaattgcccgttgagtcacctgcctccgcagattgtcgccggtggaccctcttttataattcagtttctgaagatgcaggggccttaccgggctatggtgtag

SEQ ID NO: 240855 - DNA, 588 bp, Artificial Sequence
  Description of Artificial Sequence: Synthetic coding sequence
atgctaagagacgggagattcgcatgcgctatttgtccccacaggccggtactggacacactggccatgttgacagcgcaccgggctgggaaaaagcacttaagttcccttcagctgttctacggcaagaaacagccaggtaaagagaggaaacaaaacccaaaacaccagaatgaacttcggcgtgaggaaaccaaggccgaggccccactattaacccagacacggctgattacccaaagtgccttgcacagggccccacattacaacagctgctgccgcaggaagtaccggccagaagcacccggtccctccgtgtccctttccccaatgcctccgtctgaggtcaaattgcagagtggcaagattagtagggaacccgagcccgcagccggtccacaagccgaagaatctgccactgtgagcgcccctgctcccatgtcccctacacgtcgcagagcacttgatcactatctcacgctcaggtcctctggatggatacctgatggtcgcggtcggtgggtcaaggacgaaaacgtggaattcgactctgacgaggaggaaccgcctgacctgccgttggattag

SEQ ID NO: 240856 - DNA, 693 bp, Artificial Sequence
  Description of Artificial Sequence: Synthetic coding sequence
atgagttttaaaagagagggggatgattggtctcagttgaacgtgctgaagaagcggcgagtgggcgatctccttgcgagctatattcccgaggatgaggccttgatgcttcgcgacggtcggtttgcatgcgcgatttgcccacatcgacccgttcttgacaccctggccatgctcacagctcatcgggctggcaagaaacatctgagtagccttcagctgttttacggcaagaagcaacccggaaaagaaagaaaacagaaccccaaacatcagaacgagctgcgcagagaagagacaaaagccgaggcaccgctgttgacacaaactcgcctcatcacacagtcggctttgcatagggctccgcattacaatagttgttgccgaaggaagtatcgcccagaagctccagggccttcagtgtccctgagccctatgccgccaagtgaagtgaagctacagtcgggaaagatttctagagaacctgaacctgcagctggacctcaagccgaggaatcagctaccgtatccgcccctgcacctatgtctcctaccaggcgacgagctctggaccattacctgacgctccgatcctcaggctggattcctgatggcagaggcagatgggtgaaagatgagaatgttgagtttgatagcgacgaggaggagcctcccgacctccccctcgactag

SEQ ID NO: 240857 - DNA, 1038 bp, Artificial Sequence
  Description of Artificial Sequence: Synthetic coding sequence
atgtataaagactgtatcgagagcacaggggactattttcttttgtgcgacgccgaaggaccctgggggatcatcctggaatctttggccatcctggggatcgtggtcaccattctgctgctgcttgcgtttcttttcttgatgagaaaaatccaagattgctctcagtggaatgttcttccgacccagttgttgttcttactgtccgtcctcgggctctttgggcttgccttcgctttcatcatcgagctgaatcagcagacggcccctgttcgctacttcctattcggtgtgcttttcgcgctgtgcttttcatgtctactggctcacgcatccaatcttgtgaaactcgtgcgcggttgtgtgtcattctcatggaccacaattctctgtatagcgattggctgcagcttgttacagatcattatagccaccgaatatgttacgttgattatgacccgaggcatgatgtttgtgaacatgacaccatgccagcttaatgtggattttgtagttttgcttgtttacgtcttgttcctgatggccctgacctttttcgtctctaaggcaaccttttgtgggccttgtgaaaactggaaacagcacggcagattaatcttcataacagtgctgttttcaataataatctgggttgtgtggatctccatgttgctccgtgggaaccctcagttccaacgacagccgcaatgggatgacccggtggtttgtatagctctggttacaaacgcctgggttttcctgcttctgtacatcgttcctgagctttgcatcctgtacagaagctgtcgacaggagtgtccactgcagggaaacgcatgccctgttaccgcgtatcaacacagctttcaggtagaaaaccaagagcttagtagggctagggattccgatggagcagaggaggatgtcgcgttaaccagctacgggactcctattcaaccacagaccgtggatcccacccaggaatgctttattcctcaggcaaagctgtcacctcaacaagatgcaggtggagtgtag

SEQ ID NO: 240858 - DNA, 2076 bp, Artificial Sequence
  Description of Artificial Sequence: Synthetic coding sequence
atggagggaaataaactcgaggaacaggattcgagtccaccacagtcaacgccagggcttatgaaggggaacaaacgggaagagcaaggacttggcccagagccggctgcgccacagcaacccactgcagaggaagaggctctgattgaatttcacagaagttacagggagctgttcgaatttttttgcaataacacaaccatccatggagccatccgcctggtctgttcgcagcacaataggatgaagaccgccttttgggcggtgctctggctctgtaccttcgggatgatgtactggcagttcgggctcctgtttggggagtacttctcatacccagtgtctctgaacatcaacctaaattccgataagttggtctttccggctgtgaccatttgtaccctgaatccttatcggtatcctgagattaaagaggagctggaggagttggataggatcaccgaacagaccctgttcgacctgtataaatatagctccttcacgacgcttgtggctgggtccaggtccagaagggatctgcggggtactctgccacaccctttacaacgtctacgagtgccgccacccccacacggagctaggcgtgcaaggtctgtggcctcctcgcttcgggacaacaaccctcaagtggactggaaggactggaagatcggcttccagctctgcaatcagaataaatctgattgcttctaccagacttactcaagtggcgtggacgcagtgcgggagtggtatcggtttcactatatcaacatcctctctcgtctacccgagactctcccctccctggaggaggatacattgggcaactttatttttgcttgccgattcaatcaggtttcttgcaatcaggctaactacagtcactttcaccatcccatgtacggtaactgctacactttcaacgataagaacaactcgaacctgtggatgagcagtatgcctggcattaacaatgggcttagccttatgcttagagctgaacagaatgatttcatcccactgctgtctactgtgactggggcaagagttatggtgcacgggcaagacgaaccagcctttatggacgacggcggtttcaatcttaggcccggagtcgaaacgtccatatctatgcggaaggagactctggatcgtctgggaggcgactacggcgactgtactaagaatgggtcagatgtcccagtcgagaacctttatccctccaagtacacccagcaggtgtgcatccatagctgttttcaagagtccatgataaaggagtgcgggtgcgcctatatcttttatccccgtccacagaacgtggaatattgtgattatagaaagcactcaagctggggtcaagtgagatcactcacacccgtgatccccgctctatgggaagctgaggctggacgcagtcggggatactgctattacaagctgcaggtggactttagtagcgaccaccttgggtgcttcaccaaatgcaggaagccctgttcagtgaccagttaccagctttctgctggctacagccggtggccttcagtgacaagtcaggagtgggtttttcaaatgctgtcgaggcagaataattacaccgtgaataataagcgtaatggcgttgcaaaggtgaatatcttcttcaaggaactgaactataaaactaacagtgaaagcccgtcagtcacaatggttacactcttgagcaacctgggtagccagtggtccctgtggttcggctcatcagtcttaagtgtggtggaaatggccgaactggtgttcgatctgttggtgatcatgtttctgatgctcctgcgcaggtttcgctctcgatactggagtcctggcagggggggaaggggtgcccaggaggttgccagcaccttggcttcgtctcccccaagtcacttttgtccacatcctatgtccttgtctttaagccagccaggccctgctcctagtcctgcccttaccgcccctccaccagcctacgccaccctggggcctaggcccagcccaggcggatccgcaggcgcaagcagtagtacatgcccactgggcggaccatag

SEQ ID NO: 240859 - DNA, 2058 bp, Artificial Sequence
  Description of Artificial Sequence: Synthetic coding sequence
atgctgctgcatatcaacccggcatacttgttcaaactgctgcatgggttccccccatggattatgcctaccgacggcaacttaggcgacaaaaattttcagatgggtaaacccggtcatagagagggggctacaatgcacgtcaagaagtatctcctgaaaggtttacataggctccaaaagggcccaggctatacgtataaagagttgcttgtgtggtactgtgataataccaacacccacggacccaaaagaatcatttgtgagggcccaaaaaagaaggctatgtggttccttctcacactcttgtttgccgcactggtgtgttggcagtggggtatttttattaggacttatctcagctgggaggttagtgtgagtctttccgtcggatttaaaacgatggattttccggcagtaacaatttgcaacgcctccccttttaagtactccaagatcaagcacttgctgaaggaccttgacgagttgatggaggcagtgttggaacggattctggccccagagctttcacacgctaatgcaacccgcaatctgaacttctcaatctggaatcatacacccctggtgctgattgatgagagaaacccgcatcaccctatggttctggacttgttcggagacaaccacaatggccttacctcatcctcagcctcagagaagatctgcaatgcccacggctgcaagatggcaatgcgcctctgctctctgaaccgtacccagtgcacttttcgcaacttcacttctgccacacaggccctgactgagtggtacattctccaggcaactaacatctttgcccaagtgccccagcaggagctcgtggagatgtcctatcccggagaacagatgatactcgcctgtttgttcggagccgagccctgtaactacaggaacttcactagtattttttacccacactatggaaactgctacatattcaactgggggatgacagagaaagcactgcctagcgccaacccaggcaccgagtttgggctaaagctgatcctggatatcggccaggaggactacgttccattcctggctagcaccgccggtgtgcgtctgatgttgcatgaacagcgctcatatcctttcataagggatgaaggcatatatgctatgtctggcaccgagacatccatcggagtgctcgttgacaaactccagcggatgggggagccatactctccttgcacggttaacggctctgaggtgccagttcagaatttctacagcgattacaacacaacctatagcatccaggcttgccttaggtcctgctttcaggatcacatgattagaaactgtaactgtggccactacttgtacccactgccacggggagaaaaatactgcaacaatcgggactttcctgactgggcgcactgctactcagatcttcaaatgagcgtggcccaaagggagacttgcatcggaatgtgcaaagagtcctgtaacgacacacagtataagatgaccatcagtatggccgattggccttctgaggcttcggaggattggatattccatgtcctatcacaggagcgagaccagtctactaatatcacactgtcgcgaaagggcatcgtgaagcttaacatttacttccaggagtttaactatagaaccatagaagaaagcgctgccaataacatagtatggctcctgagcaatctcggtggacagttcggtttctggatgggtggctccgtgctgtgtctcattgaattcggcgaaattatcatagacttcgtttggattaccattattaagcttgtcgccctggcaaaatctctgagacagaggagagctcaggcgagctatgccggaccaccacccaccgtggcagaactggtagaagcccacaccaatttcggattccagcctgacacagcgcctaggtctccaaacacaggcccttatccctccgaacaggcgctccctatcccagggaccccacctcccaattatgattcactcaggcttcaaccactcgacgtgattgagtcagattctgaaggcgatgccatttag

SEQ ID NO: 240860 - DNA, 1923 bp, Artificial Sequence
  Description of Artificial Sequence: Synthetic coding sequence
atgcatgtcaaaaagtatcttctgaaggggctgcacagattacagaaaggtcccggatatacttacaaggaactgctggtctggtactgcgacaatacgaacacccacggaccaaagagaattatttgcgagggcccaaaaaagaaagcgatgtggttccttctgaccctcttattcgccgcactggtgtgttggcagtggggcatttttattcgaacctaccttagctgggaggtgagtgtgtccctgagcgtggggttcaagacgatggatttcccagccgttaccatatgtaacgcgtctccctttaagtactccaagataaaacatctgctgaaagacctggacgaactcatggaggcagtgttagaaaggatcctggcgcctgaattgagccacgcgaatgccacgcggaacctcaacttctcgatctggaatcacactccgttggtactcattgacgaacggaatccccaccacccaatggtccttgaccttttcggcgacaaccacaacgggttgacatcatcaagtgctagtgaaaaaatatgtaatgcccacggctgtaagatggccatgcgcctgtgtagtctcaatagaacacagtgtacctttcggaactttacttctgccacccaggcactcaccgagtggtacattctgcaggcgaccaatattttcgcccaggtcccacaacaagaattagtcgagatgtcctaccctggcgagcaaatgattcttgcctgcctgttcggtgccgaaccgtgcaattacagaaacttcactagcatattctacccccattatggaaactgctacatcttcaattgggggatgacagagaaggccctcccatcagctaacccaggtactgaatttggcttgaaactgattttagatattggccaggaggactatgtaccatttctggccagcaccgccggtgtgagactcatgctgcatgagcaacgctcctatccttttatccgagatgagggcatatatgcgatgtctggtaccgagacctctatcggcgttctggtggacaagctgcagcgtatgggcgagccctactccccttgtactgtgaatggctctgaggtcccagttcagaatttttactcagactataacactacatacagcatacaggcctgcctgcggagctgctttcaggaccacatgattagaaactgtaactgcggccactacctgtacccgctgcctaggggggagaagtactgcaataatagggacttccccgattgggcccattgttattcagacctgcagatgtctgtagcgcagagagagacttgcattgggatgtgtaaagagtcctgcaatgatacgcaatacaaaatgaccatcagcatggctgattggccctccgaggctagtgaggactggatctttcacgtgttgagtcaggaaagagaccaaagtactaacatcaccctgtcacgcaagggcatcgtgaaactaaatatttacttccaggagtttaactataggacgatagaggaaagcgccgctaacaacattgtgtggctcctgagtaatcttgggggacaatttggtttctggatggggggaagcgtgctctgcttaattgaatttggcgaaattataatcgactttgtgtggattaccatcatcaaattggtggccctagccaaatccctacggcagcggcgagcccaagcgtcttacgccggacccccacccaccgttgctgagttggttgaagcccatacaaatttcgggttccagcccgacacagctcctaggagccctaacactggaccttatcccagtgaacaggcgttgccaattcctgggacccctccccctaactatgattctttgcgactgcagccactggacgtgatcgaaagcgactccgagggcgatgccatttag

SEQ ID NO: 240861 - DNA, 2115 bp, Artificial Sequence
  Description of Artificial Sequence: Synthetic coding sequence
atggcttttctctctcggacatccccggtggctgccgctagctttcagtcgagacaggaagctcgtgggtcaatcctgctgcagagctgtcagcttccgccacagtggctgagtactgaggcctggaccggggagtggaaacaaccacatggtggggctctcacaagtagatcacctggaccagtggcacctcagaggccgtgtcatctgaaggggtggcagcatagaccaacacagcataacgctgcatgcaagcagggccaagctgccgcacagaccccacccaggcccggtcctccaagcgcaccccctccaccacccaaggaagggcaccaggaaggattggtggaattgccagcaagcttccgggagcttctgacatttttttgcacaaacgctactattcacggcgctattagactagtgtgcagccgtgggaataggttgaagaccacgtcttggggcttactgagcttgggcgcattggtggctttgtgctggcaacttggactgcttttcgagaggcattggcacagaccggttctcatggcagtatctgttcacagcgagaggaaacttctgcccctggttactctttgtgacggcaacccacgcagaccaagtccggtgttgcggcatctggaattattggacgaattcgcccgagaaaatattgacagtctgtataatgtgaaccttagcaaaggtcgtgcggcactgtccgccacagtgccgagacacgaaccaccttttcacctggacagggaaattcgtctccagcggctgtctcacagcggatctcgcgtccgtgtgggattccggttgtgcaattctacaggcggagattgcttctacagaggatacacttccggcgtggccgctgtccaggattggtatcatttccactacgttgacattctggccctcctgcccgctgcttgggaggattctcacgggagtcaagatggccacttcgttctgagctgctcttatgatggcctcgactgccaggccaggcagttccgtacctttcatcatcctacctacggctcttgttacaccgtcgatggggtttggactgcccaacgacctggcatcacgcacggggtgggcttagtcttgagggttgagcaacaaccacacctgccactgctgtcaactctcgcaggtattcgggtgatggtgcatgggcgtaaccatacaccattcttaggtcaccactctttctccgtgcggccaggcacggaagccaccatctcaattcgggaagacgaagttcaccggctaggctccccatatgggcattgcaccgccggtggagagggtgttgaggtcgagctgttgcacaacacatcctatactcggcaagcctgcctggtctcatgttttcagcagctcatggtagaaacctgttcttgtggatactatctgcatcctttacccgctggggcagagtattgtagttctgcacggcaccccgcttggggacactgtttctacagactctaccaggatctagaaacacaccgcttgccctgcaccagtcggtgccccaggccctgccgcgagtccgccttcaagctcagcaccggcacttccaggtggccttcagccaaatcggctggatggacgcttgcgaccctgggcgaacaaggtttaccgcaccaatcccaccgacaacgcagtagtctggccaagatcaatatcgtttaccaggaactgaattatcggagcgtagaggaggctccagtatacagtgtcccccagttgttatctgcaatgggctccctctgttccttgtggttcggtgctagtgtcttgagcttactggagctgttggagctcctgctcgacgccagcgctctgaccctcgttctcggaggacgacggttgcggagagcctggttctcatggcctagggcaagtccagcatccggcgcttctagcataaagcccgaagcaagccaaatgcctcccccagcaggcggaactagcgacgatcccgagccatctggacctcacctgcctagagtcatgttacctggggtcttagccggtgtatccgccgaggaatcttgggctggtccccagcccttagaaacccttgacacatag

SEQ ID NO: 240862 - DNA, 1917 bp, Artificial Sequence
  Description of Artificial Sequence: Synthetic coding sequence
atggccgagcaccgtagtatggacggaagaatggaagcagccactcggggaggatcacacctccaggccgctgcacagacacctcctcgcccaggtcctccctccgccccaccacctcctccgaaagaagggcaccaagagggactggtggagctcccagcttcttttagggagttactgacattcttctgcacaaacgcaactattcacggtgctatccgactcgtttgtagtagaggaaaccgtctgaagactacgagttggggcttgttgtcactcggcgcattggtggccctgtgctggcaattaggcctgttgtttgaacgacactggcacagacctgtattgatggccgtttccgttcactctgagagaaagctcctgcctctcgttacactgtgtgacggtaacccacgtcggccttctcctgtgctccgtcacctcgaattgctggatgagtttgctagagaaaatatcgacagcctgtataacgtgaacctgtcgaagggaagagcggcactgtccgctaccgttccaagacacgagcctccattccatctagaccgagaaatccgcctgcaacgtctgtctcactcaggtagccgggtcagggtgggcttccgtctctgcaatagtacaggcggtgattgtttctatcggggatacacgagtggtgtggccgctgtgcaggactggtatcactttcactatgtggacattctggcactgctgccagcagcttgggaagactctcatggcagccaagatgggcactttgtgctgtcctgttcctatgacggtttggactgccaggcgcgtcagtttagaacctttcaccatccaacttacggctcttgctacaccgttgatggcgtgtggacagcccagcgaccgggtattacgcacggcgttggcttggtgctcagggtggaacaacagccccacctgccattgctctcgaccttggcaggtattagagttatggtccatggcaggaaccacactccctttctgggccaccatagtttctctgtaagaccgggaacggaagcaactatctctattagggaagatgaagtacatcgattaggatctccatacgggcactgcacagctggaggcgagggggtagaggtggaactgcttcataacacctcttacacgagacaagcctgcctggtgtcatgcttccagcagctcatggttgagacttgtagttgtggatactacctgcacccacttcccgctggtgctgagtactgctcatcagctcgccaccctgcatggggccactgcttttaccgactttaccaagacttagagacacataggctgccctgtaccagcagatgcccccgtccttgccgggaatccgcttttaagctctctaccggaacaagccgctggccgtcagctaaatccgccggatggactctcgccaccctgggagagcaagggctcccccaccagtctcatagacaacgctccagtctcgccaaaatcaatattgtgtaccaggagctgaactatcgttcagtcgaggaagccccagtgtactccgtgccccagctgctgtcagcgatgggttcattgtgctctctgtggtttggagcctcggttttatctctgcttgagctgctggaactgctgttagacgccagcgctctgacattggtgttggggggtagaaggctgaggagggcctggttcagctggcctcgggcttcccccgcatccggggcatcatccatcaagccggaggcaagccagatgcctccacccgcagggggaacttcagatgatcctgagcccagcggaccccacctcccgagggtgatgcttccaggggtcctcgctggggtttctgcagaagagtcttgggctggccctcaacctctggaaaccctggacacgtag

SEQ ID NO: 240863 - DNA, 927 bp, Artificial Sequence
  Description of Artificial Sequence: Synthetic coding sequence
taagccacagccagagccgcaactgctttcacagaggccacccggcaagcgtggaggctgtctaggactgggaccacctctactatgtggatttcatggccatgctgcccaagacatggcaggactgcgacaggtgcaaggaccgctacctcctccagcccagctgtgaccatggcttggacggccagaccagattccagcggcccttctacaacccccccaaccgctgccgcaacgcgcagcatggcaagtggtcagctgtctgcccctgcctccccaaccgttggcgcttccccatggccagtgaggggacagggctgtaggtccgggggacttacccctgctctcggacttccaggcgtgggactcgtgttgagggtcgaacagcagcctcacctgcctttactcagtactctagccggaattagagttatggtgcatggacgcaatcatacacccttcctcggacaccactccttttctgtcagacctgggaccgaagcaaccatctccataagggaggatgaagttcacaggctgggaagtccgtacggtcattgtaccgcaggaggagagggtgttgaggtcgagctgttgcacaacacatcgtacaccagacaggcatgtctcgtgtcatgtttccagcaactaatggtcgaaacttgctcctgtggatactatctgcatcccctgcccgctggagctgagtattgttcatcggctcgacaccctgcctgggggcactgtttctataggctttatcaagatctggagacccatagattgccttgcacatcaaggtgccctcgaccctgtcgggagtccgcgtttaagttgtcgaccggtacctcccggtggccctccgcaaagagtgctggctggactctggccacactaggcgagcaaggtctgccacaccagtcctag

SEQ ID NO: 240864 - DNA, 2010 bp, Artificial Sequence
  Description of Artificial Sequence: Synthetic coding sequence
atggccgagcaccgcagcatggatggcagaatggaagccgcaacccggggtgggagccacctacaaatcgcctgggcttgcggttcacctgaagccctgcctcccgaaggaatggctgcacagacacatagtgctcagcgctgcctacagactgggccaggctgtagtcctgatgccccacaacctgggcctcctagtgcaccaccacccccacccaaagagggccatcaggagggtctcgtggagttacccgcatcttttcgggagctgctgacctttttctgtactaacgctacaatccatggcgctattagactcgtttgttcgcgcggaaacagactgaagactacctcctgggggttgttgagcctaggagccttggtcgctttatgctggcagctgggactactgtttgaacgccactggcacagaccagtgcttatggctgtgtcggttcattccgagaggaaactgctgcctctggtgacgctctgtgatgggaatccgaggcgcccaagccctgtgctgagacatctcgagttgctggacgaattcgctcgcgagaacatcgacagcttgtataatgtaaatctgagcaaaggcagggctgcactgagcgcaaccgtccctcggcacgagccccctttccaccttgaccgcgagattcgcctgcagcggcttagccattctggcagtcgggttcgagtgggtttccgcctgtgtaattctaccggaggagattgcttctacagaggttacacttcaggtgtggcggctgtgcaagattggtaccacttccactacgtggacattctggcattactgcccgcagcctgggaggacagtcatggatcacaggatggccactttgtccttagttgttcatatgacggtctcgactgtcaggctcgccagtttcgaactttccaccatcccacctacggctcttgctataccgtcgatggcgtctggacagcacagagacccggtattactcacggtgtggggctcgtcctgcgcgtcgagcagcagccgcatctgccgttattaagcacactggccggaattcgcgtgatggtgcacgggagaaaccatactccattcctgggccaccattcattctccgtacggccaggtacagaagccactatcagcataagggaagatgaggtgcatcgcctcggcagcccttacggacactgcaccgctggcggtgagggtgtcgaagtcgagctcctccacaacacctcctatacccggcaggcatgtttagtttcctgtttccagcagctgatggtggaaacctgcagctgcggatactatcttcacccattgccagccggagcagaatactgctcttctgcacgccaccctgcatggggacactgtttctatcgactgtatcaggatttagagacacataggttaccttgtacaagcaggtgtcctcgaccatgcagggagtccgcctttaaattgtcaacaggaacaagccggtggcctagtgccaaatcagcaggatggacgctggccacactaggtgaacagggactgcctcaccaaagccaccgccaaaggagctcactcgccaagattaatatcgtctaccaagagctgaattaccggtctgtggaggaagctcccgtgtactctgtgccacaattactttccgcgatgggatccctctgcagtctctggttcggcgctagcgtattgtcacttctggagctgctggaactgctcctcgacgcgtcggctctcacgctcgtacttggcggtcgtcgcctgcggagagcctggttcagctggcctcgagccagccccgctagtggcgcttccagcataaaacctgaagcgtctcagatgcccccacctgctggtgggacctccgatgatcctgagccatccggccctcatctgcctcgggtaatgctccctggcgtcttggctggagtttcggccgaggagtcctgggccggtccacagcctctcgagactttggatacttag

SEQ ID NO: 240865 - DNA, 2409 bp, Artificial Sequence
  Description of Artificial Sequence: Synthetic coding sequence
atgcgcgcagtgctgtcacagaaaaccactccactacctcgttacctgtggccaggacatctatctggaccaagacggctaacatggtcctggtgcagcgaccaccggaccccgacttgcagagaactcggttcccctcatcccacaccatgtaccggcccagcgcgtgggtggccgcgacgcggtggtggcccatgcggcttcacgagcgcgggtcacgtgctatgcggatatcctctttgcctgctgtcaggcccaattcaggggtgcggcacgggactcggcgattctagtatggcctttctcagtcggacatcccccgtggctgccgcttccttccagtcccgccaggaggctagaggaagcattctgttgcaatcatgccaactgccaccacagtggctgagtaccgaggcctggacgggggagtggaaacaaccacatggaggagctctgacgtccaggtcaccaggacctgtggcgccacagcggccatgccatctgaaaggatggcagcatcgccctacacagcacaacgctgcctgcaaacagggacaagccgctgcacagacacccccacgacctgggcctccctccgcccctcctcctcctcctaaggaggggcatcaggaagggctggtagaactgccagccagctttcgggaactgcttacttttttttgtacaaatgcgacaattcacggcgctatccgtctggtatgctctagaggtaacaggttgaaaacgacgagctgggggctactgtccctgggtgctttagtggccctctgctggcaacttggactcctgttcgaaaggcactggcaccggcctgtcctgatggccgtcagcgtccactcagagagaaaacttctgccactagtcacactgtgcgatggcaatccccgacggccttccccagttctaaggcacctggaactgttagacgaatttgccagggagaatattgatagtctttacaacgtgaatctcagcaagggacgcgcagccttgtctgccaccgtccccaggcacgagcctcctttccacctggacagagaaatccgacttcagagactctcacatagcgggtcccgggtccgtgtaggcttccgactctgcaattccaccggcggagactgtttctataggggatacacaagcggggtggctgccgttcaggattggtaccacttccattatgtcgacatccttgctctgttaccagctgcctgggaagactcccatgggtctcaagacggccacttcgtgctctcctgttcatatgatggattggattgccaagcaagacagttcagaacttttcaccacccaacatatggatcttgctatacagtggacggcgtctggacagcgcagagacctggtatcacacatggagtgggacttgtgctgcgggtagagcagcaacctcatctgcctctcctgtcaaccctagcaggaatcagagtgatggttcacggacgcaaccataccccattccttggacatcacagcttctctgttcgccctggcactgaagccacaatttctataagagaagacgaagtacaccgccttggcagtccatacgggcattgtaccgccggtggggaaggggtggaggttgagctgttgcataatacatcatacacccgccaggcatgtctcgtgtcatgctttcaacagctgatggttgaaacctgttcctgcggatactaccttcatcctcttccggcaggagctgaatattgctcctcagctcgccatcccgcttgggggcattgtttctataggttgtatcaggatttggagacccatagattaccctgcacaagcaggtgtcccagaccctgccgagagagcgcattcaaactgtccaccgggacctccaggtggccatccgcaaagagcgctggctggactctggcaacgctcggggagcaagggctgccccatcaatcccatagacaaaggagttcgctggccaagattaacatcgtgtaccaggagctgaactaccgaagcgttgaagaagctcctgtgtattccgtgccccaactactttccgctatgggatctctgtgctccctttggtttggcgcttcagtgctctctctgctcgagctcctggaattactgttagacgcatcagctctgaccctagtactcggaggccgtaggctgagacgcgcttggtttagctggcctcgggcatcccccgctagcggagcgagttctataaagcctgaagcatcacaaatgccaccccctgccggagggacaagcgacgatcctgagccatctggcccacacctgccccgagtgatgttgccaggagttttggctggcgtgtccgccgaagagtcctgggccggaccgcaacctttggagacgctagacacttag

SEQ ID NO: 240866 - DNA, 1917 bp, Artificial Sequence
  Description of Artificial Sequence: Synthetic coding sequence
atggcagagcatagaagcatggacgggagaatggaggccgctacacgcggtggctctcatttacaagcagctgcccagacccctccccgtccaggcccaccctcagcccctcctccgcctcctaaagaaggacatcaggagggattggttgagcttccagccagctttagggagctacttactttcttctgcacaaatgccacgatacacggcgcaatccggctggtgtgcagcagaggcaaccgcttaaaaacaaccagctgggggctgctcagtttgggggcactcgttgccttgtgttggcaactcggtttgctattcgagcggcattggcaccgacccgtgctgatggctgtgagtgtccactccgaaaggaaactacttcctttggtcacactgtgtgatggaaatcctcggaggccgagtcccgttttgaggcacctcgagctgcttgatgaattcgcccgagaaaatattgatagcctctataatgtcaatttaagcaaaggaagagcggcactcagcgccaccgtgccaaggcacgagcccccatttcacctggaccgggagattagactgcagaggctgtcccactctggatccagagtgagagtgggcttccggctctgtaactctaccggcggtgactgtttttatcgcggttacaccagcggtgtggccgcagtgcaagactggtatcacttccactacgttgacattctggccctcctgcccgctgcgtgggaggatagccacggaagccaggacgggcacttcgtgttgtcctgcagctatgacggacttgactgccaggcccgacagtttaggaccttccaccaccccacttatggatcctgctataccgtcgatggcgtgtggactgcacaacgaccagggatcacccacggggttgggctcgtcctccgcgtggagcagcagccccatttgccactccttagtactctagctggcatccgcgtgatggtccatggcagaaaccatactccatttctgggtcaccacagcttttccgtgagaccagggacggaagctaccatcagcatcagagaagatgaggtccacaggctaggctcaccttacggacactgtactgccggaggcgagggtgtggaggtagagctcctacataataccagttacacaagacaagcctgtctggttagctgtttccagcagcttatggtggagacatgcagctgtgggtactatctacatccactgccagccggtgccgaatactgctcctcagccaggcatccagcatggggacactgcttctatcgcctgtaccaggacctcgagacccatagactgccatgtactagccggtgcccacgcccatgcagggagagcgcttttaagctgtctaccggaacgagccgatggcctagcgccaagtccgccggttggacactcgcaactctgggcgagcagggactgccccatcaatctcacagacagcgctctagtctggccaaaatcaacattgtgtatcaggaactcaattataggagcgttgaggaggccccagtgtactcagtccctcagctactctcagccatggggtccttgtgctctctgtggtttggcgcaagcgttctaagcctcctggagctgctggaactgttgctggacgcgtccgctctgacgttggtgttggggggacgaagacttagaagggcttggttctcgtggcccagggcatctcctgcgagtggcgctagcagtatcaagcccgaggcctcccagatgcctccacccgcaggagggacaagtgacgaccctgagcccagcggcccacacctgcctcgcgtgatgctgccgggagtgctcgcaggagtgagcgcagaggagtcctgggccggaccacagccgctggagactctcgatacctag

SEQ ID NO: 240867 - DNA, 1950 bp, Artificial Sequence
  Description of Artificial Sequence: Synthetic coding sequence
atggccccaggcgagaagatcaaggctaaaatcaaaaagaatctgccagttacagggcctcaagcacccaccataaaagaattaatgcggtggtattgtctgaatacaaacacccacggttgccggagaattgtcgtaagccgcggacggttgcggaggctactgtggatcgggttcaccctaacagctgtcgcgctgattctgtggcagtgtgccctgttggtcttcagcttctatacagtgtctgttagtatcaaagtccacttccgcaagctggatttccccgctgtgactatctgtaacattaatccttacaagtattcgacggtaaggcatttactggcggacctggaacaagagaccagagaagccctgaagagcctgtatggattccctgagagtaggaagcgccgtgaggccgagtcttggaattctgtgagtgagggaaagcagccaaggttttcgcaccgtatccccctgttgatttttgatcaggatgaaaaagggaaggctagagacttttttacagggaggaaacggaaagtggggggaagcatcattcacaaggcaagcaatgtcatgcacattgaatccaaacaggtggtcggttttcaactctgctctaatgatactagcgattgtgccacctataccttctcctctgggataaacgcaattcaggagtggtataagctgcattacatgaatatcatggcgcaagtgccgctggaaaagaaaattaacatgagttacagcgccgaagaactgctcgtaacatgcttcttcgatggcgtgtcatgcgatgctcgaaacttcaccctgtttcaccacccaatgcatggtaactgctatacatttaataaccgtgagaacgagactattctttcgacctcaatgggcggatctgagtatggcttacaggtgatcctgtatataaatgaggaggaatataacccttttttagtgtcgagcactggcgctaaggtgatcattcatcgtcaggatgagtaccccttcgtggaggacgtgggtaccgaaattgaaactgccatggtgacgtcgatcggcatgcatcttacagagagctttaagctgagtgagccctactcccagtgcaccgaagacggctctgacgtccccatacgcaatatctacaacgctgcttactccctacaaatctgtttgcatagctgtttccaaaccaaaatggtggagaagtgcggttgtgcccagtattcacagccactgccacctgccgctaattattgcaattatcagcaacacccaaactggatgtactgttattaccagttacatcgagcttttgtccaggaggaactcggttgtcagagtgtttgcaaggaggcgtgtagcttcaaagagtggaccctgaccactagcttggcccagtggccatcggtggtctctgaaaaatggctactgccggtactcacctgggaccagggtcggcaggttaataaaaagctcaacaagaccgatcttgctaaactgctgattttctataaagatctgaaccaaaggtctattatggaatcccccgctaacagtattgaaatgctcttatctaacttcgggggtcagctcggactgtggatgtcctgctccgttgtgtgtgtcattgaaatcatcgaggtgttttttattgacttcttcagcatcatcgcacggagacagtggcagaaagcaaaggagtggtgggcctggaagcaggccccaccttgccctgaagcacctagaagcccgcaaggccaggataaccctgctctggatattgatgatgatttgccgaccttcaacagcgcattgcatttaccacctgctttggggacgcaggttccgggaacccccccacctaagtataacaccttgcggctggagagggcttttagcaatcaattgactgacacccaaatgctcgatgagctctag

SEQ ID NO: 240868 - DNA, 5942 bp, Artificial Sequence
  Description of Artificial Sequence: Synthetic coding sequence
atggcagctaggctcctggcccctcctggtcctgacagctttaagccgttcacgccagaatcattagctaatatcgaacgtaggattgccgagagtaaacttaagaaaccaccgaaggccgacggttcccatagagaagacgacgaggacagtaagcccaagccaaacagcgacctggaagcaggaaagtccctgccttttatttacggggatataccgcaaggcctggtggccgtgcctctggaggatttcgacccttattatctgacgcagaaaacctttgtggtgctgaacaggggaaagacactgttcagattcagcgctacaccagccctgtacatcctctctcctttcaatctcatacgaaggatcgctatcaagattctaattcactctgtcttctccatgattatcatgtgcaccatactgactaattgcgtcttcatgacgttttctaaccctcccgattggagtaagaacgtggagtatacctttaccggcatttacacattcgagtctctagtcaaaatcatcgcacgcggtttttgtatcgatgggtttaccttcctgagggacccatggaactggctagactttagcgtcattatgatggcttacataaccgaatttgtcaatctgggtaacgtctctgcgctgcggacattcagagtcctccgggcactcaaaactatctctgtgattcccggactaaagaccattgtgggggcactcattcagtccgtgaaaaagctgagcgacgtaatgatcctgacagtgttttgtttatctgtcttcgccctgattggcttacagttgtttatgggtaacctcaggaataagtgcgtcgtgtggccaattaacttcaatgaaagttatcttgaaaacggcacgaaaggttttgattgggaggaatacatcaacaataagacaaacttttacacagtaccaggcatgctggaacccttgctctgtggaaatagtagcgatgccggtcagtgcccggaagggtatcagtgcatgaaggccggtagaaatcctaactacggttacaccagtttcgacaccttctcatgggcctttctagctttattccgcctcatgacccaggactactgggagaatctttatcaattgacgttgcgagcagccggaaagacctatatgattttcttcgttttagttatctttgtgggttctttttacctcgtgaacctcatcttggccgtcgtcgcaatggcgtacgaggaacagaaccaggctaccctggaggaggcagagcaaaaggaggcggaattcaaggcaatgctggagcagctcaagaaacagcaggaagaggcacaggcagcagccatggccacaagcgctggtacagtttctgaagacgcaatcgaagaagagggtgaagaagggggaggatctcctaggtcctccagtgagatctccaaattatcaagcaaatctgctaaagaaagacgtaacagacgcaagaaacgtaaacaaaaagaactgagcgaaggagaggagaaaggagatcctgagaaagtgttcaagtccgaaagtgaagacgggatgagaagaaaggcgtttcggttacccgacaaccgcatagggaggaagttctccattatgaaccagagcttgttaagtattccaggatctcccttcctgtcacggcataacagcaagagttccatctttagcttcagaggcccaggccgtttccgtgatcccggaagcgagaatgaattcgccgatgacgagcacagtacagtggaggagtctgagggacgtcgcgatagcctgttcattccgatccgggcaagggaacgacgatcgtcatactctgggtacagtggctactcccagggctcccgcagcagtcggatctttcctagtttaaggcgaagcgtgaaacggaactctacagtggattgcaacggcgtggtgagcctgatcgggggacctggctcacacatcgggggtaggctactcccagaggcaaccactgaggttgaaattaagaagaagggccctggctccttactggtaagcatggaccagttggcctcctatggaagaaaggacaggatcaattcgataatgagcgtggtcaccaatacgttggtggaagaactggaggagtcccaaaggaagtgccccccatgttggtataagttcgccaatacctttctcatttgggaatgccatccctactggattaaattgaaagagatcgttaacttgatcgttatggacccttttgtggacctcgccatcactatctgtatcgtattaaacaccctgtttatggcaatggagcatcaccctatgaccccccagtttgagcacgttctggcagtggggaacttggtattcaccggtatcttcacagctgagatgtttctcaaattgattgcaatggatccgtactactactttcaagaaggatggaacatcttcgatggattcatcgtcagtctgtcacttatggagctcagcctcgctgatgtggaagggctgagcgtacttcgatcctttaggttgctgagggtgttcaaactggctaaatcctggccaaccttaaacatgctcatcaagataatcgggaactccgtgggagccctgggaaacctcactcttgtgctggctataattgtcttcatatttgccgtggtgggcatgcagttgttcggaaaaagttacaaagagtgcgtctgtaaaatcaaccaagactgcgagctgcccagatggcatatgcatgatttcttccacagttttttgatcgtgttcagagttctgtgcggcgaatggattgagaccatgtgggattgtatggaagtagccggtcaggcaatgtgtttgattgtgtttatgatggtaatggtgattgggaacttagtcgtgttgaatctgtttcttgcgctacttcttagtagtttcagtgccgataacctagcagccaccgacgatgacggggaaatgaacaacctgcagataagcgtgatcagaattaagaaaggagttgcctggactaaactgaaggtgcatgcttttatgcaggctcatttcaaacagcgggaagctgatgaggtcaaacccctggatgagttgtacgagaaaaaagccaattgcatagccaatcacaccggggctgacattcatcggaacggggattttcagaagaacgggaacgggactacctccggaatcggcagttctgtggagaaatacattatagacgaagaccacatgtctttcatcaataacccaaatctgacggtccgagtgcccatcgctgtaggtgagagcgactttgaaaacctaaacacagaagatgtatcatcagagtctgatccagagggttccaaagacaagctcgatgacactagtagcagcgaaggcagtaccatcgatataaagccagaagtagaggaggtgcctgtggaacaacccgaggagtatcttgaccctgacgcctgcttcacagaaggttgcgtgcagagattcaaatgctgtcaggtcaacatcgaagaagggctgggaaagagctggtggatcctgcgaaaaacgtgctttctgatcgtggagcataactggttcgaaacttttatcatcttcatgatcttactctcatccggagccctagctttcgaggatatctatattgaacaaaggaagaccattagaacaatcctggaatacgcagacaaggtatttacctacatatttatcctagagatgctgctgaaatggaccgcctacggatttgtgaaattttttaccaatgcttggtgttggttagatttcctgattgtcgctgtgagtctcgtcagtctcattgccaatgccttgggttatagcgagttaggggctatcaaaagtctcaggacattacgcgctctgcggcctctcagggccctttctaggttcgaaggtatgcgggttgtcgtgaacgcgctcgtgggagctattccaagcatcatgaatgtgctactggtgtgtttgatattctggttaatcttttctattatgggagttaacctatttgccggtaagtaccattattgctttaatgagacatcagagatcaggtttgagattgaggacgtcaacaacaagaccgaatgcgagaagcttatggagggaaataacactgaaatcaggtggaaaaacgtgaaaatcaactttgacaatgtgggggctgggtatttagcccttttacaggtagccaccttcaaagggtggatggatataatgtacgccgctgtggattccagaaaaccggacgagcagcccaagtacgaggataatatatacatgtacatctacttcgtgatattcattatattcggcagcttctttacactgaacctgtttatcggggtgattattgataattttaaccagcagaagaaaaagttcggcggacaggacatattcatgacagaagaacagaagaaatactacaatgcaatgaagaagctgggaagcaagaagcctcagaagcctatacctaggccgctcaacaaaatccagggcattgtttttgattttgtgacacagcaagctttcgacatagtaattatgatgttgatttgtttaaacatggtaaccatgatggtggagacagatacccagagcaagcagatggagaacattctgtactggatcaatcttgtgttcgtaattttcttcacctgtgaatgcgtcttgaagatgtttgctttacgacactattatttcactataggctggaacattttcgattttgtagtcgttatcctgagcattgtgggaatgttcctggcagacataatagaaaagtacttcgttagcccaactctgttccgcgtgatccgcctggcacgaattgggaggattctccggctgataaaaggagcgaaggggattcggacattgctgttcgcattaatgatgtccctgcccgctcttttcaacatcggattgctcctatttctcgttatgtttatttttagcatttttggcatgtccaattttgcgtacgtgaaacacgaggccggtatcgacgacatgttcaacttcgagacgtttgggaatagcatgatatgtctctttcagattactaccagtgccggatgggatggccttttactgcccattcttaatcgtcctcctgactgttcgcttgacaaagaacatcccggatctgggtttaaaggtgactgtggcaatccgagcgtagggatcttctttttcgtgtcttatatcatcatatcttttctgattgtcgtcaatatgtacatcgccattattcttgaaaactttagcgtcgccacagaagagtccgctgacccactttctgaggacgactttgagacattttacgagatttgggaaaagttcgatcccgatgccactcagttcatcgaatattgcaagcttgctgatttcgcagacgctctggagcacccccttagagtgccgaagcctaatacaatcgaactgatagccatggatctgcctatggtttccggcgataggatccattgcctggatattctcttcgccttcaccaagcgtgttttaggcgacagcggcgagctggatatcttgcgccagcagatggaggaaaggtttgtggcgtctaatccatcaaaagtcagctatgagcctatcacaacaacccttagacgtaaacaggaggaagtctctgcagtggttctccagagggcgtatagaggccatctcgcccgaagaggtttcatctgcaagaagaccacctcaaataagctcgaaaacgggggaacacatagggaaaagaaagagtcaaccccttcgaccgcatctctcccctcctatgactcggttaccaaacctgaaaaggagaagcagcagagggccgaagaagggaggcgcgagcgagcgaaaaggcagaaggaggtccgcgagtctaaatgcta

SEQ ID NO: 240869 - DNA, 4674 bp, Artificial Sequence
  Description of Artificial Sequence: Synthetic coding sequence
atggctgcccgacttctggcgccacctggtcctgatagcttcaagccctttactccagaatccttagccaatatagaacgaaggatcgctgaatctaaactgaaaaaacctcccaaggccgacggttcccatagggaggatgacgaagatagcaaacccaagcctaacagcgatctcgaagcgggaaagtccttgccattcatctacggggacattcctcagggtcttgtagccgtgccactcgaagacttcgatccatattacctgactcagaagacttttgttgttttgaaccgcggaaagactctgtttcgattttctgcgacgcccgctctgtacattttgtcccctttcaatctgatccgcagaattgccatcaagatcctcattcatagtgttttttctatgatcataatgtgtacgattctgaccaactgtgtgtttatgaccttctctaatccacctgactggtcaaaaaacgtggagtacacattcactggtatatataccttcgaatctctcgtgaagattatcgcacgtggcttctgtattgacggatttacctttctcagggacccctggaactggctggacttctccgtaataatgatggcctacatcaccgaattcgtgaacctgggaaatgtgtccgctcttaggacgttcagagttctccgcgctctcaagactattagcgttattccaggccttaaaacgattgtaggggcactaatccagtctgtaaagaaactttcggacgtgatgattctcacagtgttctgtctgtcggtgtttgccctgatcggcctacagctcttcatgggcaacttgaggaacaaatgcgttgtgtggccaataaacttcaacgagtcctacttagagaatggcacaaaaggattcgactgggaagaatatatcaacaataaaaccaatttctacactgtacctggtatgttggagcctctgctgtgtgggaactcatccgatgctggccagtgtccagagggataccagtgtatgaaggcaggtcgcaacccaaactacggatacacatcttttgatacctttagttgggcctttctggccttgttccgcctcatgactcaggattactgggaaaacttgtatcagcttactctccgagctgccggaaaaacatacatgatatttttcgttttggttattttcgtggggtctttctatttagtaaatctcatcctcgcagttgtggcaatggcgtatgaggagcagaatcaggcaacacttgaggaggcggagcaaaaggaggccgagttcaaggccatgctcgaacaacttaagaaacagcaagaagaggctcaggctgccgcaatggcaacctccgccggaaccgtatccgaggacgcgatcgaagaggagggggaggaggggggtggcagccccaggagtagctccgaaatctccaaattgtcatcaaagtccgctaaagagcggaggaatagacggaagaaacgtaaacagaaggagctttcagagggcgaggagaagggggaccccgagaaagtgttcaagtccgagtctgaagacggcatgcgccgtaaggcattccggctgccagacaatagaatcggcaggaaatttagcatcatgaatcagtccctactgtccattcctggtagcccctttctgagtcgccacaacagcaaaagctcaattttctcgttcagggggcctggcagattccgcgaccctggaagtgaaaacgagtttgcggacgatgaacacagtacggtggaggagtctgaaggaagaagagatagcctcttcatcccaatccgggcaagggagcgaagatccagctatagtggatactctgggtatagccagggcagcaggtcctctagaatcttcccgagcctacggagaagtgtgaagcgaaactcaacagtggactgtaatggcgtcgtttctcttataggcggaccaggtagtcacatcggcggaagattactccctgaagcaacaaccgaagtcgaaatcaaaaagaaaggacccggttccctgctggtatctatggatcagctggcatcttacgggagaaaggaccgtatcaatagtatcatgagcgtagtgacaaatactttagttgaagagctcgaagagtctcagagaaagtgtcccccatgttggtacaagtttgctaataccttcctaatttgggaatgtcatccatactggattaaattgaaggaaattgtcaacttgattgtgatggatccttttgtcgacctggccatcaccatctgtattgttctgaacacgctcttcatggcaatggaacaccaccccatgaccccccagtttgagcacgttctcgccgttggaaatttggtcttcaccggcatctttaccgccgaaatgtttctgaagttgatagccatggacccttattactactttcaggaaggatggaacatcttcgatggctttattgtgtctctctccttaatggagctcagcttggccgacgtggaaggactgagtgtgctccggtccttccgattactccgagtctttaaattggccaaaagctggcccactctaaacatgctaatcaagatcatcggtaattcagtcggtgctttgggcaacttaacccttgttctggctataattgtgttcatattcgcagtggttggcatgcaactgtttgggaaatcctacaaggagtgcgtttgtaaaattaaccaagactgtgagctacctcggtggcacatgcacgacttcttccattccttcctcatcgtttttcgtgtcctttgtggagagtggattgagaccatgtgggactgtatggaggtggctgggcaggccatgtgtctcatcgtgttcatgatggtgatggtgatcggaaacctcgtggtcttaaacctgtttcttgctcttttactctcgtcctttagtgccgacaacctcgccgcaacagacgatgatggagaaatgaataatttgcagattagcgtgatcagaatcaaaaagggggtggcatggacaaaactgaaagtgcacgcatttatgcaagcgcacttcaagcagagagaagcagacgaagtaaaacctctcgatgagctttatgaaaagaaagccaattgcattgccaaccatacaggagctgatatacacagaaatggggactttcagaaaaatggcaacggtaccaccagcgggataggtagctcggtggaaaaatatataattgacgaggatcatatgtcattcattaacaatcccaacctgactgtaagagtaccaatagccgtgggggaatctgatttcgaaaatctgaacaccgaagacgtgtctagcgagtccgatccggaagggagtaaagataagctggatgacaccagcagcagcgaaggcagcactatcgatataaagcctgaagtagaagaggttccagtggagcagcctgaggaatacctggaccctgatgcttgttttactgaggggtgtgtccagcgctttaaatgctgtcaggtaaatattgaggaggggttaggcaaaagctggtggatcttgcgaaagacatgcttcttgatagtggaacataattggtttgaaacattcataattttcatgattctgctcagtagcggcgctttagccttcgaagatatttacattgagcagagaaagactattagaaccatcttagaatacgcagataaggtgttcacttacatatttatattggagatgctcctgaagtggaccgcgtatgggttcgttaagttttttacgaatgcctggtgctggctggacttcttaatcgtcgcagtcgtcgtcaacgcactcgtcggcgcaataccatctatcatgaacgtgttactggtgtgtctaattttctggcttattttctcaatcatgggcgtaaacctgtttgctggtaagtatcactactgcttcaacgagaccagtgaaataaggtttgagatagaagacgtcaataacaaaactgagtgtgagaagctgatggaaggaaacaataccgaaatacgctggaaaaatgtaaagatcaattttgacaatgtaggggctggttacctggccctgcttcaggtagcaacctttaagggctggatggacatcatgtatgctgctgtggatagtcgtaaacctgacgagcagcccaaatacgaagataacatttacatgtatatctatttcgtcatctttattatcttcggaagcttctttacattaaacctgtttatcggggttattatcgataattttaatcaacagaagaagaaattcggtggccaggacatatttatgaccgaagagcaaaaaaagtattataacgctatgaaaaaacttggcagtaaaaagccacagaagcccattcctaggccgcttaacaagatacagggaatcgtgtttgacttcgtcactcagcaagcatttgatatagttattatgatgctgatctgcctaaatatggtgacaatgatggtcgaaacagacacacagtccaagcagatggagaacattctgtactggatcaatctggtgtttgtaatttttttcacatgcgaatgtgtgctgaaaatgtttgctttgaggcattactatttcaccatcgggtggaatattttcgattttgtggtcgttatactctccatcgtgtag

SEQ ID NO: 240870 - DNA, 3588 bp, Artificial Sequence
  Description of Artificial Sequence: Synthetic coding sequence
tttttgtcccctcagactttcgtggtcttaaaccggggaaaaacgttgttccgcttctctgctacaccagcactgtacattctgtcaccttttaaccttatccgccgtatcgctatcaaaatcttgatccatagtctgttttccatgatcataatgtgtacgattcttacgaattgtgtgtttatgactttttctaacccaccagactggagtaaaaacgttgaatacacttttactggtatctacacattcgagagcctcgtgaagatcatcgcaagggggttctgcatagacggtttcaccttcctgagggacccctggaactggcttgacttctccgtgattatgatggcgtacatcaccgaattcgtgaacctcgggaatgtgagtgccctgcggactttccgggtgctgagggccctgaaaaccatttcggtgattccagggctcaagacaatcgtgggcgctctcatccagtccgtcaagaagttatcagatgtgatgattctgactgtgttttgcctgagcgtcttcgcgttgataggcctccagctcttcatgggtaaccttcggaacaagtgtgtcgtgtggccaatcaacttcaacgagtcctacctcgaaaatggcaccaaggggttcgactgggaagagtacatcaacaataagactaacttctacacagtccccggaatgttagaacctttgctctgcgggaactcttccgatgccggacaatgtcctgagggctaccagtgcatgaaggccggacgcaaccctaattacggctatactagctttgatacgttctcatgggctttcctggccttattcagattgatgacacaggattactgggaaaatctttatcaacttactctaagggctgcagggaaaacttacatgatattctttgtcctggtaattttcgtgggcagcttttacctcgtgaatctaattctggcagtggtggctatggcttacgaggagcagaaccaagccaccctagaggaggccgaacagaaggaggcagagttcaaggctatgctggagcagctcaaaaaacagcaagaggaagcgcaggctgctgctatggcaaccagcgctggtactgtgtccgaggatgcgatcgaggaggaaggtgaggaaggtgggggatctcccagatcgtcttccgagatcagcaagctctcatccaagtcagccaaggagcgcagaaaccggcgtaaaaaacgtaaacagaaggaattgtccgaaggagaggaaaagggggatcctgagaaggttttcaaatctgagagcgaagacggcatgcgacggaaagctttccgtctccccgacaatagaatagggaggaaattcagtatcatgaaccaaagtttactgtccattccagggagtcctttcctgagccgtcataactctaaaagctcgattttttcctttcggggacctggacgattccgggatcccggtagtgaaaatgagtttgccgacgacgaacacagcactgtggaggagtcagagggaagacgcgattcccttttcattcctattcgtgccagggagcgaaggtcttcctactccggctactccgggtactcacaaggcagtaggagttcgaggatctttccttccctcagacgttcagtgaaacgcaacagcacggtggattgcaatggagtggtttctcttatcggaggtcctgggagtcacattggaggcaggttgctgccggaagccaccaccgaggtcgagataaagaagaagggaccaggatccctcctcgtgtcaatggaccagctcgcctcgtacggcagaaaagatcggattaattccatcatgagcgtcgttaccaatacgcttgtcgaggaactggaagaaagtcagcgcaagtgtcctccgtgttggtataagtttgccaataccttccttatatgggagtgtcatccttactggatcaaattgaaggagattgtcaaccttattgtaatggacccattcgtagatctggctatcacaatctgtatagtcctgaacacgctcttcatggctatggagcatcatcccatgacacctcagttcgaacatgttctcgccgtgggtaatttggtatttaccgggatctttacagctgaaatgtttctcaaactgatcgcgatggatccatactactatttccaggagggctggaacatatttgatggtttcatcgtgtccctgagcctaatggagctgagtctggccgatgtcgagggtctcagtgttcttagatcatttcgacttttgcgcgtgttcaaactagctaagagttggccaactctgaatatgctgattaaaatcatcgggaatagcgttggcgcactgggaaacctgacattggtgctcgctattatcgtgttcattttcgctgtcgtgggcatgcagctttttggtaagtcatacaaagaatgcgtctgcaaaataaaccaggactgcgaattaccgaggtggcacatgcacgactttttccactcattcttgatagtgttccgcgtgttgtgtggggaatggatcgagacaatgtgggattgcatggaggtggccggacaggcaatgtgcttgatagtatttatgatggtgatggttataggcaacttggtggtattgaatttgttcctcgccctgctgctgtccagtttctccgcagataacctggctgccactgatgatgacggggagatgaacaacttacaaatttccgtaatccgcatcaagaagggcgttgcctggaccaaacttaaggtgcacgcttttatgcaggcacactttaaacagagggaggctgatgaagtaaagcctctggacgaactatacgaaaaaaaggcgaattgtattgcaaaccacacaggcgcagacatacacagaaatggggactttcagaagaatgggaacggcacgacgagtggaatcgggtcatcagtggaaaaatacatcatcgacgaagatcatatgtcattcataaacaatccaaatctaacggtccgggtcccgatcgccgtgggggaatccgacttcgagaatctaaacacagaggatgtgtcaagtgagagcgaccctgaaggatcaaaagataagttagatgacacatcctcaagcgaagggtcgacaatcgacattaaacccgaggtagaagaggtccctgtggagcagcctgaagagtacttggatcccgacgcttgtttcacagaggggtgcgttcagagatttaaatgctgccaggtcaatatagaagagggtcttgggaagagctggtggatcctccggaagacttgctttctgattgtcgaacacaattggtttgaaacattcatcatctttatgatcctcctgagttcaggcgctttggcttttgaggatatctatattgaacaacgtaagacgataagaacaatacttgagtatgcagataaagtgtttacctacatcttcatactggaaatgctgctcaaatggacagcctatgggtttgttaaattttttacaaacgcttggtgttggctggacttcttgatcgtcgctgttcccctcaacctctctggccttatctag

SEQ ID NO: 240871 - DNA, 5819 bp, Artificial Sequence
  Description of Artificial Sequence: Synthetic coding sequence
atggctgccagactcctagctcccccagggccagacagttttaaaccctttactccagaatctctcgcaaatattgaacggagaattgccgaatcgaagctaaagaagccacctaaggccgatggatcccacagggaagatgacgaagactccaaaccaaaacccaactcagacctggaagccggtaaatctttaccttttatatacggtgatatccctcagggcctggtcgccgtgccccttgaggacttcgacccttattatttgacccagaagacttttgtagtcttgaatagagggaagactctatttcgattctccgctaccccggcactctacatcctgtccccctttaacctcatccggagaattgcaatcaagatcctgatccatagtgtctttagtatgatcattatgtgcacgatcttgactaactgcgtgtttatgacgttttccaacccacccgactggtctaaaaatgtggaatatacatttactggtatctacacctttgaatctctagtcaagatcattgcacggggtttctgcattgatggcttcaccttcctacgggatccttggaactggctggacttttccgttattatgatggcgtacataactgagttcgttaacctcgggaatgtatctgcccttcgaaccttcagggttctgagagcactgaagaccatctccgtcattcctggcctgaaaacaattgttggtgctttaatccagagtgtgaagaagctaagtgacgtgatgatcctcaccgttttctgcctttcggtgtttgccctgatcggacttcagttgtttatgggaaacctgcgcaacaaatgcgtagtgtggccgataaacttcaacgaatcctaccttgagaacggaactaagggctttgactgggaggaatatatcaacaataagacaaacttttacacggtaccaggaatgctggagcccttgctgtgtggtaactcctccgacgcaggccagtgcccagaaggttaccagtgcatgaaagccggaagaaaccctaactacgggtacacatctttcgacacattcagttgggctttcctcgcgttattccgccttatgactcaagattattgggaaaatctttaccagttgactttgcgagccgctggaaagacttacatgatcttttttgttctggtgatttttgttggctcattctatctggttaatctgatattggctgtggtggctatggcatatgaggaacagaaccaggcaacccttgaagaggccgagcagaaggaagctgagtttaaagctatgcttgaacagctcaaaaagcagcaggaagaagcccaagccgcagctatggccacgagcgccggtacggtgagtgaagatgctattgaggaagagggtgaagagggtggcggaagcccaagatccagctctgaaatcagcaaattaagctctaagtccgctaaagagcggcgtaacagaagaaagaaaagaaaacagaaagagcttagcgaaggcgaagagaaaggtgatcctgagaaggtttttaaatctgaaagcgaggacgggatgcgacgcaaggcctttcgactgcctgacaatcggatagggaggaaatttagtatcatgaaccagtcccttttgtcaattcctggctccccattcctttctagacataatagtaagtcctctatcttctccttcagagggccaggaaggtttagggaccctggctcagaaaacgagttcgctgatgatgaacattctaccgttgaggaatcggaaggacgacgggactcattatttatacctatccgtgctcgggaacgacgctcctcatattcaggctacagcggatattcacagggaagtagatccagtcgcatcttcccatctctcagacgaagtgtcaaacggaattccacagtggattgtaacggcgtggtctctctcatcggtggcccagggtctcacattggtggacgcctactacctgaagccacaacagaagttgaaatcaaaaagaagggacccggatccctgcttgtgagtatggatcagctagcctcatatggacggaaggaccgaataaatagtataatgtctgtggtcactaacactctggtcgaagaactggaagaatctcagcgcaaatgccccccttgctggtacaaattcgcgaacacttttctcatctgggaatgccacccatactggattaagctcaaagaaattgttaatctcatcgtcatggacccctttgtggacctcgcaataacgatttgtattgtgctcaacacattgtttatggccatggagcaccatcccatgacacctcaattcgagcatgttctcgctgtggggaaccttgtttttactgggatcttcacggcagagatgtttcttaaactgatcgccatggacccctactattattttcaggagggatggaacatctttgacggctttatcgtgagcctgtcactgatggaactgagcctcgcggacgttgagggactttctgtactccggagcttccggctgctccgggtcttcaagctcgccaagtcatggcccactctgaacatgcttattaagataatcgggaactccgtgggggctctggggaatctcactctagtgctggccatcatcgtttttatcttcgccgtggtaggaatgcaactgttcggcaaatcctacaaagaatgcgtgtgtaagattaatcaggactgcgagctccccagatggcatatgcacgactttttccatagcttcctgatcgtgtttcgagttctttgcggtgagtggatagagacaatgtgggactgcatggaggtggctggccaagctatgtgcctgatcgtgttcatgatggtgatggttattgggaatctcgtcgtcttgaacctgttcctcgcactgctgctttcctcattctcagccgacaatctggctgcaactgatgatgacggcgagatgaataacttacagatcagcgtgatcagaatcaagaagggggtggcttggactaagctgaaggtgcacgcttttatgcaggctcacttcaaacagagagaggctgacgaggtgaagccgctggacgaactctacgagaaaaaggccaactgcatcgccaatcacacgggcgcagacattcaccgaaatggcgattttcaaaagaacggtaatggcaccaccagcggcatcggctcttccgtcgaaaaatatataattgacgaagaccacatgagcttcataaataacccaaatcttacagtgagggttccaatcgctgttggcgagtcggacttcgagaacttgaacacagaagatgtttccagtgaaagcgaccccgaggggtctaaagacaagcttgatgatacctcctcatccgagggctccacaattgatataaagcctgaagttgaggaggtgccagtagaacaacccgaagaatatcttgaccctgacgcatgcttcacagagggttgtgttcaaagattcaagtgctgtcaagtgaacattgaggagggtctgggtaagagctggtggatcctgagaaaaacatgcttcctgatcgtcgaacacaactggttcgaaacatttattatcttcatgatcctgctgtcttccggggcattggctttcgaagatatttatatcgaacaaaggaaaaccattcgcaccatcttggaatacgccgacaaggtgttcacttacatcttcatacttgagatgctgttgaaatggaccgcgtacggttttgtaaaattcttcactaacgcatggtgttggctcgatttcttgatcgtcgccgtggttgtcaatgccctggtgggggctatcccgagcatcatgaatgttctgctggtgtgtctcatattctggctgatcttctctatcatgggtgtgaacctgtttgccggaaaatatcactattgttttaatgaaacctcagaaatcagatttgaaatcgaggatgtcaataacaaaactgaatgcgaaaaactaatggaggggaataatactgagattcggtggaagaatgttaagattaacttcgataacgtaggcgctggataccttgccctcttacaagtcgctacattcaagggatggatggatattatgtatgctgcagtggactcccgcaagcctgacgagcagcccaaatatgaggataacatctacatgtacatctattttgtgattttcataatctttgggagtttttttacccttaatctgttcatcggagtgattattgacaactttaaccagcagaagaagaagttcgggggtcaggatatcttcatgacggaagaacaaaagaagtattacaatgccatgaagaaactgggctctaaaaagcctcaaaaacctattccacgcccattgaacaaaatccagggcatcgtgttcgattttgtcactcaacaggcattcgacattgttattatgatgttgatatgcctgaacatggtgaccatgatggtggaaactgacacccagagcaagcagatggagaacattttgtattggatcaacctggtcttcgtcatcttttttacttgcgaatgcgtgctgaaaatgttcgcactgcgccactattacttcacgattggctggaacatttttgattttgtggttgtgatcttatctattgtcggaatgttcctggccgatattatcgaaaagtactttgtctcccccacactattccgcgtcatcaggctggcgcgaatcggtaggattttgcggctcatcaaaggtgccaagggcatccgtacgctgctgttcgcactgatgatgtccttgccagccctcttcaatatcggcttgctccttttcctcgttatgttcattttcagcatttttggaatgtcaaactttgcatatgtgaagcacgaggcaggtatcgacgatatgttcaactttgaaactttcggaaacagcatgatttgtctgttccagatcactacttctgcaggctgggacggtctgttgctgcctattcttaaccgtcctccggattgttccctggacaaagaacacccgggaagcggcttcaagggagactgtggaaatccttccgtggggatcttctttttcgtatcctatataatcatctcctttcttattgttgtcaatatgtatatcgccattattctggaaaacttctccgtggcgactgaggagagcgcagaccctctctctgaggatgactttgagactttttatgagatctgggaaaagtttgaccccgacgccacccagttcattgagtattgcaagctggctgattttgcagatgcgctcgagcaccccctacgcgtgccaaagccaaatacaatcgagctgatcgccatggatctgcccatggtgagcggggatcgtattcactgtttggatatcctcttcgcatttacaaagcgcgtgcttggcgattcgggagagctggacatactgcggcaacagatggaagagaggttcgtggcttcgaatcccagcaaggtgtcgtatgagcccatcactactactctcagaaggaagcaagaggaggtgagtgcagtcgtcctgcagagagcctacagaggacacctagcccgacgcggattcatttgcaagaaaactaccagtaacaagctcgaaaatgggggaacccacagagaaaagaaagaaagtactccctctaccgcgtcattgccatcttatgactctgtcacaaagcctgagaaggagaaacagcagagggcagaagaagggaggcgtgagcgagccaagcggcagaaagaggtgagggagtctaaatgcta

SEQ ID NO: 240872 - DNA, 2919 bp, Artificial Sequence
  Description of Artificial Sequence: Synthetic coding sequence
atggccgcacggctactcgcgccacccggaccagattcgtttaaacccttcacacctgaaagcctggccaacatcgagcgaaggatcgcggagtctaagctgaaaaaaccccctaaggccgacggaagtcatcgggaggatgatgaggactctaagcctaagcccaatagtgacctggaagccggaaagtcgctgccctttatctacggtgacatcccccaggggctggtcgctgttcctctggaggacttcgatccatattacctgactcagaaaacgttcgtagtgctcaatcgcggaaaaaccttatttcgcttcagcgcgacccccgcactgtatatattgtccccctttaatctaatccggagaatagccatcaagatcctcattcacagcgttttctccatgatcatcatgtgcactatcctgaccaactgcgtatttatgactttttcaaaccccccagattggtcaaaaaatgtcgagtacacgtttacaggtatttatacctttgagagtctcgtgaaaatcatcgcgaggggattctgcatagacggcttcacattcctacgcgacccgtggaactggttggatttcagcgtgattatgatggcatacgtcaccgagtttgtggatttaggcaatgtctccgcactgagaacctttagggtcctgcgggctctaaagactatatcagtcatcccgggactgaagacaattgtcggggctctcatccagtcggtgaaaaagctcagcgatgttatgattttaacagtcttttgcctgagcgtgttcgcactgatcgggctacagctgtttatggggaatctgcggaataaatgcgttgtctggccgataaacttcaacgaaagctatctggaaaatggtacaaaaggcttcgactgggaggaatatattaacaataaaaccaatttttatactgtaccaggcatgctcgagccgttactttgtggcaactcttctgacgccggtcagtgtcccgaaggatatcagtgtatgaaggcaggacggaaccctaattatgggtatacaagttttgacaccttttcatgggcttttctagctctctttcggctcatgacgcaggattattgggagaacctctatcaactcactctgcgtgctgccggaaaaacatacatgattttcttcgtgctagtgatcttcgttggatcattctacctggttaatttaatcctcgcagtcgtggcaatggcttacgaggagcaaaaccaagcaactttggaggaggccgagcagaaagaggccgaattcaaggctatgctcgaacagctcaagaaacaacaggaggaggcccaggccgcagctatggccacttcggccggtaccgttagtgaagacgctatcgaagaggaaggagaggaaggtggtggttctccacgctcctcaagtgaaattagcaagttaagttcaaagtcagctaaagagcgcagaaaccggagaaagaagcgcaagcaaaaagagttgtccgaaggggaagaaaagggcgacccagagaaagtctttaagtctgaaagtgaggacggcatgcggcgtaaagcgtttcgcctgccagacaaccggattggacggaaattctcaataatgaatcagtcattattgagtattcctggctctccttttctcagtagacacaactccaagtctagtatcttctctttccgcggacctgggagattccgcgatcccggaagtgaaaacgaatttgccgacgacgagcactctaccgtggaagagtcagagggaagacgagacagcctctttatacctattcgtgccagagaaaggagatcatcatactctggctactcaggctactcccagggttccaggtccagcaggatcttccctagccttcgccgttcagtcaagagaaactctaccgtggattgcaacggcgttgtgagtctgataggagggcctgggtctcacatcggagggaggctgttacctgaggctactacggaggtggagatcaaaaagaaaggaccgggttctcttctggtttcaatggaccagctcgcctcctacgggaggaaagaccggattaattctatcatgtccgtggttacaaacaccttggtggaagagctcgaagagagccagcgcaaatgccctccatgctggtataaattcgctaatactttcctcatctgggaatgtcacccctactggatcaagctcaaggagattgttaacctcatcgtgatggacccattcgttgatctggctataacgatctgtatagtcctgaataccctgttcatggctatggaacaccaccctatgactccacagtttgaacacgtcctggccgttggtaacctggtgtttaccggaattttcactgcagagatgtttctcaagctgatcgccatggacccctactactacttccaggagggatggaacatattcgacgggtttattgtatcactgtctctgatggagctttccctagcagacgttgagggcctgagtgtgctgcggtcttttcgattgcttagggtgttcaaactcgcaaagagttggcccacgctgaatatgctgatcaagataataggtaatagcgttggtgcattagggaacctgacactggtgctggccatcatcgtctttatttttgccgtggtcgggatgcaactcttcggcaagtcatataaagagtgcgtgtgtaaaatcaaccaggattgtgagctcccccgatggcatatgcacgactttttccactcatttcttatcgtgtttagggtgctctgcggtgagtggatagagacaatgtgggattgcatggaggtggctgggcaagctatgtgcctaatcgtctttatgatggtgatggttatcggcaacttggtggtttctacaaatttgtag

SEQ ID NO: 240873 - DNA, 6030 bp, Artificial Sequence
  Description of Artificial Sequence: Synthetic coding sequence
atggaacaaaccgttctcgttccccctggtcccgacagctttaattttttcacacgagaatcgttggcagctatcgagcgacgaatcgctgaggaaaaagccaagaaccctaagccagataagaaggatgatgacgagaatggcccaaagcctaactctgatctggaagccggaaaaaacctaccatttatttatggtgatatcccacctgagatggtgtcagaacccctggaagacttggacccttactacatcaataagaaaaccttcatcgtgcttaataaaggcaaggcaatctttaggttctcggctacgtctgccttgtacattttgacgccgtttaaccccctcaggaaaatagctattaaaatcttagtccactctctctttagcatgctgataatgtgtactattctgacaaactgcgtgttcatgaccatgagcaacccaccagattggacaaagaacgtcgaatatacatttactggaatttataccttcgaaagcctcatcaaaatcattgctcggggtttttgcctggaggactttacatttctgcgggatccatggaactggctcgactttacagtcatcacgttcgcctatgtgaccgagtttgtggacctgggaaacgtgagtgccctgcgcacattccgggtcttacgagcactcaaaactatttccgtgattcctggtctgaaaaccattgtgggagccctcattcagtcggtaaagaaactgagtgacgtgatgatattgactgtattctgcctttccgtgttcgcactcataggattgcagcttttcatggggaacctgagaaacaagtgcatccagtggccacctaccaacgcttccctggaggaacactccatcgagaagaatattacagtcaactacaacggaacactgatcaatgagacagtttttgaattcgactggaagagttacatccaggatagccgctatcactatttccttgaagggttcctggacgcccttctgtgcggtaattccagtgacgccggtcagtgccccgaaggatatatgtgtgtgaaagctgggcgtaacccgaattacggatacacttcatttgatactttctcttgggccttcctgagtctttttcgactgatgacccaagatttttgggaaaacctttaccagcttactctgcgcgctgcaggcaagacatatatgatctttttcgtgctggtgatcttcctcggaagtttctatctcattaatctgatcctggccgtggttgccatggcctatgaggaacaaaaccaggctaccttagaggaagccgaacaaaaagaggccgaattccagcagatgattgagcagctgaagaagcagcaagaagccgctcaacaggctgccacggccaccgcatcagagcattcccgtgagcccagcgccgcaggcagactctctgactccagctcagaggccagcaaactgtcatccaagagtgcaaaagaaaggaggaatcgccgtaaaaagcgaaaacagaaagagcagtccggcggagaggagaaagacgaagatgagttccagaaaagcgagtctgaggattcaatccgtcggaaagggttcaggttctcaatagaagggaacaggcttacatatgaaaaacgatactcttcgccccaccagtccctcctctcgatacggggtagccttttttcgccccgaaggaattccaggacttccttgttctcctttagagggcgtgcaaaagacgtggggtctgagaatgacttcgcggacgacgagcattcgacgtttgaggacaacgagtcacgcagagacagtctcttcgtgcccaggcggcacggcgagcgtaggaacagcaacctatctcagactagccgctcgagcagaatgctggccgtgttccccgcaaatggtaagatgcactctaccgtggattgtaacggagtggtcagcctggttggaggcccttccgttcctacatcccctgttggtcagctgcttccagaagtgatcattgacaaacccgcaacggacgacaatggtaccactaccgaaaccgagatgcgcaagcggaggagctcaagtttccacgtgtcaatggatttcctcgaggatccatcacagcgacaacgcgcaatgagtatagcatcaattttgactaataccgtggaggaactggaggaaagccgacaaaaatgccctccctgctggtataagttcagcaacattttcctgatctgggattgttctccctactggttgaaggtaaaacatgtggttaatctggtcgtcatggacccatttgtggacttggccatcaccatctgtatcgttctgaacaccctctttatggctatggagcactatcctatgactgatcacttcaacaacgtgttgaccgtgggcaatctcgttttcaccggcatatttaccgctgaaatgtttctgaaaattatcgcgatggatccctactactatttccaggagggttggaatatttttgatggattcatcgtgactctgagcctcgttgagcttggtttggctaacgtggaaggactgtccgtgcttcgaagcttccggttactgcgcgtgttcaaactcgccaagagctggccaaccctgaacatgctgatcaagattataggaaactctgtgggcgctctgggtaatctgacattggtactcgccattatcgtattcatttttgcggtagtggggatgcaacttttcggtaaatcatacaaagactgtgtctgcaagattgcgagtgactgtcaattacctagatggcacatgaatgatttctttcacagttttttaatagtatttcgagtcttatgcggggagtggatagaaactatgtgggactgcatggaagttgcaggacaggcaatgtgcctgaccgtgttcatgatggttatggtcatcgggaacctggtggtcttgaacctgttcctcgccctcttactgtccagcttttccgcagataacctcgctgcgaccgacgatgacaatgaaatgaataacctgcaaatcgccgttgacaggatgcacaagggggtcgcctacgtcaaacgaaagatttatgaattcatccagcagtcctttattagaaagcagaaaattctggatgaaatcaagcccctcgacgatttaaacaacaagaaagattcctgtatgtctaatcacacagctgaaatcgggaaggatctagactatttaaaggacgttaatggtactacctcggggattgggactggctcatcagtggagaagtatatcattgatgagtctgattacatgtccttcatcaataacccttcactgaccgtcaccgtgcccatcgcagttggtgagagtgactttgagaatttgaataccgaggatttttccagcgagagtgatttggaagagtccaaggaaaagttgaatgagagtagctcatcttccgaagggagcactgtcgacatcggagccccagtggaagagcagcccgttgtcgagcccgaagaaaccctggagccagaagcttgttttactgaggggtgcgtgcagagattcaaatgctgccagatcaacgtcgaagaggggcgaggtaagcaatggtggaatctcaggcggacgtgtttcaggatcgttgagcataattggtttgaaacattcattgtcttcatgatcctactgagtagtggcgctctcgccttcgaagatatttacatcgatcagcgtaagacaatcaagaccatgctagaatacgccgacaaggtattcacctatatttttattctggagatgctgttaaaatgggtggcttacggataccagacttacttcacaaacgcttggtgttggttggacttcttgatcgtcgacgtgtccctagtgtctctgacggccaacgccctaggatattccgaactgggggctatcaagtccctccgcactctcagagctctgcgccctctgcgggcactgtcccggtttgaaggaatgcgagtggtggtgaacgccctgttaggcgctatcccctcaataatgaatgtcctgctggtctgtcttattttttggctcatctttagtatcatgggcgtcaatctgtttgccggtaaattctaccactgtattaatacaacaaccggggaccgcttcgacattgaggacgtaaacaatcatacggattgtcttaagctcattgagcgcaatgagactgcaagatggaagaacgtgaaggtgaatttcgacaacgtgggctttggctacctgtcgctccttcaggtcgccacgttcaaaggctggatggatatcatgtatgctgctgtggatagccggaatgttgagctgcagcctaagtatgaagagtctctctatatgtatttatacttcgtcatctttatcattttcggatccttctttaccctgaacctgttcatcggggtgatcatcgacaattttaaccagcagaaaaagaagttcggcggacaggacatcttcatgaccgaagaacagaaaaaatattacaacgctatgaaaaagttaggcagtaagaagccacagaagcccatccccagaccgggtaataaatttcaaggaatggtttttgacttcgtgacccgacaggttttcgacatttcaatcatgatcctcatttgcttaaacatggtgactatgatggtcgagacggacgatcagtctgagtatgtgacaaccatactgtctcgaatcaaccttgtgtttatagttctttttacaggggagtgcgtgctgaaactgatttcactgcgccattactattttaccatcggttggaacatattcgattttgtagtcgtgatactctctattgtgggcatgttccttgcagagctgattgagaagtattttgtcagcccgacattgtttagggtaatcagactggcccgaatcggacgaatattacgcttgattaaaggcgcaaagggaatccggactcttctgttcgctcttatgatgtctctccctgctctgttcaacatcggtttgctactgtttctggtaatgttcatttatgcaattttcgggatgtcaaactttgcttacgtgaagagagaggtcggcatcgatgacatgttcaacttcgagaccttcggcaacagcatgatctgcctgtttcaaatcaccacctctgcaggatgggatgggctcctggctcctatcctgaactccaaacctcccgactgcgatcccaacaaagtgaacccgggaagtagcgtcaagggggactgtggcaatccttctgtgggtatcttcttttttgtgtcctatatcataatttcattccttgtcgtggtgaatatgtatatcgccgtaatccttgaaaacttcagcgtagcaaccgaggagtcagcggaacctttgagcgaggatgatttcgagatgttctacgaggtatgggagaagttcgaccctgatgcaacccaattcatggagtttgaaaaactgtcccaattcgccgctgccttggaacccccactcaacctgccacagccaaacaaactgcagctgatcgctatggacctgcccatggtctctggggacagaatccattgcttagatatcttgtttgcctttaccaagcgggtactgggggagtcgggtgaaatggatgctctgcgcatacagatggaggaaagattcatggcttctaatcccagcaaagttagctatcagccaataaccactacacttaaacgcaagcaggaggaggtgagtgcagtcatcattcagagggcataccggagacacctgctgaagaggactgttaaacaggccagcttcacctacaacaagaacaagataaaagggggagccaacctgctgattaaggaggacatgattatcgacaggatcaacgaaaatagcattaccgaaaagactgacctgacaatgtcaacggcggcttgccccccatcttacgaccgcgtgacaaagccgatcgtagagaagcatgagcaggaaggcaaggacgagaaggccaagggtaagtat

SEQ ID NO: 240874 - DNA, 5996 bp, Artificial Sequence
  Description of Artificial Sequence: Synthetic coding sequence
atggaacagaccgtcctggtccctccaggccctgactcgttcaacttttttactcgggagagcttggccgctatagagagacgcatcgccgaggaaaaggcaaagaacccaaagccagacaagaaggatgacgatgagaatgggccaaaacccaattccgaccttgaagccggaaagaacctgcccttcatttatggtgacatcccacccgagatggtttccgaaccgttagaagacctcgatccctactacatcaataaaaaaacgttcatcgtattgaacaagggcaaagcaatctttcgcttctccgccacatccgctctctatatcttgacgcccttcaaccctctgcgaaagattgccattaagatactggtgcacagcttgttttccatgcttataatgtgcacaatcctgacgaattgtgtatttatgaccatgtctaacccgcctgattggactaaaaatgtagaatatactttcacagggatctatacctttgagagcctgataaagattatcgccagaggattttgtctcgaggactttacattcctacgggatccttggaattggcttgatttcaccgtcattaccttcgcttacgtgacggaattcgtagacctgggaaatgtctcagcattaaggacgttccgtgttctgcgggctctgaagactatttcggtgattcctgggctcaaaacaattgtgggggctctgatacaaagtgtgaagaagctctctgacgtcatgatcttaacagtgttctgtctgtcggtatttgccttaataggactccagctgtttatgggaaacctgagaaacaaatgcattcagtggccaccaacgaacgcttccctggaagagcactcaattgaaaaaaatatcacagtgaattataacggcacacttatcaatgagacagtcttcgagtttgactggaagtcttatattcaggattcaagataccattatttcttggagggtttcctggacgccttattgtgcggaaactcctcagatgcaggtcagtgtcccgagggctatatgtgcgtaaaggcaggccgaaatcctaactacgggtataccagctttgatacgtttagttgggcttttcttagcctgttccgactgatgacgcaggacttctgggaaaatctgtatcagctaactctgcgagctgccggaaaaacctacatgatcttcttcgtgctggtgatcttccttgggagtttctatcttattaatctgattctcgcagtagtggccatggcatatgaagaacagaaccaggctacgctggaggaagccgagcagaaagaagctgaatttcagcaaatgattgagcagctcaagaagcagcaagaggcggcacaacaggcggctaccgctacggcttccgagcatagccgcgaacccagcgccgctggcagactgtcagacagctccagtgaggcttccaagctttcaagtaagagcgccaaggagcgtagaaaccgcagaaaaaagcgtaaacagaaagagcagtcaggaggagaggagaaggacgaagatgagttccagaaatctgaatcagaggatagcattcgtaggaaagggttccgcttttcaatagagggaaacagactcacctacgagaaacgctatagttcaccccaccagagcttgttgagtattagaggcagtctcttcagcccccgaagaaacagtagaacaagtctctttagcttccggggaagagctaaagatgttggaagcgaaaatgacttcgcagatgacgaacactcaactttcgaggataatgagtccagacgggattctctctttgtacctcgtcgacatggggaaaggcgtaactccaacctgtcccagacatcacggagctctcgaatgctcgcagtgttccctgctaatggcaagatgcactctaccgtggactgcaacggcgtagtgagcttagtcggagggcctagcgtgcctacatcacccgtcggacagctgctgcctgagggcactaccactgaaacggaaatgcggaagaggcgctcctccagctttcacgtgagtatggattttctcgaagatccctcacagaggcagcgcgctatgtccatcgcctccatcttgaccaatactgtagaggaactggaagagagtaggcagaaatgcccaccttgttggtataagttcagcaatatttttctcatctgggactgcagtccctattggctgaaagttaaacatgtagtaaatcttgtggtcatggatccattcgtggacctggccatcaccatatgcatcgtccttaataccctgtttatggcaatggagcattatcccatgaccgaccattttaacaacgttttaaccgtgggtaatttagtctttacaggcatctttacggccgagatgtttcttaagatcatcgccatggatccatactactacttccaggaaggatggaacatttttgatggattcattgtcactctcagcctcgttgagctcggactggccaacgtggagggtttatcagttctgcgctcttttcgattactaagggtgtttaagttggcaaaaagctggcccacgctcaacatgctaataaaaatcataggcaactcggtcggagctctggggaatctaactctcgtgctcgccattattgtctttatatttgctgttgtgggcatgcagttgtttggcaagagttacaaagattgtgtttgcaagatcgcgtcagattgccagctgccccgttggcacatgaatgatttcttccactctttcctgatcgtcttcagggtcttgtgtggtgagtggatcgagactatgtgggattgtatggaggtcgccggacaagcaatgtgtctcacggtttttatgatggttatggttatagggaatttggtggttttgaatttgtttttggccctcctgctgtcatccttctcagcagacaatctggctgccactgatgacgataacgagatgaataatttgcaaatcgccgttgaccggatgcacaagggtgtagcctacgtcaagcgcaagatttatgaattcattcaacaatctttcattcgaaagcagaagatcctcgatgagataaaaccactggatgatctcaataataagaaagactcttgcatgtcaaatcacactgccgagatcgggaaggatctcgactacctaaaggacgtgaacgggaccacatccggaataggcaccggaagtagcgtcgagaagtatattattgatgagagtgattacatgtcatttattaacaatcccagccttaccgtcactgtgccaattgctgtcggcgagtccgattttgagaatctcaatactgaggacttctctagcgaaagcgacctggaggagagcaaggagaaactcaatgaatcatcctcatcctctgaaggctctacggttgatatcggcgcacccgtggaggagcagcccgtggtggagccggaagaaactttggagcccgaagcctgcttcactgaagggtgtgtgcagagattcaaatgctgtcaaatcaacgtagaagaaggaagaggaaagcaatggtggaatctgcggagaacctgttttagaattgtggaacataactggtttgagaccttcatagtcttcatgattttgctgtccagcggagctttagcatttgaagacatctacattgaccagcgcaagaccatcaaaacgatgttggaatacgctgacaaagtgttcacgtacatatttatcctggaaatgttactgaagtgggtggcatacggataccaaacgtactttaccaatgcttggtgttggctcgattttctgatcgtggatgttagtctggttagcctgaccgccaatgcgctgggctattcagagctgggcgctataaagtcacttaggacgctgcgggcacttcgcccactgagagcactaagccgatttgaaggaatgcgggtggtcgtaaacgctttgctcggggcaattcccagcatcatgaatgtgctgctggtatgcttgattttttggctgatcttctccatcatgggggtgaacctgttcgccggaaagttctatcactgcataaatactactactggggatcgatttgatattgaggatgtcaataatcacactgactgcctcaaactgattgagcggaacgagacagcccgatggaagaacgtgaaggtaaatttcgacaatgttggctttggctacttatcactcctccaggttgccacttttaaaggctggatggacattatgtacgcagccgttgacagcaggaacgtggagctgcagcccaagtatgaggagagcctgtacatgtacctgtacttcgtgatatttatcattttcggcagcttctttacactaaatctgttcatcggcgtgatcatcgacaacttcaaccagcagaaaaaaaagttcggagggcaggacattttcatgactgaggagcagaaaaaatactacaacgcaatgaagaaactgggtagtaaaaagcctcagaagccgattccacggcctggaaataaattccaaggcatggtttttgattttgtaacccggcaggtgttcgacatctctatcatgatcttgatctgtttaaacatggttacaatgatggtggaaactgatgaccagagtgagtacgtcacaaccatattaagccgaattaatttggtctttattgtgttgttcactggtgagtgtgtgctgaaactaatttccctcaggcattattacttcaccatcggatggaatattttcgattttgtggttgtgatcctctctattgtgggcatgtttctggccgaactgattgaaaagtattttgtgtcccccaccctcttcagagtgattagattagccaggatcggacgtattctgcgcctcataaaaggtgccaagggcatacgcacactgttgttcgcgctgatgatgagtctgcctgcactgttcaatataggactgctactcttcttagtgatgtttatttacgctatattcgggatgagtaacttcgcatatgtgaaaagggaagtggggatcgatgatatgttcaactttgaaacattcgggaattccatgatctgtcttttccaaatcactacaagtgctggatgggacggcttgcttgccccaatcctaaactccaaacccccagattgcgaccccaacaaggtgaaccctgggtcttctgtgaaaggtgattgtggaaatccatcagtcggcatattttttttcgttagttacattataattagtttcttggtggtggttaacatgtatatcgctgtgattctggagaacttctccgtcgccacagaggagtcggccgaacctctgtctgaagatgacttcgagatgttctatgaagtgtgggagaagttcgaccctgatgctacccagttcatggaatttgaaaagttgtcccagtttgccgcagccctagaaccacccctcaacctcccacagccaaataaattgcagctgatcgccatggacttgcctatggtctctggtgacaggatacattgcctggatattttattcgcttttaccaagcgcgtcctcggcgagtccggcgaaatggatgcgctacgcatacagatggaagagagattcatggcatcaaatccgtcgaaagtgtcctaccaacctatcaccacaactttgaaaaggaagcaagaagaagtcagcgccgtcataatccagcgtgcatacaggaggcacctgctgaagaggactgttaagcaagctagttttacctataacaaaaacaagatcaaaggtggcgctaacctgctgattaaagaggatatgataattgataggataaatgagaattccattactgaaaaaaccgacctcacaatgagtaccgctgcctgtcctccaagttatgaccgggttacaaagcccatagtcgaaaagcatgagcaagagggaaaggacgagaaagccaaaggcaagta

SEQ ID NO: 240875 - DNA, 5945 bp, Artificial Sequence
  Description of Artificial Sequence: Synthetic coding sequence
atggagcaaactgtcctggtacctccgggacctgacagcttcaacttctttactcgggaaagcctggcggctattgaacgtcgtattgcagaggagaaagcaaagaatcccaagccggacaaaaaggacgatgatgagaatggaccaaagccaaattccgatctggaggcaggcaaaaacctgccatttatttatggagatattcccccagagatggtctccgagccattggaagacttagacccttattacataaacaagaagaccttcatcgtgctgaacaaagggaaggccatcttcagattttcagctacaagcgccctgtacatccttacccccttcaacccccttaggaagatcgcaataaaaattctagtgcattcattgttttctatgctgataatgtgcacgatcctgacgaactgcgttttcatgacaatgtccaatcccccagactggacaaagaacgttgagtacacattcaccggcatctataccttcgaaagtttgatcaagatcatagctaggggtttttgcttagaagacttcacattcctgcgcgacccctggaactggctggactttaccgtgatcaccttcgcctacgttactgagttcgtcgaccttggcaacgtctctgccctgagaacgtttagagtgctgagagcgcttaaaaccatcagcgtgattcctggactaaaaactatcgtgggagcactcatccagtccgtaaagaaactatcggacgtgatgattcttacggtgttttgcctctccgtgttcgccctgattgggctgcagctgttcatggggaatctacgcaacaagtgtatccagtggcccccaaccaatgcgtccctggaggaacactctatcgagaaaaacatcacagtcaattataacggaactttaataaacgaaactgtcttcgagtttgactggaaatcctatatccaggactctaggtaccactactttctggagggatttctggatgccctcctatgtggtaacagtagcgacgcagggcaatgtccagaagggtacatgtgcgtgaaggcaggaaggaatcccaactatggatacacctctttcgacacttttagctgggccttcctttcgctgttccgcctgatgacacaagacttctgggaaaacctgtatcagctcactctgcgcgcagcagggaaaacttacatgatcttcttcgtcctggttatttttctaggctccttttacctgatcaacctgatcttagctgtcgtcgccatggcttacgaagagcagaatcaggccactttagaagaggccgaacagaaggaggctgagttccagcaaatgatcgagcagctgaaaaagcagcaggaggccgctcagcaggcagcgaccgctacggcaagtgagcacagtagagagcccagcgccgctggacgtttatctgatagctcatccgaagctagtaagctaagctctaagtccgcaaaagagcggaggaatcgccgaaaaaagcgcaaacaaaaggagcagtcgggtggagaggagaaggacgaggacgagttccagaaatcggagtccgaagactctatcaggagaaaaggtttccgtttttccatcgaaggaaatagactcacatatgaaaagaggtactccagtccccaccagtcactcctgtcaataagaggaagcctcttcagtcccagacggaacagccgtacatcgttgttttccttcagagggagagctaaagatgtgggtagtgaaaatgatttcgccgatgacgaacacagtacgtttgaagataacgagagtagacgagactctctattcgtgccccgaaggcacggcgagagaagaaacagcaatctttcccagacctcccgctcctcacggatgctagccgtattcccagcaaacggcaagatgcatagtacagtcgactgcaacggggtcgttagcctcggaacaaccaccgagaccgagatgcgcaagcgaaggtccagtagcttccacgtgtccatggatttcctcgaagatccaagccagcggcagagagccatgagcatagcgtccattctgaccaacaccgtggaagagctggaggaaagtcgccaaaagtgtcccccttgttggtataagttctctaacatcttcttaatttgggactgctctccgtactggcttaaggtgaaacacgttgtcaacctggtagtgatggacccgtttgtcgatctggccatcaccatttgtattgtattgaacactctgtttatggccatggagcactaccccatgactgatcactttaataatgtcctgaccgtcggcaatctggtattcaccgggatttttaccgccgagatgttccttaagatcatcgctatggatccttattactattttcaagaaggatggaatatcttcgacggctttatagtcactttatccctcgtggagctcggtctggccaatgtggaaggcttgtcggtcctgcggtctttccggctgcttcgcgttttcaagctggctaaaagttggccaacactcaacatgctgattaagattattgggaacagcgtcggagctctcggtaatctgactctggtgctggctataatcgtttttatttttgccgttgtgggtatgcagttatttgggaaaagctacaaggattgcgtgtgcaaaatagcaagtgactgtcaactgcctcgttggcatatgaatgacttcttccacagtttcttaatcgtgtttcgggtgttatgcggcgaatggattgaaactatgtgggattgtatggaggtggccggtcaggccatgtgcctaacagtctttatgatggtcatggtcattggcaatctggtggttctgaatctgtttctcgctctccttctctcttcctttagtgccgacaacctggctgccaccgacgatgacaatgaaatgaataatttacagatagccgttgatagaatgcataagggggtagcctacgtgaaaagaaagatctatgaattcatacagcaatcattcattagaaagcagaagatattggatgagataaagcccctggacgatcttaacaataagaaggattcctgcatgtccaatcacacagccgaaatcggaaaagacctggattatctcaaggacgtgaacggaacaacttccggaatcgggactggatcgtctgtggaaaagtacattattgacgagtccgattatatgtcttttataaacaacccaagcctgaccgtcactgtgccaatcgccgtgggagaatcagacttcgagaacctgaataccgaagacttctccagtgagtccgaccttgaggagagcaaggagaagctgaacgagagttcgtccagctccgagggatcgacagtcgatataggggcacctgtcgaagaacaaccagtggtggaaccagaggagacactcgagccagaagcgtgttttacagaaggctgcgtgcaacgttttaaatgttgccagatcaacgtcgaggaaggacggggaaaacagtggtggaatcttaggcggacatgctttcggattgtagaacacaactggttcgagacctttatagtttttatgattcttctgtcttccggcgctctggccttcgaggatatatatatcgaccagaggaagactatcaagaccatgctggaatatgctgataaagtgttcacatacatctttatcctggaaatgttgttgaagtgggtagcatacggatatcaaacttatttcaccaacgcgtggtgctggctggacttcctgattgtcgacgtgtccctggtgagcctcaccgctaacgcactcggctattcagagctgggggctattaagagcctgcggaccctgcgggcattgagaccgctgagggcactgtcacggttcgagggtatgcgtgttgtggtgaacgcactgctcggagccatcccaagcattatgaacgtccttctcgtctgcttgatcttttggctcattttctctatcatgggagtgaatttgtttgcaggaaaattttatcactgcatcaacacgacaaccggcgatagattcgatatagaggatgtcaacaaccataccgactgcttaaagctcatagaaagaaacgagaccgctagatggaagaacgtgaaagttaatttcgacaatgtggggttcggttacttgagccttctccaggtagccactttcaagggatggatggatattatgtacgctgcagtggacagccgaaacgttgagcttcagcccaagtacgaagaatctctgtacatgtacctctactttgtgatctttatcatatttggttctttcttcactctgaatttgttcatcggcgttatcatcgataatttcaaccagcaaaagaaaaaattcggaggacaggatatctttatgaccgaggaacaaaaaaaatactacaacgcaatgaagaagctgggctctaagaaaccccagaagcctatccctcgcccaggaaacaaattccagggtatggttttcgattttgtcacccggcaggtgttcgacatcagtataatgattctgatttgtttgaatatggtgactatgatggtggagaccgacgaccagtctgagtacgtgacaacaatcctgagcagaattaatttggtgttcattgtcctgtttacgggcgaatgtgtgttgaagctgattagtttaaggcattactatttcaccattggttggaacatcttcgattttgtggtagtcattctctctatcgtaggcatgtttctggcagaactgattgaaaaatatttcgtgagccctacactttttcgggtgatacgtttggcaagaatcgggcgtattctccgtctgattaaaggagcaaagggcatacggactctgttattcgcactgatgatgtcacttcctgctttgtttaatattgggctcttgctctttctcgttatgtttatttacgccattttcggcatgagtaacttcgcatacgtcaagcgggaagtggggatcgacgacatgttcaatttcgagactttcgggaactccatgatatgcctcttccagattaccacaagtgcagggtgggatgggcttttagcacctatcctgaattctaagcctccagattgcgaccccaataaggttaatcccggaagctccgtgaagggggactgcggcaaccccagtgtcggcatcttctttttcgtttcttatatcattatctcgtttcttgtggtggttaacatgtatattgccgttattctggagaatttcagcgtggcaactgaagagagcgcagagcctctctctgaggatgactttgagatgttctatgaggtttgggagaagtttgatccagatgcgactcagtttatggagttcgaaaagttatcccagtttgctgcagccctcgagccacctttgaacctgccacagccgaataaacttcaattaatagccatggaccttccgatggtctccggggaccggattcattgcctcgatatactctttgcttttacaaaacgtgtactaggcgagagtggagagatggatgctctgcgcatccagatggaggagaggtttatggcgtctaacccttccaaagtgagctaccagccaattacaacaacgttgaaacgaaaacaggaggaggtcagcgcagtcatcattcaacgggcttatagaagacacctcctgaagagaacggtcaagcaggcctcgtttacatataataagaataaaatcaagggcggtgcgaacctgctgataaaggaagatatgataatcgatcggatcaacgagaattccattaccgaaaaaaccgatctgaccatgtctaccgcggcatgtcctccctcctacgacagggtcaccaagccaatcgtggagaagcatgaacaggagggaaaggatgagaaggctaaggggaagta

SEQ ID NO: 240876 - DNA, 6029 bp, Artificial Sequence
  Description of Artificial Sequence: Synthetic coding sequence
atggagcagacggtgctcgtgccccctggacccgactcctttaatttttttacccgagagagtctagcggcaatcgagcgaaggattgcggaggaaaaagcaaaaaatccaaaacccgacaaaaaagacgatgacgagaacggaccgaagccaaactccgatttggaggctggcaagaatcttccattcatttacggcgacatacctccagagatggtttcagaacccctggaagacctggatccgtattatataaacaagaagaccttcatcgtcctgaataagggcaaagcaattttccgattctctgccacatccgccctttacattctgaccccttttaatccattacgtaagatcgctattaagatcttggtgcatagtctgttttccatgctcattatgtgcaccatattgacaaactgtgttttcatgacaatgtctaatccacctgattggacgaagaacgtggagtacacctttacaggcatatataccttcgaatccctgataaagattatcgctcgcggtttttgtctcgaagacttcacttttctgcgagatccatggaactggctggatttcacagtcattacttttgcttacgtcactgagttcgtggacctcggcaacgttagcgccttgagaaccttcagggtcttaagagctctgaaaacaatatcagtgatccctggcctaaagaccatcgtaggcgctcttattcagagtgtgaagaagctgtcagacgtgatgatcttgaccgttttttgcctcagtgtgtttgctctaataggcctccagctgttcatgggcaacctgaggaacaagtgtatccaatggccccctacaaacgcatccttggaagaacatagcattgagaaaaacataacagttaattataacgggaccctgatcaatgagaccgtttttgagtttgactggaagagttatatacaggactcccgctaccattactttctcgaaggctttttagatgccctgctgtgcggtaattcctctgatgccggtcagtgccctgaaggctacatgtgtgtgaaggctggacggaatcccaactacggatacacttcttttgatacattttcttgggccttcttatctctgttcagactaatgacccaagatttttgggaaaatctataccagctgaccttaagggcggcaggtaagacctacatgatctttttcgtgcttgtaatctttctgggcagtttctacctgataaatctcatcctcgccgtcgtcgccatggcctacgaggaacaaaatcaggccacactggaagaggccgaacagaaggaagccgagtttcagcaaatgattgaacaactgaaaaagcagcaggaggctgcacagcaagcggcaactgccactgcaagtgagcactctcgcgaaccctcagcagctggacgcctcagcgacagctcgtctgaggcttcgaagctgtcctccaagtcagctaaagaacggcgtaataggcggaagaaacgcaaacagaaggagcaatccggcggtgaggagaaggacgaggatgagttccagaagtccgaaagtgaggattccatcaggcgcaaaggtttcaggtttagtatagagggcaatagactcacgtacgagaagcgttactcatcacctcaccagtctttattgtcaatccgcggaagtctcttttcccctcgcaggaacagccggacaagcttgttctcatttcgcggaagggctaaggacgttgggtccgagaacgacttcgccgatgacgaacattcaacgtttgaggataacgagtcaagacgagacagcctgttcgtcccaaggaggcacggtgagcgccgaaacagtaatctgagccagaccagccgcagcagtcgaatgcttgctgtgtttccagctaacggcaaaatgcacagcaccgtcgactgcaatggagttgtttcgctggtgggcggtccttccgtccccaccagcccagtgggccagcttctacccgaagtgattatcgacaagccggctacagacgacaacggcactaccacggaaacggagatgaggaagcgtaggagctccagtttccacgtgtcgatggacttcctggaggacccctctcagcgacaaagggcaatgagcatcgcctctatactgactaatacagtggaggagcttgaggaaagcagacagaaatgcccaccttgctggtataaattctctaatatatttcttatttgggactgctccccatactggctgaaagtgaagcacgtcgtaaatctggttgttatggacccatttgtggatctcgctattaccatttgcatcgtcctgaatacactcttcatggctatggaacattacccaatgacagaccattttaacaatgtgctgacagtgggaaatctggtgtttacaggaatatttaccgcagagatgttcctcaagattatagccatggacccttactactactttcaggagggctggaatatctttgacggttttattgtgactctctctttggtggaactcggattggcaaacgtagaggggctctctgtactgcgctcctttcgcctacttcgtgtgttcaagctcgctaaatcttggcctaccctgaacatgttaataaagatcattggcaattcagtgggagcacttggcaacctgactcttgttctggccatcatcgtgttcatattcgcggtagtgggcatgcagctattcggtaagagctataaagactgtgtgtgcaaaatcgcaagtgactgccaactgcccaggtggcatatgaatgacttctttcattcttttctgattgtgttccgggtcctgtgtggagaatggattgaaaccatgtgggactgcatggaagtggctggacaagcaatgtgtctgaccgtattcatgatggttatggttatcggaaaccttgtggttttgaatctgtttctggcgctgttgctcagcagtttcagtgctgacaacctcgcggctaccgatgatgataacgagatgaacaacctccagattgccgtcgaccgcatgcacaaaggggtggcatacgtcaaacgcaagatttacgaatttatacagcagtcgtttatccgtaagcaaaaaatcctcgacgagatcaagccactggatgacctcaataataaaaaagatagctgcatgtccaatcacaccgctgagattggaaaggacctggactacctgaaagacgttaatggaaccacgtccgggattggtacgggatcgtcagtcgagaagtacatcatagacgaatctgactatatgtcttttattaacaacccgagcctcactgtcacagtccccattgccgtaggagaaagtgactttgagaacctcaataccgaggacttcagtagtgagtctgatctggaagagtcaaaagaaaagttaaacgagtcaagtagttccagcgaggggagtactgttgacattggagctccagtggaagagcagcccgttgtagagcctgaggagacgttggaacctgaggcttgcttcacggaaggctgcgtgcagcggttcaaatgctgtcaaattaacgtcgaggagggtcgaggcaagcagtggtggaacctgagaaggacctgctttcggatcgtggaacacaattggtttgagacatttatcgtcttcatgatactgctgagcagtggagcacttgcctttgaagacatttacatcgatcagagaaagacgattaagactatgctcgaatacgctgacaaggtattcacttatatctttattctcgaaatgctacttaagtgggtggcctacgggtatcaaacctattttaccaacgcctggtgctggttggatttccttatcgtagatgtatctctcgtcagcctaacagccaatgccctgggatattcagagcttggcgcaattaagtctctgagaaccctgagggcactacgtcccttgcgggcactcagccgattcgaaggtatgcgggtagtcgtgaacgcgttactgggcgctatccctagcatcatgaacgtactgctggtatgcctgattttttggttgatcttttccattatgggagtgaacctgttcgctgggaagttttatcactgtattaacaccactaccggggataggtttgacattgaggatgtgaataaccacaccgactgccttaaactaatagagaggaatgaaacagcacggtggaagaatgtgaaggtgaactttgataatgtcggctttggctatctctctctgctgcaagtggccacgtttaagggatggatggacattatgtacgctgcagtcgatagccgcaatgtcgaactgcagccaaaatatgaagagtcactttatatgtatctgtatttcgtaattttcataattttcggtagcttcttcactctgaaccttttcatcggtgtgattattgataactttaaccagcaaaagaaaaaatttgggggacaggatatctttatgaccgaggagcagaaaaagtactataatgccatgaaaaaactggggtctaagaaaccgcagaaacccattccacgccctggtaacaaatttcagggaatggtgttcgacttcgtgacacggcaggtgttcgacatctctatcatgattctcatttgtctaaacatggtcacaatgatggtcgagactgatgatcagtcagagtacgtgacaactatactgtcacgcatcaacttggtttttatagtactcttcaccggagaatgcgtactcaaactgatttctctgagacattactattttaccatcggctggaatatttttgattttgtggtggtgatcctctctatcgtcggcatgttcctggccgagctgattgagaaatattttgtgtctcctacactgtttcgggtgatccggctggctaggatcggtagaatcctacgcctgatcaagggggctaaggggatccgaactctgctcttcgctctgatgatgagcctcccagcgttattcaacataggcctgcttttgttcctggtgatgttcatttacgcaatcttcggaatgagtaacttcgcctatgtcaaaagagaggttgggattgacgacatgttcaatttcgagacgttcggcaacagcatgatctgtctattccagataaccactagcgcgggatgggatggtttactcgcacccattctgaactcaaagcctcctgactgcgacccgaacaaggtaaaccccggttctagtgtcaagggggactgtggcaatccctctgttggtatttttttttttgtgagttatattatcatctcgtttctggtggtcgttaacatgtatatcgcagtgatattagagaacttcagcgtggcaaccgaggaatcagcggagcccctgtccgaagacgacttcgaaatgttctatgaagtgtgggagaaatttgacccagacgcaacacagttcatggagtttgagaaattgtctcagtttgctgccgcactcgagcctccattgaacctgcctcaaccgaacaagttgcagctgattgccatggatctcccaatggtcagtggcgacaggatccactgcttagacattctgttcgcctttactaagagggtgctgggagagtctggcgagatggatgcccttcggattcagatggaagagcgctttatggcttctaatcctagcaaggtgagctatcagccaattactaccacattgaaaagaaagcaggaagaggtgtcagcagtgattattcagagagcttatcgcaggcacctcttgaaaagaacggtgaaacaggccagttttacatacaacaagaataagataaaagggggtgctaacttgctcattaaagaggatatgattattgatagaataaacgagaacagtatcacagagaagaccgacctaactatgagtaccgccgcttgccctccttcctatgatagagtgactaagcctattgtggagaagcatgaacaggagggaaaagatgagaaagccaaaggtaaata

SEQ ID NO: 240877 - DNA, 657 bp, Artificial Sequence
  Description of Artificial Sequence: Synthetic coding sequence
atgggtcggttactggcgttggtcgttggcgctgctctcgtttcctcggcttgcggcggttgtgtggaggtggacagcgaaacagaggccgtttacggtatgaccttcaagattttgtgtatttcctgcaaacgtaggtctgaaaccaatgcagagacatttacagagtggaccttcaggcagaagggaacagaagagtttgtgaaaatcctgaggtatgagaatgaggttctccaacttgaggaggatgagagatttgagggcagagtggtctggaacggatcccgcggtacaaaggacttgcaagacctgtcgattttcattacaaacgtaacttataaccatagcggagattatgaatgccatgtgtatcgtctgctcttcttcgagaactatgaacataacacaagtgtggtgaagaagatacacatcgaggtcgttgacaaggccaatagagacatggccagcattgtgtcagagattatgatgtatgtgctcattgtggtcctcacaatttggctggtggccgagatgatttactgctataagaaaatagccgcagctaccgagactgcagcccaggagaacgcgtctgaataccttgctataacttctgaatcgaaagagaattgcaccggcgtgcaggtggcagagtag

SEQ ID NO: 240878 - DNA, 807 bp, Artificial Sequence
  Description of Artificial Sequence: Synthetic coding sequence
atgggcaggttgctggcgttggtcgttggcgcagctttggtatcttcggcgtgcggtgggtgtgtagaggtggatagcgaaaccgaggccgtctacggaatgactttcaagattctctgcatcagctgcaagcgaaggtcagaaactaatgccgagacttttactgaatggaccttcaggcagaaaggcaccgaggaatttgttaaaatcctgcgatatgagaacgaggtgttgcagcttgaggaggacgaacgtttcgagggacgggtagtatggaatggctccaggggcacgaaggacctgcaggatctgtcgatttttattactaatgttacatataatcactccggcgactatgagtgtcacgtgtatcgcctgctgttcttcgaaaattacgaacataatacgtctgtagtgaagaagatccatatcgaagtggtggataaaggggaaagcggcgctgcctgccccttcactgtgacccacagacgcgctcgatggcgtgatcgctggcaggccgtggacaggaccggctggctgtgtgcatggccagccaacaggcctcaacaaagggcagagggtgaaggaagctcaccctcctgccctctgcaattgtggcccctgttcctaagttcaccccgaagggggcaatcgatgcctgtaccccaccggaggtcgggctatcggacgcagctgtgccatctgtgttgcatgactagcggtcggtgccttctgtctctgtcacaacgcgttgtactgggccttcccggaattataatcagatgcgtgagcaggggggtggtgtag

SEQ ID NO: 240879 - DNA, 6018 bp, Artificial Sequence
  Description of Artificial Sequence: Synthetic coding sequence
atggcacagagcgtgttagtgcctccagggcctgatagcttcaggtttttcacaagggaaagtctggccgctattgagcaaaggatcgctgaggagaaagcaaagaggcccaaacaggagcgcaaggacgaggacgatgagaatggcccaaagcctaattccgatctcgaagccggtaaatccttaccatttatctacggagacatcccccctgagatggtgagtgtgcctctcgaggatcttgacccatactatatcaacaaaaagacatttatcgttctgaacaaagggaaagccatatctaggttcagcgccacccccgctctgtatatcttgactccgttcaatcctatccggaagttggcgataaaaattctcgttcacagcctgttcaacatgcttattatgtgcactatcttaacgaattgtgtgtttatgactatgagtaatcccccagactggactaagaatgtggaatacacattcaccggcatttatacatttgagtctctaatcaagattctggcaagagggttctgcttagaggatttcactttcctgagagatccatggaattggctggatttcacagttatcacgttcgcctacgtaaccgagtttgtcgatctcgggaacgtcagcgcattgagaacattcagagttctacgcgcattgaaaacaatctccgtgatccctggactgaaaacaatcgtcggtgcattgattcagtccgtaaagaaactcagtgacgttatgatcctaaccgttttctgcttgtccgtcttcgccctcatcggactgcagctgtttatgggcaaccttcgtaataagtgcctgcagtggccgcctgacaactcaagtttcgagattaatatcaccagcttcttcaataattccctcgatggaaatggaacaactttcaacaggaccgtgtccatcttcaactgggacgaatacattgaagacaaaagccatttctattttctagaaggccagaatgatgcactcctgtgtggtaactcgtctgatgcagggcagtgcccagaaggttatatttgcgtcaaagctgggcgtaatcctaactacggttacacatcttttgataccttctcatgggcctttcttagtttgttcagactcatgacgcaggatttttgggagaatctgtatcaactgaccctgcgcgcagcagggaaaacttacatgattttcttcgttttagtgatttttctgggcagtttttatcttatcaaccttattctggctgttgttgcgatggcttacgaggaacagaaccaggcgactctggaggaagctgagcagaaggaggcagagttccagcaaatgttagagcagctcaagaaacagcaagaggaggctcaagcagccgctgctgctgcttccgcagagagcagggacttctcaggcgctgggggtattggcgtcttctccgaaagctcgagtgtagcctcaaagcttagttccaaatccgagaaagagctgaagaaccgtcgtaagaagaagaaacaaaaggagcaatccggcgaggaagaaaagaacgaccgagtgaggaagagcgagtcagaggactctatccgcaggaaagggtttcggttctcactcgagggctccagattgacatacgaaaaacgcttttctagtccccaccaaagtctcttaagcatacggggttctcttttttctccacgacgcaactctcgggcaagcctgttctcctttaggggcagagccaaagacattgggtctgagaacgactttgcagatgacgaacactctacttttgaagacaatgactctaggagggatagtctgttcgtgccacacagacacggagaaagacggcatagtaacgtgagtcaagccagtcgggcatcccgggtgttgccgatactgcctatgaatggcaaaatgcactccgccgtggactgtaatggggttgtttcacttgtcggaggaccctctacgctgaccagtgcgggtcagctcttaccagaaggcactaccacagaaaccgagataagaaagcgcaggagttcgtcatatcacgtgagcatggatctgctggaggaccccaccagtagacagcgggctatgtcaatcgccagcattttgaccaatacaatggaagagctcgaagagtctcgacagaagtgcccaccttgttggtataagttcgccaacatgtgcctgatttgggattgttgcaagccatggctcaaagtgaagcaccttgtaaatttagtcgtgatggacccattcgtcgatttagcaataaccatatgtatagtgcttaataccctcttcatggcgatggaacactaccccatgactgaacaattctccagcgtactgtcagtcggtaatctggtctttacagggatctttaccgccgagatgttcctgaagatcatagcaatggatccatattactattttcaggaaggatggaatatttttgacggattcatcgtaagcttgtcactcatggaactgggcctggccaacgtcgaaggtttgtctgtgctcagaagcttcaggctccttagggtcttcaaattagcaaagtcgtggcccacgcttaacatgcttatcaaaattataggaaatagcgtcggtgccctcgggaatctgacgttggtgctggccatcatcgtgttcatctttgctgtggtcgggatgcagctttttggtaagtcgtacaaggagtgtgtttgcaaaatttctaacgactgtgagcttcctcggtggcacatgcatgactttttccactctttcttaatcgtttttcgggttctatgtggcgaatggatagaaacaatgtgggattgtatggaggtagctggtcagactatgtgcctgaccgttttcatgatggtgatggtcattggcaacctggtagtactgaacctgttcctggcattgctcctttcatctttttcttccgacaatctagctgcaactgacgacgataatgaaatgaataacctgcagatagctgttggccgaatgcagaaaggaatcgattttgttaagcgcaaaataagagagtttattcaaaaggcgttcgtgcggaagcaaaaagcactagatgagatcaagcctctcgaagatctcaacaataagaaagacagctgtatctctaaccacaccaccatcgagattggaaaagacctgaattatcttaaggatggaaatggcacaacctctggcattggctcaagtgtggaaaagtacgttgtggatgagagcgactatatgtcctttattaataacccaagcctgacggtcaccgtccccatagccgtgggcgaatctgattttgagaacttgaacacagaggagttcagttcagagagcgatatggaagaatcaaaggagaagctcaatgcgacaagtagctcagagggaagcaccgttgacataggagcacctgcagagggggaacagccggaggtcgagcccgaggagtctttggagcccgaggcctgtttcacagaagactgtgtgagaaaatttaaatgctgtcaaatatcaatcgaggaggggaaaggaaaactctggtggaatctccgcaaaacatgctacaagatcgttgaacataactggttcgagactttcattgtttttatgatcctgctaagcagcggggcactggctttcgaggacatctacattgagcagcggaagaccatcaagactatgctcgaatacgctgacaaagtgtttacgtacatattcattctggagatgctgcttaagtgggttgcctacggctttcaggtttatttcacaaacgcctggtgttggcttgatttcctgatagtggacgtctctctggtgagccttacagcaaacgccctcggctactctgaacttggtgctattaaatccctccgaacgctgcgtgccctcaggccccttcgcgctctctcccggttcgaaggtatgagggtggtagtcaacgccctgttgggtgccataccttccattatgaacgtcctcctcgtttgcctgatcttctggctcatcttctccattatgggcgtgaatcttttcgctggcaagttctatcactgcatcaattacactacaggcgaaatgtttgacgtaagtgtggtcaacaactattctgagtgcaaagctctgattgaatcaaaccagacagcaagatggaagaatgtgaaggtcaactttgataacgtgggcctcggctatttatctctcctccaggttgcgaccttcaaaggctggatggatattatgtatgcggctgtcgattctcgcaatgtggaacttcagccaaagtatgaggataatctttacatgtacctgtacttcgtgattttcattattttcggatccttctttacgctcaatctgttcatcggcgttattattgacaatttcaaccagcagaaaaaaaaatttggcggacaggatatcttcatgacagaggaacagaagaagtactacaacgccatgaaaaaattgggctctaagaaaccccagaaaccaatcccccgacccgcaaacaagtttcagggcatggtcttcgattttgtgacaaagcaggtgttcgacatctccattatgatactgatctgtctgaacatggtgactatgatggttgaaacggacgaccagagccaagaaatgaccaatattctgtattggatcaatcttgtgtttatcgttctgttcacaggggagtgcgtgttaaagttaatttcgttgaggtattattacttcacaattgggtggaacatctttgatttcgtagtggtgatattaagcatcgtgggaatgttcctcgccgagcttatagagaaatacttcgtcagcccaacactcttccgcgtcataagacttgcgaggatagggaggatcctgcggctcattaagggagctaagggcattcgaacactcttgttcgctcttatgatgtcactgcccgcactgttcaacattggtttactgcttttccttgtgatgttcatctatgccattttcgggatgtcgaactttgcctacgtgaaaagggaggttggtattgatgatatgttcaacttcgagacgtttggcaactccatgatttgtcttttccagatcacaaccagtgcgggatgggatggattgctcgcgccaattctcaattctggaccacctgattgcgatcccgacaaggaccatccgggatcctctgtgaagggagattgcggaaacccctcagtcggaattttcttttttgtgtcttatattatcatcagcttcctggtcgttgtgaacatgtatatcgctgtgatcctcgagaatttttccgtggccaccgaggagtcagcagaacccctttctgaggacgacttcgagatgttttatgaagtctgggagaaatttgaccccgacgctactcaatttatcgagttcgctaaactaagcgatttcgcggacgccttagacccacccttgttgatagctaagcctaataaggtccagttaattgcaatggatctacccatggtcagtggagataggatacattgcctggatattttattcgcctttacaaaaagggtccttggcgaaagcggcgagatggatgccctgcgcatccagatggaggagcgattcatggcatcaaatccaagcaaagtatcatacgagcccatcacaaccaccctgaagagaaaacaggaggaagtaagcgccatcattatccagcgcgcatatcggcgatacctgctgaaacaaaaagtgaagaaggtttcatctatctacaagaaagataagggaaaagaatgcgacgggacacccataaaggaggatacactgatagacaagctgaacgagaatagcactcctgaaaagacagacatgacgcccagtacaacatcccccccttcgtatgattcggttacaaagcccgagaaagagaaattcgagaaagataaatccgagaaggaagataagggaaaagatatccgggagagtaaaaaatac

SEQ ID NO: 240880 - DNA, 6017 bp, Artificial Sequence
  Description of Artificial Sequence: Synthetic coding sequence
atggcccagagcgttctcgtgccgcctggaccagactcctttcggtttttcaccagagagtcccttgcagcaatcgagcaaagaattgccgaggagaaggctaagagacccaaacaagagcggaaggatgaggacgatgagaatggccctaagcccaactccgatctggaggcagggaaaagtttacccttcatttacggagacatccctccagaaatggttagtgtgccattggaagatcttgacccttattatattaacaaaaagacgttcatcgtgctgaacaaggggaaggcaatctccagatttagtgcgacccccgctttgtacatactcaccccattcaaccctattaggaaattggccattaaaatcctagtgcattcactctttaacatgttaattatgtgcacgatcttgaccaattgcgtatttatgactatgagcaacccccctgattggaccaagaatgtggaatatacgttcacagggatctatacatttgagagcttgatcaagattctggccagaggtttttgcttagaggattttacttttctgagggatccctggaattggctggacttcacggtaatcacctttgcttatgtcactgaattcgtgaatcttggaaatgtgtccgcactccgcacttttagggtgcttcgcgcactgaagactatatcagtcatacctggcctgaaaactattgtgggtgcccttattcagtctgtaaaaaaattaagcgatgtgatgattctgaccgttttttgcctgtccgtgttcgcactgatcggcctgcagctgtttatgggcaacttgaggaataaatgccttcagtggcctccagacaatagcagcttcgaaataaacatcacctcgttctttaataattccctcgacggcaacggcacaacgttcaacagaactgtgtctatctttaactgggacgagtacatcgaagacaagtcacacttttattttcttgaaggccagaacgacgccttattgtgcggcaacagctctgatgctggacagtgccctgaaggctatatttgcgtcaaggccggaagaaaccctaactacgggtacacgagctttgatactttttcctgggctttcctgagcttgtttcgcttaatgacgcaggacttttgggaaaatttataccagcttactttaagggccgcaggtaagacttacatgattttttttgtgctggtaatatttctgggatcattctacctgatcaacctgatcctagccgtcgtggccatggcatatgaagagcagaatcaagctaccttagaggaagccgaacaaaaagaggccgaattccaacagatgctcgagcaactcaaaaaacagcaggaggaggctcaggctgccgcagctgccgcatcagcagaaagcagagatttcagcggagccggtgggattggggtcttctcagagtctagctcagtggcgtccaagctttcaagtaaatctgagaaagagctgaagaacagacgcaagaaaaagaaacagaaagagcagtccggtgaagaagaaaaaaacgaccgagttcggaaatccgagtctgaagactctattcgacggaaagggtttaggttttccctcgaaggctcccgattaacatacgaaaaacggttttcctcgcctcaccagtccctgcttagcattagaggctcgctgttcagtcccagacgaaactcgcgcgcaagccttttttcattcagaggcagggcaaaagacatcggttctgagaacgactttgctgacgatgaacacagcaccttcgaggacaacgacagcagaagggattcgctttttgtgcctcaccgccatggagaacgaaggcattcaaatgtgtcacaggcttccagagcaagcagggtcttgccgattctgcctatgaacggaaagatgcacagcgcagtggattgtaatggggtggtgtccctagtggggggaccatcaaccctgacgagtgctggccaactgctgccagaaggtacaacaacagagactgaaattcgcaaaaggcgtagctccagctatcacgtctcgatggatctgctggaggatcccacttctagacaacgggctatgagcatcgcttcgattttgacaaacacaatggaggaactggaggagagcaggcaaaagtgtcccccttgctggtataaattcgctaatatgtgtttgatatgggattgttgtaaaccctggctcaaggtcaaacacctggttaacttggtggtgatggacccttttgtggacctggccattacgatttgtattgttctgaacactctattcatggcaatggagcactatcctatgaccgaacagttctcttccgttctcagtgtaggcaacctggtgtttacagggatatttactgccgagatgttcctcaagatcatcgccatggatccttactattattttcaggaaggctggaacatctttgacgggttcatcgtgtctctaagcctcatggaactggggctggcgaacgtagagggtctgagcgtcttgaggagctttagactcctccgtgtgttcaaactcgccaagtcctggcccactttaaatatgctgatcaagattatcgggaacagcgtaggcgctctgggtaatttaaccctcgtgctcgcaatcatcgtttttatatttgctgtcgtcggtatgcagctgttcgggaaaagctacaaggagtgtgtatgcaagataagcaacgactgtgagctacccagatggcacatgcacgattttttccacagcttcctcattgtgtttagagttctctgcggagagtggattgaaactatgtgggactgtatggaagttgccggtcaaacaatgtgtttgacagtgtttatgatggttatggtgatcggaaacctggttgtacttaatcttttcttagctttgctgctgtcctcatttagttctgataacctggcagctaccgacgacgacaacgaaatgaacaacctgcaaatagccgttgggagaatgcagaaggggatagacttcgttaaaaggaagattagggaattcattcagaaggcattcgtgcggaagcaaaaagcattagatgagatcaaaccgctcgaagacctcaataacaaaaaagacagctgcatcagtaaccacaccaccattgaaataggcaaggacctgaactatcttaaagacggaaatggtactacaagtggcatcgggagttcggttgagaaatacgtggtggatgagtccgattacatgtcctttatcaataacccgtccttgacagttactgtcccaatcgctgtgggagagagcgacttcgaaaacctcaacaccgaagagttcagctctgagagcgatatggaggagtcaaaagaaaagttgaacgcaacttccagtagtgaaggatctacagtcgatataggggcacccgctgagggggaacagccggaggtggaacctgaagagagtctggaacctgaagcgtgcttcacagaggattgtgtgcgcaaattcaaatgctgccagatttccatagaggaagggaagggcaagttatggtggaatctacggaagacctgctataagatcgtggagcacaactggttcgaaactttcattgtgtttatgatacttctgtcaagtggggctttggccttcgaggacatttacatagagcagaggaagaccattaagactatgttggaatacgccgataaggtgttcacatatatcttcattctggaaatgttgctgaagtgggtagcatacggtttccaagtctactttactaacgcttggtgttggctcgactttctcatagtagatgttagccttgtgtcactgaccgcaaatgccctcggctatagcgaactgggggctattaagagtctgcggaccttgcgagccctgaggccattgcgggctctgagcaggttcgagggcatgcgcgtagtggtaaatgctcttctcggcgcaatccctagtattatgaacgtgttattggtgtgcctcatcttttggctgattttctctatcatgggggttaatctgtttgctggtaagttttaccattgtattaactatacaactggagaaatgttcgatgtgagtgtggtgaacaattacagcgagtgtaaagccttgatcgaatccaaccagaccgccagatggaagaacgtgaaggttaactttgacaacgtggggcttggctacctgtctctattacaagtcgctacctttaaaggctggatggatataatgtatgctgctgtagactccaggaatgtggaacttcagcccaagtacgaagacaacttgtacatgtacctttatttcgtaatctttattatattcggttccttcttcacccttaatctgtttataggagtaattatcgacaactttaatcaacagaaaaaaaagtttggcggacaggacatcttcatgacagaagagcagaagaagtattacaacgccatgaagaagctgggtagcaagaaaccccaaaagcccattcctcgcccagcaaacaagtttcaagggatggttttcgactttgtgaccaaacaggtcttcgacatttccattatgattctaatatgcctgaacatggtgaccatgatggtggaaaccgatgaccaatcccaggagatgaccaacatcctgtattggattaacctcgtttttatcgtccttttcacaggcgagtgtgtgttaaagctgatttctctgagatactactatttcacgattggctggaacatattcgacttcgtagtagtgatcctctcaatcgtggggatgtttctggccgagttaatcgaaaaatacttcgttagtccaaccttgtttcgggttataagactagcaagaatcggacggatactgcgcttaataaaaggcgctaagggtatccggactctgctctttgcgttgatgatgtctttacctgctctttttaatatcggacttttactattcctggtgatgtttatctacgctatttttgggatgagcaactttgcctacgtgaaaagagaagtgggtatcgacgacatgtttaactttgaaaccttcggtaacagtatgatctgtttgttccagatcaccacctccgctgggtgggatggcttgctggcacccatcctgaatagcgggccaccagattgcgacccagataaagatcaccccggatcctctgtgaagggggattgcgggaatccctcagtgggcattttcttttttgtcagttatatcatcatttcatttctggtcgtggtaaacatgtatattgctgttatcctggagaatttcagtgtcgccaccgaggaaagtgcagagccacttagcgaggacgactttgaaatgttctatgaagtgtgggaaaagttcgatcccgacgccacccagttcatcgagttcgctaaactctctgatttcgcggatgctctggacccaccgctcctgatcgcaaagcctaataaggttcaactgattgccatggacctgcctatggtcagcggtgatagaattcattgtctcgatattttgttcgcattcaccaaacgtgtgctcggggagtcaggtgaaatggacgctctccgcattcagatggaggaacggtttatggcctctaatcctagcaaggtgtcgtacgagccaatcacaacaaccctaaagagaaagcaggaggaggtctccgctataattattcagagagcctacaggaggtacctgctgaaacagaaagtaaaaaaggtctcttccatttataaaaaggacaagggtaaagagtgcgatggaactcccatcaaggaggacacattaatcgacaagcttaacgaaaacagtacaccggaaaagactgacatgacaccctccaccacctcaccaccgagctatgattcagtgacaaagccagagaaggaaaagtttgaaaaggataagtccgaaaaagaagacaaggggaaggacatccgtgaaagtaaaaaata

SEQ ID NO: 240881 - DNA, 6017 bp, Artificial Sequence
  Description of Artificial Sequence: Synthetic coding sequence
atggctcagagtgtgctggtcccccctgggccagacagcttcagattttttacgcgggagagcctggccgctattgagcagagaatcgccgaggagaaagccaaaagacccaagcaggaacggaaggatgaggatgacgagaacggcccaaaacctaacagtgatctggaggcgggaaaaagcctgccatttatctacggcgacattcctccggaaatggtttccgtcccactggaagacctggacccatattacataaataaaaagacttttattgtcctcaataaaggcaaggcaatctcacgattttctgcaactcccgctctgtatatattaaccccatttaacccaatccgaaaactcgcgattaagatcctggtccactctctttttaatatgttaatcatgtgcaccatcctgactaactgtgtgttcatgaccatgagtaatcctcctgattggaccaagaatgttgaatacaccttcaccggtatctatacatttgaatccctcataaagattctggccagggggttctgccttgaggatttcaccttcctcagggatccatggaattggcttgacttcaccgtgatcacatttgcttacgttacagaattcgtaaatctcggcaacgtttcagcattgcgcacttttcgagtcctgcgggctctgaaaaccatatccgtgatcccaggcttgaaaaccatcgtgggggctctgattcagtccgtcaagaaattatctgacgtgatgatcttaaccgtgttttgtttgagcgtttttgcacttattggcctccagctcttcatgggaaacttgcgcaataaatgcctgcagtggccgccagacaactcttcttttgaaattaatataacaagcttttttaataattctcttgatggcaacggcacaacatttaatagaaccgtctctatctttaattgggacgaatatatcgaggataagtcccacttttattttttggaaggacagaatgacgccctcttgtgtggcaactcgagtgacgctggacaatgccccgaaggatatatttgcgttaaagccggacgaaacccaaactatggatacacaagttttgatactttctcatgggcatttctcagtctgttccgcctcatgacccaggacttctgggagaatctgtaccagttaacacttcgcgctgccggtaagacctatatgatcttttttgtgcttgtgatcttcctgggctctttttacctaatcaaccttattctggccgttgtcgccatggcgtatgaggaacaaaaccaagctaccctcgaggaagcggaacagaaggaagccgaattccagcagatgctggaacagctgaagaagcagcaggaagaggcccaggccgctgcagcagcggcaagcgcagaatcccgcgatttttccggtgccggaggcattggagtgttttccgagagttcaagcgtagcttctaaactgtcatcaaaaagtgagaaggaattaaaaaatagacggaagaaaaaaaagcagaaggagcaatccggcgaggaggagaaaaacgatcgtgtccgaaagagtgaatctgaggacagcatacgccgtaaaggatttcgctttagcttagagggatccagattaacatacgaaaagcggttctcctccccgcaccagtcactgctgagtatccggggatccctgttttcgccacgcaggaatagtcgggcaagtctgtttagctttcggggtcgagcgaaagacatcggcagtgagaacgactttgccgacgatgagcacagtacatttgaggataacgactcgagacgagatagcctgtttgttcctcatagacatggggagagaaggcatagtaacgtgtctcaagcttcgagggccagtcgcgtgcttcctattctgcccatgaacggcaagatgcactcagccgtggattgcaacggggtagtaagcctcgtcgggggtcccagtacactaacatcagccggacaactgctccccgagggcacaacgacagaaacggagattcgaaagcgacggagttcatcctaccatgtgtccatggatctcctcgaggatcctacctccagacagcgggctatgtccatcgcatctatcctcacaaataccatggaggagctggaggaatcacgtcagaaatgccctccctgctggtacaagtttgctaacatgtgcttaatttgggactgctgtaaaccgtggctcaaggtaaagcatctcgtgaatcttgttgtgatggacccctttgtggacctagctataaccatctgtattgtcctgaacacactgttcatggcgatggagcactacccgatgacggaacagttcagttccgtgttgtctgtgggtaatctagtgtttacgggcatttttacagcggaaatgtttttaaagataatcgctatggacccatactactacttccaggaggggtggaacattttcgacgggttcatcgttagtctcagcctgatggagctgggtctcgcaaatgtggaaggtttgagcgtgcttcgaagcttccggctgttacgggttttcaagctggccaagtcatggcccaccttgaatatgctcattaagatcatagggaattctgtgggggcactgggtaatttgaccctggtcctagctatcattgtctttatctttgctgtcgtgggaatgcaactttttgggaagagttacaaggagtgtgtatgcaagatcagcaatgactgtgaactgccacgctggcacatgcacgatttctttcactccttcctgatagtctttcgcgtgctgtgcggcgagtggatcgaaactatgtgggattgtatggaagtcgctggccagacaatgtgtctcactgtcttcatgatggtcatggtgatcggaaacctggtcgtgctgaacctcttcctagcactgctgctgtccagcttctcatccgataatctagctgccaccgatgacgataacgaaatgaacaacctacagattgccgtcgggaggatgcagaagggaattgactttgtcaaacgcaaaatacgtgaatttattcaaaaggcgttcgtaaggaaacagaaggctctggatgaaataaaacccctggaggaccttaataataagaaagactcctgcattagtaaccacaccaccattgaaatcgggaaagacctcaattacttaaaagacggcaatggaacaacatcaggcatcggcagctctgtcgaaaaatatgtggtggatgaaagcgattacatgagcttcatcaataatcccagtctaaccgtgaccgtcccaattgctgtgggcgagtcagatttcgagaaccttaacaccgaggaattcagcagcgagtcggacatggaggagagcaaagagaaactgaacgcgacctcgtcgtccgaaggaagcactgttgatataggggcacctgccgagggcgagcaacccgaggtcgaacctgaggaatcactggagcctgaggcatgctttaccgaggattgcgtcaggaagttcaaatgctgccaaatttccatcgaagaaggcaagggtaagttgtggtggaatctccggaagacgtgttacaagattgtcgagcacaactggttcgagacctttatagtcttcatgatcctgctgtctagtggagcgttagcgttcgaagatatctacatcgagcaacgcaaaacgataaagaccatgctggaatacgcagacaaagtctttacttacattttcatcctggaaatgctgttgaaatgggtggcctacggattccaagtttatttcacaaatgcttggtgctggttagatttcctcatagtggatgtttccttggtgagcctaacggcgaacgccctgggatatagcgagctcggagctattaaaagcttacggacccttagggcactgcgccctctgcgcgcactgtcaaggttcgagggcatgagggtggtagtcaacgcgctactgggggctatcccctcaatcatgaatgtgctgctggtgtgcttgatcttctggctgatctttagcatcatgggtgtgaacctgttcgctggcaaattttatcattgtatcaactacacgacgggagagatgttcgatgtgtccgttgtgaataattactcggagtgtaaggcattaatcgaaagtaatcaaaccgccagatggaagaatgtgaaggtgaacttcgacaacgttggcctcggctaccttagcttgctgcaggtcgccacctttaaaggatggatggacataatgtacgcggctgtggacagtcgaaacgttgaactgcagcccaagtacgaggataacttatatatgtacctttacttcgttatttttattatctttggatctttctttaccttgaatctgttcattggagtgattatcgacaattttaatcagcagaagaaaaaattcggcggtcaggacattttcatgaccgaggagcagaagaagtattataacgcgatgaaaaagctcggcagcaaaaagcctcagaaacctataccacggccagctaataaatttcagggtatggtgtttgattttgttacaaaacaggtatttgatatcagcatcatgatcctgatttgtctgaatatggtgactatgatggttgaaacagatgatcagtcccaagaaatgactaatattctctattggatcaatctcgtttttatcgtgctcttcaccggcgagtgcgtgctgaagctgatttcactgaggtactattacttcacaatcggatggaacattttcgactttgtcgtcgtgattttgagcatcgtcggaatgttcctggcagaattgatcgaaaagtactttgttagcccgacccttttccgcgtcattcgcctcgccaggatcggacggattctgagattgatcaagggcgcaaagggcatcaggacactgttgttcgcactaatgatgtccctgccagcactgttcaatatcggtctgttgctattcctggtgatgtttatttacgccatatttgggatgtcaaattttgcctacgtgaaaagagaggtgggtattgacgacatgttcaacttcgaaacctttggaaacagcatgatctgtctgtttcagattacgacctccgccggatgggatggcctacttgcaccgatccttaacagtgggcctcctgattgtgatccggacaaggaccaccctggtagctctgtgaaaggcgactgcggaaacccttctgtgggcatctttttctttgtcagctacatcataatctcatttctggtcgtggtgaatatgtatatcgccgtaattcttgaaaacttttccgtcgctaccgaggagagtgcagaacccttgtctgaggacgattttgaaatgttttatgaggtttgggagaagtttgatcctgacgcaacccagttcatcgagtttgctaagctctcagattttgcagacgccctggatcctccattactgatcgccaagccaaacaaggtgcagttgatcgccatggacttgcccatggtgagcggcgacagaatccactgcttagatatactatttgcatttactaagcgggtgctgggggagtccggggagatggatgccctgcgcattcagatggaggagcgattcatggcatctaacccctcaaaagtttcctacgaaccgatcacgacaactctgaaaaggaagcaggaggaggtgtctgctataattatccaacgagcataccgcagatatttgctgaaacagaaagtcaaaaaggtgagctctatctataaaaaggacaagggcaaagaatgtgacgggactcctatcaaagaagacacactgatcgacaagctgaatgaaaattccaccccggaaaaaacagacatgactcctagcactacaagtcctcctagctatgactccgtgaccaagcccgagaaggagaaattcgagaaggataaaagcgagaaggaggataagggcaaggacatcagagagtcaaagaaata

SEQ ID NO: 240882 - DNA, 6017 bp, Artificial Sequence
  Description of Artificial Sequence: Synthetic coding sequence
atggcgcaatcggtcctagttcccccagggccagactcattccggtttttcactcgcgaaagcctagcagccattgaacaaaggatcgccgaagagaaggccaagcgtcccaagcaggagcggaaagatgaggatgacgagaacggaccaaagcctaacagcgacctcgaagctgggaagagcctgccgttcatctatggggatattccacccgagatggtaagtgtgccactcgaagacctggatccttattacataaataagaagacgttcattgtcctgaacaaaggaaaagcaatctctaggttcagcgctacccccgctctatatatccttacacccttcaacccaatacgtaagctcgccatcaagattttggtacattccctcttcaatatgctgataatgtgtaccatcctcacgaattgtgtgtttatgaccatgtcgaatcccccagactggactaagaatgttgaatacacttttacaggaatctacacctttgagagtctgataaagatactggctcggggattctgtctggaggatttcacattcttgcgggatccctggaactggctggattttaccgtgatcaccttcgcctacgtcacagagtttgtagatctgggcaacgtgagcgccctcagaacattcagagtcctcagagccctgaaaaccatttccgtgatccctggcttgaagaccatcgtcggtgccctgattcagagcgtcaagaagctgagtgacgttatgatactgacagttttctgcttgtccgtatttgcactaattgggctccagctgttcatggggaatctgcgaaataagtgcctgcagtggcccccagacaatagcagttttgagatcaatataacctcatttttcaataatagtctggacggcaatggcactacctttaaccgcactgtgtccatcttcaactgggacgaatacattgaagacaagagccatttctattttttggagggacagaatgatgctcttctgtgtgggaacagttcagacgctggccagtgccctgaggggtacatttgcgttaaggccggaaggaatcccaactacggctacacttcttttgataccttcagctgggctttcctaagtctcttccgcctgatgacgcaggacttctgggagaacctctatcagctaacacttcgcgcagctggaaaaacatatatgatcttctttgtgctggtgattttcctgggaagtttctatctgataaatctgatattggcagtggtcgccatggcttatgaggagcagaaccaagccacccttgaagaggcagagcagaaggaagcggagtttcagcagatgttggagcagcttaagaagcagcaggaggaagcccaggctgcagctgccgcagccagcgccgagagccgagatttctccggtgctggcggaatcggagttttctctgaatcaagctctgtcgctagcaagttgtcgagtaagagcgaaaaggaactgaagaatcgacgaaaaaagaaaaaacagaaggaacaatctggcgaagaagaaaagaacgaccgagtgagaaagtccgagtccgaggactccatcagacgtaagggattccgatttagcctagagggctcgaggcttacttacgaaaaacggttcagtagtccccatcagtcattactctctatacggggtagtctttttagccctagaagaaatagtagggccagcctgtttagctttcgtggtagagcaaaagacatcggaagcgagaatgattttgctgatgacgagcactctacctttgaggacaatgattctcggcgagattcgctgtttgtcccacatcggcacggggagcgacgacacagcaatgtttcacaagcttcaagagcctcccgagttctgcccatcctgcctatgaatgggaagatgcattccgcggtggactgcaatggagtcgtgtctctcgtcggcggtccttctacgctcacgtccgctggtcaacttctacccgaaggcaccactaccgagacggagatccgtaagagaagaagcagttcttaccatgtgtctatggacctacttgaggatcccaccagccggcagcgggcaatgtcaattgcttcaatcctcacaaatacaatggaggagctggaggagtctaggcagaaatgccctccatgctggtataaatttgccaatatgtgtctgatttgggactgctgtaaaccctggctcaaggtgaagcacttagtcaacttggtggtgatggacccatttgtggatctagccataacaatttgcatagtgttgaatacactgttcatggccatggaacattatcctatgacagaacagttcagcagcgtgctttcagtcgggaatctggtgttcactggtatattcaccgccgaaatgttcctgaaaattatcgccatggacccatactactatttccaagaggggtggaatatttttgatgggttcatcgtctctctgagtctcatggaactgggattagccaatgttgaagggttatctgttttaaggtccttcagattgctgagggtgttcaagctggccaagtcctggccaactctgaatatgctgattaagattataggtaacagtgtgggagccctggggaacctaacactcgttcttgccatcatcgtctttattttcgcagtggtgggaatgcaactgttcgggaagtcttataaggaatgcgtctgtaaaatatcaaatgattgtgagctccctcggtggcacatgcacgacttcttccattcgtttcttatcgtgtttcgggtgctgtgtggggagtggatagaaaccatgtgggactgcatggaagtggccggtcagacgatgtgccttaccgtgtttatgatggtgatggttataggcaatctggtggtgctgaatctcttcttggcactccttctgtcatccttttcatccgacaatctcgccgctaccgatgacgataacgaaatgaataacctgcagatcgccgtcggacgaatgcaaaagggcattgactttgtgaagaggaaaatccgggaattcatccagaaagctttcgtgagaaagcaaaaggccttggacgaaatcaagcccctggaggacctgaacaacaagaaagattcttgcatcagcaatcatacgaccatcgagattggaaaggacctgaactatttaaaggatggaaatggcactaccagtggtatagggtcatctgtagagaagtacgtggtggacgagtctgattacatgtccttcatcaacaatccctcactgactgtcaccgtgcctattgctgttggagaaagtgacttcgaaaacctgaatactgaggagttctcatccgagagtgacatggaggagagcaaagagaagttgaacgccacctcatctagcgagggctcaaccgttgacattggggctccggctgagggcgaacagcccgaggtggagcctgaggaatcattggagcctgaagcctgtttcaccgaggactgcgtgcggaagtttaaatgttgccaaatatctatagaggagggaaagggcaagctgtggtggaatctccgaaagacttgctataaaattgtggaacacaactggtttgaaacctttattgtgtttatgatccttctctctagcggagctctggcctttgaagatatctacattgaacagagaaagacaattaaaaccatgctggaatatgctgataaagtgtttacttacatctttatcttggaaatgttgctgaaatgggtcgcgtacgggtttcaggtgtactttacgaatgcgtggtgctggttggacttcttaatcgtggacgtgtcactcgtctccctgaccgctaatgcactaggctattctgaactgggcgcaatcaagtctcttagaacattacgagcactgcgcccactgcgcgcactctcccggttcgaggggatgcgggtagtggtaaacgctttgctcggcgctataccaagtatcatgaacgtgttgctagtttgcctgatcttctggttaatcttcagcatcatgggggtgaacctttttgccggtaaattctaccattgtattaactacaccaccggtgaaatgttcgatgtctctgtcgtcaataactactctgagtgcaaagccctgatcgagagcaatcagaccgctagatggaagaacgtgaaagtgaactttgataacgttgggctgggctacctgtccctgctgcaggttgccacctttaagggttggatggacattatgtacgccgcagtggactcacggaacgtggagctgcaaccgaagtatgaagacaacctgtacatgtacttatacttcgtgatcttcataatttttgggtcttttttcacacttaatctttttattggcgtcatcatcgataatttcaatcagcagaagaagaagttcggaggccaggacatctttatgaccgaagaacaaaaaaaatattacaacgcaatgaaaaagttgggctccaagaaaccgcagaagccaattccaagacccgctaataagtttcagggaatggtatttgactttgtgacaaagcaggtgtttgacatttcaatcatgattctgatttgcctaaacatggttactatgatggtagaaaccgacgaccagtcacaggagatgactaacattttgtattggattaacctagtgtttatcgtactgtttacgggcgagtgtgtactgaagctaattagcttacggtattactattttaccattggatggaacatattcgacttcgtagtggtcatattaagtattgtgggaatgtttttagcagagttgatcgaaaagtactttgtgtcgcccacgttgtttcgggttatacgcctcgctcgaattggaaggatcctacgcttgatcaaaggcgcaaaaggtatccgaaccctgctgtttgcactgatgatgagcctcccggctctgttcaatatcggccttctcctgttcctggtgatgttcatctatgccatttttgggatgtctaacttcgcctatgttaagcgcgaggttgggattgacgacatgtttaactttgaaactttcggaaatagcatgatctgcctctttcagattacaacaagtgccggatgggacggactgctggcccctatcctgaattccggaccacccgattgcgacccagataaggaccatcctggcagctctgttaaaggggattgtgggaatcctagcgttggaatattcttttttgttagttacattatcattagcttcctcgtggttgtcaacatgtatatcgctgtgattctggagaacttcagtgtggctacggaagagtccgcggagccactctccgaagacgactttgagatgttttacgaagtgtgggaaaagtttgaccctgacgcaacgcagttcatcgaatttgctaaactgtccgattttgctgacgccctagacccacccctgcttatcgctaaacctaacaaagtgcaactgattgcaatggaccttcctatggtcagtggggatcggatacattgtctggacattctattcgcttttacaaaacgggtcctgggggagtctggcgaaatggacgcgcttcgcattcagatggaagaaagattcatggcgagcaacccctccaaggtgtcatatgaacccatcacaaccactctgaaacgcaagcaagaggaggtatctgcgatcatcattcaacgtgcctacagacggtacttgctgaagcagaaagtgaaaaaagtttcgagtatatacaagaaggacaagggaaaagaatgcgatggcacgcccatcaaagaggatactctgatcgacaagctcaatgagaactctactcccgagaagacggacatgacgcctagcactacctcgccaccatcttatgacagcgtgacaaaaccggagaaagagaagtttgagaaagataaatctgaaaaggaagacaagggaaaagacattagggagtcaaagaagta

SEQ ID NO: 240883 - DNA, 1512 bp, Artificial Sequence
  Description of Artificial Sequence: Synthetic coding sequence
atggctcagtctgtcctggtaccacccggtcccgattctttcaggtttttcacaagagaaagccttgccgcaatcgaacagcgcattgcggaagaaaaggccaaacggcctaaacaagagcggaaggatgaagacgacgaaaacggtcctaaaccaaactccgacctggaggccggaaagagtctcccgtttatttatggtgacatcccccctgaaatggtgtccgtgccccttgaggacttagatccgtattacattaataagaaaaccttcattgtgctgaataaaggaaaggccatctcgaggttctccgcaaccccagcattgtatattcttaccccctttaatccaatcagaaaactggctatcaagattctggtgcattccctgttcaacatgctcatcatgtgcactatcctcacgaactgcgtgtttatgacaatgagcaatcccccagattggactaagaatgtggaatataccttcacagggatctacacttttgaatctctgattaaaatcctagcacggggattctgcctcgaagatttcacattcttaagagacccttggaactggctggatttcaccgtgataacatttgcgtacgtcaccgagttcgtcgacctgggaaacgtctccgccctgcgcacgttcagagtgctgcgggctctgaaaacaatatcagtgatcccaggactcaaaactatagtgggagccttaattcagtctgtgaagaagctgagcgatgttatgattctgactgtgttctgtctgtctgtgttcgcccttattggcttgcagctgttcatgggcaatctgagaaataagtgcctgcagtggccacccgataactcatctttcgaaatcaatatcaccagctttttcaacaattcactggatggcaacggcacaactttcaacagaacagtttctattttcaactgggatgaatacatagaagacaaatctcacttctacttcctcgaggggcagaacgacgcattgctgtgtgggaatagtagcgatgctggccagtgccccgaagggtacatatgtgtgaaagccggacgtaatccgaattacggctatacctcctttgatactttttcctgggcatttctgagcttatttcgcctcatgacacaggacttctgggaaaacctttatcaactgactcttcgcgcagccggtaagacgtacatgattttttttgttctggtgatttttctgggaagtttctacctgattaacttgatactggccgttgtcgccatggcatatgaagagcagaaccaggccaccctagaggaagccgagcagaaagaggccgaattccagcagatgctggagcaactgaaaaagcagcaggaagaggcccaggcggctgccgcagcagcctctgcggaaagcagagatttttctggtgcaggcggaattggggtcttctcagagtcatcgtccgtcgccagcaagctcagctctaagagcgagaaggaactgaaaaattag

SEQ ID NO: 240884 - DNA, 648 bp, Artificial Sequence
  Description of Artificial Sequence: Synthetic coding sequence
atgcaccgcgatgcttggctgccgaggccagctttttccctgaccggattgtcgttgtttttcagccttgtcccaccgggaagatcaatggaagtcacagtcccagctaccctgaatgtgctgaacggatcagatgccagactgccctgtacctttaactcctgctatactgtgaatcacaaacaattcagtttgaactggacataccaagaatgtaacaactgtagtgaagaaatgtttctccagttccggatgaagattatcaatttgaagctggagcgctttcaggatcgggtggaattctcaggtaacccctccaaatacgacgtgtctgtgatgttgcggaacgtgcagccagaggatgagggcatctacaattgctacatcatgaatcctccagaccgccacagagggcacggcaaaattcaccttcaagtgctgatggaagagcccccagagcgcgattctaccgtggctgtcatcgtgggcgcatccgtgggaggttttcttgcagtcgtcattctggtcctgatggtggtgaaatgcgtccgcagaaaaaaggagcagaagctgtccacagacgacttaaaaactgaggaagaaggcaaaacggacggcgagggaaatcctgacgatggagcgaaatag

SEQ ID NO: 240885 - DNA, 6003 bp, Artificial Sequence
  Description of Artificial Sequence: Synthetic coding sequence
atggcgcaggcacttttggttccgcctggacccgaaagctttcggttgtttaccagagaatcactggccgcaatagaaaaacgggctgctgaagagaaggccaaaaagcctaagaaagaacaggacaacgacgatgagaataaacctaaacccaactcagacttggaagctggcaagaaccttcctttcatttatggtgatattccacctgagatggtgtctgaacccttggaggacctggatccatactacattaataagaagacgttcattgtgatgaacaagggtaaggcaattttccgattctcagcaacctctgcgctctatattctcactcccctcaatcctgtgagaaagatcgcgatcaagatcctggttcacagccttttttccatgttgatcatgtgtaccattttaacgaactgtgtgtttatgactctgagcaacccaccagactggactaagaacgtcgagtacacttttacaggtatttatactttcgaatctctcattaaaatcctcgccagagggttctgcctggaggattttacatttttgcgagatccatggaactggctcgacttctctgtgattgttatggcttatgtcactgagttcgtcgatctaggaaatgtgtccgctctgcgaaccttcagggtgctcagggcccttaagacaatatctgtcatccccggattgaagacaatcgtcggggctttgatccagagtgtcaaaaagcttagtgacgttatgatactcaccgtgttctgtctctctgtgttcgcattaattggattgcagctgttcatgggcaatcttcggaataagtgtttgcagtggcccccatctgattccgccttcgaaaccaacactacgtcctacttcaatggaaccatggactcaaatggaactttcgtgaacgtcactatgagtacctttaattggaaggattatatcggagatgatagccatttctacgtcctcgacggccaaaaggatccgctcctgtgtgggaatgggtctgacgctggccagtgccccgaaggctacatatgcgtcaaagctggtagaaaccctaactacggatatacttcctttgacaccttctcttgggcgtttctttctttattcaggctgatgacccaggattactgggagaacctgtaccaactgaccctgagggccgcaggaaagacatacatgattttctttgttttggtcatttttcttggaagcttctatttggtgaatcttattcttgcggtggttgccatggcctatgaagaacagaatcaggcgacactggaagaggccgagcagaaagaagctgaatttcagcagatgctggaacagctcaagaaacagcaggaggaagcacaagcagtggctgctgcaagcgccgcaagccgtgatttttctggaatcggcggactcggtgagctgttggagtctagcagtgaggccagtaagttgtccagcaagtctgccaaagaatggcgcaaccggaggaagaaaaggaggcagagagaacatctggaggggaacaataaaggcgaaagggacagctttccgaagagcgagtccgaagattccgtgaaacgctcttcattcttgttttctatggatgggaacaggttgactagcgataagaagttctgtagtccccaccaaagcttgcttagtattaggggctcactgtttagccctcgcagaaactcgaaaacatctatcttcagcttccgaggccgagcgaaggacgtgggttccgagaatgattttgctgacgatgagcactctacatttgaggattcggaaagtaggcgggattctctctttgtgccccatagacacggcgagaggcgcaattcaaacgtgtcacaggcatcgatgtctagcagaatggtgcctggactgccagccaacggaaaaatgcatagtactgtggactgcaacggggttgtcagcttagtggggggaccatctgcccttacgtcacccactggccaactcccgcctgaaggtaccaccaccgagaccgaggtgaggaagagaaggctaagttcatatcagatttcaatggaaatgttggaggacagtagcggtaggcaacgggcagtctccattgctagtatcttaaccaacactatggaagagcttgaggagtcgagacagaagtgccctccttgttggtatagatttgctaacgtatttcttatctgggactgctgtgatgcctggctcaaggttaagcacctggtaaatctcattgtgatggaccccttcgtggacttggcaattacaatctgcatcgtactgaacaccctttttatggctatggagcactacccaatgaccgaacagttcagctcggtgttgactgtggggaacctggtgttcacaggtatctttacagctgagatggtgttaaagattattgccatggatccctactactattttcaggaaggatggaacatctttgacggcataatcgtcagcctctcactgatggagctcggcctgagcaacgtggagggcctgagcgttctgcggtcttttcgcctcctgcgagtcttcaagttggctaaatcctggccaaccctgaacatgctaattaaaatcataggaaactccgtgggtgcattaggtaacctcacgctagtcctagccataatcgttttcatttttgcagtggttggtatgcaattgttcggaaagagctataaagaatgcgtgtgtaaaatcaatgacgactgcacactacctcgctggcacatgaacgacttctttcacagtttcctcatagtattccgcgtgctgtgtggcgaatggattgagactatgtgggattgtatggaagtagctggacaaaccatgtgcctgattgtcttcatgctagtgatggtcattgggaatctggtcgtgcttaatttgtttctggctctgctgctgtccagtttctcatctgacaatctggcagctacagatgacgacaacgagatgaataatctccaaatcgcagtgggtcgcatgcagaaagggattgactacgtgaagaataagatgcgcgagtgtttccagaaagccttttttcgaaagccgaaggtgattgagattcacgaaggaaataagatcgatagctgcatgtctaataatactggaatcgagatctctaaggagctcaattatctgcgggacggtaatggcaccacatctggagttggtaccggttccagcgtcgagaagtatgttatagatgagaatgactatatgtcatttataaacaacccatccctcactgtgacggtgccaatcgcagtgggtgagagtgattttgagaatcttaacactgaggaattcagctctgagtctgaactggaggagtctaaagagaagctgaacgcaacttcttccagtgaagggtcaaccgtcgatgtggtgttaccccgagaaggagagcaggccgaaacggagcccgaagaggatctaaagccagaggcatgttttaccgagggatgtattaagaaattccctttttgtcaggtaagcacagaagaagggaagggaaagatttggtggaatctgcgcaagacctgctactccatcgtggagcataactggttcgaaacgttcatcgtattcatgatactcctgtcctccggtgccctggctttcgaagatatctatattgagcaacgaaagacgataaagacgatgctggagtacgctgacaaagtgttcacgtacatttttattcttgagatgctgctcaaatgggtagcctatggctttcagacatacttcactaacgcctggtgttggttggactttctaatcgtggacgttagtctcgtgagcctggttgctaacgccctcggatatagcgagttgggcgcaattaaaagccttaggacattgcgggcactgaggcctctacgcgcactgtctaggtttgagggaatgcgtgtcgtcgtcaacgccctggttggcgcaattcccagtattatgaacgtgttactggtgtgcttgatattttggcttattttctcaataatgggagtgaatctgtttgccggtaagttttaccactgcgtcaacatgactacaggcaacatgttcgacatctccgacgtaaacaatctaagcgattgccaagcgctcgggaagcaggctcgatggaaaaacgttaaagtaaatttcgataatgttggtgctggctacctggccttactccaggtcgctacattcaaagggtggatggacataatgtatgccgctgtggactccagagatgtgaaactgcagcctgtttacgaggaaaatctgtacatgtatctctacttcgtcatctttatcattttcggtagttttttcacattaaatctcttcatcggggtgataattgacaatttcaaccagcagaagaagaagtttggcggacaggacatcttcatgaccgaggagcagaagaaatactacaacgcaatgaaaaaactaggatccaaaaaaccccagaagcctattcctcgaccggcaaacaagtttcagggaatggtgttcgacttcgtgacaagacaggtttttgatatatccattatgatcctgatttgtctgaacatggttaccatgatggttgagactgacgatcaagggaaatatatgacactggttctgtcccgtatcaacctggttttcatcgttctcttcaccggcgaatttgtgctcaagctggtctctctccggcactattacttcacgatcggctggaatatatttgattttgtcgtcgttattctgtccattgtgggtatgtttctggccgagatgattgaaaaatattttgttagtcctactctattcagggttattcgccttgcacgaatcggcaggattcttcggctaatcaagggggctaaaggcatcaggactctactatttgccctgatgatgagcctgcccgctctatttaatattgggcttctcctctttttggtaatgttcatctatgccatcttcggaatgagcaacttcgcatatgtcaagaaggaagctgggatcgatgatatgtttaattttgagacgtttgggaattctatgatctgtctattccagatcacaaccagcgcgggatgggacgggcttctggccccaatcttgaactcggccccacccgattgcgaccccgacaccatccatccgggttcctctgtgaagggagactgtggcaacccgagcgtggggatcttctttttcgtgagctatattattatcagttttctggtggttgtgaacatgtacattgcagttatccttgagaatttttcagttgccactgaagagagtgcagagcccctgtcagaagacgacttcgaaatgttctacgaagtttgggagaagttcgatccagatgccacccagtttattgagttcagtaaacttagtgattttgctgccgcattggatcctccactcttgatcgccaagccgaataaggtgcaactcatagcaatggatctgcctatggttagcggagatcgaattcattgcctggatatcctttttgcctttacgaagcgggttttgggcgaaagtggcgagatggatgctctgcgcatccagatggaagaccgctttatggcctccaatccgagtaaagttagctacgagccaatcactactaccctcaagaggaaacaggaggaagtcagcgccgcaatcatacaacgcaacttccgctgctacctgctaaagcagcggctgaagaatataagcagcaactataataaggaggctattaagggcaggatcgatttgcctatcaagcaggatatgatcattgataagctgaatggcaattcaacacccgaaaaaacagacggaagctcgagcactaccagtccgccttcttacgacagcgttaccaagcctgataaagaaaaattcgagaaggacaagccagaaaaagagtctaagggcaaagaagttcgcgagaaccagaaatat

SEQ ID NO: 240886 - DNA, 6002 bp, Artificial Sequence
  Description of Artificial Sequence: Synthetic coding sequence
atggcccaagcccttttggtccccccaggacctgaatccttcagactgttcactagagaaagcttggctgctatcgagaaacgcgctgcggaggagaaggctaaaaagcctaaaaaggagcaggacaacgatgatgagaacaaacctaagcctaatagcgaccttgaggccggtaaaaatctcccatttatttatggagacataccgcctgagatggtttcagagccactggaggacctcgatccttattacatcaataaaaaaaccttcattgtgatgaataaaggaaaggccattttcagattcagtgctactagtgctctgtacattttgacccctctgaatcccgtacggaagattgcaatcaagatactcgtgcactccttgttcagcatgctgattatgtgcaccatccttacgaactgcgtgtttatgacactctcgaatcccccagactggacaaagaatgtggagtacacgttcaccggtatatacacgtttgagtctctgattaaaatattggcccgaggattctgcctagaggactttacctttttgagagatccttggaattggttggatttctccgtgattgtgatggcttatgtaactgagtttgtctccctggggaacgtaagtgccctacggacgttccgggtgctcagagcgctgaaaactatctctgtcattcccggattgaaaaccattgtgggagcactcatacagagtgtgaagaaactgagcgacgtcatgatcctcactgtgttttgcctttcagtgttcgcgctgattggcctccagctctttatgggaaacttgcgtaataagtgtttacaatggcccccttccgattcagcctttgaaacaaacaccaccagctattttaacggaacaatggactctaacggtactttcgtgaacgtgaccatgtcaacatttaactggaaggactacatcggcgacgactctcacttttatgtcctggacggccagaaggatcctctcctctgtggcaatggcagcgacgccggtcagtgtcccgagggctatatttgcgtgaaggcaggcagaaaccccaactatggatatacaagtttcgatacatttagttgggcgtttctatccttgtttcggctgatgacacaggactactgggagaacctgtaccagttgaccctgcgagccgctggtaagacatacatgatctttttcgtcctggtgattttcctgggatcattctacctggtgaacctgattttggctgtcgttgcaatggcctatgaggaacagaatcaggccactctggaagaagcagagcaaaaggaggccgagtttcagcagatgctggagcaattgaagaagcaacaggaggaagcacaagcagtggctgccgcttctgccgctagccgtgatttttccggaatcgggggactgggtgaattgttggaatctagctcagaggcatccaagctcagcagtaaaagcgcaaaggagtggcggaaccgacggaagaagagacgacagcgtgaacacctggagggcaataacaagggcgaacgggactctttccccaaaagcgagtccgaggactccgtcaagaggtccagcttcctgttcagcatggacgggaaccggcttacaagcgacaaaaaattctgtagccctcaccaatcacttctgagcatccggggatctttgtttagcccacgacggaattccaagaccagtatcttttcctttcgagggagagccaaagacgtgggaagcgagaacgactttgctgatgacgagcattccacttttgaggacagtgaatctaggcgagactctctattcgtcccacatcgccacggtgaaagacgtaattccaacgttagccaggccagtatgagtagccgcatggtgcctgggctccctgcaaatggcaaaatgcactcaacagtcgattgcaatggggtggtgagcctggtggggggaccatccgcattaacgtccccaaccggtcagctgcccccagagggaacgactaccgagaccgaggtccgcaagagaagactgtccagttaccagatctctatggaaatgctagaggatagcagcggccgacagcgcgctgtctctatcgcttcaatcctgactaacaccatggaagagcttgaagagtcgcggcagaagtgcccaccttgctggtatcgattcgcgaatgtgttcctgatctgggattgttgcgatgcctggcttaaagttaaacacctcgtgaatttgatcgtgatggatccctttgtagacctggctataacaatttgcattgttctcaacactctgttcatggcaatggaacactatcccatgaccgaacagttttcttcagtgctgaccgttggaaacctcgtctttacagggatcttcacggcggagatggttctgaaaattattgccatggatccatactactattttcaggaagggtggaatatcttcgatgggatcatcgtgtcactgtctctcatggaactgggcctgagcaacgtcgaggggttgtcagttctgcgaagcttccggctgttaagggtatttaagctcgcgaaaagttggccaactctgaatatgctgataaagatcatcggcaactcagtaggagcactgggaaatctaactttggtgctagctatcatcgtgtttatattcgcagtcgttggaatgcaactctttgggaaaagttacaaggaatgtgtgtgtaaaattaatgatgattgcactttgccacggtggcacatgaatgattttttccatagctttctcatcgtgttccgtgtgctgtgtggcgagtggatcgagacgatgtgggattgcatggaggtggccggtcagactatgtgcctcattgtctttatgctggtgatggtgattggaaatctcgtggtgctaaatctctttcttgcactcctgcttagctctttctcaagcgacaatctggccgctaccgacgacgacaacgaaatgaacaatcttcagattgctgtcggccgaatgcagaagggcatagattacgtaaagaataaaatgagggaatgcttccaaaaggcgtttttccgaaagcccaaggtgatcgagatccacgagggcaataaaatcgatagctgtatgtccaacaatacgggcatagaaatctcaaaggagctgaattacttgcgggacggtaatggaaccaccagcggcgtaggaaccggctcctctgtcgagaaatacgtgattgacgagaatgattacatgtccttcatcaataatccatccctcacggtgaccgtgccgattgctgtcggggagtctgatttcgagaatctcaacaccgaggaattctcgtctgagtccgagcttgaagaatctaaggagaagctcaacgctactagtagttccgaagggtctaccgttgatgttgtgctcccccgtgaaggggaacaggccgagactgagcctgaggaagatctgaagccggaggcatgcttcacagaggggtgtataaagaagttccctttctgtcaggtgagcaccgaggaagggaagggcaagatctggtggaacctgcgaaagacatgttatagcatcgtggaacataactggtttgagaccttcatagtctttatgattctgctgagctccggtgcgttggcgtttgaagacatatacatagaacagcggaagacaatcaaaacaatgctcgaatacgcggacaaggtctttacgtatatcttcatactggaaatgctcctgaaatgggtggcttacggtttccagacctattttaccaatgcatggtgttggttggacttcctgattgtagacgtgagtcttgtgagtctggtagccaacgcgttgggctattccgagttaggagccattaagtcgttgaggactctgagggctctccggcctttgagggcacttagtcgttttgaaggaatgagagttgttgtcaacgctctggtgggcgctataccttcaatcatgaacgtgctgctcgtttgcttaattttctggctgatcttcagcatcatgggtgtcaacctcttcgctggaaaattctatcactgcgtcaacatgacaaccggaaatatgtttgacatctcagatgtcaacaacctttccgattgccaggccctgggaaaacaggctcgttggaagaatgtgaaagtgaatttcgataatgtgggagccggatacctggctctgctccaggtcgcaacatttaaagggtggatggacatcatgtacgccgctgtcgacagtagagacgtaaaactccagcctgtctacgaggaaaacctgtacatgtatttatattttgtgatctttatcatattcggctcattttttacactgaacctttttataggagtgataatcgacaatttcaaccagcagaagaagaaattcggaggccaggatatctttatgacagaagaacaaaaaaaatactataacgccatgaaaaagcttggcagcaaaaaaccccagaaacccattcctcgcccagcaaacaagtttcagggcatggtgtttgattttgtgacacggcaagtgtttgacatttctatcatgatactcatctgcctcaacatggtgaccatgatggtggagacagacgatcagggtaagtacatgactttggttctctcccggattaatcttgtttttatcgttttatttaccggcgagttcgttctgaagttggtttccctgcgtcattactactttaccattgggtggaacatatttgactttgtggtagtgatcctctcaattgtgggtatgtttctggccgagatgatagagaaatactttgtgagccccacattgtttagggtcattaggcttgcgagaattggcaggattctcagattgattaagggtgccaaagggatccgaactctgctttttgccttgatgatgagtctgccagcgttgttcaacatcggattactgctgttccttgtgatgtttatttacgctatcttcggcatgtctaacttcgcctacgtgaaaaaagaggccggaattgatgacatgtttaactttgagaccttcggcaactcaatgatctgcttattccagataactacatcagccggttgggacgggctactggcccctattctcaactccgccccacctgattgtgatccagacactattcatcccggatcttccgtaaagggcgactgtggaaatccgagcgtgggtatattctttttcgtgtcctacataatcatctctttcctcgtggttgtgaacatgtacattgccgttattcttgagaatttttcagtggctacggaggagagcgctgaaccgctctctgaagacgacttcgagatgttctacgaagtgtgggagaagtttgatcccgatgcgacacagttcatcgagtttagtaagctcagtgactttgccgctgctctggatccaccccttctgatagcaaaacccaacaaagtccagcttattgccatggatcttccaatggtgtccggggataggatccactgtctcgatattctgttcgcatttaccaagagagtcttaggagagtcaggtgagatggacgctctgagaatccagatggaagacaggtttatggcctcaaatcccagcaaggtctcctacgaacccataacgacaacactgaaacgcaagcaggaggaggtgtccgcagcgattatccaacgcaatttccgctgttatttactgaagcagcgtcttaagaacatttcaagcaactataacaaagaagccatcaaaggtcggatcgaccttccgattaagcaagacatgatcattgacaaactgaacggcaattcaacaccagagaagactgacggctcttcaagtaccacgagtccacctagttatgattctgtgactaaacccgataaggagaaattcgagaaggacaaaccagaaaaggagagtaagggtaaggaagtacgggaaaatcagaagta

SEQ ID NO: 240887 - DNA, 5855 bp, Artificial Sequence
  Description of Artificial Sequence: Synthetic coding sequence
atggcacaggccctgttggtcccaccaggccctgaatctttcaggctgttcaccagggagagtctggctgccattgagaaaagagcagcagaagagaaggcaaagaaacctaaaaaggagcaggataacgacgatgagaacaagccaaaacctaacagcgatctagaagctgggaagaacctgcccttcatttacggcgatattccccctgagatggtgtccgagcccctcgaggaccttgacccatactatatcaacaaaaaaactttcattgtgatgaataagggaaaagccatatttcgattctcggccacaagcgcactctatattctgactcctctgaatcccgtgcggaagatagccataaaaatactcgtgcacagtctattctctatgctcatcatgtgcacaatcctgactaattgtgttttcatgactttgtctaacccgcctgactggaccaaaaatgtcgagtacaccttcaccggaatctacaccttcgaatcattgatcaaaattctggcgcgagggttctgtttggaggacttcacattccttcgcgatccgtggaactggcttgatttcagtgtgattgtgatggcttacgttacagaatttgtcagtctcgggaatgtctctgcacttcggaccttccgcgtcctgcgcgcactgaaaaccatttccgtgatccccggactaaagacaatcgtcggagctcttatacagagcgtgaagaaactctccgacgtgatgattttaacagtgttttgcctgtctgtgttcgcgttaattgggttacaactttttatgggaaacctgcgaaacaaatgtctgcagtggcctccttcggattcagcctttgagacaaatactacaagctattttaatggaaccatggactccaatggcacgtttgtgaacgtgactatgtctactttcaactggaaagattatattggagacgattcgcacttctacgtgctcgacggccaaaaagatcccctgctatgtggtaacggcagcgacgctggacagtgccctgaagggtacatctgtgtgaaggctgggaggaacccaaattacggctacacgtcgttcgatacgttctcatgggcttttctatctctgtttcgcctcatgacccaggattattgggagaatctttatcagctgacactgagggcggcaggtaagacatacatgatattttttgtgctggtgatcttcttggggtctttctacttagttaacttgatcctggctgttgtggcaatggcatatgaagaacagaatcaggccaccttggaggaagcggaacagaaggaggcagagttccaacaaatgctggaacaactcaaaaagcagcaggaagaggcccaggcggtggctgccgcatctgctgcatccagagacttttccggaatcgggggtcttggagagctcctagagtcttcttccgaagcttctaaactgagctccaagtccgccaaggaatggcggaataggagaaagaagagacgacagcgcgagcatctggaaggaaacaacaagggcgaaagggacagcttccctaagtcagagtccgaggattcagttaagcgtagctcttttcttttctctatggatggaaaccgtctgactagcgataaaaaattctgctccccccaccagtctctgctttccattcgaggctcactctttagcccaaggcggaattctaaaacctccattttctccttcagagggagagccaaggatgtcggaagtgaaaacgatttcgccgatgatgaacacagcactttcgaggactcagagagccgtcgcgacagtcttttcgtgcctcacagacacggagaaagaagaaacagtaacgggaccaccactgagaccgaagtgcgtaagagaagactctcttcctaccagataagtatggaaatgctcgaagatagtagtgggcgtcagcgggcagtctcaatcgcaagcattctgacgaatacgatggaagagctggaagagtcgcgccagaagtgcccaccttgttggtacagattcgcaaacgtcttcctgatctgggactgctgcgacgcatggctgaaggtgaagcatttggtgaatctgatcgtgatggatccattcgtagacttagcgataactatttgcattgtcctcaatacacttttcatggcaatggaacactatcccatgactgagcagttttcatcagtgctgactgtgggcaatcttgtgttcaccggcatattcactgcagaaatggtactcaaaatcatagccatggatccgtactactactttcaggagggatggaatatatttgatggcatcattgtatctttatcacttatggagttgggcctgtctaacgtagaaggactttctgtcctccggtctttcaggctgctccgggtcttcaagctagccaaatcctggccaaccctgaacatgcttataaaaatcatcggaaatagcgttggcgctttagggaacctgactttggtgctggccattatagtttttatcttcgctgttgttggaatgcaactcttcggtaagagctataaggaatgcgtgtgtaagattaatgacgactgcactctcccaaggtggcacatgaacgatttttttcattctttccttatcgtctttcgcgtgctgtgtggtgagtggatcgagacaatgtgggattgtatggaagtggctggtcaaacaatgtgcctgatcgtatttatgttggtgatggtaatcggcaacctggtagtgctaaatctgttcctcgccctgttgctgagctctttcagcagtgataatctggctgcaaccgacgacgacaatgagatgaataatctgcagattgccgtggggagaatgcagaagggtatcgactacgtcaagaacaaaatgcgagagtgctttcaaaaagcattttttaggaaacctaaggtgatcgagatacacgagggcaacaaaatagacagctgcatgtccaacaatacaggaatcgagattagcaaagagttaaattatctgagggatggtaacggcacgacttccggggtcggcactggaagttccgtggagaagtacgtgattgatgagaacgactatatgtcattcatcaataacccatcactcacggttaccgtgcccatcgccgtcggtgagtccgactttgagaacctaaacacagaggagttctcttccgaatctgaactcgaggaaagtaaagagaaactcaacgcaaccagctcctccgagggatcaacagtcgacgtggttctgcccagagaaggagaacaggccgagaccgaacctgaagaggatttgaagcctgaagcttgcttcacagaaggatgcatcaaaaagttcccgttctgccaggtgtctaccgaagaagggaagggaaaaatctggtggaacctccgaaaaacgtgttatagcatcgttgaacataactggttcgagacattcattgtatttatgatactcctatcttccggcgcattggccttcgaggatatctacattgaacagcgcaaaacaattaagaccatgctggaatacgccgataaagttttcacatacatttttattctggagatgctcctgaagtgggttgcgtatggcttccagacatatttcaccaacgcttggtgttggctcgattttcttatagtggatgttagccttgtctccctggtggctaacgctctgggttactccgaactgggagctattaagtctcttaggaccctaagagctttacgccctttgcgcgctcttagcagattcgagggaatgcgtgtggtggtaaatgctctggttggagcaataccttccattatgaacgtgctgctggtgtgcttgatcttctggctgatattctctattatgggagttaatctgttcgcaggaaaattctaccattgcgtgaatatgacaacagggaacatgttcgatatttcagacgtgaataacctaagcgattgtcaagcccttggcaagcaggcccgatggaagaatgtgaaagtcaatttcgataatgttggtgctgggtacctcgccctactccaggtggctacgttcaaaggctggatggacataatgtacgccgctgttgactcccgcgacgtgaagctgcagcctgtctatgaagagaacctgtacatgtacctgtactttgttatctttattatttttggatctttcttcactctcaatcttttcatcggggtcatcatcgacaactttaaccagcaaaaaaagaagtttggcggtcaagatatttttatgacggaagaacagaaaaagtattataatgccatgaagaaacttgggagtaagaagccacagaaacctataccgcgtcctgcgaacaagttccagggcatggtattcgactttgtgacacgccaggtcttcgacatttctatcatgatcctgatttgtctgaatatggtgaccatgatggtcgaaaccgatgaccaaggcaagtacatgaccctggtgctctccaggattaatctggtattcatcgtgctgtttaccggcgagtttgtgctgaaactcgttagcttgcgtcactactatttcaccatcggatggaacatcttcgattttgtagttgtaatcctcagcattgttggaatgttcctggccgagatgatcgaaaagtactttgtgagcccaactctgtttcgagtgatcaggttggctcggatcggcagaatcctgcgcttaataaagggtgctaagggaattcgcaccctgttgtttgccctaatgatgagtcttcctgctcttttcaacataggactccttctctttcttgtgatgttcatttatgctatctttggaatgagtaatttcgcctacgtgaaaaaggaggccggaatcgatgacatgttcaacttcgaaaccttcggtaacagcatgatctgtctcttccaaatcaccacctcggccggttgggacggactgctcgccccaatcctgaattcagcccctcccgactgcgatccagacaccattcaccctggatccagtgtgaagggcgattgcgggaacccaagtgtcggaattttctttttcgttagttatattatcatctcctttctggtggtcgtcaacatgtacattgccgtcatactcgagaacttctctgttgcgactgaagagtccgctgaaccgctgagcgaagacgattttgagatgttctatgaagtttgggaaaaattcgaccccgacgccactcagtttatcgaattcagcaaactgagcgacttcgctgctgcactcgatccgcctttgctgatagcgaaacctaacaaagtgcaactgatcgccatggatctccctatggtcagcggcgataggatccactgcctggacattctgttcgcctttacaaagcgagtcctgggggaatctggcgagatggacgccctgcgcattcagatggaagataggttcatggcatcaaatccctccaaggtcagctacgaaccaattacaacaacacttaaacgaaaacaggaggaagtctccgccgcaataatccaaaggaatttcagatgttacctgcttaagcagaggttgaaaaacatatccagtaactataataaggaagccatcaaagggcgaattgacctgccgattaagcaggatatgataattgataagcttaatgggaactccactccggagaagacagatggttcctcttccaccacctcaccgcctagctatgatagtgttaccaagccagataaagagaaatttgaaaaagacaaacccgagaaggaatcgaagggtaaagaagtccgcgaaaaccagaaata

SEQ ID NO: 240888 - DNA, 4095 bp, Artificial Sequence
  Description of Artificial Sequence: Synthetic coding sequence
atggcccaggccctgctcgtgccacccggtcccgaaagctttcgactgttcacccgcgagtcgctggcggcaattgagaagagagctgcggaagagaaggcgaagaaacccaagaaggagcaagacaacgatgatgagaataaacctaagccgaattctgatcttgaagctggaaaaaatctgccattcatatatggcgacattccaccggagatggtctcagaacccctggaggacctcgacccttactatattaataagaagacgtttattgtgatgaacaaaggaaaagccatcttccggttttcggcaactagtgccctgtacatcttgacccctttaaacccagtgagaaagattgcaattaagatcctcgtgcattccttgttcagcatgctcattatgtgtacaatcctaaccaattgcgtcttcatgaccctttctaatcccccagactggacgaaaaacgtcgagtacacttttactggcatctatacctttgagtcattaattaagattctggcccgaggcttctgtctggaggatttcactttcttgcgagacccctggaattggttagatttctccgtgatcgtgatggcttatgtcaccgagttcgtcgatttggggaatgtttcagctctgaggacattccgcgtactgagagcccttaagacaatctcagtcatccccggtctgaaaactatcgtgggagctttaattcagtctgttaagaaactgagcgacgtgatgatactcactgtcttctgcctgagcgtatttgcccttatcggattacaattgttcatgggcaacctgagaaacaagtgtctccagtggccgcctagcgattcagcgtttgaaaccaatacaacctcctatttcaacggaaccatggacagtaacggcacttttgttaatgtgacaatgtctacttttaattggaaagactatatcggcgatgacagtcacttctatgtgcttgatggccagaaggaccccttactgtgcggaaatggctctgacgccggtcagtgtccagaaggctacatttgtgtgaaggccggtcgaaatcccaactatggatacacaagcttcgacactttctcctgggccttcttgtctttattccgacttatgacccaggattactgggaaaatctgtaccagcttactctcagagctgctggtaagacttacatgatattctttgttttggtcatatttctgggctcattttacttggtcaacttgattctagcagtcgtcgcgatggcttacgaggaacagaatcaggccaccctggaggaggctgaacaaaaagaggctgagttccagcaaatgttggagcagttaaagaagcagcaggaagaggcccaagcagtcgctgcggctagcgccgcaagcagggatttctcgggcatcgggggattgggcgaactgctggagagcagctccgaggcctccaagctgtcatctaagagcgcgaaagagtggcgcaatcggaggaagaaacggagacagagagagcaccttgagggtaacaacaagggggaacgcgactcatttcccaagtctgagagtgaggactcagtgaagcggagctcctttctcttctcaatggacgggaaccgcttgacctcagataaaaaattttgttctccacaccaatcacttcttagcatccgaggttcattgttcagcccaagacggaacagtaaaacaagtatctttagctttcgaggacgggcaaaagacgtggggagcgaaaacgactttgctgacgatgagcactccacgttcgaggactcagagagcagaagggattccctattcgtcccccaccgccacggcgagaggcgtaacagtaacggcacaactactgagactgaggttcgcaagcgccgattgtcttcctaccagatctctatggagatgctcgaagatagctcggggcgtcaaagagccgtttcaattgcctccatcctgaccaacaccatggaagagttggaggagagtcgccagaaatgccctccgtgttggtacagatttgccaatgtgttccttatctgggactgctgtgatgcttggctgaaggtgaaacatttagtcaatctcatagtgatggacccattcgtcgatctcgctatcaccatctgcattgtgctgaacacactcttcatggccatggaacattaccctatgacagaacagttcagtagcgtgctcacagtcggcaacctggttttcactggaatctttactgctgagatggtgcttaagataatagccatggacccctactactactttcaagagggatggaatatctttgacggtataattgtctccctttcactcatggagctgggactcagcaacgtggaagggctaagcgtgttgcggagctttcgtctgttacgcgtcttcaaattggctaagagctggcccaccttgaatatgttgattaaaattatcggtaactccgtcggggcactcgggaacctcacattggtgttggccattattgtctttatattcgcagtcgtggggatgcagctgttcgggaaaagctataaggaatgtgtttgtaagatcaacgatgattgcaccctgccccgttggcatatgaatgacttttttcactcgtttctgatcgtatttcgcgtgctgtgcggggaatggattgaaacaatgtgggactgcatggaggtggctggccagaccatgtgcctcatagtatttatgttggtgatggttattgggaacctggtagtattaaacctgttcctggcccttctgctgtcatcctttagctccgacaatctcgccgcaacagatgacgacaatgagatgaacaacctacagatcgccgtggggcgtatgcaaaaagggatcgattatgtaaaaaataagatgcgggaatgtttccagaaggcgtttttcaggaaacccaaagtgatcgagattcacgaagggaataagatagattcttgtatgtccaacaacacaggcatcgaaatttctaaggagctgaattatctaagggatgggaacgggacgacgagcggtgtagggactggaagtagtgtcgaaaaatatgtgattgatgagaatgactacatgagctttatcaacaatcctagcctaaccgtaacagtcccaattgccgtgggagagagcgattttgagaatctgaataccgaagagttttcaagcgagagcgagctggaggagtctaaagaaaagctgaacgctacatcctcttccgagggcagtacggtggatgtagtgctgccgcgtgagggcgaacaggcagagactgaacctgaagaagaccttaaacccgaggcgtgcttcaccgagggttgtataaaaaagttcccattttgtcaggtgtctactgaggaaggcaaagggaagatttggtggaacctcaggaaaacctgctactctatagtggagcataactggtttgagacgtttatagtctttatgattctgctgagttctggggctctggcttttgaagacatctatatcgaacagaggaaaactatcaagactatgctggaatacgctgataaggtttttacttatatattcatactggagatgctgcttaaatgggtggcatacggcttccagacctatttcaccaatgcgtggtgctggctggacttcctgatcgtggacgtgtcattggtgtcattggtggccaatgccctcggttactctgaattgggtgctatcaaaagtctccgaacactcagggctttaaggccactgcgtgcactctctaggtttgaggggatgagggtagttgtgaatgccctggtgggagcgatcccctcaatcatgaatgtgttgttggtgtgcctgatcttttggctgattttctccattatgggcgtgaacctgttcgcgggaaaattctaccactgtgtgaatatgacgacaggcaacatgtttgacatctcggacgtcaacaatctgtccgattgccaagccctcggcaagcaggcaagatggaaaaatgtaaaggttaatttcgacaatgtgggtgctggttatcttgcacttctgcaggtctag

SEQ ID NO: 240889 - DNA, 603 bp, Artificial Sequence
  Description of Artificial Sequence: Synthetic coding sequence
atggcccaagcccttctggtcccccctggacccgaatcattccggctattcactcgagaatctttggcagctatagagaagagggccgctgaagagaaggccaagaagcctaagaaggaacaggacaacgatgacgagaataagcccaagcccaatagtgatctggaagcagggaaaaatttgccatttatctacggagacattccgcctgagatggtgagcgagcccctggaagacctggacccctattacattaacaaaaagacatttattgtcatgaacaaaggtaaagctatatttcggttttccgccacttctgccttgtacatccttacccctctgaaccccgtacgcaagatcgccattaaaattctggtgcattctctgttctcaatgttgattatgtgcaccattttgaccaattgcgtttttatgacactgtccaaccctccggattggaccaaaaatgtggaatacaccttcaccgggatatataccttcgagagcttaattaagatactagcacgcggattctgtctggaagatttcacctttctgcgagacccttggaactggctcgatttctcggtcattgtgatgtag

SEQ ID NO: 240890 - DNA, 1452 bp, Artificial Sequence
  Description of Artificial Sequence: Synthetic coding sequence
atggtcttcgacttcgtcacccggcaggtatttgatattagcataatgatcctgatctgtctgaatatggttaccatgatggtggagaccgatgatcaagggaagtacatgaccctggtgttgtctcgcatcaaccttgtgtttattgtgctgtttacaggtgagtttgtgcttaagcttgtctctctccgccactactactttacaattggctggaacattttcgatttcgttgtagttatcctctctattgtcggaatgttcctggccgaaatgatagagaaatatttcgtgtctcccacactgtttcgcgtcatccgactagcgagaattggacggatactgcggctcattaagggcgcaaagggaattaggactctcttgttcgccctcatgatgtccctgccggcactgtttaatatcggcttgctgctgttcctggtgatgtttatctacgcaatctttggcatgtctaatttcgcatacgtgaagaaggaggcaggaatcgatgatatgttcaatttcgagacattcggaaatagcatgatttgcctgttccagatcaccactagtgccggatgggatggactgttggcacctatcttaaatagcgcccctccagactgtgatccagataccatccacccaggatctagcgttaagggcgattgcgggaatccgtctgtaggcattttcttcttcgtcagctacatcatcatatcatttcttgtcgtggtgaatatgtatatagctgtcattctggagaacttctccgtcgcgacagaggaatcagcggagccactctcagaggatgatttcgagatgttttacgaagtatgggaaaagtttgatccagacgccacccaattcattgagttctccaagctgagtgactttgccgcagctttggatcccccattgctgattgcaaagccaaacaaggtgcagctgatagcgatggaccttccgatggtgtctggggaccgaatacactgcttagatattctctttgcttttactaaacgggtccttggcgagtccggtgaaatggacgctctcagaattcagatggaagataggtttatggcctcaaacccgagcaaggtaagctacgaacccataacaacaactcttaaaaggaaacaggaagaggtctctgctgcaatcattcagaggaattttaggtgctatctactaaaacaaagactcaaaaacatctccagcaactataataaagaggcgatcaaagggcgtatagatcttccgataaagcaggatatgatcatcgacaagttaaatgggaattcaacacccgagaaaacggacgggtcctccagcactacctccccgccaagctatgactctgtaacaaagccagataaagaaaaattcgagaaggataaacctgagaaggaatcaaagggcaaggaagtacgcgaaaatcagaagtag

SEQ ID NO: 240891 - DNA, 648 bp, Artificial Sequence
  Description of Artificial Sequence: Synthetic coding sequence
atgcctgctttcaatagactttttccactagctagtcttgttctaatttattgggtgagtgtatgcttccctgtgtgcgttgaggtgccgagcgaaaccgaggccgtgcagggcaacccaatgaagctcagatgcattagttgcatgaaacgtgaggaggtggaggctaccactgtcgtggaatggttctacagaccggagggtggaaaagacttcttgatttatgagtaccggaacgggcaccaagaggttgagtcccccttccagggcaggctgcagtggaacggaagcaaggacctgcaggacgtctctatcacagtgctaaatgtgactctgaacgatagtggtctgtatacatgtaatgtttctcgcgagtttgagttcgaggcacaccggccttttgttaagactacgcgcctcatacccctgcgagtcacagaggaggcaggcgaggacttcacatctgttgtctctgaaattatgatgtatatcttgttggtgtttctgactctgtggctcttaattgaaatgatttattgctacagaaaagtatctaaggcggaagaggccgcacaggaaaacgcgagcgactacctggccattccctcagagaacaaggaaaactcagccgttcccgtggaagagtag

SEQ ID NO: 240892 - DNA, 648 bp, Artificial Sequence
  Description of Artificial Sequence: Synthetic coding sequence
atgcccgcttttaacagactcttcccattggctagtctggtgttgatttattgggtctccgtctgctttccggtatgcgtggaagtgccttctgagaccgaggccgtacaagggaaccctatgaagcttcggtgcatatcatgtatgaagagggaggaggtcgaggccaccaccgtggtggaatggttctatcgtcctgaaggaggtaaggattttctcatctacgagtaccgaaatggtcaccaggaagtcgaaagccctttccagggccgtcttcagtggaatggttctaaggacctgcaagacgtcagcatcacggtgctcaacgtgacattaaatgactctggtttatatacctgtaacgtgtctagggagtttgagttcgaggcccaccggccattcgtgaaaacaacgaggttaatacctttgagggtgactgaagaggctggtgaagacttcaccagtgtggtttccgaaatcatgatgtatattttactggtctttctgacgctatggctcttaatcgagatgatttattgttaccgtaaggtgtctaaggcagaggaggctgcccaggagaatgctagcgattaccttgcaataccctctgagaataaagaaaactcagccgtacccgtcgaagagtag

SEQ ID NO: 240893 - DNA, 426 bp, Artificial Sequence
  Description of Artificial Sequence: Synthetic coding sequence
atgcctgcttttaataggcttttcccactggcctcattggtcttgatctactgggtgtctgtgtgtttcccagtatgcgttgaagtaccttcggaaaccgaggcagtgcaaggcaaccccatgaagttacgctgtatctcttgcatgaaaagagaagaggtggaggctactacagtggtagagtggttttaccgaccggaagggggaaaggacttcctgatttatgagtaccggaacggacaccaggaggttgagtctccatttcaggggaggttacagtggaatggatccaaagatctgcaggacgtctccatcaccgttttaaacgtcacattgaacgactccggattatacacctgcaacgtgtctcgggagtttgaattcgaggcacaccggccatttgtcaaaacaacacgtctgatctag

SEQ ID NO: 240894 - DNA, 648 bp, Artificial Sequence
  Description of Artificial Sequence: Synthetic coding sequence
atgccagcctttaaccgactatttccacttgcatcactggtgctgatatattgggtgagcgtttgctttccagtctgcgtagaagtccctagcgagaccgaagccgttcaggggaaccctatgaaactcaggtgtatctcttgcatgaagagagaagaagtggaggctacgaccgttgtcgaatggttctacaggcctgaaggcggtaaggactttctgatatatgagtaccggaacggccatcaggaagttgaaagcccattccagggtagactgcaatggaacggaagcaaagatctccaggacgttagtattaccgtgctgaacgttacgttgaatgatagcggcttatatacctgcaacgtgagccgagaattcgagtttgaggctcaccgtccatttgttaaaaccacgagactaataccactgcgcgtgactgaagaagctggtgaagatttcacctccgtcgtgtctgaaataatgatgtatatactcctggtctttctgacactgtggctgctgatcgaaatgatttattgctataggaaggtcagcaaggcagaggaggctgcacaggagaacgcatcagactaccttgccataccatccgagaataaggaaaactcggccgtcccagttgaagagtag

SEQ ID NO: 240895 - DNA, 5510 bp, Artificial Sequence
  Description of Artificial Sequence: Synthetic coding sequence
atggcccgtcctagtctctgcaccctcgtgcccttaggtcccgagtgcctccggccatttactcgggaatctcttgcagcaatcgagcagagggcagtggaagaggaggcacggctccagcgcaacaagcaaatggagattgaggagccggagagaaaacccagaagcgacctcgaggctggtaaaaatctgcccatgatctacggggatccacctcctgaggttatcggcattccccttgaggacctagatccatactacagcaataagaagacatttatcgtcttgaacaagggcaaagccatcttcaggttcagtgctactcctgccctgtatcttttaagcccctttagcgtcgtgcgtaggggggcaataaaggttcttatccacgctctttttagcatgttcatcatgattacaatactcacaaattgcgtgttcatgaccatgtctgatccccctccatggagcaagaatgtagaatacaccttcactggaatttacacatttgaatcgctgataaaaatactagccagaggattctgtgtggatgatttcacctttcttcgggacccttggaattggctcgactttagtgtgataatgatggcttatctgacagagttcgttgacttgggtaacattagcgccctaagaaccttccgggtgctgcgcgctctaaagactattactgtcatccccggattgaaaaccatcgtcggagccctgattcagtctgtgaagaaactgagcgacgtcatgattttaacagttttttgcctttcagtcttcgccctcgttgggcttcagttgtttatggggaatctgagacagaagtgtgtccggtggcctcccccattcaacgatactaacacgacttggtactcgaatgacacatggtatgggaatgatacttggtacggaaatgaaatgtggtatggaaatgactcgtggtatgctaatgacacctggaatagccatgcatcttgggccacaaacgatacttttgactgggacgcctacattagtgatgaagggaacttttatttccttgaagggtctaatgatgctctactgtgtgggaattcttctgatgctgggcactgtcctgaagggtatgagtgcatcaagacaggcaggaatccaaattacgggtacacatcctacgacacattttcatgggccttcttggcactgttccgtctcatgacccaagactactgggaaaatctgttccagctgacccttcgggcagccggtaagacctatatgattttcttcgtggtcatcatcttcctgggatccttctacctcattaacctgattctggccgttgtggccatggcgtacgctgaacaaaatgaggcaactctggccgaagataaggagaaggaagaggagttccagcagatgcttgaaaagttcaagaagcaccaggaagagctggagaaggccaaggccgctcaggctcttgagggaggggaagcagacggcgatcctgcccatggcaaggactgtaatggatctctcgatacctcccagggagaaaaaggagcgcctaggcagagtagtagcggggactcaggaatttcagacgccatggaggagctagaggaagcccatcagaagtgccctccttggtggtacaaatgcgctcacaaagtcctaatctggaattgctgcgctccgtggcttaagttcaagaatatcatacatctgatagtgatggacccctttgtggacttaggcattactatctgtattgttcttaatacactcttcatggcaatggaacattatccaatgaccgaacattttgacaatgtgcttacagtcggcaatctcgttttcaccggaatcttcaccgccgagatggtgctcaagctgatcgcaatggatccctatgagtacttccagcagggttggaacatcttcgattctattattgtcacgcttagtctggttgaactgggactcgccaacgtgcaggggctgagtgtgctaaggtcctttaggctcctgcgcgtgtttaaactggctaagagctggcccaccctgaatatgctcataaagataataggcaactccgttggcgctctggggaatctcacgctggtgcttgctatcatagtgtttatatttgccgtggtgggaatgcagcttttcggcaaatcatacaaggaatgcgtgtgcaaaattgcattagattgtaatcttccacgttggcacatgcacgattttttccattcgttcctgatcgtgtttaggattctgtgcggagaatggatagagaccatgtgggactgcatggaggtagcgggacaggcaatgtgcctgacggtgtttctgatggttatggtaatcggaaatctggtcgtactgaacctgtttctagcacttttactgtcatccttttctgccgactccctcgcagccagcgacgaggacggtgagatgaataacttacagattgcgattggtcgaattaaattgggcatcgggttcgctaaagccttcctattgggtctgctgcatggcaaaatactgtctcccaaagacataatgctcagtttgggggaggccgacggtgcaggtgaagccggtgaagccggagagacagctcctgaagacgagaagaaggaacctccagaggaggatctgaagaaggacaatcacattcttaaccacatggggctagccgatggacctccttcaagcctagaactggatcatctgaactttattaacaacccttatcttactatccaggtgcccatcgcctctgaagagagcgacctagagatgcccactgaggaagaaacagataccttttcagagcccgaagatagtaagaagcctccacagccgttatatgacggtaattcatcagtatgcagcactgccgattacaaacctcccgaagaagaccccgaggagcaagccgaggagaaccctgagggcgagcagccagaagaatgctttactgaggcatgtgtgcaacggtggccttgcctttacgttgatattagccagggcagaggtaagaaatggtggaccttaagacgggcttgctttaagatcgtggagcataattggttcgagacctttatcgtctttatgattcttctgtcatcaggagcgctggcctttgaggacatctatatcgagcagcgaagagttattagaacaatcctggaatatgccgacaaggtcttcacttatatcttcattatggagatgctgttgaaatgggtcgcatatgggttcaaggtatacttcactaacgcctggtgctggctggactttctgatagtggatgtttctatcatttcactggtggccaactggttggggtattcagaactgggtcctataaagtctttaagaacgctgagggcgctgcggccactgcgcgctctcagccggttcgaggggatgcgggtggttgtgaatgccctcctgggcgcaattccctccataatgaatgtgcttctggtctgcttaatcttttggctgatcttttccattatgggcgttaatctgttcgctggtaagttctactattgtataaacacaacaacctccgaaagattcgacatctccgaagtgaataacaagagcgaatgcgaatcactgatgcataccggccaagttcgttggctaaatgtcaaagttaactacgataatgtgggactgggatatctatccttactacaggtggctacctttaaagggtggatggatattatgtatgccgctgtcgactctagagagaaagaggagcagcctcagtacgaggtgaacctgtacatgtatttatatttcgtgatttttattatctttggctccttcttcacgcttaatttattcattggtgtgattatcgacaatttcaatcagcagaaaaagaagctgggcggaaaagacatatttatgaccgaagaacagaaaaaatattacaatgctatgaagaaactcggcagcaagaaaccccagaagcccatcccaagacctcagaataaaattcaggggatggtatatgaccttgtgacaaaacaggctttcgacatcaccataatgatcctgatctgtctgaacatggtaactatgatggtagaaaccgataaccagtcccagctaaaagttgacatactgtataatatcaatatgatctttattattatctttactggagagtgcgtgctgaagatgcttgccttgaggcagtactacttcacagtaggctggaacatttttgatttcgtcgtagtgatactgtctatcgtgggtctggcgcttagcgatctcattcagaagtactttgtgagccccaccctgttccgcgtgattcgcctagcgagaattggaagagttctaagactaatacggggagctaaagggatccgaacattgctgttcgccctcatgatgagtctgccagctctctttaacattggacttctgctgtttctggtcatgtttatatattctattttcggaatgtccaacttcgcctatgtgaaaaaggagagtgggatcgatgatatgttcaattttgagacattcggtaactcaattatttgcctgtttgaaatcacaacctccgccggttgggatggactgctgaatcctatactgaactctgggccacccgactgcgatccaaacctcgaaaatcccggaactagtgtgaaaggggactgtggaaacccttccataggcatttgttttttctgtagttacataattattagctttctcatagtcgttaacatgtatatcgcaatcatcctggaaaatttcaatgtggcaacggaagagtcttccgaaccactgggtgaagacgactttgagatgttttacgaaacatgggaaaagttcgatcctgacgctacgcagttcattgcatattcccggctgagtgactttgtagacactttgcaggagccacttagaattgcaaaacccaacaagatcaaactcatcactcttgatcttccaatggttccaggcgacaaaatccactgtttggacatacttttcgcccttacaaaagaggtcctgggagactccggggagatggacgccctaaaacagaccatggaggaaaagtttatggccgctaacccatcgaaggtgtcatatgagcccataacgactacgctgaaaaggaagcacgaggaggtttgtgccatcaagatacagcgtgcatatcgaaggcacctcctgcagcgctctatgaaacaggcctcctatatgtaccggcatagtcacgatgggagtggggacgatgccccagaaaaagaaggcctgttggccaacactatgagcaaaatgtacgggcacgaaaacgggaacagttcaagtccatcccctgaggaaaagggtgaggccggagacgcgggtcctaccatgggattaatgccgatatctccaagtgatacagcctggccacctgctccccctcctggccagaccgtgagacctggcgtgaaagagtccctggtgta

SEQ ID NO: 240896 - DNA, 687 bp, Artificial Sequence
  Description of Artificial Sequence: Synthetic coding sequence
atgcccggagctggagatggagggaaggctcctgcacgatggctaggtacgggcctactgggactgtttctgctgcccgtaacactgagtttggaagtttctgtgggcaaagctacagacatttacgccgtgaacggtactgaaattctgctcccgtgcacctttagctcatgcttcgggtttgaggacctgcacttccgctggacgtacaactcaagtgatgccttcaagattctcatagagggcacagtcaagaacgaaaaatctgaccccaaggttactttgaaagacgatgaccgcataactctggtgggcagcacgaaggaaaagatgaataatatttctattgtgttacgtgacctcgagtttagtgatacagggaaatacacatgccatgtgaagaacccaaaagaaaacaacttgcagcatcatgcgacaatttttctacaggtggtcgataggctggaggaggtcgacaacaccgttacacttatcatcttagctgtggttggcggagtaattgggctgcttattctcatcctgctgatcaagaagcttataattttcattttaaagaagactcgagaaaaaaagaaggaatgcttggtcagtagcagcgggaatgacaacacggagaatggactacctggatcaaaggcagaggagaaacccccttccaaggtgtag

SEQ ID NO: 240897 - DNA, 285 bp, Artificial Sequence
  Description of Artificial Sequence: Synthetic coding sequence
atgccaggcgctggggacggcggaaaggcacccgcaagatggctcgggaccggtttgctggtggaagaagtggacaacaccgtgacattaattatattggcagttgtaggtggtgtgattggcctccttatactgattctcctgatcaagaagctgatcatttttatcctcaaaaaaacaagagaaaagaaaaaagagtgtctagtctcttcatccggaaatgataatacagaaaatggtctgcctggaagtaaggcagaagagaaacctcccagcaaagtgtag

SEQ ID NO: 240898 - DNA, 5970 bp, Artificial Sequence
  Description of Artificial Sequence: Synthetic coding sequence
atggccatgctacctcctccagggccacagtcttttgtgcattttacaaaacagagcctggctttgatcgaacaacgtattgcagagaggaagtcaaaggaaccaaaggaagaaaagaaggacgatgacgaggaggctcccaaaccctcctccgaccttgaggccggaaagcagctcccatttatatatggcgacattcccccaggcatggtgtcagagcccctggaagatttggatccatactacgcggataagaaaacatttattgtgctgaataaaggtaagacaatcttccgcttcaacgcaactccagcactgtatatgttgtcaccttttagccccctgcggaggatcagcattaaaatcctggtgcacagcaccctgttctccatgctcatcatgtgtaccatcctcaccaattgcatattcatgacgatgaacaatccccctgattggacaaaaaatgtggagtacacattcactggcatctatacgttcgagagtctcgtgaagattttggctaggggcttttgtgtgggggagttcacgttcctcagagatccctggaactggttggactttgttgtcatcgtcttcgcctaccttacagagttcgtcaacctgggcaacgtatcagctttaagaacttttagggttctccgtgctttgaagactatctctgtcattcccggacttaagactattgttggggcacttatacaatctgtcaagaagctgtcagacgtgatgatcctcactgtcttctgcttgtcagttttcgcacttattggactccagctgtttatgggcaatttaaagcacaagtgttttagaaactctctggagaataacgagacgctggagagtatcatgaatactctggagagcgaggaggatttccggaagtatttttattatctcgaggggtcaaaggatgcccttctgtgcggatttagcacagattccggccagtgcccagaggggtacacttgcgtaaaaataggcagaaaccctgactatggctatacgtcatttgacaccttctcctgggccttcctggctctgttccgattgatgactcaggattactgggaaaatctgtatcagcagacactgcgggcagctggaaagacatacatgatcttctttgtggttgtgatcttccttggttcgttttacttgatcaatctcatacttgccgtggtggccatggcatatgaagaacagaatcaagcaaatattgaggaggctaagcagaaggagctggagtttcagcaaatgctggatagactgaagaaggaacaggaggaggccgaagcgatcgcagcagcagccgctgaatatacaagcatcaggaggtcccggatcatgggacttagtgagagcagcagcgagactagcaagctcagctcaaaaagcgcaaaagagagaaggaatagaagaaaaaagaaaaatcagaaaaaactatcttccggtgaagaaaagggggatgccgaaaagctaagcaaaagcgaatccgaagactctatcaggaggaaaagctttcatcttggggtggagggtcacagacgcgcacacgagaagcggttatcaacacctaatcagtctcccctgtccattcgtggctcattatttagcgccagacggagtagtcgcacaagcctattctcttttaagggtcggggacgggacattgggagtgaaaccgagttcgccgacgacgaacactccatctttggggacaacgaatccaggcgcggatccctgtttgtgccacatcgtccccaagagaggcgttctagtaatatctcccaggcgtcccgatcccccccaatgctcccagttaacgggaagatgcactcagctgtggactgcaatggagtggtgtctcttgtcgatggtcggtccgctcttatgttgccaaacggccagctgctgccagaagtgatcatcgataaggctacttctgacgattctggcacaacaaatcagatccacaagaaacggcgatgttccagttacctgctgagcgaggatatgttgaacgacccaaaccttaggcaacgcgctatgagccgagcctccatactgactaacaccgtggaggaactggaggaaagcagacaaaagtgccctccctggtggtatcgattcgcccataagttcctcatctggaattgctctccgtactggattaaattcaagaaatgcatctacttcatcgttatggacccttttgttgatctggcaataactatttgtatcgtattgaacacactctttatggctatggaacaccatcccatgactgaggaattcaagaatgttctcgcaatcgggaacttggtctttacgggcatcttcgccgctgaaatggtgctgaaactgatcgcaatggacccatatgaatatttccaggtcggttggaacatcttcgactcactgatagtgacactgagtctggttgagttattcctcgcggacgtggaggggctgtccgtcctgcggagcttcaggctgctgagggtcttcaagctggctaagagctggcctaccttgaacatgcttataaaaatcattggaaattctgttggcgcactaggcaacctgacactggtcctggcaatcatcgtcttcatctttgccgtggtcgggatgcagctgttcggcaaatcatataaagagtgtgtgtgtaaaatcaacgatgattgcacactcccgagatggcacatgaacgacttttttcacagcttcttgatcgtattccgagtcctatgcggagagtggattgagaccatgtgggattgtatggaggtggccggtcaggctatgtgtcttatcgtttatatgatggtaatggtgatcggcaatctggtggtgctcaatctctttcttgcattacttctgtcgtcattctctagcgacaacttgaccgcaatcgaagaagacccggatgccaacaatctgcagatagccgtaacgcgaatcaaaaaaggaataaattacgttaaacaaaccctacgagaatttatcctaaaagccttctccaaaaagccaaaaatctcccgcgaaatacgtcaagccgaggacctgaacaccaagaaggagaattatatctctaatcacacccttgctgaaatgtcaaaaggtcacaacttcttgaaagagaaagacaagataagcggattcggatccagtgtcgacaagcacctcatggaagactcagacggccagtcttttattcacaatccaagcttgacggttactgtgcccatcgcccctggtgaaagcgaccttgagaacatgaacgccgaggagctctcctcggacagtgattcggagtacagcaaggtgagactcaacagatcctcctcttccgagtgctccaccgtcgacaatcccctgcctggggaaggagaggaggctgaggccgagccgatgaattccgacgagccggaggcctgcttcacggacggatgcgtttggagattttcgtgttgtcaagtcaacattgaatcaggcaagggcaagatttggtggaatatccgcaagacttgttacaagattgtcgaacacagctggttcgaatcattcatcgtactgatgatacttctgagctctggggctctggctttcgaagacatctacattgaaagaaaaaaaacaattaagattattctggagtacgctgataagattttcacttacatcttcatcctggagatgctcctcaagtggattgcttacggttacaagacctatttcacaaatgcctggtgctggctcgactttctgatcgttgatgtcagcctggttaccctcgttgcaaatacccttggctatagtgatctggggcctataaagtccttgcggaccttacgggctctgagacctctgagggccctatctcgcttcgagggcatgagagtggtcgttaatgccctgatcggagctattccctcaataatgaacgtattactcgtctgcttgatcttctggttgatcttctccataatgggcgtaaatctgttcgcaggcaaattttacgaatgcatcaataccaccgatggaagtcgcttccccgcttcccaggtgcccaaccgatctgagtgtttcgctctgatgaatgtaagtcagaacgtgcgttggaagaacctcaaagtcaatttcgataatgttggcttaggttacctctctcttcttcaggtggctacttttaagggatggaccattatcatgtacgcagcagtggactctgtgaacgtagacaagcaacccaagtacgagtatagtctttacatgtacatttattttgtcgtgttcatcatcttcggcagcttctttactcttaacctgtttattggcgtgatcattgataacttcaaccagcaaaagaaaaagctcgggggacaggatatctttatgaccgaggagcaaaaaaaatattacaatgcaatgaagaagcttggatcgaaaaagccacagaagccaatccctaggcctggaaacaagatccaggggtgtatatttgatctggtgaccaatcaagccttcgatatctcaataatggtcttgatctgcctgaatatggtgaccatgatggtggagaaagagggccagtctcagcacatgacagaggtgctgtattggataaatgttgtgttcatcattttgtttaccggggagtgcgtattgaaattaataagcctgcgccattattatttcaccgtgggatggaacattttcgactttgtggttgtgatcattagcatagtgggaatgttcctggccgatctcatcgaaacatacttcgtgtcaccgaccttatttagagtaatccgccttgccaggataggcagaattttgcgactagtcaagggcgcaaaaggaatccgcaccctgctcttcgccttgatgatgtcccttccagccctctttaacatcggtctgctgctgtttttggtgatgtttatttatgctatctttggcatgtctaatttcgcctacgtgaaaaaggaagacggcattaacgatatgttcaacttcgagacttttggaaacagtatgatctgtctgtttcagattacgacctcggcgggttgggatggactcctcgcgccaatattgaactccaaacccccagattgtgatcccaagaaagtacaccctggctcttctgtggagggggactgcggcaatccgagcgtgggaatcttttattttgtttcctacatcataatttcttttttagtggtcgttaatatgtatattgcggtgatcctggagaacttttcagtagctacagaggaatccaccgaacctcttagtgaagacgacttcgaaatgttttatgaggtctgggaaaaattcgatcccgacgcaacccagtttattgagttttctaagttatccgactttgcagctgcactggacccaccgctgctgatcgctaagccaaataaggtgcaactgattgcaatggaccttccgatggtctcaggagacaggatccactgtctcgatatcttatttgcttttaccaagcgtgtgttgggcgagagcggggagatggacagcctgcgaagtcagatggaggagcgctttatgagcgccaacccatctaaggttagttacgagcccataacaacgaccctcaaacgtaaacaagaggacgtgtctgctactgtcatacagcgcgcttataggcgctacaggctgagacagaacgtgaaaaatatctccagtatatatatcaaggacggggatcgcgacgacgatctactgaataaaaaggacatggcttttgataacgtgaatgagaattcctcacccgaaaaaactgacgctacatcctctactacttctcctccctcttacgattcagtgaccaaaccggataaagagaaatatgaacaggaccgcaccgagaaggaggacaagggcaaggatagcaaggagagcaaaaagtag

SEQ ID NO: 240899 - DNA, 5969 bp, Artificial Sequence
  Description of Artificial Sequence: Synthetic coding sequence
atggccatgctgcctccccctgggccacagagctttgtgcacttcaccaaacagagcctggcactgatcgagcaacgtattgctgaaagaaaaagcaaggagccgaaggaggagaaaaaagacgacgacgaggaagcgcctaagcccagctcagacctggaagccggaaaacagttgccatttatttacggcgacattcctcccggtatggtgtccgagcccttggaagatttggacccttactacgctgataagaaaacctttatcgtgctaaacaaagggaagactatcttccgctttaatgctacacccgcattatatatgctgtctccattctcccctctgcgtcgcatctctatcaaaatcctggtgcattccacactgttctctatgttaataatgtgtaccatattaaccaattgcatcttcatgacaatgaataacccacctgattggaccaagaacgtggaatacacctttacagggatctatacttttgagagcctggttaagatcttggcaaggggcttctgtgtgggcgagttcacctttcttcgggatccatggaactggcttgacttcgtcgttatcgtctttgcctacgtgacagaatttgtagatctaggcaacgtttctgctctcagaaccttcagagtgctcagagctctaaaaaccattagcgtgatccctggcctcaagactattgtcggcgctttgattcagtcagtcaagaaacttagcgacgtgatgatcttaaccgttttttgtctgtctgtgtttgctttaatcggactgcaattgtttatgggaaatctgaagcacaaatgtttcagaaactctctggagaacaatgagactttagagtccataatgaatacattggagtccgaggaagacttcaggaaatatttctattaccttgagggctccaaggatgctcttctgtgtgggttctctacagattcaggccagtgtcccgaaggatatacctgcgttaagatagggaggaaccctgattacggctacacatctttcgatacattctcctgggcatttctagctttattcagattgatgacccaagactactgggaaaatctctatcaacagaccctgcgggcagcaggaaagacctatatgatcttcttcgtcgttgtcatttttctcgggtccttttacctcatcaacctaattttggctgtcgtcgctatggcctatgaagaacaaaaccaagcgaacatcgaagaggctaaacagaaagaactggagttccagcagatgctcgacaggctgaagaaggaacaggaggaagctgaagccattgctgcagccgcagctgagtatactagcatacgcagatctcgtattatgggcttgtccgaatcatcctcagaaacctcgaagctctcttcgaaaagtgctaaggagcgacgaaaccggaggaagaagaaaaatcagaaaaaactgtcctctggtgaagaaaaaggggacgctgagaagctgtctaaatccgagagcgaggacagtatacgcagaaaatctttccatctgggagtagagggccaccgtagagcccacgagaagcgcctgagcaccccgaaccagagccctctctccatcagaggaagtttgttttcagcaagaaggtctagtcggaccagcttgttttccttcaaggggcgagggagagatatcggttcagaaactgagttcgccgatgacgagcacagcatttttggcgataatgagtcaaggagaggctctctgtttgtccctcaccggccacaggagaggcggagctccaacatttcgcaggcctcccgatcaccaccaatgctaccagtcaacggcaagatgcactctgctgttgactgtaacggagttgtgtctctcgtcgatgggaggagcgctctcatgctcccaaatggtcaactgctgccggaggtcataattgataaggctacttcggacgacagtggtaccacaaaccagatccataaaaaaaggcggtgttcatcctatctgctttcagaggacatgttgaatgatccaaacttgcggcagcgggctatgtctcgcgctagtattctgacaaatactgtggaggagcttgaggagagtcgccagaaatgcccgccttggtggtaccgattcgcacacaaattcttgatctggaactgcagtccatactggataaagtttaaaaagtgtatctatttcattgtgatggaccccttcgtagacctcgcaatcactatctgcattgtgcttaatacactatttatggcaatggagcaccacccaatgacggaagagttcaaaaacgtgctcgccattggcaatttagttttcacaggtatttttgctgccgaaatggtattgaagctgatcgcgatggatccttatgagtacttccaggtgggctggaacatatttgatagtctcatcgtcacgctctcactggtggagctgttcctggccgacgttgaggggctttccgtgctgaggagtttccggctgctgcgggtctttaaattagcaaaatcctggcctacattaaatatgcttataaagattatcggaaactccgtgggggctctcggcaatctgactttggtcctcgctattattgtattcatattcgctgtggtgggaatgcagctgtttggtaaatcttacaaggaatgtgtgtgcaagattaacgacgactgcactctacctagatggcatatgaatgactttttccatagtttcttgatcgtgttccgggttctgtgtggcgagtggatcgagacaatgtgggactgcatggaagtggccggacaggctatgtgcttaattgtgtacatgatggtgatggtaattggaaatctggtggtcttaaacctgtttctggccctgctactcagctccttcagttcagacaacctcaccgctattgaggaagatccagacgcaaataatcttcagatcgctgtgacgaggattaagaaaggcattaattatgtgaagcagacactgcgagaatttattcttaaagctttcagcaaaaagccgaagatttcacgtgagattcgccaggcagaggatctcaacaccaagaaggaaaattatatatcaaaccacacattagctgaaatgagtaagggccacaacttcctcaaggaaaaggacaaaatcagcggtttcggatcctcagttgacaagcaccttatggaggactcagacgggcagtccttcatccataacccgagcctgacagtaacagttcccatcgctcctggcgagagtgacctagagaacatgaacgccgaagaattgtctagcgactccgactccgagtatagcaaagtccgattaaaccgcagcagctcatccgagtgttctacagtggataatcccctgccaggagaaggcgaggaagctgaggccgagcccatgaactctgatgagcccgaggcttgcttcaccgatgggtgtgtgtggcgctttagttgttgtcaggttaacattgaaagtggtaagggcaaaatctggtggaacattcgtaagacctgttacaagatagtggagcattcctggttcgagtcatttatcgtcctcatgatccttctttcctctggcgcacttgctttcgaagatatttacatagagcgaaagaagacaattaagattatcctggagtatgcagataagattttcacatatatttttattctggagatgctactgaaatggatagcgtacggctataagacttatttcaccaatgcctggtgttggcttgactttcttatcgtggacgtcagtctggttacccttgtggccaataccctgggttactcagacctcggcccaatcaagagccttaggaccctgagagcactcagaccgctgagggctctttcacgatttgagggcatgcgagtggttgtgaacgccctcattggcgcaattccgagtattatgaacgtgttactggtatgcctgatcttctggctgatattctccattatgggcgtgaacctttttgccggaaagttttacgagtgtattaacactacggacgggagtagattcccagcttctcaggtgcccaatagatctgaatgctttgctctgatgaatgtgtcccaaaacgtgaggtggaagaacctgaaagtaaacttcgacaatgtcggtctggggtatctgtccttgttgcaggttgcaacattcaaaggttggaccatcattatgtatgctgctgtagactccgtgaatgtcgacaaacagcctaaatatgagtattccctgtacatgtatatttacttcgtcgtattcatcattttcggatccttcttcaccctgaacttgttcatcggagtcattatcgataacttcaaccagcagaaaaagaaactgggaggacaggacatttttatgacagaagagcaaaagaagtactacaatgccatgaagaaacttggttccaaaaaacctcagaagcctattccacgcccaggaaacaagattcaggggtgcatctttgatttggtgacaaaccaggcctttgacatcagcattatggtcttgatttgcctaaacatggtaacaatgatggttgagaaggagggccagtcgcaacatatgaccgaggtcctctattggattaacgtagtgttcataattctgttcacaggtgagtgcgtcctgaaacttatttcactgcggcactactattttacagtaggctggaatatttttgatttcgtggttgtgattatcagtattgtcggcatgtttttagcggacctcattgaaacttatttcgtgtcccctaccttattccgcgtcatacgtttggctcgtattggcaggatactccgcttggttaaaggggctaaagggatcagaaccctgctgttcgccttgatgatgtctcttcccgctcttttcaatattggcttattgttgttcctcgtcatgttcatctatgcaattttcggcatgagcaattttgcatacgtcaaaaaagaagacggtatcaatgacatgtttaatttcgaaacttttgggaatagcatgatctgcctctttcagataacaaccagcgcagggtgggacggactgctcgcccctatactgaatagcaagcccccagactgtgatcctaagaaggtgcaccctggcagctctgtggagggggactgtggcaacccctccgtcggaattttttactttgtgagctacataattatcagcttcctagtcgtggtcaacatgtacatagctgtgatcctggagaatttttctgtcgctactgaagagtcaacagagccactgagcgaagatgacttcgagatgttctacgaagtatgggaaaaatttgatccagacgctactcaattcatcgaattctccaagctctctgatttcgctgccgcattggacccacctcttctcattgctaaacctaataaagtccagctaatcgccatggacctgcccatggtctccggcgatcgcatccattgtctcgacatactctttgcctttacaaagagagttctcggagagagtggtgaaatggatagcctgcggtctcagatggaggaaagatttatgtccgcaaatccaagcaaagttagctacgagcctatcactactaccctgaaaaggaagcaggaagacgtttctgctactgttattcaacgggcatacaggcgctatcggctgcggcagaacgtgaaaaatatatcctctatctatatcaaggatggtgaccgtgacgatgatttattaaataaaaaagatatggccttcgacaatgttaacgagaatagtagccctgaaaaaacagacgccacctcgtccaccacatcacctccttcttacgattcagtgacaaaacctgataaagagaagtacgagcaggataggaccgagaaggaggacaaagggaaagactccaaagaaagcaaaaagta

SEQ ID NO: 240900 - DNA, 5966 bp, Artificial Sequence
  Description of Artificial Sequence: Synthetic coding sequence
atggctatgttgccccctccagggccacagtccttcgtccactttaccaaacaatccctggctttgatcgaacagcgcatagctgaaagaaaaagtaaagaaccaaaggaagaaaagaaagacgacgacgaggaagcacccaagccatcctccgatctggaagcagggaagcagctgcctttcatttatggagacataccacctggaatggtgtcagagccactggaggacctggatccatattatgctgataagaagacatttatcgttttaaacaagggcaaaacaatcttccgttttaacgccacacccgcactttacatgttgtctcctttttcacccctgaggcggataagtattaagatcttggttcacagcctgttttcaatgttaataatgtgcaccatcctgacaaactgcatttttatgacaatgaacaaccctccggattggactaaaaacgtggagtataccttcacaggcatctatacattcgagagcttggtaaagatcctggccagaggattttgtgtgggggaatttacatttctgagagatccttggaactggctcgattttgttgtaattgttttcgcctatcttacagaattcgtcaacctgggaaatgtgtccgctcttaggacttttcgtgtcctgcgcgcactaaagactatttccgtaatcccaggtctcaaaacaatcgtgggtgctctgattcagagcgttaaaaaacttagtgacgttatgatccttacagttttctgcctttccgtgtttgccctgatcggactgcagctgttcatgggtaatctcaaacacaaatgcttcaggaatagtctcgaaaacaatgagaccctggaatccataatgaacacactggagagcgaggaggattttagaaaatatttctactatctggaaggcagtaaagatgcacttctgtgtggtttctccaccgattcaggccagtgccctgaagggtatacctgcgtcaaaataggtcgaaacccagactatggctacacatcatttgacaccttctcctgggcgtttctggctctattcaggctgatgacgcaagactattgggagaacctatatcagcagaccctgcgggctgctggaaaaacttatatgatcttcttcgtcgtcgtcatctttctcggcagtttctaccttatcaatctgatcctggccgtggtggcaatggcttacgaggaacaaaaccaggctaatattgaggaagcgaagcagaaagaactggaattccaacaaatgcttgatcggctgaagaaggaacaggaagaagctgaggctatcgcagctgcagctgctgagtacacctctatcaggaggtcacggataatgggcctgtcagaatcgtcctccgaaacatccaaactcagttccaaaagtgcaaaggagcggagaaaccggaggaagaagaagaatcagaaaaagctgagcagtggcgaagaaaaaggagatgcggagaaactctccaaatctgaatccgaagactcaattcgcagaaaaagcttccacttaggcgtagagggccataggagagcccacgaaaagaggttgtctactcctaaccagtcccccctgagcatcagaggtagcctttttagcgcaaggagatctagcagaactagccttttttcttttaaaggtagaggtcgcgacatcggaagcgagaccgaatttgccgacgacgagcactcaatattcggcgataatgagagccgcaggggctccctgtttgttccccaccgccctcaagaacggagatcgtcgaacatctcacaggctagtcggagcccccctatgctgccagtcaacggcaagatgcacagtgcggtggactgcaacggtgttgtgagcttggtcgacggtaggtcagcactgatgctgcccaacggccagctgctgcctgaagtcatcatagataaagcgacctcagatgactctgggaccacaaaccagattcataagaaaagacgctgcagctcctatttgctgtcagaagatatgctgaacgatcccaacctgcgccagcgtgctatgtctagagctagcatccttactaataccgtggaggagctggaggaaagtcgccagaaatgccctccctggtggtaccgttttgcccacaaattccttatctggaattgttcgccgtactggataaaatttaaaaaatgcatttacttcattgtcatggaccctttcgtcgatctggccatcaccatttgcattgtgctgaacaccctattcatggcaatggaacatcacccaatgaccgaggaatttaagaacgtcctggctatcggaaatctggttttcaccggaattttcgcagcggaaatggtgctgaaactgattgcaatggatccatatgagtatttccaggtagggtggaatatttttgactctctcattgtgaccctaagtctggttgagctttttctggccgacgtggaaggtctaagcgttctacgctccttcaggctgctgcgggtgttcaaattggctaagagctggccaactctgaacatgctcattaagatcattggcaacagtgtcggtgctcttggcaaccttacattagtccttgccatcatagtcttcatctttgcagtagtgggcatgcagctgttcgggaaatcatataaggaatgtgtatgtaaaattaatgatgactgcactttacccaggtggcacatgaatgacttctttcattcatttctgattgtgtttcgagttttgtgtggcgaatggattgaaaccatgtgggactgcatggaggtcgccggacaagccatgtgcctcattgtttatatgatggttatggtcatagggaaccttgttgtgttaaacttgttcttggctctactcctctcctctttctctagtgataacctgaccgccattgaagaagacccggatgctaataacttgcagattgcggtgactagaattaaaaagggtattaattatgtcaaacaaaccctccgggagtttatactgaaagcattcagcaagaaacccaaaattagccgggaaatccgccaggcagaggaccttaatactaaaaaggagaattacattagtaaccacactttggccgagatgtctaagggccataactttcttaaagaaaaggacaagattagcgggtttggcagtagcgtcgacaagcatctgatggaggacagcgatgggcaatcctttattcataacccttccctgacggtgaccgtccccatcgctccaggggaatccgacctggagaatatgaacgcagaggaactctcatcagacagtgattctgaatatagtaaggtcaggctgaaccgatcctccagtagtgagtgctctaccgtggacaacccgttgccaggtgagggagaagaggctgaggctgagcccatgaatagcgacgaacccgaggcatgttttacagatggatgtgtgtggcggttttcctgttgtcaagtcaatatagagagcgggaagggaaaaatctggtggaatattcgaaagacatgctacaaaattgtagagcacagttggttcgaaagctttatcgtcctcatgattctcctctcctccggcgcattggctttcgaggatatatacatcgagagaaaaaagaccatcaagataattcttgaatacgccgataagatcttcacctatatctttatcctggaaatgttgcttaagtggatcgcgtatgggtataagacttatttcaccaacgcctggtgctggctggacttccttatcgtggatgtgagtttggtcactctggtcgctaatacactggggtacagcgacctcggaccgatcaaaagtctgcgaacccttagggcccttagaccactgcgggctttaagcagatttgaggggatgcgtgtcgtcgtgaacgcattaatcggagccatcccatcgatcatgaatgtcttactggtgtgcctcattttctggttaatcttttctatcatgggagtgaacctgttcgctggaaagttttacgagtgtatcaacaccaccgacggctcaagatttcccgcatcccaagtgcctaaccgcagcgaatgcttcgccctgatgaacgttagtcagaacgtgcgctggaagaatctcaaagttaacttcgataatgtcggtctgggctacttaagtctcctgcaggtggcgaccttcaaggggtggaccatcatcatgtacgccgcagtcgactctgtcaacgtggacaaacagcccaagtacgagtattccttatatatgtatatctactttgttgtctttatcattttcggttctttcttcacactgaatctgtttataggcgtgattattgataattttaatcagcagaaaaaaaaacttggcggtcaggacattttcatgactgaagagcagaagaaatattataatgctatgaaaaaactcggctccaagaagccacaaaagcccattcccaggcctggaaacaaaattcagggttgtatttttgacctggtgaccaaccaggccttcgacatctccatcatggtattaatttgcttgaacatggtgacgatgatggttgagaaagagggtcagtcccagcacatgactgaggtgctatattggataaatgttgtgtttattattctatttacgggagagtgcgtgctgaagctgatttcgttgcgacactattatttcactgtgggctggaatatctttgactttgtggtggtaatcatctcaatcgttggcatgttcctggcagatctgatcgagacctattttgttagcccgacgctgttcagagttattagactggcccgaattggacgtattctccgcctagtgaagggggctaaggggataagaactctcctgtttgccctgatgatgtcactgccagccctgttcaacattggccttctcctatttttggtgatgtttatctacgcaatcttcggcatgagcaattttgcatacgtgaagaaggaggatggaattaacgacatgttcaattttgagacatttgggaacagcatgatctgtctgttccagatcaccacatctgccggttgggacgggctactggcaccaatactaaactctaagccaccagattgtgatccaaagaaagtgcaccctggctcctctgtagagggagattgcggtaatccatctgtcggaattttctatttcgtttcatatattataatatcgtttctggtcgtggtgaacatgtatatcgccgtgatcctggagaacttttccgtggctaccgaggagtcaacagagcccctgtcggaagacgattttgagatgttttacgaagtctgggaaaaattcgatcctgacgctacccagttcatagagttttccaagctaagcgactttgctgccgctctggacccacccctcctcatcgccaagccaaacaaggtccagctaatcgccatggatctgcccatggtttccggtgaccggatccactgcctggatatcctatttgcgttcaccaagagagttctgggagaaagtggcgagatggacagtctgcgcagccagatggaggagagatttatgtccgcaaacccttccaaggtgagttatgaacccatcacaaccacgctgaagcggaagcaggaagacgtcagcgccaccgtaatccaacgggcttaccggagatatcgcctaaggcagaacgtcaaaaatataagcagcatctacattaaagatggagatagggacgatgacttactcaataaaaaggacatggccttcgacaacgtaaatgagaacagcagtccagaaaagaccgatgcgacaagcagcactacatccccaccttcatacgactccgtgacaaagcccgacaaggaaaagtatgaacaagaccggaccgagaaggaagataagggcaaggattccaaggagtccaagaagta

SEQ ID NO: 240901 - DNA, 5933 bp, Artificial Sequence
  Description of Artificial Sequence: Synthetic coding sequence
atggccatgctgccccctcctggccctcagtctttcgtacactttacaaaacagagtctggcgctaatcgaacagaggatagcggagaggaagagcaaggagccaaaggaggagaaaaaggatgatgatgaagaggcgccaaaaccgtcatcagacctcgaagcaggtaagcaactgccatttatctacggagatattccccctgggatggtgtccgagccactcgaggacctggacccatattatgctgataagaagacattcattgttctgaacaagggtaaaacgatctttcgatttaacgccacccctgcgctgtacatgttatcccccttcagccccctgcggagaatcagcatcaaaatcctggttcattctctgtttagcatgctgatcatgtgcactatactcacaaactgcatcttcatgacaatgaataatcccccagactggacaaaaaatgtagagtatactttcactggcatctatacattcgaatcgcttgtgaagatactagcgaggggtttttgcgtgggtgagtttaccttcttgagagacccttggaactggctcgacttcgtggtgatcgtgtttgcatatctgacagagtttgtgaatctgggtaatgtgtctgctttgcgtacattccgcgtactgcgtgcgcttaaaacgatcagcgttatacctgggctcaaaacgatcgttggagccctgattcagtcggtgaagaagttgtccgatgtcatgatacttacagtgttttgtttatctgtcttcgctctgatcggactgcaactgtttatgggtaatctaaagcataagtgctttcgcaacagtctggaaaataatgagacactggaatccatcatgaatactcttgagtccgaagaggattttcgaaagtacttctattatctagagggttcgaaggatgcccttctgtgtggtttcagcaccgactcaggtcagtgcccagaaggctatacctgtgtcaagatcggacgaaacccagattacgggtatacgtcattcgataccttttcttgggcttttctggccctgtttcgactcatgactcaggactactgggagaacctgtaccagcagactctccgggctgccggtaagacctatatgatcttctttgtcgtagtcatctttctgggctctttttatctgattaacctcatccttgcagtggtcgcaatggcctacgaagagcagaaccaggcgaacattgaagaagctaaacaaaaagagctcgagtttcagcaaatgctcgatcggttgaagaaggagcaagaggaggcggaggctatagccgcagcagcggcagaatatacttcaatcaggagatctaggatcatgggtctctccgaatcctcctcagagaccagtaagctgagtagcaagagcgccaaagagcgaaggaacaggcgcaagaaaaaaaaccagaagaagctgtcatccggggaagagaagggagatgcagagaagcttagcaagtctgagagtgaggattcaatacgtaggaagagtttccacttgggagtggaaggccaccgcagagctcacgagaaacgtctgtctactccaaaccagagtcctctgagtatccgcggatccctgtttagcgccagacgctcgtctcgaacatccctgttctctttcaaaggcaggggaagagacataggctcggagacagagtttgctgatgatgaacactctatctttggcgataacgaaagtaggaggggcagtttatttgtgccccatcgccctcaggaacgtcgtagtagtaatatttctcaggccagtaggtcgcctccaatgttgccggtgaacgggaagatgcactcagcagttgattgcaacggcgttgtaagccttgtcgatgggcgatcggccctgatgctaccaaacggacaactgttgccagagggcactactaatcagattcataaaaaaagacgctgctcctcctatctcctgtctgaggatatgctcaacgatcccaatctccggcagagggccatgtctcgcgcttccatccttacaaacacagtggaagaactggaagaaagcagacagaagtgtcccccttggtggtatagatttgctcacaagtttctaatttggaattgctctccttactggattaagttcaagaagtgtatttacttcatcgtgatggatcctttcgtcgacctagccatcaccatatgtatagtcttgaatactctatttatggctatggagcatcatcccatgaccgaagagttcaagaacgtactagctatcgggaatctcgtattcactggcatctttgcagccgagatggttctgaagctgattgccatggatccttacgagtactttcaggtcggatggaatatcttcgactctttgatcgtgacgctgtcgctagttgaactgttcctggcggatgtggaaggcttgagtgtgctgagatcctttcgactcctgagagtgttcaagctggccaagtcatggccaaccctgaatatgttgataaaaattatagggaacagcgtgggcgctctagggaatctcacacttgtgcttgccattatcgtgttcatcttcgctgttgtgggcatgcagctttttggcaaatcttacaaggaatgcgtgtgcaagatcaatgacgattgtactttaccacggtggcacatgaacgacttttttcacagttttctgattgtctttagggtgctttgtggtgagtggattgagacaatgtgggactgtatggaagtcgccggacaggcaatgtgtctgattgtgtacatgatggtcatggttattggcaatctcgtggtccttaatctttttctggcattactgctttcaagctttagcagcgacaacttgacagcgattgaggaagatccagacgccaataatcttcagattgccgtgacaagaatcaagaaggggataaattatgttaaacaaacacttcgggaattcatcctcaaagcatttagtaagaaaccaaagattagccgcgaaataaggcaggccgaggatctgaataccaaaaaagagaattacattagcaaccacactcttgcagagatgtctaaaggtcataatttcctcaaagaaaaagataagatcagcgggttcgggagttctgtggataaacacctgatggaggattcggatggccaatcttttattcacaacccatccctgacagtcacagtgcccatcgcccctggagagtccgacttagaaaatatgaatgctgaggagctctcatcagatagcgactctgagtatagcaaggtgagactcaataggtcatcatcgtctgagtgtagcaccgttgacaatcctctccccggagagggagaggaagctgaagccgagcccatgaactccgacgagcccgaggcctgtttcactgacggttgcgtgtggcgcttttcatgctgtcaggtgaacattgaaagcggcaagggcaaaatttggtggaatattcgaaaaacatgttacaaaatcgttgagcatagttggtttgaaagcttcattgtccttatgattctcctgagctcgggagcgctggcgttcgaagacatctatatagagagaaaaaaaacaattaaaatcatactggagtacgcggataaaatttttacatacatcttcattctggaaatgttgctgaagtggattgcttatggatacaagacttattttactaatgcttggtgttggctagatttcctgatcgttgatgtgtcgctggtgacactagttgccaataccctgggctatagcgatttagggcctattaaatcccttcggaccctgagggccctgagacctctgcgggcacttagtcgatttgagggcatgcgtgtggtcgttaatgcgttgatcggggcaatcccttctatcatgaacgtgctgctagtgtgtcttattttttggctgatcttcagcattatgggcgtgaatctattcgccggaaagttctatgagtgtattaatactacagacgggagcagatttcctgctagccaggttccaaatcggtcagaatgcttcgccctgatgaacgtgagccagaacgttagatggaagaacttaaaagtgaattttgataatgtaggtttgggatatctgtcgctgcttcaagtcgccacatttaaaggttggaccattataatgtatgctgccgtggattcagttaacgtcgataaacagcctaaatatgagtactcactctacatgtacatttactttgtggtgtttattatttttggatcgtttttcacactgaacctcttcatcggtgtcatcattgataattttaatcagcagaaaaagaaactgggagggcaagatatattcatgactgaggaacagaaaaagtattacaatgctatgaaaaaacttgggtccaagaagccccaaaaaccaattcctcgacccggaaacaaaattcagggctgtatttttgatctggttacaaatcaagccttcgatattagcattatggttcttatctgcctgaatatggtcaccatgatggtggagaaggagggccagtcacaacacatgacggaggtgctgtactggataaatgtggtttttatcattctgttcaccggggaatgcgtactgaaactgatctctctgaggcactactacttcaccgtcggctggaatattttcgacttcgttgtagtgatcatatccattgtgggtatgtttttggccgacttaattgagacatacttcgtatcccccacactttttcgtgtgattcgcctggcgcgaattggcaggatccttcgcctggtgaagggagccaaagggattagaacccttctgtttgccctgatgatgtctcttcctgctctctttaatatcggactgttgctgttcctggtgatgtttatttatgccatatttggtatgtctaatttcgcttacgtaaagaaggaagatggcattaatgacatgtttaacttcgaaacattcggtaattcaatgatttgcctctttcagatcacaacgagcgccggatgggatgggctgctagccccaatccttaacagcaaaccaccagattgcgatcccaagaaagtccatcctggctcctcagtcgagggcgactgcggaaaccccagcgtcgggatcttctattttgtgagttatatcatcatctcgtttttagtggtcgtgaatatgtacatcgccgtgattttagaaaacttctctgtcgctacagaggagtccactgaaccgttgtccgaggatgatttcgagatgttctatgaagtgtgggaaaagttcgaccctgacgccacccaatttatagagttctcaaaattgtctgacttcgccgctgctttagatcctccgctgttgatcgcaaagcccaacaaggttcagctcattgctatggatttgcctatggtctccggcgataggatccactgcctagatattctcttcgcatttacaaagagggtgttaggagagagcggcgaaatggacagcctgagaagccaaatggaggaacggttcatgagcgcaaatcctagcaaagtgagctacgagccgatcacaaccactctgaagagaaaacaggaagacgtctcagccaccgtcattcagcgagcatatcggcgttacagactgagacagaacgtgaagaacatctcgtcgatctacattaaagacggggatagggatgatgatctgctgaacaagaaggacatggccttcgataatgtaaacgaaaactcctcgcccgaaaagaccgacgctacctcatccactacgtccccaccctcctacgattccgtgactaaaccagacaaggagaaatatgaacaagatcggaccgagaaagaagataaaggcaaggattccaaggagtcgaagaaata

SEQ ID NO: 240902 - DNA, 1620 bp, Artificial Sequence
  Description of Artificial Sequence: Synthetic coding sequence
atcttgactaactgcatattcatgacaatgaacaaccctcctgactggacgaagaacgtagaatatacatttactggcatctatactttcgaaagcctcgtcaaaatcctagctagaggattttgcgtcggcgaatttacctttctgcgcgatccctggaattggctcgattttgtagtgatcgtcttcgcatacgtgacggagttcgtggatctcggcaacgtgagtgctctccgcacttttcgagtcctgcgggctctgaaaacaatttccgtaatccccggtctgaaaactatcgtcggagcgttgattcagagtgtgaaaaaactcagcgacgtgatgatcctcacagtgttctgcctgagtgtgttcgcactgataggcttacaattgtttatgggaaacttgaaacataaatgttttcgtaactcactggaaaacaatgagaccctggaatcaatcatgaataccctggagagtgaggaggactttcggaaatatttctactaccttgaaggatcgaaggacgccttgctgtgcggcttttcgactgatagcggtcaatgtccagaggggtacacttgcgtgaaaattggaaggaaccccgattatggatacacctcttttgacaccttctcctgggcatttttagccctgtttaggcttatgacacaggattattgggaaaatctgtatcagcagaccctgagagccgcaggtaagacctatatgatcttcttcgtcgttgtcattttcctggggtccttttaccttatcaatctgattctcgccgtggtcgccatggcctatgaggaacagaaccaggccaatatcgaggaggctaagcagaaagagctagaatttcaacagatgctggatagactcaagaaagaacaggaagaggctgaggcaattgctgcagcagccgcagaatacacctcaattcgcaggtctcgcatcatgggtttgtccgagagctccagtgaaacgagtaagctcagtagcaagtctgctaaggagagacggaataggagaaaaaaaaaaaaccagaaaaagctgtcatcaggtgaggagaagggcgatgccgagaagctctccaagtccgaatcagaagactccattcggagaaaaagtttccacctgggggttgagggtcatcgcagggctcacgagaaaaggctctccacgcctaatcagtcacccctctcaattcggggttcccttttttcagccagacgctccagcaggacttctctgttttcgttcaaagggaggggcagagatatcggcagtgaaacggaatttgccgatgatgaacactctattttcggggacaatgagagcagacggggtagcctctttgtgccacaccgccctcaagaacgaaggagtagtaacatttctcaagcctcccggtcaccccctatgctgcccgtgaacgggaagatgcatagcgccgtcgattgtaatggggtggtgagtctggtcgacggacgttcagccctcatgctaccaaacggacaactacttcccgaagtgattatcgataaagctaccagcgacgactccggcactacaaatcagattcacaagaagcgtcgctgttccagttatttgtag

SEQ ID NO: 240903 - DNA, 198 bp, Artificial Sequence
  Description of Artificial Sequence: Synthetic coding sequence
atggccaattttttgctgccgagagggaccagctcgtttcggcgatttaccagggaatctctggccgcaatcgaaaaacggatggctgagaagcaggctcgcggaagcaccacgcttcaggaaagtcgggaaggtcttccggaggaggaagcccctcgtccccaattggacctgcaggcatcgaaaaagttaccatag

SEQ ID NO: 240904 - DNA, 6050 bp, Artificial Sequence
  Description of Artificial Sequence: Synthetic coding sequence
atggccaacttccttcttcctagggggacctcgtccttcagaaggttcactagagagagtctggctgccatcgagaaacgcatggccgagaaacaagccagaggctctaccacgctgcaggagtccagagagggcctgcccgaggaggaggccccacgtccccagctggacctccaagccagtaagaagttgccagacctctacggcaacccaccacaggagctgattggtgaacctctggaggacctggatcctttctacagcacacagaaaaccttcattgttttaaataagggaaaaaccatatttcggttctccgccactaacgcactgtacgtgctatccccattccaccccattcgtcgcgcagccgtaaaaatcctggtacatagcttgtttaacatgctgataatgtgcaccatcctgacaaattgcgtttttatggctcagcatgacccaccgccttggactaaatacgtagaatatactttcacagcaatttacaccttcgaaagtcttgtcaagatcctggctaggggattttgtctgcatgcatttaccttccttcgggacccttggaactggcttgacttctctgtaataattatggcctacacaaccgagttcgttgatctgggaaatgtgagcgcactcaggacatttagggtgttgcgagcactgaagaccatcagcgtgatctccggattaaagactattgttggcgctctgatccagtccgtgaagaaattagcagatgtgatggttctcacagtattttgcctgtctgtttttgcactcataggcctgcaactgttcatggggaacctgcgccataagtgcgtgcggaacttcacagccttgaacggcaccaacggttccgtggaagccgacggactggtgtgggaatcccttgacctgtacttatctgatccggaaaactatcttcttaaaaatgggacatctgacgtcctgctctgtggaaattcctcagacgctggcacctgccctgagggataccgatgtctcaaggccggagagaatccggaccatggctatacctcctttgactcattcgcctgggcctttcttgcactttttcgtctcatgactcaggactgttgggagaggctgtaccaacagactctgagatctgccggaaagatttacatgatctttttcatgcttgttattttcctgggctctttctacctggtcaatttgatacttgcagttgtcgctatggcatacgaagagcagaatcaggcgactatcgcagaaaccgaagagaaagagaagagatttcaggaagctatggagatgctcaaaaaagagcatgaagccctgaccatccggggtgtggacactgtcagcagatcatcactggagatgagccctctggcacccgtgaactcacatgagcgcagatctaaacgcaggaagagaatgtcctcagggactgaggaatgtggcgaggaccgcttgcctaagtctgatagcgaggacggaccgagggctatgaatcatctcagcctgacccgtggtctgagtaggactagtatgaaaccaaggagttcgagaggaagtatcttcacatttaggaggcgtgacttaggttcagaggccgactttgcagacgacgagaattcgaccgcaggggagtcagagtctcaccatacttccctacttgtaccatggcccctccggcgtacttccgcccaggggcagccgtcgcccggtaccagcgcccctggtcacgccctccacggcaagaagaatagtactgtggactgcaacggcgtcgtatcgttgcttggtgctggcgatcctgaagcaacctcacctgggagtcacttactgcgacctgtaatgctcgaacacccccctgacaccactacaccgtctgaggaacccggtggtcctcaaatgctgacttcccaggccccttgtgtagacggcttcgaggaacccggtgcaaggcagcgcgcacttagtgccgtgagtgtgcttacaagtgcccttgaggagctggaagagtctaggcacaaatgcccgccttgctggaaccgccttgcccagaggtacctgatctgggaatgttgcccactctggatgagcattaaacagggcgtgaagcttgtggtaatggatcctttcacagacctcacgataaccatgtgcatcgtgctaaacacactctttatggccctagaacattataacatgacgagtgagtttgaagaaatgctccaggttggaaacctggtcttcacagggattttcacagcagaaatgacatttaagatcattgctctggatccttactattacttccagcaagggtggaatatttttgactcaattattgtgattctgtccttgatggagcttggcctttcccgaatgtccaaccttagcgtcctcaggtctttccgcctcctgcgggtatttaagttagctaaatcatggccaacacttaatacccttataaagattattgggaatagcgtgggtgcactcggaaatctgaccctcgtgctcgctatcatcgtgttcatctttgcagtagtgggcatgcaactgttcggcaaaaactattctgaattacgcgacagcgacagtggactactaccccgttggcacatgatggatttttttcatgcgttcctcatcatttttcgtattctttgtggcgagtggattgagaccatgtgggactgtatggaggtgagcgggcagtccctctgcttgctcgtatttcttctcgtgatggttattgggaatctcgttgtgcttaacctttttctggcactcttactgtccagcttctccgcagacaacctgactgctcctgatgaagatcgggagatgaacaacctccagcttgctttagccagaattcagaggggcctccgcttcgtgaagcggactacatgggacttttgctgtgggcttcttaggcagagaccgcaaaaacccgctgctctcgcagcacagggacaactcccttcttgcatagctaccccttactcccctccgccaccagaaactgagaaggtgccaccgactagaaaggaaacgcggttcgaagagggcgagcagcccggacagggaacaccgggtgatccagagccagtttgcgtgcctatcgccgtggccgagtcagacactgacgaccaggaagaggatgaggagaacagcttagggacagaggaggaatcttctaaacagcaagagagccagcccgtgtcagggggaccagaagcgccaccagacagcagaacatggtcccaggtcagtgccaccgcatcttccgaggctgaggcgagcgcctcccaggcggactggcgccagcagtggaaagctgaaccacaagccccaggctgtggcgagactcccgaagactcttgtagcgagggatcaactgcagacatgactaataccgccgaactgttggagcagatccctgacttgggccaggatgtcaaggacccagaggactgtttcaccgaaggctgcgtcagaaggtgcccatgttgtgcagttgataccacacaggctccaggtaaggtttggtggaggctgcggaaaacatgttatcacattgtcgaacattcgtggttcgagacatttataatctttatgatcctgttgtcttcaggcgcactggcattcgaagacatataccttgaggaacggaagactataaaggtcctcctcgagtacgctgacaagatgttcacatatgtgttcgtccttgaaatgctgttgaaatgggttgcatacgggtttaagaaatacttcaccaatgcctggtgctggctagacttcctgatagtggacgtatcacttgtctccttagtagccaacactttaggcttcgccgaaatgggtcctatcaagtcgttacgaacgcttagagccctccggccactaagggcactcagcaggtttgaaggcatgcgagtggtggtaaacgcgctggtaggggctatcccctctattatgaatgtactgctggtttgtctgattttctggttgattttctccataatgggagttaatttgtttgcaggtaaattcgggaggtgcatcaaccaaactgaaggagatctgccccttaactataccatcgtgaataacaagtcccagtgcgagtccctcaatctgacaggcgagctatactggacaaaagtgaaagttaactttgacaacgtgggcgctggatacctggcactcctgcaggttgcaaccttcaaaggctggatggacatcatgtatgcagcggtggatagcagaggctatgaagagcagccgcagtgggagtacaacctctatatgtatatctactttgtgatcttcattattttcggcagtttcttcactctgaacctgtttatcggggtgataattgacaacttcaatcagcagaaaaagaaactgggcggtcaggatatttttatgactgaagagcaaaagaaatactacaacgcgatgaagaaactgggctctaagaagccacagaagcctatacctcggccattaaacaaataccagggttttatctttgatattgtgacgaagcaagccttcgatgtcactatcatgttcctaatatgtttgaacatggtcacaatgatggtggagaccgatgaccaatcacctgaaaagataaatattctcgccaagatcaacttgctttttgtcgccatctttacaggggaatgtatcgtgaaactggccgctctgaggcactattacttcaccaattcatggaatattttcgactttgtggtcgtcatcctcagcattgtgggcacagtgctgagcgatatcatccagaaatatttcttttcgcctaccctctttcgggttataaggctagctcgaatcggacgcatcctccgcctcattagaggcgctaagggtatccgtaccttactttttgcacttatgatgagcctacctgcactcttcaacatcgggctgctcctgtttctggtaatgtttatctactccattttcggcatggcgaactttgcctatgttaaatgggaagccggaattgatgacatgtttaactttcagacgtttgctaattccatgctgtgcctttttcagatcactacgtcagcaggttgggacggcttactttcaccaattctgaatacaggacctccttactgtgatcccacactgcctaatagcaatggctcgcgcggtgactgcggatcccccgcagtcggaatcctgttcttcaccacttacatcatcattagctttctgatcgtcgtgaacatgtacatcgccatcatcctggagaatttttcagtagccacggaggaatcaacagaaccactatccgaggatgattttgatatgttttacgaaatctgggaaaagttcgatccagaagccacccagtttatagagtatagcgtgctgtccgacttcgcagacgccctgtcagaaccgttgcgtatagccaagcctaaccagatttctctcatcaacatggatctaccaatggtctccggtgaccggatccattgcatggacatcctttttgcattcacgaagagggtattaggggagtcgggcgagatggatgctttgaaaatacagatggaggagaagttcatggccgcaaatcctagtaagatttcctatgaacctatcacgacaactctgcgccgtaagcatgaagaggtgagtgcaatggtcatccaacgggcatttaggcgccatctgctgcagcgaagtcttaagcacgcctccttcctttttcggcaacaggccggaagtggactttccgaagaggacgccccagaaagggaagggctgattgcctacgtcatgtctgaaaatttcagtcgtccgttaggtcccccatcatcatcttctatcagttccacttctttccctcccagttacgattctgtgacaagggcaacctcagataatctgcaggtgcggggttctgattattcacattccgaggatctggcggactttcccccatctcccgatcgagatcgagagtctatagttta

SEQ ID NO: 240905 - DNA, 342 bp, Artificial Sequence
  Description of Artificial Sequence: Synthetic coding sequence
atggcccaacatgaccccccaccctggaccaagtacgtggagtacgtgagcgaaaacattaaactgggcaacctgagtgccttaaggacctttcgggtgctcagggcgctcaaaactatctctgtgatccccggactaaagactatcgtcggggctctaattcagtccgtgaaaaaactggcagacgttatggttctaacagtgttttgtttgagtgtgttcgctctgatcggtctacagctcttcatggggaacttaaggcataagtgtgtccgaaactttaccgccctgaacgggactaacggttctgtggaagccgatggccttgtgtgggaaagctag

SEQ ID NO: 240906 - DNA, 6050 bp, Artificial Sequence
  Description of Artificial Sequence: Synthetic coding sequence
atggctaactttttgctgccaaggggcactagctccttcaggcggtttaccagagaatccctcgcagccattgaaaagcgtatggccgagaagcaggctagaggtagtaccacactgcaagagtctcgtgaaggcttaccagaggaggaagcccctcgcccacagctggacctccaggcgtccaagaaactgccagacctttacggcaatcccccacaggaactcatcggcgagccactggaggatctggaccccttctactcaacccagaagaccttcattgtgttaaacaaggggaaaaccatcttccgcttcagcgccacaaatgcgctctatgtgttgagtcccttccaccccatccgcagagctgctgtcaagattctcgtgcattcccttttcaatatgttgattatgtgtacaattttgaccaactgcgtgtttatggctcaacatgatcctccgccttggactaaatatgttgagtatacgtttacagcaatatacacctttgagagcttagtgaaaattctggctcggggattttgtttgcacgccttcacatttcttcgcgatccgtggaactggctggatttcagtgtcattatcatggcgtacgtgagcgaaaatattaaactggggaacttgagtgcccttcgaacattccgagttctccgtgctctgaaaacaatttccgtgattcccggtttaaaaacgatcgtgggagccctcattcagagcgtgaagaaacttgcagatgtgatggtgttgaccgtcttctgtctgtccgtgttcgccctgatcggcctgcagctgtttatgggaaatctccgacataaatgtgtgcgaaactttactgctctgaacggaacaaacggctccgttgaggccgatggattggtgtgggagagcttggatctttacttgtctgatcctgaaaactaccttttgaaaaacggtacttcggatgtgctgctgtgcggaaattcgtccgacgcgggaacttgcccggagggatacagatgtctgaaggcaggcgagaacccagatcatggttacacttcattcgattcgttcgcttgggcctttctggcattgtttcggttgatgacccaggattgctgggaacgtttatatcagcagaccctgcgctctgctggtaaaatttacatgatcttcttcatgctggtcattttcctcggatctttctacctggtcaacttaatccttgcagtggtcgctatggcctatgaagaacagaaccaggcaactattgcagagaccgaagagaaagagaaaagattccaggaagctatggaaatgttgaaaaaagagcatgaggcccttaccatccgaggggtcgatacagtctcgcgctcttcattggaaatgtccccactggcaccggttaacagccacgaaagacgatcaaaacggagaaagcgtatgtcttccggcactgaagagtgcggcgaggatcggctccccaaatccgactccgaggacggtcctagggccatgaaccatctgtccctgaccaggggactgtcccgaacgagcatgaaaccccgaagctcccgcggtagcattttcacctttaggaggagagacctcgggagtgaagcagacttcgccgacgatgaaaatagcaccgccggagagtcggagtcgcatcatacttcccttctggtgccttggcctctgaggcgtactagcgcccaagggcagccttctccgggaacttctgcccctgggcacgctttacacggcaaaaagaatagtacagtggactgcaatggcgtcgtcagcctgctcggcgcaggagatcccgaggccacaagcccaggatcccacctgctgcgcccagtgatgctggaacatccaccagatacaacaacaccctcagaggaacctggcggaccgcaaatgcttaccagtcaggccccttgcgttgacgggtttgaggagccaggtgctcgccagagagccctgagtgccgtttcggtcctcacaagcgcccttgaagaacttgaagagagtagacacaaatgccccccatgttggaaccgtttggctcaaaggtatctgatttgggagtgttgtccattgtggatgagtattaaacaaggggtgaagctggtcgtgatggatccgttcaccgacctcacgattacaatgtgcatcgttctcaacactctgttcatggccctggagcactataacatgacctcggagttcgaagagatgttacaggtcggcaaccttgtgtttaccgggatttttacagccgaaatgacctttaagatcattgctctggatccatattattactttcagcagggttggaacatttttgacagtatcatcgtgattctttccctgatggagctggggcttagcagaatgagcaacctctctgtcctccgaagctttcgtctcctccgcgtattcaagctggccaaaagctggcctactctcaacaccttgattaaaattattggcaactccgtcggggcactaggcaacctgacgctggtgctggcaatcatcgtctttattttcgccgtggtgggtatgcagctttttggtaagaattactccgaactgagagactccgactcggggctcctgccacgctggcatatgatggacttctttcacgcttttctgattatcttccggattctgtgcggagagtggattgagacaatgtgggactgcatggaggtgtccgggcagtctttgtgcttgctggttttcctgcttgtcatggtcataggaaatttggtggtattgaacctgtttctggccttacttctatcctctttcagcgccgataatctgaccgcaccagacgaagaccgcgagatgaataatctgcagctggccctcgcccgaatccaacgcggactgcgctttgttaagcggacaacctgggacttctgctgcggcctgctgcgccagagaccacaaaaacccgctgctctggctgctcaggggcaactgccctcctgtatcgcaacgccttacagccctccgcctccggagaccgagaaggttccacctacacgaaaggaaacacggtttgaggaaggagaacagccaggccagggaactcctggcgaccccgaacctgtgtgcgtacctatcgccgtcgctgagagcgacaccgatgaccaggaagaggatgaagagaactcactgggcaccgaggaggagtccagtaaacaacaggaaagccaaccggtgtctggcggaccagaggcaccaccggactctcgtacgtggagccaggtcagcgccactgcctcatctgaagccgaagcgtccgcctctcaggcagactggcggcaacagtggaaagcggaaccacaggctcccggatgtggcgagacccccgaggacagttgctccgaaggcagcactgccgatatgaccaatactgccgagcttctggaacaaatcccagatctggggcaagacgtcaaggacccagaagattgcttcactgaaggctgcgtacgtagatgtccatgctgcgccgtcgacacgacccaggcgccaggcaaggtttggtggcgcctaagaaaaacctgctatcatattgtggaacacagttggtttgagactttcatcatctttatgatcctgctgtccagcggcgcactggcattcgaagacatctacctggaagagcgcaagaccattaaagtcctcttagaatacgccgataagatgtttacctacgtcttcgtcctcgagatgctgctaaaatgggtcgcgtatggcttcaaaaaatattttaccaacgcctggtgctggctcgatttcctcatcgtggacgtgagtctagtcagcctcgtggcaaacactttgggtttcgcagagatgggccctatcaaatctctcagaacactgagagctctacggcctcttcgagctctgtcgcgcttcgagggtatgagggtagtcgttaatgccctcgtaggtgccattccgtccataatgaatgtgctgttggtctgcctgatcttctggctgatcttttcaatcatgggagttaacctgtttgcaggcaaatttggccgatgcatcaaccaaaccgagggggatttacccctaaactataccattgtgaataacaagagccagtgtgagagtctcaatctcacaggcgagctctattggaccaaagtgaaggtgaactttgataatgtgggtgcaggctacttggcgcttcttcaggtggccacgtttaagggttggatggatatcatgtatgcagctgtggattcgcggggatacgaagaacagccacaatgggagtacaatctttacatgtacatctattttgtgatcttcatcatctttggctctttcttcacactgaacctgttcatcggggtaatcatcgacaattttaaccagcagaaaaaaaaacttggcggtcaggatatattcatgacagaagagcagaagaagtactacaacgcgatgaaaaagctgggctccaaaaaaccacagaaacccatccctcgcccactaaataaataccaaggttttattttcgatatcgtaactaagcaggccttcgatgtgacaatcatgtttctcatttgcctgaatatggtgaccatgatggtggagactgacgaccagtccccagagaagattaatatcttagcaaagataaatctcctatttgtggccatattcaccggggagtgcattgtaaagctagccgctttgcggcattactacttcacgaattcctggaacatattcgactttgtggtcgttatattaagtattgtcggcaccgttttgtctgacattatacagaagtattttttcagccctacactgttccgggtgattagacttgcgaggatcggcaggatcttgcgattgatcagaggtgcgaagggtatcagaaccctgctgtttgcactcatgatgagcctgcccgctctgttcaacattggactcctccttttcctcgtgatgttcatctatagtatattcggcatggctaactttgcctatgttaaatgggaagccggaatcgatgatatgtttaactttcagacttttgctaacagtatgctctgcctgttccagatcactacgagtgctggatgggacgggctgctatctcccattttaaacaccgggccaccctattgtgaccccacactgcccaattcaaacgggagccgcggagattgcggttcaccagcggtggggattttatttttcaccacatacatcataatttcttttcttattgttgtaaacatgtacatcgctatcatcctggagaacttttctgtggccactgaggaatccaccgaacccctgtctgaagatgatttcgatatgttctacgagatatgggagaagtttgaccccgaggcaactcaattcatcgaatactctgtgctttccgacttcgcggacgctttaagcgaacctttgcggatagccaaaccgaaccagatctcattaataaatatggatctgcccatggtgtcaggcgaccgtattcactgcatggacatcctgttcgcattcaccaagcgcgtgctcggcgagtccggagagatggatgccctgaagattcaaatggaggagaagtttatggcggctaacccaagtaagatcagctatgagccgataaccacaactttgcggagaaaacatgaggaagtgtccgccatggttatccagcgagcctttcgtcggcacctgctgcagcgttctctcaagcacgcctcttttttgttccgccaacaggctgggagcggtctgtctgaagaagacgctccagagagagaggggttaatcgcctacgtgatgagcgaaaacttctcgcggccactgggacctccaagcagttccagcattagttctactagttttcctcccagctacgacagcgtgacccgagccaccagtgacaacctgcaagttagggggagcgactattctcactctgaggatctagcagatttcccaccatctcctgatcgggatcgagaatccatcgtgta

SEQ ID NO: 240907 - DNA, 5996 bp, Artificial Sequence
  Description of Artificial Sequence: Synthetic coding sequence
atggccaacttcctgttacctagagggacttccagctttagacgcttcacgagggagagtctggccgcaatcgagaagaggatggctgaaaagcaggcaaggggaagcaccactctacaggaaagccgtgagggcctccctgaggaggaagccccacgtccccagctggatctacaggcctcgaaaaagctgcctgacttgtatgggaaccccccacaagagctcattggtgaaccactggaggatctagaccctttttattctacccaaaagacatttatcgtgctaaataaaggaaaaactattttccggttcagcgccacaaatgcgctgtatgtcttgagtccatttcacccgatacgccgagcggcagtcaagattcttgttcattctctgtttaatatgctgataatgtgtacaatcttgacgaactgtgtattcatggcacagcacgacccacccccatggaccaagtatgtcgagtatactttcaccgctatctatacattcgagtctctggtgaagattctagcaaggggattctgtcttcacgcatttacttttctgcgtgatccttggaattggctagacttttcagttattatcatggcttacgtgtctgagaacataaagttaggaaatttatcagcactgcggaccttccgggtcttgagggcccttaaaaccataagcgtcattcccggactgaagactattgtgggagctctgatccaaagcgtgaaaaagcttgccgacgtcatggtcctgacagtattctgtctttccgtgtttgccctcatcggactacagctttttatgggcaacttgcggcacaagtgtgtgcgaaacttcacagccctgaatggcaccaacggatccgtcgaggcagatggccttgtctgggagtccctggacctgtatcttagtgatcccgagaactacctcctgaaaaacggaacctcggatgtgctgctgtgcggaaattcaagtgacgctggaacttgccctgagggatataggtgcctcaaagcaggagagaatccggatcatgggtacacatcattcgacagctttgcatgggcgtttttagccctctttcggctaatgacacaggactgttgggaacggctctatcagcagaccctgagatccgctggcaagatctacatgatcttcttcatgctcgtgatattcctagggagcttctacctggttaaccttatccttgccgtggtagcaatggcctatgaggagcagaaccaagcaaccatcgccgagacggaggaaaaagaaaagcggttccaggaggctatggagatgctcaagaaggagcacgaagctctgacaatcaggggtgtcgacaccgtgagcagaagttcgttggagatgagtccactggcccctgtgaactcacacgagagaagaagcaaacgtcgcaagcgcatgagttctggcactgaagagtgtggcgaggaccggctgcctaaatcagactcagaggacggtcctcgggcaatgaaccatctgtcacttactcggggattgtcaagaacctcgatgaagccaaggtcatccaggggcagtatctttaccttccgcagaagagatttgggaagtgaggccgacttcgccgacgatgagaacagcacagcaggagaatcggagtctcatcacacaagcctgctggtaccttggcccctgcgtcgtaccagtgctcagggacagccgtccccgggtacttccgccccagggcacgcgcttcatggtaaaaagaacagcaccgtggattgcaacggtgtagtgagtctgctcggcgcaggagacccagaagcaactagcccaggatcacacctgctccgaccggtgatgcttgagcaccctccagacaccacgaccccatctgaggagcctggcggtccacaaatgctgacatcccaggcaccttgcgtcgacggctttgaggagcccggagctcgtcagcgcgctctctcagcagtcagcgtcctgacatccgccctggaggagctggaggagtcaaggcataaatgtccgccttgctggaacagactagcccagcgctatctgatttgggaatgttgtccactgtggatgtccatcaaacagggagtcaaattggtggtgatggatcctttcaccgacctgacaataacaatgtgtatcgttttaaacaccctcttcatggccctcgagcactataatatgacctcagagttcgaggagatgttgcaggtgggcaatctcgttttcaccggcattttcaccgctgagatgacctttaagatcatcgccctggacccctattattattttcagcagggctggaacattttcgattccatcattgtcattttaagcctgatggaactggggcttagcaggatgtcgaatctctcagttctgcggagtttccgactgttacgagtcttcaaactggctaaaagttggcccacactgaacaccctgataaaaattatcggtaactcagttggcgcacttgggaatctaacactggttttggcgatcatcgtttttatctttgctgtggtggggatgcagttgttcgggaagaactatagcgagcttagggattcggattccggtctgctgccacggtggcatatgatggactttttccacgcgttcctcatcatattccggattttgtgcggagaatggatcgagacaatgtgggactgcatggaggtcagcggtcaaagcctgtgcttattagtgttcctgttggtaatggttatcggtaaccttgtggtactgaacctgtttctcgcactcctcttaagttcattcagcgccgacaacctgaccgcaccagacgaagacagagaaatgaataacctgcagctggctttggccagaatccaacggggattacgatttgtgaagaggaccacttgggacttctgttgtggtctgttgcggcagcgtcctcagaagccggcagcgctggcagcccagggccagctgccgtcctgtattgccaccccatattcaccgcctccgccagagacagagaaggtgccacctacacggaaagagacccgattcgaagaaggcgaacagcctgggcagggaacccctggagatccagagccagtgtgtgtacctattgcagtggccgaatcggacaccgacgaccaggaggaggatgaagaaaactcactcgggactgaggaggagtcctcaaaacaacaagaatcccagcccgtctcggggggacctgaggcccctccagactcacggacatggagtcaggtgtcagccactgcgtcgagcgaagccgaggcctctgcctcacaggcagactggcggcagcagtggaaagccgaacctcaagcacctggctgcggagagacacccgaagactcgtgcagcgagggaagtactgctgatatgactaacaccgcagagctgttagagcagattccagaccttggacaggacgtaaaggaccccgaagactgcttcacggagggatgtgtcaggagatgtccgtgttgtgccgtggacaccacccaagccccaggtaaggtgtggtggcgtttacgcaaaacttgctaccacatcgtcgaacattcatggtttgagactttcataatttttatgatcttgctttcgagtggggctcttgcctttgaggacatttatctggaggagcggaagactatcaaagtcctccttgagtacgccgacaaaatgttcacatacgtgttcgtgcttgagatgctccttaaatgggtggcctacggcttcaaaaagtactttacgaatgcctggtgttggttagacttcctcattgtggatgtgtctctggtaagcctcgtagcaaacaccctgggattcgcagagatgggtcccattaaaagccttagaaccctgagagctttacgcccacttagagcactgagcaggtttgaggggatgagggtggttgtgaatgcgctggtgggggctattcctagcatcatgaacgttctgcttgtgtgcctgattttttggctgattttttctataatgggggtgaacttgtttgctgggaaatttggcaggtgtatcaaccagaccgagggagacctgccccttaactatacaatcgtcaataataagtcccagtgcgagagtctgaatttgacgggagagttgtattggacaaaagtgaaggtgaacttcgacaacgtgggcgcaggataccttgccctgttacaggtgtatgaagaacaaccccaatgggagtacaatctttatatgtacatttatttcgtcattttcattatatttggtagtttcttcaccttgaacttgtttatcggggtgattattgacaatttcaatcaacagaaaaaaaaattgggaggacaggacatttttatgaccgaggaacagaagaaatattacaacgcgatgaagaaactgggaagtaagaaacctcagaagccaatcccacgcccactgaataagtaccagggctttatttttgacatcgtcactaagcaggcgttcgacgtgacgatcatgttcctgatttgtcttaatatggtcacaatgatggtggagacagacgatcagagtcccgagaagattaacatactggccaaaatcaatttgctgtttgtggcgatctttactggcgaatgtattgttaaactagccgcactgcgtcactactacttcaccaactcatggaatatctttgactttgtcgtggtcatactctcaatcgtgggtacagtcctatcggatataatccagaagtactttttttcacctactctctttagggtgattcggctcgccaggattggacgcattctgcgactgatccgtggagctaagggcattcgcactctcctgttcgcactgatgatgagcctgccagctctttttaacatcggtttgctgctgttcctagtgatgtttatttactctatttttgggatggctaacttcgcatacgtgaaatgggaagcagggatagacgacatgttcaactttcagaccttcgcgaatagtatgttatgtctgttccaaatcacaacaagtgcaggatgggacggcctgctgtctcccattttgaacacgggacccccatactgcgatcccacgcttcccaactctaacggcagcaggggagactgcgggagcccagcagtcgggatcctctttttcacaacgtacatcatcattagtttcctgatcgtggtcaacatgtatatcgctattatcctggaaaacttctcggtagccaccgaggagtctacggaacccttgtccgaagatgattttgatatgttttacgaaatctgggagaagtttgaccccgaggcgactcagtttatcgaatacagtgtgttatccgactttgcggatgccctctcagaacccttgagaattgccaaacccaaccaaatcagtttgatcaatatggatcttccaatggtatccggcgataggatccattgcatggatattcttttcgcctttacgaagagggttctgggcgaatccggcgagatggatgcgctcaagattcagatggaggaaaagttcatggcggcaaacccttccaaaattagctacgaaccaatcaccaccaccctgaggcgcaagcacgaagaggttagtgcaatggtgattcagcgcgctttcagaaggcatctattgcagagaagcctcaagcacgcatcatttctttttaggcagcaggctggttcaggacttagtgaagaagatgccccagaacgggagggtctcattgcttacgtgatgtctgagaatttcagcaggccactcggcccacctagttcttccagcatttccagcacatctttccccccttcctatgacagcgtcactagagccacctccgacaatctccaggtgaggggcagcgactattcccattcagaagacctcgcggacttccccccatcacctgaccgtgacagagaaagtatcgtgta

SEQ ID NO: 240908 - DNA, 6047 bp, Artificial Sequence
  Description of Artificial Sequence: Synthetic coding sequence
atggctaactttctgctgcccagaggcacctctagttttcgccgattcactagagaaagtctcgccgctatagaaaagaggatggccgagaaacaggctagaggcagtactactctgcaggaatcaagagaaggcctgccggaggaagaggcccctaggccccagttagacctgcaagcaagcaagaagcttcccgatctgtacggaaaccctccccaggagctcattggcgaaccactagaagatttggatccgttttatagcacccagaagacattcatagtcttgaataaaggaaagacgatcttcaggtttagtgccactaatgcgttatatgtcctgtccccttttcaccccatccggcgtgctgctgtaaaaatactcgtgcactcgttgttcaacatgttgattatgtgtaccatcctcactaactgcgtgtttatggcccagcatgatccacctccttggactaaatatgtcgagtacacgttcaccgccatttacacatttgaaagcttggttaaaatcttagctcgcggattttgtttacacgctttcacctttcttcgggacccctggaactggttggatttcagcgtgatcatcatggcttataccaccgagtttgtagatcttggcaacgtgagcgcgctcagaacatttcgtgtgctgcgcgcactgaagactatctccgtgatatccggcttgaagactatcgttggtgccttgattcaatccgtcaagaaactggctgatgtcatggttctgaccgtgttttgtctaagcgtgtttgccctgataggtttgcagctgttcatggggaatttgcgccacaagtgcgtgcggaacttcactgccctaaatggcaccaacgggtctgtagaagcggatgggctcgtatgggaatcacttgacctctacctgtctgacccagagaactatttgctgaagaatggcacatccgacgtacttctttgcggcaattcctctgatgcaggtacctgcccagagggttataggtgcctgaaggcaggagaaaacccagaccatggctacaccagcttcgacagcttcgcttgggcctttctggcgctatttagactaatgactcaagactgctgggagagactttaccaacaaacactgcggtcagctggtaaaatttacatgatttttttcatgctggtaatttttctggggtctttctatctcgttaatttgatcctggctgtagtggcaatggcctacgaagagcagaaccaggctacgattgccgagactgaggaaaaggaaaaaagattccaggaggcgatggagatgctgaagaaagagcatgaggctctgaccattagaggcgttgatacagtctcacggtctagtctagaaatgtcgcctctggccccagtgaacagccatgagcgacgctcgaaacggcgtaagagaatgtccagcgggaccgaagaatgcggcgaagacaggctgcccaaatctgactcagaagacggccctcgggcaatgaatcacctcagcctcacgaggggactgtcccggacctcaatgaagcctaggtccagccgcggatccatcttcacgtttaggcgccgtgacctcggatcagaggctgatttcgcagatgacgaaaacagcaccgccggagaaagcgaatcccaccacacctcactcctcgtgccatggccgcttcgcagaacaagtgcacagggacaaccttccccgggaacaagcgccccaggccatgctcttcatggcaagaagaattcaaccgtcgattgtaacggcgtggtcagtctgctaggggctggcgaccctgaagcaacttctccgggatctcatctcctgagacccgtcatgttggaacatcctcccgacaccactactccctccgaggaacccggaggaccccaaatgttgacaagtcaggctccctgcgtggatggttttgaggaaccaggagcgagacagcgggctttgtcagcagtttccgtgctgacgagcgccctggaggaactcgaggagagtcgccacaagtgcccgccttgctggaatagactggcccagaggtacctgatctgggagtgttgtccgttatggatgagcatcaagcagggggttaagctagtcgtaatggatcccttcacagatctgacaatcactatgtgcattgtattaaatactctctttatggcgctggaacattataacatgaccagcgaattcgaagagatgcttcaggtggggaatctcgtgttcactggtattttcaccgcagaaatgacctttaagattatcgcccttgacccatattattactttcagcagggatggaacatattcgactccataatagtcatcctctcactgatggaactgggcctgtctcggatgtcgaatctgtccgtcctgagatctttccgcctgctgcgtgtgtttaagttagctaaatcctggccaacacttaataccctgattaagattataggaaacagcgttggagccctggggaatcttaccctggtgttggctattattgtttttatctttgctgttgtgggcatgcagctgtttgggaaaaattactctgaactgcgggactccgattcggggctgctcccgagatggcatatgatggattttttccacgccttccttatcattttccgcattctctgtggagaatggattgaaacaatgtgggactgcatggaggtcagtggccaatcgctgtgcctgcttgtcttcctgctggttatggtgatcgggaatctcgtagtactgaatcttttcctggccctgctgctgagctccttttccgcggataatctgaccgcccctgatgaggatcgggagatgaataaccttcagcttgctctggcccgaatccagcgaggcctccgcttcgtgaaacgaacaacgtgggatttctgttgcggacttttaagacagcgccctcaaaagccagcagccctggctgctcaagggcagttgccttcatgtatcgccactccctactccccaccaccacccgagactgaaaaggtcccccctacaaggaaagagacgcgtttcgaagaaggggagcagcctggccaggggactcctggcgacccagagccagtgtgtgtgcccatagccgtggccgagagcgacaccgacgatcaggaggaggacgaggagaattccctgggaactgaggaggaatcatctaaacaggagtcgcagcctgtcagcgggggtcctgaagcccctccagattccagaacctggtcccaagttagcgccactgctagctctgaggccgaggcctccgccagtcaggcggactggaggcaacagtggaaggccgaaccccaggctcctgggtgcggagagaccccagaggattcttgctccgaggggtccacggccgatatgaccaataccgccgaattgctggagcagatcccagatcttggccaggatgtcaaagaccccgaggattgcttcaccgagggatgcgtgcggaggtgcccctgctgcgccgtagacaccacacaagctcctggaaaggtgtggtggagactgaggaagacatgctaccacatcgtcgaacactcatggtttgaaacatttataatttttatgattctgctgagctccggggctctggcatttgaggacatctacctggaggaacgcaaaaccattaaagtactcttagaatacgccgacaaaatgttcacttacgtttttgtcctcgaaatgttactgaaatgggtcgcatacggcttcaaaaaatacttcacgaacgcctggtgctggctcgattttctcattgtggacgtaagcctggtgagcctcgtcgccaacacattgggtttcgccgagatgggacctattaagtcccttaggactctccgagctctgcgcccattgcgcgcactgagtaggttcgagggaatgcgcgtagtggtcaacgcactggttggcgctatcccctccatcatgaatgtccttctggtgtgcttgatcttctggctgatattctctatcatgggggtgaatctgttcgctggtaaattcggaagatgcatcaaccaaaccgagggcgacctgcctctgaattacaccatcgtaaacaacaaatcgcagtgtgaaagtctcaacctgaccggagagctatactggacaaaggtgaaagtgaatttcgacaacgtgggtgccggatatctggcactgcttcaggtggctacatttaagggatggatggacataatgtacgccgctgttgacagtagggggtacgaggaacagccacagtgggaatataatttgtacatgtacatctacttcgtgatatttatcatcttcgggagcttcttcaccctgaatcttttcattggtgtgatcattgacaactttaaccagcaaaagaagaagcttggtggtcaggacatcttcatgacggaggagcaaaaaaagtactataacgccatgaagaaactgggctccaagaaaccccagaaaccaataccgagaccactcaataagtaccaggggtttattttcgacattgtgaccaaacaggcctttgacgtgactattatgttcttgatatgtctgaatatggtaacaatgatggtagagacagatgaccaatcacccgagaaaataaacattctcgcaaagatcaacttgctcttcgtggcaatcttcacaggagagtgtattgtgaagctggccgctctccgccactactatttcaccaattcctggaatatatttgacttcgttgtagtgatcctctctatcgtcggcaccgtcctgtccgatataatacagaagtacttcttttcaccaaccctcttccgggtgattcggctagcgagaattggacggatccttcgcctgatccggggagccaaaggcatcagaactttgcttttcgcactgatgatgagtctgcctgccctgttcaatattgggctgctcttgtttcttgtaatgttcatatactcaatttttggaatggcaaacttcgcttacgtaaagtgggaagctgggatagacgacatgtttaatttccaaactttcgctaattcgatgctctgtcttttccagatcacaacgtctgctggttgggacggcctcctgtcgcccattttgaacacgggcccaccttactgcgaccctacactgccaaactctaatggctcgagaggagattgtggctcccctgcagtgggtatcctgttttttactacctacatcattatctcttttttgatagtagtgaatatgtacatcgctataatattggagaacttttcagttgctacagaagaatcaactgagcccctttccgaagatgatttcgacatgttttacgagatatgggagaaattcgaccctgaggccacgcaattcattgaatatagcgtcctgtccgatttcgctgacgcccttagtgagcccctccgaatagctaaaccaaaccagataagcctgatcaatatggatcttcccatggtctcaggagatcgcattcactgcatggacatcctcttcgcgttcactaagagggtgttgggcgagagcggagagatggacgctctcaagattcagatggaggagaagttcatggctgccaatccttccaaaattagttacgaacccatcaccacaacccttcgtcgcaagcacgaggaggtgagcgccatggttattcagcgtgcctttaggcggcatctgctgcaaaggagcttaaagcacgctagttttctctttcgacaacaggctggctccggtctctcagaggaagacgcacctgagcgagaagggctgattgcttatgtcatgtcagagaacttttctcgaccgctgggaccgccatcaagctcctccatctcttctactagtttcccacctagctatgacagcgtgactagggctacttccgacaaccttcaagtgagggggagcgattactcccattctgaagatctggcagattttcccccaagcccagaccgtgaccgcgagagtatcgtata

SEQ ID NO: 240909 - DNA, 5996 bp, Artificial Sequence
  Description of Artificial Sequence: Synthetic coding sequence
atggccaattttctgctacccagaggtacgagttcgtttcggagatttactcgggaatctctggccgcaatcgagaaaaggatggccgagaagcaggctcggggaagcaccacacttcaggagagcagggaaggtcttccagaggaggaagcaccccgtccccagcttgatctccaggctagtaaaaagttacctgacctgtatggaaaccccccacaggagctgatcggcgaacctctggaggacctggatccattttattccacgcaaaaaaccttcatcgtgctgaacaaaggaaagaccatttttcgcttcagcgccaccaatgctctgtacgtgctaagcccattccaccccatcagaagggcagccgtgaaaatcctcgtccacagcctgtttaacatgcttattatgtgcaccatcctgactaactgcgtgtttatggcccagcacgatccccctccttggaccaaatacgtggaatatacatttacagcaatttacacatttgagagcctggtgaaaatcttagcccgaggtttttgtctccacgccttcacttttctgagagacccttggaactggctggacttctccgtcattatcatggcctatgttagcgaaaatatcaaattaggaaacctgtctgccttgaggactttccgcgtgctgagagccttgaaaaccattagcgtgattccgggtctgaagacaatcgtgggagcactgattcagagcgtgaaaaaacttgcagacgtgatggtgctgaccgtgttttgtttatccgtattcgcgctcatagggcttcaactttttatggggaatttacgacacaaatgcgtgagaaactttaccgccttaaacgggacaaacggcagtgtggaagccgatggtctggtctgggaatcccttgatctgtatctctccgatccggagaattatctgcttaaaaacggtaccagcgacgtgctcttgtgtggaaatagctctgatgctggtacctgcccagagggatatcggtgcctgaaggccggtgagaacccagatcacggctatacaagttttgattcttttgcgtgggctttcttggctctgttcagactcatgacccaagactgctgggagaggctgtaccaacagaccctcaggtcagccggaaaaatttatatgatattctttatgctggtgatctttttggggtcattctacctggttaatctgatcctggcggtggtcgctatggcctatgaagagcagaaccaggcgacaatagcggagacagaagagaaggaaaaacgcttccaggaggcgatggaaatgttaaaaaaggagcatgaagctctgaccatcaggggggtcgataccgtgagccgatcctctctggaaatgtcgcctctggcacccgtgaattctcacgaaaggagatccaagcggagaaagcgtatgtccagcgggaccgaagagtgcggggaggatagactaccaaaaagcgatagcgaggatggccctagggcaatgaatcatctttccctcactcgaggactgagtcgcacatccatgaaaccccgatcttcccggggtagcatatttacatttagaagaagggatctgggtagcgaggcagattttgctgacgatgagaattctaccgccggagaaagcgaaagccatcacacttcgctattggtcccatggcctctgagacggacgtccgcacagggacaaccatctccaggaaccagcgcgccaggccacgccttacatggaaaaaagaactccaccgtggactgcaacggtgtggtgtctctgctcggagctggcgatccagaggctacatcgccaggcagtcatcttctgagaccggtgatgcttgagcacccccctgacacaaccacaccttccgaagaacctggcggtcctcagatgttgacctcacaggccccatgcgttgacggctttgaggaacccggtgccagacagagggctctatcggccgtctcagtgttaacctcggcccttgaggagctcgaagaatcgaggcacaaatgccctccttgttggaaccggttggctcagagatatctgatttgggagtgttgccccttgtggatgtcaattaaacagggggtgaagctagtggttatggaccccttcaccgacttaaccatcactatgtgcatcgttctgaatactctgttcatggcactcgaacattacaatatgacttctgaattcgaggagatgctgcaagtgggtaatctggtctttaccggcatcttcactgcagaaatgaccttcaaaataatagctctggacccttactattattttcagcaagggtggaacatttttgattccatcattgtaatcttgtcgctgatggaactaggcttgtcacgcatgagtaatctatctgtgctaaggagtttcagattgcttcgcgtctttaaattagctaagagctggcccaccttgaatacactcatcaaaattatcggcaactctgtgggcgctctcggaaatctcaccttggtcctcgctattatcgtgttcatctttgcagtagttgggatgcagctgttcggcaaaaactactccgagttgcgcgactctgacagtgggctgttgccacggtggcacatgatggatttttttcatgccttcctcattatcttcaggatcttatgcggcgagtggatagagaccatgtgggactgcatggaggtctcaggtcagtccctctgcttacttgttttcctactggtgatggtaattggtaacctcgtcgtcctcaacctgttcctggccctcctgctctcatcattttcagccgacaatttgaccgctccagacgaagaccgggagatgaataatctgcaactggcactcgctaggattcagcgcggtctgaggttcgtcaaaagaacaacctgggatttctgctgcggactgctccgccaacgcccacagaagccagctgcccttgccgctcaggggcagttaccaagctgcatcgctactccttattctcccccaccccctgagaccgagaaggttcccccaaccaggaaggagaccagatttgaggagggagagcagccgggacaagggacaccgggagaccctgagcctgtgtgcgtacctatcgctgtggcagaaagtgacacagacgaccaggaggaggatgaggagaatagcctcggaacagaagaagaatccagtaaacagcaagagtcccagcccgtctccgggggaccagaggcccctcccgacagcagaacatggagccaggtaagcgcgaccgctagcagtgaggccgaagccagcgcgtcacaggcggactggaggcaacagtggaaagcagaacctcaggctccaggatgcggagagacaccagaagacagctgttcagaagggtcaaccgcggacatgacaaataccgcagagctgttggagcaaatacccgatctggggcaggatgtaaaggacccagaagattgcttcaccgagggatgcgtgcgcagatgcccttgttgcgcggtcgacaccacacaggcaccaggaaaagtatggtggaggctgcgtaagacttgctaccacatcgtagaacattcctggtttgagacattcatcatattcatgatcctgctttcaagtggcgcactcgccttcgaggatatctatctcgaggagcgcaagacaattaaggtgctgcttgagtacgcggacaagatgtttacttatgttttcgtcctggagatgctgttaaagtgggtggcatatgggtttaagaaatattttactaacgcatggtgttggttggactttctaatcgttgacgtcagcctggtctctctggtggcaaacaccctcgggtttgctgaaatgggcccaataaagagcttaagaacgctgagagccctccgaccgctgcgggcactcagcagattcgagggcatgcgtgttgtggtgaatgcacttgtcggcgctattccatctatcatgaatgtgctgcttgtgtgtctgattttttggctcatattctcgatcatgggcgtaaatctgtttgcaggaaagttcgggagatgcatcaaccagaccgagggagacctgccgctcaattataccatcgtaaataataaatcacagtgtgagtcactcaacctgactggggaactatactggacaaaagtcaaggtgaatttcgacaatgtaggtgctggctatctcgcgctgttgcaagtgtacgaggaacaaccacaatgggagtacaatttatacatgtatatctactttgtgatctttattatatttggaagcttctttactctgaacttatttatcggtgtgataattgacaacttcaatcagcagaagaaaaagctaggagggcaggatatttttatgaccgaggaacaaaagaagtactacaatgccatgaagaagctgggtagtaagaagccccagaaacctattccacgccctctgaacaaataccaaggcttcatcttcgacattgttaccaagcaagcatttgatgtgactatcatgtttctaatttgtctaaatatggtcaccatgatggtggaaaccgacgaccagagcccagagaagatcaatattttagcgaaaattaaccttcttttcgtcgccatctttaccggagaatgtatcgtgaagctggccgcattgaggcattactatttcaccaactcctggaacatatttgactttgttgttgtcatactgtccattgtgggcaccgttctgtcagatatcatccagaaatatttctttagcccaaccttgttccgcgttattagactggcaaggattggcagaatcctgcggctgattagaggggctaaaggcattagaacactgctgtttgcgttgatgatgtctctccccgctctctttaacatcgggcttctgttgtttcttgtcatgttcatttacagtatctttggcatggccaacttcgcctatgtgaagtgggaggcagggatagacgacatgtttaacttccaaacgtttgccaactcaatgctatgccttttccaaattactacatctgccggttgggacggcctactatcacctattcttaacacagggcctccctactgcgatcctaccctgcccaactccaatggctccaggggagattgcggatcacccgcagtcggcattcttttcttcaccacatacattatcatttccttccttattgtcgtcaatatgtatatcgctatcatcttagaaaatttctccgtcgcaacagaagaatccaccgagcctctctccgaagatgattttgatatgttttacgagatttgggaaaagttcgatccagaggccactcaattcatagagtacagtgtgttgagcgatttcgcagacgctttgagcgagcccctgcgtatcgccaaaccaaaccagatcagtttgataaacatggatttgccgatggtatcgggcgaccggattcattgcatggatatcctcttcgcattcaccaaacgcgtgctaggcgaaagtggagaaatggatgctctaaagattcaaatggaggagaaattcatggctgcgaaccccagcaaaatttcctacgaaccgataactacaacccttaggagaaaacatgaggaggtaagcgctatggtaattcaacgcgcatttagacgccacttgctacagcggtccctcaagcacgctagctttttgttccgccagcaggctggctctggcctgtccgaggaggatgcaccggagcgggagggtctcatagcctacgtcatgtcagagaactttagcagacctctggggccaccatcatccagctcaatttcctcaaccagcttcccacctagttacgattctgtcacacgtgcaacgtctgataatcttcaggtgagaggaagtgactactcacactccgaggatctggccgatttccccccatcgccagacagggatagggagagcattgtcta

SEQ ID NO: 240910 - DNA, 6047 bp, Artificial Sequence
  Description of Artificial Sequence: Synthetic coding sequence
atggccaacttcttgctccctaggggtactagttccttccggaggttcacaagagagtcacttgccgctattgagaaaagaatggcggagaagcaggccagaggctctaccactctgcaagagagccgggaaggattacccgaggaagaagccccaaggccccaactggacctgcaggcctccaagaagctgcctgacctatatgggaatcctcctcaggagctcattggagagcccctcgaagatctggacccattttactctacgcagaaaacttttatcgttttgaacaaggggaaaacaatttttcgattttcagctactaatgcactttacgtactcagccctttccaccccatccggagagccgcagtgaagattctggtacactcactatttaacatgctcatcatgtgcaccatcctgacaaattgcgtatttatggctcagcatgatccgcctccttggactaaatatgtcgaatatacgtttacagctatatatacctttgagagcttggtgaaaatactggccaggggcttttgcctccatgcgtttacatttctgagggacccatggaactggctggactttagcgtcattatcatggcctatacaacagaattcgtggatctagggaatgtcagcgcacttcggacattccgcgtgctacgtgcattgaagactattagtgtgattagtggcctgaaaacaatcgtcggcgctttgatccagtctgtcaaaaaactggctgacgtgatggtgctcaccgtgttttgtctgagcgtgttcgccctgattggtttgcagttattcatgggaaatctaagacacaaatgcgttcgcaactttacagccctcaatggaacaaacgggagcgtggaggccgatggtttggtctgggagtcccttgatctctatctgagtgaccctgagaactacctgctgaagaacggcacttcagatgttctgctgtgtggtaactccagcgacgccggaacatgcccagagggatataggtgtttaaaagctggggaaaacccagatcatgggtacacctcatttgacagtttcgcgtgggccttcctggcccttttcagacttatgacccaggattgttgggagaggctataccagcagaccttaaggtccgctggaaagatttatatgatattcttcatgctggtcatcttcctcggcagtttttatctagtcaacctcattctagccgttgttgctatggcctacgaagagcagaatcaggccaccattgcagagactgaggaaaaggagaaaagattccaggaagccatggagatgttgaagaaagagcacgaggcactcacaatcaggggagttgatacagtgtcccgctctagcctggaaatgtccccacttgcccctgtcaactcacacgagcgcaggtcaaaacgacggaaacgtatgtctagtggcaccgaggagtgcggggaggacaggctgcctaaatcggatagcgaggatggtcccagggctatgaatcacctgagcttgacaagaggcctctcacggacctcaatgaaacccaggtcttcgaggggatcaatattcacattccgaaggagggatctgggctctgaggccgattttgccgatgacgagaattcgacagctggagagtctgaatcacatcacacatccctcctggttccatggccattacgacgaactagcgcacagggccaaccatctccaggaacatcagctcccggacatgctttacatgggaaaaagaactcaacagtcgactgtaatggcgtggtttccctgttgggggctggcgatccagaggccacttcccccggatcgcacctcctaaggcctgtcatgctggagcatcctcctgacaccaccacaccctctgaggagcctgggggtccccagatgctgactagccaggcgccatgtgtggatggtttcgaggagccaggtgctcgccagagggcactgagtgccgtaagcgtcctgacctctgctctggaggagctggaagagtctaggcacaagtgcccaccatgttggaaccggttggcccagcgttacctgatatgggagtgttgtccgttgtggatgagcatcaaacagggagtgaagttggttgtgatggatccatttacagacctgaccatcaccatgtgtattgtgctaaacactctatttatggccctggaacactacaacatgacatccgagttcgaagaaatgttacaggtcggcaatcttgtgttcaccgggatttttacagctgaaatgacgtttaaaataatcgcgctcgacccttattattattttcagcaggggtggaatattttcgactctattatagttatactgagtctaatggaactcgggctcagtcggatgtctaatctgagcgtactgcgatcttttcggctgctgagagtatttaaactggctaagtcctggccgactctgaacacactgatcaaaatcattggaaattcggtgggtgccctaggaaacctgactttggtgctcgctattatcgtgttcatatttgccgtagtaggcatgcagctctttgggaagaactattccgaactccgcgatagcgacagcggcctactaccaaggtggcatatgatggattttttccatgccttcctgataatcttcaggattctgtgcggcgagtggattgaaacaatgtgggattgcatggaagtgagcggccagagcctctgtctccttgttttcctgttggtgatggtcataggcaacttggttgtgctaaacctgtttctcgcgctgctcctctcatcattttcggccgataatttgaccgcacctgatgaggatagggagatgaacaatcttcaactcgcgctggctcgtatacaacgcggactaaggttcgtgaagcgcactacttgggacttttgctgtggtcttctccggcagcgaccccagaagccagccgctcttgctgcacaggggcagcttccctcgtgcattgcaactccttacagcccccctccgccagagaccgagaaggttcccccaacccggaaggaaactaggttcgaggagggtgagcagcccggtcaagggacacccggagaccctgagcccgtctgcgtgcccatcgcggttgctgaatccgacacagacgatcaggaggaagacgaggaaaattccctcggcacggaagaggagtcctcaaaacaggaatcacagcctgtgtcaggcggtcctgaggctccccctgactctcgcacctggagccaggtgagtgccactgccagttccgaagccgaggcctctgcctcacaagccgattggaggcagcagtggaaggcagaaccccaggcgcctggctgcggagagaccccagaggatagttgcagtgaggggtcgaccgccgacatgaccaatacggctgagctgctcgaacagatcccagatctcggtcaggatgttaaggacccagaagattgttttaccgagggctgtgttcggaggtgtccatgttgtgctgtcgacactacacaggcgccaggtaaggtatggtggcgcctaagaaaaacatgttaccatatcgtggagcactcatggtttgagacgtttatcatttttatgatcctgctgagttccggagctttggctttcgaggacatctacttggaagaacgcaagacaatcaaagtgctgcttgagtatgccgacaagatgttcacctatgtatttgtactggagatgctgctgaagtgggtggcctacgggttcaaaaaatattttacaaacgcatggtgttggctcgatttcttgatagtggatgtgtcactggtgagtctggtggctaacaccctgggctttgccgagatgggtcctattaagagcctgaggaccctgagggccctcagacctcttcgtgcgcttagtaggttcgagggcatgcgggtggtggttaacgctttggttggggcaatacccagtattatgaacgtgcttctggtctgtctgattttttggctgattttcagcattatgggggtgaacctgtttgctggcaagtttggaagatgcatcaaccaaaccgagggagatctgcctctcaactatactattgtgaacaataagtcgcagtgtgaatctctgaaccttacgggagagctatattggacaaaggtcaaggtaaactttgacaatgtcggcgctgggtacttggccttgttgcaggtggccaccttcaagggatggatggacatcatgtacgccgcagtggacagccgtggttatgaggaacagccccagtgggagtacaatttgtacatgtacatttactttgtgatattcattatctttggatccttctttaccctgaacctgttcatcggtgtgattattgataatttcaatcagcaaaagaagaaactggggggacaggacattttcatgactgaggagcagaagaagtactataatgctatgaaaaagctgggatctaagaaaccccagaagcctattccacggcctctcaataagtaccaagggttcatcttcgatatagtcaccaagcaggcctttgacgttacgatcatgtttttaatctgtctcaatatggttacaatgatggttgagacagacgaccagtctcctgaaaagataaatatactcgccaagattaacctcctcttcgtggccattttcaccggagagtgcattgttaagctggcagcactccgccactactacttcactaatagttggaacatttttgacttcgtagtggtgattctgtctatcgtcggcacagtactatccgacattattcagaaatacttcttctctcccaccctgtttcgcgtcatcagattggcccgaatcggcagaatcttacgactgattaggggagccaagggaatccgaacattgttgtttgctttgatgatgtcactgccagctctttttaacatcgggttattactgtttcttgtgatgttcatatattccattttcggcatggctaattttgcatacgtgaaatgggaagctggtatcgatgacatgttcaacttccaaacatttgcaaattccatgctctgcctatttcaaataacaactagcgctgggtgggacggtctcttgtctcctattctgaacactggcccaccctactgcgaccctactctacccaactccaatggaagcagaggagactgtggctcccctgcagtgggcattctcttctttacgacatacatcattattagctttcttatcgtggtgaacatgtatatcgctataatcctggaaaacttctccgtggcgacggaggaatcaaccgagcctttatctgaggacgatttcgatatgttttatgagatctgggaaaagtttgatcccgaggctacgcaattcatcgagtattcagtgctctccgattttgctgacgccctctctgaacctttgcggatagctaaacccaaccaaatctcactgataaacatggacctaccaatggtttctggcgatcgaatccattgtatggatatcctctttgccttcactaaaagggtgcttggagaatctggtgaaatggatgctcttaagatacagatggaagagaaatttatggctgctaacccgtccaagatctcttatgagcctatcacaactacgttaaggaggaaacacgaagaggttagtgcgatggtcattcagcgggcattcagaaggcatttgctccagcgctccctaaagcacgcgagctttctctttaggcagcaggctggaagcggcctgtctgaagaagacgccccagaacgggagggccttatcgcatatgtgatgtcagagaactttagtcgccctctcggccctccttcctcatcctccatatcttctacaagcttccctcccagctacgacagcgtgaccagagcaactagcgacaatctccaggttagaggaagcgactacagtcattctgaagatctcgcggattttccgccttctcccgatcgagatagggaatcgatcgtata

SEQ ID NO: 240911 - DNA, 5888 bp, Artificial Sequence
  Description of Artificial Sequence: Synthetic coding sequence
atggctaatttcctgctgccaagaggcacaagctccttccgtcgcttcaccagggaatcgctcgcagccatagagaagagaatggctgaaaaacaggccagaggttctaccactctgcaggaatctcgtgagggtcttcccgaagaagaagctcctcgcccacagcttgacctccaagcctccaagaagttaccagatttgtacgggaacccaccccaggagcttattggggagccattggaagacttagatccattctacagcactcagaagaccttcattgtcctgaacaaagggaaaactattttccgatttagcgccaccaatgccctgtacgtgctctcgccttttcatcctatcaggagggctgccgtcaagatcctggtccattcgctttttaacatgctaattatgtgcaccattcttacaaattgcgtctttatggcacagcacgatccccctccctggactaagtacgtggagtataccttcaccgctatttacacattcgaatccctggttaaaatcttggcccgaggcttctgcctccacgcctttacgttcctgagagatccttggaactggttagatttcagcgtgatcataatggcctataccaccgagttcgtggatcttgggaacgtgagcgcccttcgtacctttagggtgctcagagcattgaagactatcagcgttatcagcggacttaaaaccattgtgggtgcattgattcaaagtgtgaaaaaactggctgatgtaatggtgctgaccgttttctgtctcagcgtctttgctcttattggcctccagctctttatgggaaacctgcgccataagtgtgtaaggaatttcaccgcattgaacggaaccaatggttccgttgaggccgacggcctagtgtgggaatctctcgacctttatttgtcagacccagagaattacttgcttaagaacgggacaagcgacgtgttgctatgcgggaactcgtctgatgccggaacatgcccagagggctatcggtgccttaaggcaggcgaaaatcccgatcatggatacacaagctttgattcttttgcctgggcattcctggctttgtttaggctgatgacccaggactgctgggagagactgtaccagcagacgctgcgtagtgcaggaaagatttacatgatcttctttatgctggtgatttttctgggatctttttacctggtgaacctgatccttgcggtggtcgcaatggcttatgaggaacagaatcaggcaacaatcgcagaaacagaggagaaggagaagcggttccaagaggccatggaaatgctaaaaaaagagcacgaggcactgactatcaggggggtcgataccgtttctcggtccagcctggaaatgtccccactagcgccagtgaattcccatgaaagacggagtaagcgtaggaagaggatgtctagcggcaccgaagagtgcggcgaggacaggctcccaaagagtgatagcgaggacgggcctagggcgatgaaccatttaagtttgaccagaggactgtcacggacaagcatgaaacccaggtcttcgagagggagtatattcacctttcgcaggagggatctcggatcggaagctgactttgctgatgacgagaacagtaccgcaggagaaagcgaaagccaccatacgagtctcctcgttccctggccccttcgacggaccagcgctcagggccaacccagtccgggaacttctgcacctggacacgccctgcacgggaaaaaaaattctacggtcgattgtaacggcgtagtgtctctgctgggcgctggcgatcccgaagcaacttctccaggatcccatttgctgcgcccagtcatgctagagcacccgcctgacactaccaccccaagtgaggaacccggtggacctcagatgcttacaagtcaggcaccatgtgttgatggcttcgaggagccaggggcacgccagcgagccttgtcagcagtgagcgtgctcactagtgccctcgaagaactggaggagtcccgccacaaatgccctccttgttggaatcgcctggcccagagatatctcatatgggaatgttgccccctctggatgtcgatcaagcagggcgtaaagctggtggttatggacccgttcactgacctcactattacgatgtgcatcgtgctgaacaccctttttatggcattagaacactacaatatgacttctgaattcgaggaaatgttgcaggtcggtaatctggtgtttacggggatatttaccgccgagatgaccttcaagattatcgctctcgacccatattactacttccaacaggggtggaatatcttcgacagcatcattgttatactgtctctaatggagttgggacttagcaggatgagcaatctgagtgtgctgaggagttttcggttgctacgggtgtttaagctggccaagtcttggcccactctgaatacactgattaagattattggcaactccgtgggtgccctgggcaatctgaccctcgtactggccatcatcgtcttcatctttgccgtggtaggcatgcagctcttcggcaaaaactacagtgagctgagagattctgattctggtctgcttccacgttggcacatgatggatttttttcatgcattcctgattatctttaggatactgtgtggggaatggatcgagacaatgtgggattgtatggaggtgagcgggcagagcctttgtttgctcgtttttctgctcgtgatggttatagggaatctcgtggtcctgaatcttttcctggcattgctgctgtcaagcttctcagccgataacctgactgcacctgacgaagacagggaaatgaacaacctgcaattagctctggcaaggattcagagagggcttagattcgtcaaacgaaccacttgggacttctgttgtggactcttgaggcaaagacctcagaaacccgcagcgttggctgctcagggacaattaccttcctgcatcgccactccttatagccccccaccgcctgagactgaaaaggttcccccaacacgaaaagaaacgaggttcgaagagggcgagcagcccggacaaggaacgcctggagaccctgagcccgtttgtgtcccaattgcagttgcagagtcagacaccgacgaccaggaggaggacgaagaaaatagtctaggcaccgaagaagaatcaagtaagcaaacaccagaggattcgtgtagcgaaggatctaccgctgacatgacaaacacggctgagttattggagcagatccccgatctgggacaggacgttaaagatcctgaggattgtttcaccgaaggatgcgtgagacggtgtccctgttgcgctgttgataccacacaggcacctggtaaagtctggtggcgcctcaggaaaacgtgctaccacatcgtggagcactcgtggttcgagacctttatcatattcatgatcctattatcaagcggtgcccttgcgtttgaggacatttatctagaggaaaggaagacgatcaaagtactgttggaatacgccgataagatgtttacctacgtgttcgtgctcgagatgcttcttaagtgggttgcatatgggttcaagaagtatttcacaaatgcctggtgctggcttgatttcctgatcgtcgacgtgagtctggtttctctcgtcgctaacaccctggggtttgctgagatggggcctatcaaatccctccggaccctgcgggcattgaggcccctgagagcactgagcaggtttgagggcatgcgtgtagtggtcaacgccttagtaggggctatacctagcatcatgaacgttttgttagtttgtcttattttttggcttattttttctataatgggcgtgaatttgttcgcgggaaaatttggacgctgcatcaatcagacagagggcgatctgccgcttaattatactattgtcaataataagagccagtgcgagagcctcaaccttaccggggaactctactggaccaaagtgaaagttaatttcgacaacgttggagctggctatctcgctcttttgcaagtggccacattcaaaggctggatggatattatgtacgcggcagtggactcaagggggtacgaagaacagccacagtgggagtataatctgtatatgtatatctatttcgtgattttcataatatttggttcctttttcaccctaaacctgttcatcggcgtgataatcgataactttaatcagcagaaaaagaagctcggcggacaggatatatttatgaccgaggagcagaagaaatattacaacgcaatgaagaagctcggatcaaaaaaacctcagaagcccatcccaaggccacttaacaagtaccagggtttcatttttgacatcgttacgaagcaggccttcgacgtaacaattatgttcctgatatgcctaaatatggtgaccatgatggtcgagactgacgaccagagtcccgagaaaattaacatacttgccaagatcaacttgctcttcgtggctattttcacaggtgaatgcatcgtgaagctagccgctctccgacattattattttacaaattcttggaatattttcgacttcgttgtcgtgatcctctctattgtgggtaccgtgttatcagatataatccaaaaatatttcttttcccctaccctcttccgcgtgatcagactggctcgaataggtagaatactcagactgatacggggtgctaagggcattcgaacactactgttcgccctgatgatgtctctgcctgctctattcaatatcggactgctgctgtttctcgtcatgtttatttactcaatctttggcatggccaacttcgcttacgtcaaatgggaggccggtattgacgacatgttcaacttccagactttcgccaacagcatgctgtgtctgtttcagatcacaacgtcagccggttgggacggtctgctctcaccaattctaaatacagggcctccctactgtgatcctacgctcccaaactctaacggcagcaggggcgactgtggaagtcccgcagtggggatattgtttttcaccacatatatcatcatctcattccttattgtcgtgaatatgtacatagccatcatactggaaaactttagcgttgccaccgaggagagcaccgagcccctgagtgaagatgacttcgacatgttctacgaaatctgggaaaagttcgatcctgaagcaacacaattcattgaatatagtgtgctgtctgactttgcagatgcactcagtgagccattgagaatcgccaagccgaatcagatcagtcttattaacatggatctgccaatggtctctggggaccgaatccactgcatggatatccttttcgctttcacaaagcgggtactgggagagtctggagagatggatgctctcaagatccaaatggaggaaaagttcatggccgcaaatccaagtaagatctcctacgagcctattacaactaccctccgacgaaaacatgaggaggttagcgctatggtcattcagcgcgcattcagaaggcaccttctgcagcgatccttaaaacacgcctcattcctgtttcgccagcaggccggttctgggctgtcagaggaggacgcacctgaacgggaggggctgatagcatacgttatgagcgaaaacttctcccgcccactggggccaccgtctagctcctcaattagctcaacttcctttcccccatcgtacgactccgttacgagagccactagtgataacctccaggtgcgaggtagcgactactctcatagtgaagatctagcagacttccctcccagccccgatagggatagagaatccatcgtata

SEQ ID NO: 240912 - DNA, 5888 bp, Artificial Sequence
  Description of Artificial Sequence: Synthetic coding sequence
atggccaacttcctcctcccacgaggtactagttcctttcggagattcacccgagagagtctggccgcaatcgagaagaggatggccgagaagcaggccagaggatccacgaccttgcaggagtcacgagaaggtctccccgaagaagaagcccctaggccacagttagatttacaggcttccaaaaagttgccagatttgtacggcaatccaccgcaggaactgattggcgagcctctcgaagacctggaccctttttactcaacccagaagacattcatagttttgaacaaaggtaaaaccattttcagattcagtgcaacgaatgccctgtatgttctttcgccattccatccaatcagacgagcagccgtcaagatattggtgcatagcttatttaacatgctaatcatgtgtaccatcctcacaaactgtgtgtttatggcacagcacgacccaccaccttggacgaaatacgtggagtacacatttactgctatatacacctttgagtctcttgtgaagatcttggcacggggtttttgtctacacgcattcacctttctgagggatccttggaattggctcgatttttcggtgattatcatggcatatgtctctgagaacattaaactgggcaacttaagcgctctgcgtacgttccgtgtgctgagggcccttaagaccattagtgtgatccctggtcttaaaaccatagtcggtgcattaatacagagcgttaaaaaattggcagacgttatggtcttgacagttttttgtctgtccgtgttcgctcttattgggctgcagctgttcatgggcaacctgaggcacaaatgtgtccgaaattttaccgccctgaacggcaccaacggatcggttgaagctgacggtctggtctgggaatcgcttgacctgtacctctctgatcccgagaactatctgttgaagaatggaacctctgatgtgctgctctgcgggaactcctcggacgccggtacttgtcctgaggggtacagatgcctcaaagctggagagaacccagaccacgggtacacatcatttgatagtttcgcttgggccttcctggcgctctttaggttaatgactcaagattgttgggaaaggctttatcagcagaccttaaggagcgccggaaaaatctatatgatcttttttatgttagttatttttctggggtcattttatctcgtgaacctgattctcgccgtcgtggctatggcctatgaggagcagaatcaggcaacaatcgctgagactgaggagaaggagaaacgctttcaggaagcaatggagatgctgaagaaggagcatgaagctttgacaataaggggggtggacacggtgtcccgctcatctctggagatgtcccctctggctcctgttaactcgcacgaacgacggtctaagcggaggaagcgcatgagcagtggaaccgaggagtgcggagaagatcgcctgccaaaaagcgactccgaagacggcccaagagcaatgaaccacctttccctcacacgcggactgtcgcggaccagcatgaagccccgttcatctcgagggtccatttttacctttcgtaggcgagacctcggctccgaggctgattttgccgacgatgagaatagtacagccggagagtcggaatctcatcacacatccctgctcgtcccatggcccttaagaagaacatcggctcagggtcagccaagccccggaacttcagcacccggacacgcgttgcatgggaagaaaaattcaactgttgattgtaacggagtggtctccctactcggagctggtgaccctgaagccacatctccgggttctcacctgctaagacccgtgatgctcgaacacccccctgacaccaccactccaagtgaggagcctggtggcccacagatgttgaccagtcaagccccatgcgtggatggattcgaggagccaggtgccaggcaaagagccctgtcagccgtcagtgttcttacttccgccctggaggaactggaagagtcaaggcacaaatgcccaccgtgctggaatagactggcccagcgatatctgatatgggaatgctgtcccctttggatgagcatcaagcaaggcgtgaagctggtggtgatggacccgttcaccgacttgacaattactatgtgcatagtattgaataccctctttatggccttggagcactataacatgacgagcgagtttgaagagatgctgcaggtcggcaatctggtcttcactgggatttttactgcagaaatgaccttcaagatcattgctttagatccctattattatttccaacaagggtggaacatcttcgactccattatcgtgatactttcactgatggaactcggactgtcccgaatgtcgaatctgagcgtgctccgctcatttaggctgctaagagtttttaagttggcgaaaagttggcccaccctgaacacactgatcaagataattgggaattccgtaggcgcactggggaacctcacactggttctggccattatcgtcttcatcttcgccgtcgtgggaatgcagttgttcggtaagaattactccgagctgcgcgatagtgacagcgggctcctgccgagatggcatatgatggactttttccatgcttttcttattatatttaggattctgtgtggcgaatggattgaaactatgtgggattgcatggaggtcagcggccaaagcttgtgtcttctggtgtttctgttggtcatggtcatcggcaacttggtggttctgaatctcttcctggccttgctgctgtccagtttctccgccgataacttgaccgctccggacgaggaccgagaaatgaacaacctccagctggcattagcacgaattcagcggggactgaggttcgtcaagagaactacctgggacttctgctgcggcctgctgcgacagcgaccccaaaagccggctgccctggccgctcagggtcaactgccttcttgtatagcaactccatacagtcctcctccacccgagacggaaaaggtgcctcctacacgcaaggaaaccaggttcgaagagggagaacagcccggtcaggggacccccggagatcccgaacccgtgtgcgtccctattgctgtggcagagagcgacacagatgaccaggaagaggacgaggagaacagcctggggactgaggaggaaagctcaaagcagactcccgaggactcttgcagcgaagggtccaccgctgacatgacaaacaccgcagaactcctagagcaaattccagatctggggcaagacgtgaaagatcccgaagattgctttacagagggatgcgtgcgtagatgtccatgttgtgctgtggataccacacaagcccctgggaaagtctggtggcgtctccgcaagacctgctaccacatagttgagcatagctggttcgagacctttattatcttcatgatcctgctctccagtggcgcactggcatttgaagatatctacctcgaggaacgtaaaactataaaggtcctgctggaatacgctgataaaatgttcacttacgttttcgtgcttgaaatgttgctcaaatgggtggcctatggattcaagaaatacttcaccaatgcttggtgttggcttgatttcctaatcgttgatgtctctcttgtgtctctcgtggcgaatactctgggttttgcagaaatgggtcccatcaaaagtctaagaactttgcgagctctccggccactcagagccctgagtcggttcgagggaatgagggtcgtggtcaatgcattggtaggagcaatcccctctatcatgaatgtgctactggtgtgccttatcttctggctaatattctccatcatgggtgtgaatctgttcgctgggaagtttgggagatgcataaatcagacggaaggtgatctcccactgaactacacaatcgtaaataataaaagtcaatgcgagtccctcaatctgacgggcgaactgtactggacgaaagttaaggtgaactttgacaacgttggcgcaggctatctcgctttgctgcaggtggccaccttcaagggatggatggacattatgtacgccgctgtcgacagtcggggttatgaggaacaaccgcaatgggagtataatttatatatgtacatatacttcgtaatttttattatcttcggatctttttttactctgaacctgttcattggggttatcattgacaacttcaaccagcagaaaaaaaaattaggaggacaggacatattcatgacagaggaacaaaagaaatattacaacgctatgaagaagctgggcagtaaaaagccccagaaaccgatccccaggcctctgaataagtatcagggcttcatttttgatatcgtgacaaaacaggcattcgacgtcaccattatgttcctaatctgtctgaacatggtgaccatgatggtggaaaccgacgaccaaagtcctgagaagatcaatattttagctaagatcaatctgctctttgtggctattttcacgggagagtgcatagtgaaattggcggcactgcggcactactatttcaccaacagctggaatattttcgatttcgtcgtggttatcctgagcatcgtcgggactgtgctatccgacattattcagaaatacttctttagtccaacactgttcagagtaataagactggcgagaattggccgaatcttaagattgattcggggagcaaaggggatccggactctcctgttcgccctgatgatgtccctgccagctctgttcaatatcggcctgctgctgttcttggtaatgtttatctactcaatttttggtatggctaattttgcttatgtgaaatgggaagctggtatcgatgacatgtttaactttcagacttttgctaacagcatgttgtgcctgttccaaattacaaccagcgccggttgggatgggcttctgtcgcctattctgaatacgggtcctccttattgtgaccctaccctacccaatagcaacggatcgagaggtgactgcggcagtcctgctgtaggcatcctcttcttcaccacatatatcattatctcatttttaattgtcgtgaacatgtatatcgcaatcatcctggaaaatttctccgttgccaccgaggagtcgactgaaccgctgtccgaagatgacttcgacatgttttacgaaatctgggaaaaattcgatcctgaggcaacacagttcattgaatattcggtactgagtgacttcgctgacgcactgtcggaaccgctgaggatcgctaagccgaaccagattagcctgattaacatggatcttcccatggtcagtggagaccgcattcattgcatggacatactgttcgccttcacgaaaagggtgctcggtgaatctggggagatggatgccctgaagatccagatggaagagaaatttatggctgccaatccaagcaaaatctcttacgagccaataactacgacactgagacgcaagcacgaggaggtcagcgcaatggttattcagagggccttccgcagacatctgttacagcgaagcttaaagcacgccagtttccttttccgtcagcaagctggttctgggctttctgaggaagacgctcctgagagagaggggctgatcgcctacgtaatgtcagagaattttagccgacccctgggcccaccctcaagcagctccatctcctcgacctccttccccccatcatatgactctgttacccgagctacaagcgacaatctgcaggttcggggtagcgactacagtcattcagaggacctggctgactttcccccttcccctgatagggatcgggagtctatcgtata

SEQ ID NO: 240913 - DNA, 5888 bp, Artificial Sequence
  Description of Artificial Sequence: Synthetic coding sequence
atggccaacttcctactgccaaggggcacatcctcctttcgccgtttcacgcgtgagtctctggctgccatcgagaagcggatggccgagaagcaggctcgaggatccacgactctgcaagagagccgcgaaggtctgccagaagaggaggcaccacgcccacaactggacctgcaagcatccaagaagctgcctgatctctacggaaaccctccccaggagcttatcggggagccgttagaggacctcgaccctttctacagcactcagaagactttcatcgttttgaataagggcaaaaccatattccgcttcagtgcaaccaacgccctctacgtattgagtcccttccatccaattcggagggctgcagtgaagattttggtccattccctgtttaatatgctgatcatgtgcactatcctcacgaattgtgtcttcatggcacagcatgatccaccaccatggaccaagtacgtcgaatacacctttacagcaatctacaccttcgaaagcttggtcaagatcttggcccgagggttctgtctccacgcttttaccttcctgagggacccctggaactggttagactttagtgtgatcatcatggcttacgtgtcagaaaacattaagctgggtaacctcagcgctctccgaactttccgggtgctcagggctctgaagactattagcgttatccccggtctgaagactattgtgggggcactcatccagagcgtcaaaaagttggcagacgttatggtgctgacggtgttctgtctgagcgttttcgcgctcatcggactacagcttttcatgggcaacctgagacacaagtgcgtaaggaacttcacagcactgaacggcaccaatgggagcgtcgaagcagacggccttgtgtgggagagcctcgacttatatttaagcgacccggagaactacctgttgaaaaacgggaccagcgacgtgctattgtgtgggaattcaagcgatgcaggcacatgtcctgaaggatatcgttgcctgaaggctggagaaaaccccgatcacgggtataccagtttcgatagttttgcttgggcttttcttgcgttgttccgactcatgacccaggactgctgggaaaggctgtaccagcagaccctgagatctgccggtaagatttacatgattttctttatgctggttatctttttaggctctttctatctggtaaatctcatccttgcggtagtcgcaatggcctacgaagaacagaatcaagctactatagcagagactgaggagaaggagaagcggttccaggaagccatggagatgctgaaaaaggaacatgaagccctcacaattcggggtgtggatacggtaagcaggagtagcctcgaaatgtcccctttagccccagtgaacagccatgagcgccgtagcaaacggagaaaacgaatgagttctggcacggaggaatgtggggaagatcggcttccgaagtctgactctgaggacggacccagggccatgaaccacctctcacttacacggggactgagccgcacctcaatgaagcccagatcctctcgcggttcaattttcacgttcaggagaagggacttgggcagcgaagctgatttcgccgacgacgaaaacagcacagctggagagtccgaatcgcaccacacaagcctgttggtgccttggccgctgcggcgtacctcggcccagggacagccttcccccggaacctccgcccctggtcacgctctccacggcaagaagaattccactgttgactgcaacggtgtcgttagcttgctgggcgctggagaccccgaggccacttctcccggttcacacctgcttcgtcccgtcatgctagagcaccccccagacaccaccacaccttccgaagagcccggtgggccacagatgctgacatcacaggcaccgtgtgtagacggctttgaggagcctggtgcgcgtcagagggcactttccgccgtgtccgtgcttacatcggctctcgaggagctcgaagagtctaggcacaagtgtcccccttgctggaatcgcctcgcacagagatatctcatttgggaatgttgccctctgtggatgagcatcaagcagggtgtcaagctggtcgtgatggatccctttactgatctcacaatcactatgtgcattgtactcaatacactgttcatggccttggagcactataacatgacgtccgagtttgaagagatgctgcaggttggcaatctggtgttcactggtatctttactgccgagatgactttcaagatcatcgccttggacccctactattacttccaacaaggatggaacatttttgacagtatcatcgtgattctgtctctaatggagctcgggctctccagaatgagcaacctcagcgttctgcgatcctttagactgctccgagtgttcaaattggccaaaagctggccaaccttgaacactctgattaagattattggcaactccgtcggtgcgctcggtaacctgacgcttgtgctcgcaattatcgtctttatcttcgctgtggtcggcatgcagttatttggcaagaattatagcgagctcagagacagtgacagcggattactccctcgctggcatatgatggactttttccatgctttcctgatcattttcaggatattgtgtggagaatggattgagacgatgtgggattgcatggaagtgagcggacagtccctttgtctgctagtcttcctcctcgtgatggtgatcggaaacctagtggttctgaatcttttcctggctctcctgctttcttcgttcagcgccgacaatttgaccgccccagacgaggacagagagatgaataaccttcagttagctctggcccgaattcagcgaggactgcgctttgtgaaacgtactacatgggacttttgctgtgggctcttacggcagagacctcagaaacccgctgccctggctgctcaggggcagctgcccagttgcatcgctaccccatatagtcctccaccgcctgagacagagaaagtacctcccacccgtaaggagacacggttcgaagagggggaacagccagggcagggtaccccgggagatcccgaaccagtgtgtgtgccgatcgcggtggccgagagtgatacagacgaccaggaggaagatgaagagaattctctgggcactgaggaggagagttctaaacaaacgcctgaggactcttgtagtgaaggtagcaccgctgacatgaccaacaccgctgaactgctggagcagatcccagatctcggccaggatgtgaaggatcctgaggattgttttaccgagggttgtgtgagacggtgtccatgctgcgctgtggacaccacccaggcaccagggaaggtgtggtggaggctgaggaagacttgctaccatatcgttgaacatagttggttcgagacattcatcatcttcatgatcttgcttagcagcggcgctctggccttcgaggatatataccttgaggagcgaaagactatcaaagtgctactagaatatgcggataagatgttcacgtacgtgtttgtccttgaaatgcttcttaagtgggttgcatatggatttaaaaagtacttcacaaatgcgtggtgttggttggactttctcatcgtagatgtgtcactggtcagtctagtggctaatactctcggctttgcggaaatgggccctattaaaagtctgaggacgctccgtgcactgcgtcccctacgagccctctctcggttcgagggcatgagagtcgtggttaatgctctggtgggagctatacctagcattatgaacgtattgcttgtctgccttattttttggctgattttctctataatgggagtgaatctgttcgcaggtaaattcgggaggtgcattaaccagacagaaggagacctgcccctcaattatactattgtcaacaataaatctcagtgtgaatcattgaatttgacaggggagctatactggactaaagtgaaagttaacttcgacaatgtgggagctggttacctagctctgcttcaggtggccacattcaagggctggatggacatcatgtatgcagcagtggatagcaggggatacgaggagcagccccagtgggaatacaacctgtatatgtacatttatttcgtgatattcatcatttttggaagttttttcactttgaatcttttcatcggggtgatcattgacaacttcaatcagcaaaagaaaaaactgggcggacaggacatctttatgactgaggagcagaaaaaatactacaacgccatgaaaaagctgggaagcaaaaagccgcagaagcctataccacgcccactgaataaatatcaaggcttcatcttcgatattgtgacgaaacaggcgttcgacgtcacgataatgttcctcatatgtcttaacatggtgacaatgatggtggaaactgacgaccagtcacccgaaaaaatcaacattctcgcaaagattaacctgctctttgtagcaatctttactggggagtgcatcgtgaagctcgcagcactcaggcactactacttcactaactcatggaacatctttgatttcgttgttgtcatcctgtctatcgtgggtactgttttatctgatattatacaaaagtacttttttagtccaaccttgttccgtgtgattcgcctcgctaggattgggcgtattctgcggctcatcagaggagccaagggcattcggaccttgcttttcgcactcatgatgtctttaccagcgctctttaatatcgggttactgttgtttcttgtcatgtttatttacagtatcttcggtatggctaattttgcctatgtgaaatgggaagctgggatagatgacatgtttaactttcagactttcgcaaatagcatgctttgcctgttccaaattacaacgagcgcgggttgggatggccttctgtcccctatactcaacacaggaccaccctattgcgaccctaccctgccaaatagtaacggaagcaggggggactgcggatcccctgccgtgggtatcctctttttcactacctatatcattatctcttttctcatcgtggtgaacatgtatattgcgattatcctcgagaacttctccgtcgcgacagaagaatccacggaaccactgtccgaggatgatttcgacatgttctatgagatttgggagaagtttgaccccgaagccacccaatttattgagtattctgtgctgtctgattttgcggacgctctctctgagcccctgaggattgcaaagccaaaccagatttctttgatcaatatggatctgccaatggtgagcggggacagaatccactgtatggatatcctctttgcttttaccaaacgggtgctgggcgagtctggtgaaatggacgctctgaagattcagatggaggagaaattcatggctgctaatccatctaaaatatcatacgagccaattacaacgactctcaggagaaagcatgaagaggtgtccgccatggtcatccagcgggcatttcgaagacatttactccaaagatcgttgaaacatgcgtcattcctttttcgacagcaagccggaagtgggttgtcagaagaggacgccccagagcgggagggcctaatcgcatacgttatgagtgagaattttagccgacctctcggccctccttcgtccagctcaatttcgagtaccagcttccccccaagttacgattctgtcactagggctacatcggacaatttgcaagtgagggggtcagactacagccattcagaagacctggccgatttcccaccgtctcccgacagagaccgcgagtccatagtgta

SEQ ID NO: 240914 - DNA, 5951 bp, Artificial Sequence
  Description of Artificial Sequence: Synthetic coding sequence
atggccaactttctgctccctcgagggacttcttctttcaggcggtttacccgggaatctttggcagccatcgagaaacggatggccgaaaagcaagcacgcggatcaacaacactacaggaatcaagagagggccttcctgaagaagaggcccctcggcctcagctggatcttcaggcttccaaaaaactccctgatctctacggcaacccccctcaggagctcatcggcgaacccttggaagatctcgatccattttatagcacccagaagacttttatcgttctgaacaaagggaaaactatcttccgcttctcagcaacaaatgctttgtacgtgctctccccttttcaccctatcagacgggctgctgtcaagatccttgtccatagtctgttcaatatgctcatcatgtgcactattctgactaattgtgtgttcatggctcagcacgacccgccaccctggactaagtacgtcgagtatactttcaccgctatatataccttcgaaagcctcgtgaagatcctggcccgaggcttctgtctgcacgcgtttacttttctcagggatccctggaactggttggatttctctgttatcataatggcttacgtgagcgaaaacataaagctgggcaatttgtctgccctgagaaccttcagagttctgcgggctctgaagaccatctctgtaatcccagggctgaaaaccatagtgggcgctttgatccagtcagtgaagaaattggctgacgtcatggtgctcacggtgttctgcctttctgtgttcgctcttatcggcctgcagctctttatgggcaatctgaggcacaaatgtgtgcggaattttaccgcgttgaatgggacaaatggctctgtagaggccgacggccttgtctgggagtccttggatctgtacctgagcgacccagagaactatctcctgaaaaatggcacttccgatgtgctgctgtgtgggaactcaagcgatgcaggtacctgtcccgagggatatagatgtttaaaagcaggcgaaaatcccgatcacggatacacatcctttgactctttcgcatgggccttcctagccttgttccgtttaatgacacaggattgctgggaacggctgtaccagcaaacgttgaggtccgcaggaaagatctacatgatctttttcatgctggtcatcttcctgggctctttctacctggtgaatttgatcctagctgtagttgctatggcatacgaggagcagaaccaggccaccattgctgagacagaagagaaggagaaacggtttcaagaagctatggagatgctgaaaaaggagcacgaagctttgactatccgcggagtagacactgtgtccaggtcctcactagaaatgtctccgctagctcctgtcaacagtcatgaacgcaggagcaaaaggaggaaacgcatgtccagcggcacggaggagtgtggcgaagataggctccctaaatccgatagtgaagacgggcctagggccatgaaccacttgtctctgacccgcggactgtcccgaacatctatgaagcctcgatcctctcgcggttctatttttacattcaggcgcagggacctaggcagcgaagcggactttgcggacgatgagaattctaccgccggagaatcagaatctcaccatacatcgctgctggtcccatggcccctgcgcaggaccagtgctcaaggccagccctctcccggaacaagcgctcccggacatgccctgcatggaaaaaagaacagcacagtggactgcaacggagtggtgtccctcttgggggctggggaccccgaggccacctctccaggttcacacctcctaaggccggtgatgcttgagcatccccctgacactaccacgccctcagaagaacctggaggtccacagatgctaactagtcaagcgccatgcgtggacggattcgaagaacctggtgccagacagcgggctctgtctgcggtgtcagttctaacaagcgctcttgaagaattagaagagtctcgccacaaatgtccaccatgttggaataggttagcacagcgctacctaatatgggaatgctgccccttgtggatgagcattaaacagggggtgaagctggtcgtgatggatccatttactgacttaacgataactatgtgcatagtgctcaacacccttttcatggccctggagcactacaatatgacaagtgaatttgaggagatgctgcaggtgggcaacttagtgtttactgggatcttcaccgccgagatgacatttaaaatcatcgcgctggacccttattactattttcagcaaggctggaacatcttcgattcaataattgtgatactttccctcatggagctcgggttatcacggatgtcaaatttgtccgtgctacggagcttcagactcctcagggtgttcaaattggccaagtcatggcccactctgaatactctcataaagatcattggaaattcagtgggggcactagggaacctcacccttgtgctggctatcattgtttttatcttcgctgtagtggggatgcagctcttcggtaaaaattattctgaactgcgtgactctgacagcgggctactgccacgctggcacatgatggatttcttccatgcattcctgataattttcagaatcttatgtggggagtggattgagactatgtgggattgtatggaggtttctggccagagcctatgcctgctggtgttccttctggtgatggtgattggcaatttagtagtgttgaacttgttcctcgcactactcctgtcctccttcagcgccgacaatctgacagctccagatgaggacagagagatgaataatcttcagcttgccttagccagaatccaacggggactgcggttcgtgaaacgcaccacctgggacttctgttgcggcctgctccggcaacgaccacaaaagcccgctgccttggccgctcaaggccagctccctagctgcattgcaaccccatattctccgcctccaccagagacagagaaggtgcccccaactcggaaagagactagattcgaggagggagaacaacccggtcagggcaccccaggagatccggaacctgtttgtgtgcctattgccgtggccgagtctgacaccgacgaccaggaagaggacgaggaaaattctctcggaactgaagaggaatcgagcaaacaagagagccagcctgtctccggtggaccagaagcaccccctgattcccgcacatggtcacaggtgtctgcgaccgccagctcagaggccgaagcatcggcaagccaagctgattggcgccagcagtggaaagcagagcctcaggccccaggctgcggtgaaactcccgaggatagctgctctgaagggagcactgccgacatgaccaataccgccgagctcttggaacaaataccagatttgggacaggatgttaaggacccagaggactgttttacagagggctgcgtgaggagatgcccttgctgtgctgtagatacaacccaggcaccaggcaaagtctggtggcgcttgcgcaagacttgctatcacatagtggagcacagctggttcgagacctttatcatttttatgatcttgctgagtagtggtgcccttgcgttcgaggacatatatctcgaagagagaaaaacaatcaaagtattactggaatatgctgacaaaatgttcacatatgtattcgtgctcgaaatgctgctaaagtgggtagcctacggctttaaaaaatacttcactaatgcctggtgttggctggacttccttatcgtggatgtgtcccttgtctcgttagtagctaacacactgggatttgccgagatgggaccaataaagagtctgagaacactgcgtgccctccgaccactgagggccctctcaaggttcgaaggcatgcgagtggtagtaaacgcgttagtcggcgctattccatccattatgaatgtgctcctagtctgccttatcttttggctgattttcagtataatgggtgtgaacctctttgcgggaaagttcgggagatgtatcaaccagaccgagggtgacctaccactcaactatacaatcgttaataataagtctcagtgtgaatctcttaatctgacaggcgagttatactggactaaggtcaaggtcaatttcgacaatgtgggagcaggatacctggccctcctccaagtggcgacttttaaggggtggatggacattatgtacgcagccgttgatagtagaggatatgaggagcagccacagtgggagtacaacctgtatatgtatatctacttcgttatattcataatctttggcagcttcttcaccttgaatctgtttattggagtcatcatagacaactttaatcagcagaaaaaaaagcttggaggccaggacatcttcatgaccgaggaacaaaagaagtattataatgcgatgaagaagctcgggtcaaagaagccacagaaacccatccctcgacccttgaacaaatatcagggctttattttcgacatcgtgacaaaacaggcattcgacgtgaccattatgttccttatttgcttgaatatggtaaccatgatggtggagactgatgaccagagcccagaaaaaatcaacatcctcgctaaaattaacctactcttcgtcgccattttcacaggtacagtgctctctgacataattcagaagtatttcttctctcctactctcttcagagtgattcggctcgccagaattgggagaatcctccggcttatacggggtgcaaaagggattcgtactctgctgtttgctttgatgatgtcactgcccgcactgttcaacattggactgctgttatttttggtgatgttcatatatagcatctttggcatggcaaacttcgcctatgtgaaatgggaggcaggcatcgatgatatgtttaatttccagacctttgccaattctatgctgtgcctgtttcagattactacatctgcgggttgggacgggctcttgtctcccatcctaaacacaggcccaccctattgcgaccccacattacccaacagtaatgggagccgaggcgactgtgggagtcctgcggtgggaattctgttcttcactacgtacataatcatttcttttctgattgtggtgaatatgtacatagcaatcattctcgagaacttctcagtagcaacagaggagagtaccgagccactgtcagaagatgattttgatatgttttatgagatctgggagaaatttgatccagaagctactcaatttatagagtatagtgttctgtccgactttgcagacgccctgtctgaaccactgcggatcgcaaagcctaaccaaatcagcctgattaatatggatctgcccatggtcagtggcgatcgcattcactgtatggatattctctttgcctttacgaagagagtgctgggtgagagcggcgagatggacgcactgaagattcaaatggaagaaaagtttatggcggcaaatccaagtaagatctcttacgagcccattactaccaccttgcggagaaaacatgaagaggtatccgctatggtaatccagagggctttccgacggcacttgctgcaacggagtctgaagcatgcatccttcctgtttaggcagcaggctgggtccgggctcagcgaagaagatgctccagaacgggaaggcctcattgcctacgtcatgtcagaaaatttctccaggcctcttggaccaccgagttctagcagtatatcaagcacatctttccccccttcctatgactcagtcacacgggcaaccagtgacaatctccaagtgcggggttccgattattcacatagtgaggacctggcagactttccccctagccccgacagagatcgagagagcatcgtgta

SEQ ID NO: 240915 - DNA, 5049 bp, Artificial Sequence
  Description of Artificial Sequence: Synthetic coding sequence
atgctagcgtcaccggaacctaaaggtctcgtaccatttacaaaagagtcattcgagttaatcaagcaacacattgccaagacccacaatgaggaccatgaggaagaagatttaaagccaactcccgacttggaggtggggaagaaactgccttttatttatggcaacctgagtcaggggatggtgagtgagcctttggaagatgtggacccatactactataagaagaagaacacattcatagtcctaaacaagaataggaccatatttcgatttaacgccgcttctattttatgcactctgtccccctttaactgcattaggaggacaaccatcaaagtgttagttcaccctttttttcagcttttcatcctcatctccgtgctgatcgactgtgttttcatgagccttacaaaccttcctaagtggcggcctgtgttagaaaacacactgctgggaatttacaccttcgagatcctggtgaagttatttgctagaggggtctgggccggatccttcagctttctgggggatccctggaattggctcgacttttctgtgacggtgtttgaagtcatcattagatacagtccattagactttattccaacactgcagacggcccgtacactgcgcatcctgaagatcatcccactgaaccagggactgaagtctctcgtgggggtgcttattcactgcctcaagcagctgatcggagtgatcatactcaccctgttttttctctctatatttagcttaatcggcatgggattgttcatgggcaatctaaaacataaatgctttaggtggccacaggaaaatgagaacgaaaccttgcataaccggacaggaaacccatattatatacgagagaccgaaaacttctattacttggagggggagcgctatgccctgctgtgtggtaatcgcaccgatgctgggcagtgccctgaggggtacgtgtgcgtgaaagctgggattaatccagatcagggcttcacgaactttgattcctttggctgggcattgtttgcactgtttcgactaatggcgcaggattatccagaagtgctctaccatcagatcctgtatgcatccgggaaggtctatatgatattctttgtcgtcgtgtcattcctgtttagtttttatatggctagcttgtttctggggatactagccatggcctatgaggaggagaagcagagggtgggcgaaattagcaagaaaatcgaacccaagtttcagcagacagggaaagaacttcaggagggtaatgagacagatgaggccaaaaccattcagattgagatgaagaagaggtcacctatctcgaccgatacatcactagacgtcctggaggatgctacactaaggcataaggaggaactcgagaaatcaaagaaaatttgtcccctgtactggtacaaatttgctaagaccttcttgatctggaattgtagtccctgctggttgaaactcaaggaatttgtacaccgaattatcatggccccttttacagacctgttcttgattatctgtattattttgaacgtgtgctttctgactctggagcattatccaatgagcaaacagacaaacaccctgctcaacataggaaatttggtgtttatcggcatttttaccgcggaaatgatcttcaagatcattgccatgcatccctacgggtatttccaggtcgggtggaatatcttcgatagcatgattgtgtttcacggactgatagagctgtgcctggcaaacgtcgctggaatggctctgctccgcctatttagaatgctccgcattttcaagctgggtaaatattggccaacgtttcagatactaatgtggtccttgtccaattcttgggtcgcactaaaagatctggtgctgttgctattcacctttatcttttttagcgctgcctttggcatgaagctgttcgggaaaaactatgaggagtttgtatgtcacatcgataaggactgtcagcttcccagatggcacatgcatgattttttccactccttcttaaacgtcttccgcattttgtgcggagaatgggtagagaccctctgggattgtatggaggtcgcgggacagtcttggtgcatacccttctatctgatggtgatcctcatcggaaatctactggtattatacttatttctcgcactggtctccagctttagctcatgcaaggacgtgacagccgaggagaataatgaggccaagaatctgcagctggctgtggcccgaatcaaaaaggggattaattacgttctattgaaaatcctgtgtaagacacagaatgttcccaaggataccatggatcacgttaacgaagtttatgttaaagaggatatctccgaccatactctgtcggagcttagtaacacccaagatttcctgaaggacaaggagaaatcaagcgggacggagaaaaacgcaacagagaacgaaagccagtctctgatcccatccccaagcgtctctgaaacagttccaatcgcatccggagaaagcgatattgagaatctggacaataaggagattcagtccaagagcggagatggaggctctaaggaaaaaatcaagcagagcagcagcagtgaatgttcgactgtcgatattgccattagtgaagaagaggagatgttttatggtggggagcggagtaaacacttaaagaacggttgccgcaggggaagctcccttggacagatcagtggggctagtaaaaaaggcaaaatatggcaaaatatccgaaagacctgctgcaaaattgtggagaacaactggttcaagtgcttcatcgggctggtcactttgctgtctacaggaaccctggctttcgaggatatttacatggaccagcgtaagacaatcaaaatcttactcgaatatgccgacatgatcttcacatatatctttatattagaaatgttgctgaagtggatggcgtacggtttcaaggcgtattttagcaatgggtggtacagactggatttcgtggtggttatcgttttctgtctctcactcatcggtaagacccgggaggaattgaagccattaattagtatgaagttcctgagacccctccgcgtgctgtctcagtttgagcgcatgaaagtggttgtccgcgcattgatcaagacaacgcttccaactctgaacgtgttcctcgtgtgcttaatgatttggttgatttttagcatcatgggggtggacctgtttgcgggtcggttttatgaatgcatagatcctacctctggagagcggttcccatcgtcagaggtcatgaacaagtctaggtgcgaaagcttgctgtttaacgaaagcatgttgtgggaaaacgcaaagatgaattttgacaatgttgggaatgggttcctgagcctgctgcaggtcgccactttcaacgggtggatcacaattatgaattctgcaatcgactccgtggctgtgaatatccagccgcacttcgaggtgaacatttacatgtattgctatttcattaacttcataatattcggggtgttcctgcctttgtccatgcttatcactgtgattatcgataacttcaacaagcataagatcaaactcggcggttcaaacatctttataaccgtgaagcaacgcaagcaataccggagattgaaaaagctgatgtacgaggacagccagcgccctgtgccaaggcctcttaacaaattacagggatttatctttgacgtagtgactagccaggctttcaatgtcattgtcatggtgcttatttgttttcaggcaattgccatgatgatagataccgacgttcaatccctccagatgagtatcgcactgtattggatcaactcgatttttgtgatgttatacactatggaatgcatccttaagctgatcgctttccgctgcttctacttcaccattgcctggaatattttcgattttatggttgtgatcttctcaattactgggttgtgcttgcccatgacagtgggatcttacttggttcccccttctctggtgcaactgattcttctatctcgcattatccacatgctgcggctgggaaaagggccaaaggtctttcacaacctgatgctgcctcttatgctgagcttgcccgcattactgaatatcatcttgctaatttttctggtcatgtttatctatgccgtgttcgggatgtacaacttcgcttacgtgaaaaaagaggctggcatcaacgatgtgagcaacttcgaaacctttggcaatagcatgctctgtctgttccaggtggcaattttcgctggatgggatggaatgttggacgccatctttaacagcaagtggtctgattgtgatcctgataagattaatcccggaactcaagttcggggagactgcggaaatccctccgtgggcatcttctactttgtgagctatattctcatctcctggctcatcatcgtcaatatgtatattgtggtggtaatggagtttcttaatatcgcctccaagaaaaaaaacaagacacttagcgaagacgatttccgtaagttcttccaggtatggaaacggtttgatcctgatagaacccagtatatcgatagctctaagctgtcagattttgccgctgctctcgacccccctctgttcatggcaaaaccaaataaaggacagctcattgcgcttgacctccccatggccgtgggtgatcgtattcactgtctggacattctcctcgctttcacaaagagagtgatgggacaggacgtcagaatggagaaagtcgtttccgaaatcgagagcggatttcttctcgcaaatccatttaaaatcacatgcgagcccatcactaccacgctgaaacgcaaacaggaggctgtgtcggcaactatcatacagagggcctacaagaattatcggctgaggcgcaatgacaagaatacatctgacatccacatgatcgatggcgacagagacgtgcacgccacaaaagagggggcttacttcgataaagccaaagagaagagccctattcagtcccagatctac

SEQ ID NO: 240916 - DNA, 5048 bp, Artificial Sequence
  Description of Artificial Sequence: Synthetic coding sequence
atgctcgcgtcaccagagccaaaaggccttgttccctttacgaaggagagcttcgagctgataaagcaacacattgccaagacacataacgaagatcacgaggaagaagatttaaaacctaccccagacctggaggtgggcaagaaattgccttttatttatgggaaccttagtcagggtatggtttcagaacccttagaggatgtggatccctactattacaaaaagaagaatacgttcattgtcctgaataagaatcgcactattttcagattcaatgcagcctccattctttgcacactatcacctttcaattgcattcggaggactacgatcaaggtgttggtacatccattcttccaactgttcatccttattagcgttctaatcgactgcgtgtttatgtccctgacaaaccttcctaagtggcgtcccgttctagagaacacactactcggcatctacacattcgagatactggttaagcttttcgcgagaggggtctgggccggaagctttagcttcctcggggacccctggaactggcttgactttagcgtcactgtgttcgaggtgatcatccgatatagcccactcgacttcataccaaccctgcagaccgccagaactctgcgaattttgaagatcattcccctcaaccaaggacttaagtcgctggttggggtcctaatccactgtctgaagcagttgatcggagtgatcattctgactctgttctttctgagcatattttccttaattggaatgggactcttcatggggaatttaaagcataaatgctttcgctggccacaagagaacgagaatgaaaccctgcacaacagaacgggaaacccatattacataagggagaccgagaacttctattacttagaaggagaacggtatgccttattatgtggtaaccggaccgatgctggtcaatgtcctgagggatatgtatgtgtcaaggccggaattaatcctgatcagggtttcacaaactttgattcctttggatgggccctgttcgctctgttcagactcatggcccaagattaccctgaggtgctgtaccaccaaatcctgtacgcttccgggaaggtatacatgatatttttcgtcgtcgtctcttttttgttttctttttacatggccagtcttttcctagggattctagcgatggcttacgaagaagagaagcagagagttggcgaaatctctaaaaagatcgaacccaaattccaacagaccggcaaagagttgcaggaaggcaacgagacggatgaggctaagacaatccagatcgaaatgaagaaaagaagcccgatcagcacggataccagtctggacgtgttggaggatgcaacacttaggcataaagaggagcttgaaaagagcaaaaaaatctgtccattatactggtacaaatttgctaagacatttctgatttggaactgctctccatgctggctcaaactgaaggagtttgtccatcgcattatcatggcaccatttacagacttatttctcattatctgtatcatcctcaacgtatgcttcttgacgttagagcactaccccatgagtaagcagactaataccttgctcaacatcgggaacctggtctttatcggcatctttacagccgagatgatcttcaagattatcgcaatgcacccatatgggtactttcaagtcggctggaacatctttgattctatgatagtattccacggcctcatagaactgtgcctggcaaatgtggccggaatggctctgctgcgactgttcaggatgctgcggatttttaagctgggaaagtactggccaacttttcaaattctcatgtggtccctgagcaattcctgggttgcattaaaagaccttgtgctgttgttgttcacatttattttcttctcagcggctttcggaatgaagctcttcggcaaaaattatgaagagtttgtgtgtcatatagacaaggattgccagttaccccgatggcacatgcatgacttttttcattcctttcttaacgttttccgaatcttgtgtggcgagtgggtggagacactgtgggactgtatggaggtcgcagggcaatcatggtgcattcctttttacctcatggtgatcctgatcggtaatctgctagtcctgtaccttttcctcgctttagtatccagcttctcctcctgtaaagacgtaacagcagaggagaacaatgaggccaaaaatctgcaactcgccgtggccagaattaagaagggcatcaactatgtgctcctgaagattctgtgcaagactcaaaacgtgcccaaagatacaatggatcatgtgaacgaggtttacgtaaaggaagacatttcagatcataccctgtcagagctttccaatacacaggacttcttaaaggacaaggaaaaatcatccggcacagaaaagaatgcgactgagaacgagagtcaatcgctcatccctagccctagcgtaagcgaaaccgtcccaatcgccagtggagaatccgacattgagaatctggataataaagagatccagtctaagtctggtgatggcggatccaaagagaaaattaagcagtcttcatcctctgagtgtagcaccgtggacatcgctatttccgaggaagaggagatgttctatgggggagaacgcagtaaacacctcaaaaatgggtgtcgtcgcggaagctccttagggcagatatctggtgcgtctaaaaaaggaaaaatctggcagaacatcagaaagacttgctgcaaaatagtagagaataactggttcaaatgctttatcggactggtcacactcctctccacaggcaccctggctttcgaggatatttacatggatcagcgtaaaacaataaagatcctgctggaatacgctgatatgatctttacttacatattcatcctggaaatgctgcttaagtggatggcttacgggttcaaggcttacttcagtaatggctggtatcggctagactttgtggtggtgattgttttttgcctttccctcatcgggaagacccgggaagagctgaaaccgctgataagcatgaaatttcttaggcctttgagggtgctgtcacagttcgaacggatgaaggtggttgtgcgcgcacttataaaaactacgctacctacactgaatgtgtttctcgtgtgtctgatgatctggcttatattcagtatcatgggggtggatctgttcgcgggtaggttttacgaatgtattgatcctacctcaggcgagaggttcccaagttctgaggttatgaataagagtagatgtgaatcattactctttaacgagtccatgctctgggagaacgcgaaaatgaacttcgacaacgtggggaatggcttcttaagtctgttgcaggtggctacatttaatggatggattaccatcatgaactctgccatcgactctgtcgccgtcaatattcaaccgcacttcgaagtgaacatttacatgtactgttactttattaattttatcatcttcggcgtgttcctgccactgtcaatgctgataacggttatcattgacaacttcaataagcacaaaatcaaattaggaggcagcaacattttcatcactgtgaagcagcggaagcagtaccgcaggttaaaaaaacttatgtatgaggactcccagcgtcccgtaccaagacccctgaacaaattgcaaggctttatattcgatgttgtgacatcccaagctttcaatgtcattgtaatggtactcatctgttttcaggccatcgcaatgatgattgatactgacgtgcaaagcctgcagatgagcattgccctatattggatcaattcgattttcgtgatgctttacacaatggaatgcatcctgaagctcatcgcctttaggtgcttctacttcaccatcgcctggaatatctttgactttatggtagtaatattctccattaccgggctatgcctgcccatgacagtaggatcttatctcgtaccaccttcactggttcaattgatccttctcagcaggatcatccatatgttgcgcttggggaaaggtcccaaagtgtttcacaaccttatgctgccgttaatgttatcactgcccgctcttttaaatataatccttttgatattcctagtgatgttcatctacgccgtgtttggcatgtataattttgcatatgtgaagaaagaagctggcataaatgatgtcagtaatttcgagacgttcgggaatagcatgctatgcctgtttcaggtggctatcttcgccggatgggatggcatgctcgacgcaatctttaattctaagtggtccgattgtgatcccgacaagataaaccccggtacgcaggtccgtggggactgtggcaatccttccgtggggattttttattttgtctcatatatactaattagttggctgattatcgtgaacatgtatattgtcgtcgtgatggagtttctaaatatcgcttcgaaaaaaaaaaacaagactctgtctgaagatgacttccgaaagttttttcaggtgtggaagcgttttgatcctgaccggactcaatatatcgactcctccaaactgagcgacttcgctgccgctctggacccccctcttttcatggcaaagcctaataaaggacagctaatcgccctcgatctgcctatggctgtgggtgaccggatacattgcctagatatactgttagcctttacaaagagggtgatgggacaggacgtgcgaatggaaaaggttgtgtcggagatcgaatcgggctttttgttagcaaaccccttcaagataacctgtgaacctattaccacgaccctgaaacgcaagcaggaggcagtgtctgccaccatcatccaacgggcttacaaaaattacagactgagaagaaacgataagaacacctccgatatccatatgattgacggcgaccgggatgtccacgctaccaaggaaggcgcatacttcgacaaagccaaagagaaatcccccatccagagccagatata

SEQ ID NO: 240917 - DNA, 2592 bp, Artificial Sequence
  Description of Artificial Sequence: Synthetic coding sequence
atgctggcgagccccgagccaaagggactcgtgccctttactaaggaaagcttcgagcttatcaagcagcatatagccaagacacacaacgaagatcatgaggaggaggacttgaagccaacaccagatctggaggtcggcaaaaagctacctttcatctacggaaatttgtctcagggtatggtcagcgaaccactcgaggacgtggacccgtattactacaagaaaaaaaataccttcattgttctgaataaaaaccgaacgatttttaggttcaatgctgcaagcattctgtgtactctctcgcctttcaattgcatcaggcgcactactattaaggtgctcgtgcacccattctttcagctttttatcctgatttccgtgctcatcgactgtgtgtttatgagcctgaccaaccttccaaagtggcgacctgttttggaaaataccttgctaggaatctacacttttgaaattctggttaaactctttgcacgcggtgtgtgggccggttccttcagctttctgggggacccatggaattggttggattttagtgttaccgtgttcgaagtaattataaggtattccccactcgacttcatccccacccttcagactgcccgtaccctgaggatcctgaagataatacctctcaatcaaggtctaaaatcactggtgggagttctcatccattgcctcaagcagttaatcggagtcattatcctgacgttgttcttcctgagtattttctctctcatcggcatgggcctctttatggggaatttaaagcacaagtgctttcgctggcctcaagagaacgagaacgagaccctgcacaataggactggtaatccgtactacatccgcgaaaccgaaaatttctattacctagaaggtgagcggtatgcgctgttgtgcggaaaccgaaccgacgcaggacagtgtccagaggggtacgtatgcgtgaaagctggaataaaccctgaccaggggttcaccaactttgacagcttcggctgggccctgttcgctctgtttcgcttaatggcccaggattatccagaggtcctgtaccatcagattttatatgccagtggtaaggtatatatgatcttctttgtagtcgtcagttttctgttttcattttatatggccagcctgtttttagggatcctggccatggcctacgaagaggaaaagcaacgggttggggaaatcagtaaaaaaatcgagcctaagttccagcaaacaggtaaggagttacaagagggaaacgaaactgacgaagccaaaacaatccagatcgaaatgaaaaagaggtcacccatcagcacggatacctcgctagacgtcttggaagacgcaacactaaggcacaaagaggaactggagaagagcaagaaaatttgccctttgtattggtacaaatttgcaaaaaccttcttaatctggaattgctcgccctgctggctgaagctgaaagagttcgtgcacagaatcattatggccccttttaccgatctcttcctgattatctgcataattctgaatgtctgcttcttgactcttgagcactatcccatgagcaaacaaaccaacaccctcctcaatatcggcaatctggtgtttataggcatcttcactgccgagatgatttttaagatcatagcgatgcacccatacggatatttccaggtcgggtggaatattttcgattcaatgattgtcttccatgggctgatagagctgtgtcttgctaacgtagcgggtatggccctgctgaggctatttagaatgctgcggatcttcaagctcggcaagtattggcctactttccagattctcatgtggagcttgagcaactcctgggtggccctcaaagatctggtcctgttgttgttcacctttatctttttttcggctgcttttggaatgaagcttttcggaaagaactacgaagagttcgtttgccatatcgataaggattgtcagctgcccaggtggcacatgcatgacttcttccattcatttctgaatgtgttcagaatcctctgtggggagtgggtggagaccctgtgggattgtatggaagtggctggacaatcctggtgcattccgttctatttaatggtcatactgattggcaatctgctagtgttatacctgttccttgcactggtctcgtcgttctcttcctgcaaagatgtcacagccgaagaaaataacgaagccaaaaacctgcaactcgcagtagcacgcattaaaaagggaatcaattacgtactcctgaaaattctttgcaagacgcaaaacgtcccaaaggatacaatggaccacgtcaatgaagtatatgtcaaggaagacatcagcgatcatacattgagcgaacttagtaatactcaggacttcttgaaagacaaagaaaaaagttcaggcaccgaaaagaacgccactgagaacgagtcacagagtctcatcccttcgccatcagtatccgaaacagtgccaattgccagcggagagagcgatatcgaaaacttagacaacaaggaaatccaatcgaaatccggcgacgggggaagtaaatag

SEQ ID NO: 240918 - DNA, 1209 bp, Artificial Sequence
  Description of Artificial Sequence: Synthetic coding sequence
atgttggcatctcctgaacctaaaggattagtgcctttcacaaaggagtccttcgaacttattaaacagcacattgctaaaactcacaacgaggatcacgaggaggaagatttgaaaccaactcccgatttagaggtaggtaaaaaactaccttttatttacggtaacctgtcccaggggatggtctctgagccactggaggatgtcgatccatactactacaagaagaaaaataccttcatagtcctgaataagaataggacgatattccgcttcaacgccgcatccattttgtgcacactctctccgtttaactgtatccgtcgtacaactatcaaggttctcgtacacccattttttcagctgtttatcctgatctccgtgttgatcgactgcgttttcatgtccctgacaaatctccccaagtggaggcctgtactggaaaatacgctgctaggaatttatacttttgaaatccttgtcaagctgttcgcacggggtgtttgggcaggtagtttcagcttcttaggggacccatggaattggctggacttttccgtgacagtctttgaggtcatcattcgttactctccactcgatttcataccaactcttcaaacagccagaacactcaggatcctgaagatcattcccctaaatcaaggtttgaaatcactcgttggtgtgcttatccactgcctgaagcagctcatcggggtgatcatccttaccctgttttttctttctatttttagcctgataggtatggggctgtttatggggaacctaaagcacaagtgctttagatggccacaggagaatgagaatgagaccttacataataggacaggaaatccatactacatacgtgaaacggaaaacttctattacctggaaggggagcgttatgcattgctgtgcgggaaccggacagacgctggacagtgtccagaaggatatgtgtgcgttaaagcaggcatcaatcctgatcaagggttcacaaactttgacagctttggctgggctcttttcgctctgttccggctcatggcccaggattatccagaagtgctataccatcagatactgtacgcatctggcaaggtgtacatgatcttctttgtcgtcgtgtcctttcttttcagcttctacatggcatcactgttcttggggatccttgcaatggcctatgaggaggagaagcaatag

SEQ ID NO: 240919 - DNA, 5870 bp, Artificial Sequence
  Description of Artificial Sequence: Synthetic coding sequence
atggagtttccaatcggatctttagagaccaataactttcgacgcttcactcccgaatcccttgtggagatcgaaaagcagatagccgcaaagcaaggtacaaaaaaagcccgagaaaaacatagagagcagaaagatcaggaagaaaagcccaggccccagttggacctgaaagcatgtaaccagcttcctaagttctacggcgagctgcccgcagaactcattggcgagcctctcgaagacctagatcccttctactccacgcaccggactttcatggtgctcaataaggggcgaacgatctccagattcagcgccacgagggccctctggctgttctccccgtttaacctcattagaaggacagcgattaaggtgtctgtgcatagctggttttctctgtttattaccgttaccatccttgtgaattgtgtctgtatgactcgaaccgatcttcccgaaaaaatagagtacgttttcaccgtcatttacaccttcgaagcgctcatcaaaattctggcccgaggtttctgtttgaacgaattcacatacctcagagacccatggaattggttagacttctcagtcatcacgctggcgtatgtagggacagccatcgatctcagaggaatttccggcctcaggacttttcgcgtattacgagcgctcaagactgtgagcgtcatcccaggtctgaaggttatcgtgggagccttgattcattctgttaaaaagctggccgatgtgaccatactgacaatcttctgtttgagcgtattcgctctggttggcttgcagttgtttaagggaaacctgaaaaacaaatgtgtcaagaatgacatggctgtgaacgaaacaactaactactcctctcaccgcaaacccgacatctatatcaataaacggggaactagcgatccactgctatgtggtaatggtagcgattccggccattgcccagatggctatatctgtttgaagacttccgataacccagattttaactacaccagttttgactcatttgcttgggcatttctgagtctgtttcggctaatgacacaggactcctgggaacgcttgtatcagcagacactcagaacttcgggtaagatttacatgatcttctttgtgctcgtgattttcctgggcagcttctatctggtgaatttgatccttgcagtggttacaatggcctacgaagagcagaaccaggccacgaccgacgagattgaggccaaggagaagaagtttcaggaagccctagaaatgctgcgcaaggagcaggaagtattagcggctctcgggattgacacgaccagtttgcactctcacaacggctctcctttaacaagcaagaatgccagtgaaaggagacacagaatcaagccaagggtttccgaagggtcaaccgaggacaacaagtctccgagaagcgacccttataatcagcgccgaatgagctttctggggctggcttccggcaagcgacgcgctagccatggctctgtattccactttaggagtcctggtagggacatcagcttacctgagggcgtgactgacgatggcgtttttccaggagaccatgaatcccatcgcggtagcctgctgctgggcggtggggctggccagcagggccctctgccccgatcgcccttgccccagccaagtaatcccgattctcggcacggagaggatgagcaccagcctcccccaacttccgagcttgcacctggcgcagtggacgtcagcgcctttgatgcgggacagaagaagacctttctctccgcagaatacctggacgagccgttccgtgcccagcgagcgatgtcagtggtgagcattattacaagcgttttggaggagctagaagagtctgaacaaaagtgccccccatgcctcacctctctgagtcagaagtatctgatctgggattgctgtcctatgtgggtcaaattgaaaaccattctcttcggattggtcacagaccctttcgctgaactcacgattaccctttgcatagttgtaaataccatctttatggcaatggaacatcacgggatgtctcctaccttcgaggccatgctgcaaatcggtaatattgtctttaccatcttctttactgcagagatggtgttcaaaattattgccttcgacccttattactatttccagaagaaatggaatatttttgattgtattatcgtgacagtatctctgctcgaactcggcgtggctaaaaaaggcagtctgagcgtgctcaggtcattcaggctcttgcgggtgtttaagttagcaaaaagctggcccacactgaatactttgatcaaaatcattggaaacagcgtgggggcacttggtaacctcacaatcatactggctattattgtgtttgtgttcgcattggtgggcaaacagcttctgggcgagaattatcgcaataataggaaaaacattagtgctccccacgaagattggccacggtggcatatgcacgatttctttcacagttttctcattgtctttcgtatcttgtgtggcgagtggatcgaaaatatgtgggcttgcatggaagttggacagaaatctatatgtctgatccttttcctaaccgtaatggttctgggaaatctggtggtgctcaacctatttattgcactgttactaaattcctttagcgccgacaatctcacggcacctgaggacgacggcgaggtgaataacctgcaggtcgccctagcacgaatccaggtgttcggccatcgcaccaagcaggccctgtgtagttttttttcaagatcttgcccattcccccaaccaaaagctgaacctgagctggtggtgaaattgccgctcagttcctcaaaggcagagaatcatattgccgcaaataccgcacgcggaagcagtgggggtctccaggcgcctaggggtcccagggatgagcattccgacttcattgccaacccaacagtttgggtgtcggtccccatcgctgagggagaatccgacttggatgatctggaggacgacgggggagaagatgctcagtcattccagcaggaagttattcccaagggtcagcaagagcagttgcagcaggtcgaaaggtgtggcgaccatttaacccctaggtcccctgggactggaacttccagcgaagatttagctcctagccttggtgagacgtggaaagacgagagtgtgcctcaggtgcccgcagaaggcgtcgacgataccagctcatctgaggggtctacagtcgattgcctggaccctgaagagatcttgaggaaaatccctgaactggcagatgatctggaagaacccgacgattgtttcaccgaggggtgcattagacactgcccttgttgtaagttagacaccacaaagagcccatgggatgttgggtggcaggttaggaagacatgctaccgtattgttgagcatagctggtttgagtcctttattatctttatgattctcctgtcttccggctccctggcgttcgaggactattacttggaccaaaagccaaccgtaaaggccctgctggagtatactgatagggtattcacttttatttttgtgttcgagatgctgctaaaatgggtggcgtatggtttcaaaaagtactttaccaacgcctggtgctggctggatttcctgattgttaacatcagcctgatttcccttacagctaaaatcctggaatacagcgaggttgcccctatcaaagcgcttcgaacccttagggcgctccgccctctgcgggctctcagtcgcttcgagggaatgagagtggtggtcgacgcactggtgggagccatcccttcaatcatgaatgttctgcttgtctgcttgattttttggctcatattcagcataatgggagtgaatctgttcgcgggaaaattttggagatgtatcaactataccgacggcgagtttagtctggtccccctttcaattgtaaacaacaagtccgactgcaagattcagaactctacagggagtttcttctgggtaaatgtgaaagtaaactttgacaacgtagcaatggggtacctggcgctgcttcaggtggcgacatttaaaggatggatggacattatgtacgctgcagttgatagccgggaagtgaacatgcagcctaagtgggaggacaatgtttacatgtacctctattttgtgatattcataatattcggcggatttttcacactcaatctctttgttggggtcatcatcgataattttaaccagcagaaaaagaaactcggagggcaggacatttttatgaccgaggagcaaaaaaaatattataatgctatgaaaaagttgggcagtaagaagccccagaagccaatcccccgacccctgaacaagtttcaaggctttgtgtttgacatcgtcactaggcaggcatttgatattactataatggtgctgatttgtctgaacatgatcaccatgatggtcgagacagacgaccaatctgaagagaagacaaagattctgggaaagatcaaccagtttttcgttgctgtcttcacaggcgagtgcgtgatgaagatgtttgcactgcggcagtattactttaccaatgggtggaatgtgttcgatttcatagtagtggtgctaagcatcgccagcctgattttttctgctatcctgaaatcacttcagagctattttagtcctactttgttcagggtgatcagattagccagaattggtcggatcttaagattgatccgggcagccaaaggcatcagaacgcttttgttcgccttgatgatgtcacttcccgctctctttaatataggtctgcttctttttctggtcatgttcatctacagcatatttggcatgagtagttttcctcatgtacgatgggaggccggtattgacgatatgttcaattttcagacgtttgctaattccatgctgtgcttgttccaaataactacttcagctgggtgggacgggttgctttctccgatactcaatacaggcccaccttattgtgaccctaacctgccaaactccaacgggacccggggagactgtgggagcccagccgtaggcataattttctttaccacttacatcatcatatcttttcttattatggtaaacatgtatatagcagttattctcgaaaatttcaacgtggcaacagaagagagcacagagcctctgagtgaggatgatttcgatatgttttacgagacttgggagaagtttgaccccgaagccacacagttcatcacgttctccgccctgagtgactttgccgacacgctgtccggcccattaaggattcctaagccaaaccgaaatatcttaattcaaatggacctccctctggtacctggagataagatacactgcttggatatcctcttcgccttcacaaagaacgtgcttggcgaatctggagaactggacagtctgaaggccaatatggaggagaagttcatggcaacaaatctgtccaagtcctcgtatgagccaatcgccactactctacggtggaagcaggaagatatctccgccaccgttattcagaaagcttaccggtcctacgtgctgcataggagtatggccctgtccaataccccttgtgtccctcgtgccgaagaagaggcagcttccttgccagatgaaggcttcgtggcgtttaccgcaaatgaaaactgtgtgctgccagacaaatcagaaaccgcgagtgctacctcattccctccatcatacgagtctgtgactagaggcctctctgatagagtcaacatgaggaccagtagttcaatccagaacgaggacgaggccacgagcatggaactgatcgcacccggtccata

SEQ ID NO: 240920 - DNA, 5375 bp, Artificial Sequence
  Description of Artificial Sequence: Synthetic coding sequence
atggatgacagatgttaccccgtgatcttccctgacgagcgaaacttcaggcccttcacttctgactctctggcagcgatcgaaaaacgcatcgctatccagaaggaaaagaagaaatccaaggatcagacgggcgaagtcccacagccacgccctcagctggatttaaaggcgtctaggaaactgcccaagctttacggtgacattcctcgggagctgattggcaaaccacttgaagacctcgatcctttttacaggaatcataagaccttcatggtcttgaaccggaaaagaactatctatagattttcagcaaaacatgctctctttattttcggacctttcaactcgatccgaagcctggcgattcgagtgtctgtgcactcactgttcagtatgtttataataggaacggtcatcataaattgtgtcttcatggcgacagggccagctaagaactcaaatagcaacaacaccgacattgctgagtgtgtgttcaccggcatttacatctttgaggctcttatcaaaatcctggcgcgaggattcattcttgatgaattcagttttctgcgtgacccatggaactggctcgacagcatcgtgattgggatagcaatcgtttcctatattcccggaatcactatcaagctattacctttgcgcaccttcagagttttcagagcactgaaagcgatcagcgttgtgtcccgcttgaaggtgatcgtcggcgctctgttgagatcggtgaagaaattagtgaatgtaatcattcttacatttttttgcctgagtatttttgccctggtaggccaacaattgtttatggggagtctgaacctaaagtgcatctcaagagactgcaagaatatatccaacccggaggcttacgatcactgcttcgaaaagaaagagaactctcctgaatttaagatgtgtggaatctggatgggtaattcagcctgcagtatacaatacgagtgcaaacatacgaagattaatcctgattataactacaccaactttgacaacttcgggtggtccttcctggcaatgtttagactgatgactcaggacagctgggagaagttgtaccagcaaaccctgcgcaccactgggctctacagtgtgttcttttttatcgtcgtgatattcctaggcagcttctacttgatcaacctcacgttggccgttgtgacgatggcgtacgaagaacagaataagaatgtggccgctgaaattgaggctaaggaaaagatgtttcaggaggcccaacagctgctgaaggaagagaaagaggcgcttgtcgcgatgggaattgacagaagcagcctgacttccctggagacctcatacttcactcctaaaaagcgtaagctctttggaaataaaaagcgtaagagttttttcttgagggagagtggaaaagaccagcctcccggttccgacagcgatgaggattgccagaagaagccccagctgctcgagcaaaccaaacgtctctcacagaacctctcacttgaccattttgatgagcatggggaccccctacaacgacagcgggctctaagtgccgtatcaatcttgacaatcaccatgaaggagcaagagaaatcccaggaaccttgcctgccctgtggcgagaacctagcctctaaatacctggtctggaattgctgtccacagtggctgtgtgttaaaaaggtgcttagaacagtaatgaccgaccctttcactgaactggcaatcacgatctgtattataattaataccgtgtttcttgcgatggagcatcataagatggaggcctcgttcgagaagatgctgaacatcggcaacttggtctttacatctatctttattgccgagatgtgccttaagatcatcgcactagacccataccactacttccgaaggggatggaacatcttcgactcaattgttgcgctgctatccttcgcagacgtgatgaattgtgttcttcagaaacgctcctggccattccttcgctctttccgagtcctgagagtttttaagctggcaaaaagctggccaaccctgaacacgctgatcaaaatcatcggaaactctgtcggggcactgggcagcttgacagtcgtgctagtgatcgtcatttttatctttagcgtggtgggtatgcagctattcggccgttcatttaacagccagaaatctccgaagctctgcaatcctaccggcccaactgtgagctgcctcaggcactggcacatgggcgatttctggcattcattcctagtcgtttttaggattctgtgcggcgagtggatcgaaaatatgtgggaatgcatgcaggaagcaaatgcctcctcatccttgtgcgtcatcgtctttatcctcattacagtgatcggcaagcttgtggtcctgaacctgtttatagccctcctgctgaatagcttcagcaacgaggagaggaacggaaatttagagggtgaggcaagaaaaacgaaagtccaactcgcactggatcggtttaggagagctttctgttttgtacggcatacactggagcacttctgccataagtggtgcaggaagcagaatctcccacagcaaaaggaggtcgcagggggttgcgccgctcaaagcaaggacatcattccactcgtgatggagatgaaacgaggctcagaaactcaggaggagctcggtatattaacctctgtacccaaaacactcggagtaagacacgactggacatggctggcacccctagcggaggaggaagatgatgtggagttcagtggcgaagataacgcacagaggattacacaacccgagcccgaacagcaggcttatgagctccaccaggagaataaaaagccgacttctcagcgtgtgcagtccgtcgaaattgacatgttctcagaagacgagcctcacctgaccatccaggaccctcggaagaagtccgacgtcacctcaattctctccgagtgctctactatcgatttgcaggatggctttggctggctgcccgagatggtgccgaaaaaacagccagaacgctgtctccctaaaggatttggatgctgttttccgtgctgtagtgtggataaaagaaaacctccttgggtcatttggtggaacctgcgtaagacatgttaccaaattgttaagcactcttggtttgagtcattcatcatctttgtcatcttgctttcatctggggctctcatttttgaggatgtgcacctggagaaccagccaaaaattcaggagctactgaattgcaccgatatcattttcacacacatattcatcctggaaatggttctcaaatgggtggcttttggctttggcaagtacttcacatctgcatggtgttgcttggacttcatcatagtaattgtctcagtgaccacgctgattaatttgatggagctaaaatcattccggaccctgcgtgcactgagaccactccgagccttgagtcagtttgaaggcatgaaagtcgtcgtaaatgctctcataggggcaattccagcaatccttaatgtcttactggtttgcctgattttttggttagtattttgcatcttaggggtctacttttttagtggcaaatttggcaaatgcattaatgggacagattccgtgatcaactacaccattattactaataagtcacaatgcgagtcagggaatttctcttggattaatcagaaagtgaatttcgataacgtcggcaacgcctacctggcccttctgcaggtggccacgtttaaaggctggatggacattatatatgcagccgtggacagcactgaaaaggaacaacagcctgaattcgagagtaatagccttggctacatttattttgtggtattcataatctttggctctttttttaccctgaatctgttcataggtgttatcattgacaacttcaatcagcagcagaaaaagctggggggtcaggacatcttcatgacggaggagcagaaaaagtattataatgcgatgaaaaagttgggttccaaaaagcctcagaagcccatacctaggccgctgaacaagtgtcagggcctggtcttcgacatcgtcacatcccaaatctttgatatcattatcatatcattgatcatccttaatatgatctccatgatggccgagagttacaaccagccgaaggccatgaagtccatactggaccacctgaattgggtgttcgtggtcatttttacccttgagtgcctaattaaaatcttcgcgctgaggcagtattattttacgaacgggtggaatctgttcgactgtgtcgtggtgctactgtccatcgtctcaactatgataagcaccttggagaatcaggaacacattcccttccctccaactctcttccgaattgtgcggctcgctcgcattggtagaatactgcgtttggttagagccgctagaggaattaggactctgctgtttgcactgatgatgtccttgccctctctgttcaacatcggcctactgttatttctgatcatgtttatatacgcaatcttgggaatgaactggttttctaaggtaaaccccgagtccggaattgatgacatctttaactttaagacgtttgcctcttcgatgctgtgcctctttcaaatttcaacctctgctggctgggactctctcctgtcgccaatgctgcggagtaaggagtcctgtaattcctcttctgaaaactgtcatctccccggtattgccacgagctactttgtaagttatatcattatctcattcttgattgtggtgaacatgtatattgctgtgattctggagaattttaataccgcaacggaagagtccgaggaccccctcggcgaggatgacttcgacatcttctatgaagtttgggagaagtttgacccagaggcaacacaatttattaaatacagcgccctaagcgactttgccgatgccctcccagaacccctgcgagtagccaaaccgaataagtatcagttcttggttatggatctgccaatggtgtccgaggaccgactgcactgcatggatatcttgtttgcattcaccgccagggtccttgggggatccgatggcctcgattccatgaaagcaatgatggaagagaaatttatggaggcaaacccgctgaagaaactgtacgagcccattgtcacgacgaccaaacggaaggaagaggagaggggcgcagccatcattcaaaaggcttttcgaaagtatatgatgaaagtgactaagggggaccaaggcgaccagaatgacttggagaacgggcctcactctcctctgcagacgctctgtaatggtgatctgagttcttttggcgttgcaaagggaaaagttcattgcgatta

SEQ ID NO: 240921 - DNA, 4335 bp, Artificial Sequence
  Description of Artificial Sequence: Synthetic coding sequence
atggacgatagatgctatcctgtcattttcccagatgagcgaaattttcgaccttttacaagtgacagcttggcagccatcgagaagcggatcgctatacaaaaggagaaaaaaaaaagcaaggaccagactggtgaagttccccaaccacgcccacagctggacttgaaagcaagtcggaagctgccgaagctttatggagatataccgagagagctaataggcaaacctttagaggatttggatcctttctaccgtaatcataagacattcatggtgctgaacaggaaacgtacgatttaccgcttctctgcgaagcatgcgctattcatctttggacccttcaacagtattcgatcattggctattagagttagtgtccattccctattctctatgtttataatcggcaccgtgataatcaactgcgtatttatggcgaccggccctgctaaaaatagcaactcaaataacactgatatcgcagaatgtgtatttacggggatttatatcttcgaggccctaatcaagattctggccaggggctttatccttgacgagttcagctttctcagggacccctggaactggttagacagcattgtcattggtattgcgatcgtgtcttatattcccggtatcacgattaaactcttacctttgcgcacttttagggttttcagagccctgaaggccatatcagtcgtttctcggttgaaagtcatcgttggcgctcttcttcgtagcgtcaagaaactagtgaacgtcataatcctgacttttttctgcctttctatcttcgctctggtcgggcagcagctgtttatggggtctttgaacctgaagtgtatcagcagagactgcaaaaatatctctaatccggaagcttatgaccactgtttcgagaagaaggaaaactctccagaattcaagatgtgtgggatttggatgggcaatagtgcctgctccatccagtatgaatgcaaacacaccaagataaacccagactacaattataccaactttgacaattttggctggtccttcttagccatgtttcggttaatgactcaagatagttgggaaaaactttatcagcagactctgagaaccacaggcctttattccgtgtttttctttatagtcgtcatcttcttgggctctttctatctgattaacctgacgctagcagtggttaccatggcctacgaagaacaaaataagaatgtagctgccgagatcgaggctaaggagaagatgtttcaagaggcgcaacagctgttgaaggaagaaaaagaggccttagtcgccatgggcattgacagaagctcgctgactagcctggagacgtcctactttacacccaagaagcgcaagctttttggcaataagaagcgtaaatccttctttctaagggagtctgggaaagatcagccaccgggaagcgactctgacgaggattgccagaagaagccccagctgctggagcaaacaaagcggctctctcagaacctcagcctggatcacttcgatgagcatggcgacccattgcagcgacagcgagccctctcggccgtctccatattgaccatcactatgaaagagcaggaaaagtcacaggaaccgtgtttgccttgcggcgagaacctggccagtaaatatctcgtgtggaattgctgcccacaatggttatgcgttaagaaggtcctcagaacggtgatgacagaccctttcactgaacttgcaattaccatttgcataattattaacaccgtgttcttagccatggagcatcacaagatggaagcctcctttgagaaaatgctgaacatcggaaacctcgtgtttacgagtatctttattgccgagatgtgcttgaagattatcgctctggacccctatcattatttcagacgaggctggaacatttttgactccatcgtggcccttctgtctttcgccgacgtcatgaattgtgtccttcaaaaacgctcatggccatttctaagaagctttagggtgctgagagtgtttaagctcgcaaaaagctggcctaccctcaacacattaatcaagataattggcaacagtgtcggggctcttgggagcctaacagtcgtcctcgtaatcgtcatcttcattttctccgtggtgggcatgcaactgtttgggaggagcttcaacagccagaaaagcccaaaactgtgcaacccaaccggacctaccgtcagctgcctcagacactggcacatgggcgacttctggcactcattcttggtggtgttccgcattctctgcggtgagtggatcgaaaatatgtgggaatgtatgcaggaggctaacgccagcagctccctttgcgtaattgtttttatcctaatcaccgtcattggcaagctggtcgtgctgaatctgttcatcgccctgctcctcaattccttctctaatgaagagaggaacggtaatctcgaaggcgaggcgcgaaaaactaaagtgcagctcgctttagaccgtttccgacgggcattttgctttgtccgccacactttagagcacttctgccataaatggtgccgaaaacagaatctgccacagcagaaggaagtagccggaggttgcgcagctcaatccaaagacataattcctttggtgatggagatgaagcgaggctcagaaacccaggaagagttgggcatcctaacaagtgtgccgaagacactaggagtccgccacgactggacgtggctggcgccactggccgaagaagaagatgacgttgagtttagtggagaagataacgcacaaaggataacacagcccgagcccgagcagcaggcctatgagttacatcaggagaataaaaagccaacctctcagagagttcagtccgtcgagatcgacatgttctccgaagacgaaccacacctgactatccaagatcctagaaagaagtcggatgtgacctctatcctgtccgagtgctcaactatcgacttgcaggatgggtttggttggctaccagagatggtcccgaaaaaacagcctgaacgatgccttccaaagggctttggctgctgcttcccttgttgctccgtcgacaaacgcaaacccccttgggtcatttggtggaacctccgcaagacctgctaccagatcgtgaagcatagctggtttgagtcttttatcattttcgtcatcctcctcagtagtggagcccttatatttgaagacgttcacctggagaatcagcctaagattcaagagctactcaactgcactgacattatatttacacacatttttattctggaaatggtgctgaagtgggtggcttttggctttggaaaatactttaccagtgcctggtgctgtctcgactttattattgtgatagtgagcgtgacaaccctcatcaacctaatggagctgaaaagcttcaggaccctgagggccctccgtcccctgcgagccttaagccagtttgagggcatgaaagtcgtggtgaacgcactgattggtgccattccggctatcctgaatgtgctcttggtgtgcttgatcttctggctggtgttctgtattttaggggtctactttttcagtggaaagttcggaaagtgcatcaatggaaccgacagtgtgatcaactacacaattatcaccaataagagccagtgtgaatcaggaaacttcagttggatcaaccagaaggtcaactttgacaacgtgggaaacgcgtacctcgccttactgcaggtggccacctttaaaggctggatggatatcatctacgccgctgtagacagcacagagaaggaacagcagccagagtttgagtcaaattccctgggatacatttactttgtggtcttcataattttcgggagcttcttcacccttaatctcttcattggggtaatcatcgacaattttaaccaacagcagaagaaactcgggggacaggacatctttatgactgaagagcagaagaaatactataacgcgatgaaaaaattgggaagcaagaaacctcagaaaccaataccacggcctctgaataaatgtcagggccttgtctttgacattgtgaccagtcagatcttcgatatcattataatctccttgatcattctgaacatgattagtatgatggcagagagctacaatcagcctaaggcaatgaaatctatcctggatcacctgaattgggtatttgtggttattttcacgctagagtgtttaattaaaattttcgcactaaggcagtattacttcaccaatggttggaacttgtttgactgcgtcgttgtcctgcttagcattgtaagcaaatag

SEQ ID NO: 240922 - DNA, 5375 bp, Artificial Sequence
  Description of Artificial Sequence: Synthetic coding sequence
atggatgaccggtgctacccagtgatcttccccgacgagcggaactttcggccttttactagcgacagcttggccgctatcgagaagaggatagccattcagaaagaaaaaaaaaagagtaaggaccagactggagaggtccctcagcccaggccacagctcgacttgaaagcgtcccgcaaactacctaaactttacggcgacatcccccgagaactgataggtaaacccttggaggatctggatccattctacaggaatcacaaaacattcatggtactgaatcgcaaacggacgatctatcggttctcagccaagcatgcgttgtttatttttggaccctttaactccattcgctctcttgcaatacgagtgtctgtgcacagccttttttctatgtttatcataggaaccgtaatcatcaactgcgtcttcatggctaccggcccagctaagaacagcaactccaacaatacagatattgcagagtgcgtctttactggtatttacatattcgaggccctcatcaagatccttgctaggggctttatcctcgatgaattctctttcctgagagacccgtggaactggctcgactccattgtcatcggtatcgctatagtcagctacatccctggcattaccatcaaactcttacccttgcgaacgttccgtgtgttcagagctttgaaggctatctcagtggtgtcccgactgaaagttattgtgggggctctcctcaggtctgtgaagaagttggttaacgttatcatcctcacgttcttctgcttgtccatatttgcactcgtgggtcagcagctattcatgggctctctgaacctgaagtgcatttctcgggattgtaagaatatctctaacccggaggcttatgatcactgcttcgaaaagaaagaaaacagccccgaatttaagatgtgtgggatctggatggggaatagcgcatgctccatccagtatgaatgtaagcatacaaaaataaacccagattacaactatacaaattttgacaatttcggatggagctttctggccatgttccggctgatgacgcaagattcttgggagaaactctaccaacagactcttcgcacaacgggactatatagtgtcttttttttcattgtggtgatctttctgggcagtttctacctcatcaatctaacactggccgtcgtgacaatggcctacgaggaacagaataaaaatgtggcagccgaaatcgaggcaaaggaaaaaatgtttcaggaggcgcagcagctgttgaaagaagagaaagaagccctggtcgccatgggaattgacagatcttcgctgacctcgttagagacctcctatttcaccccgaagaagcgcaaattgttcggcaataaaaagcggaagagcttttttttgagggagtctggcaaggatcagccccctggaagcgactccgatgaggactgtcagaaaaagcctcagctgctggaacagacgaaacgattgagccagaatctgtctctagaccactttgatgagcatggagaccccctgcaacggcagcgcgcacttagcgctgtcagcatcctcacaattaccatgaaggagcaggagaaatcacaggaaccttgtctgccatgcggagagaatctcgcttctaagtatctagtgtggaattgttgtcctcagtggttatgtgtgaagaaagttctgcgcacagtgatgaccgacccttttacggagctcgccataacaatttgtatcatcatcaataccgtgttcctggccatggagcatcataagatggaagcctcattcgaaaagatgctaaacattggcaacctggtcttcacctcaatctttatagctgagatgtgcctgaagatcatcgccctcgacccataccactacttccgaagagggtggaacatatttgattctattgttgctcttttgtcctttgcagacgtgatgaattgtgtgctccaaaaacgatcctggcccttccttagatcattccgtgtcctgcgggtgtttaaactggccaaatcttggccaacgctgaacaccctgatcaagatcatcggaaattcagttggagccctggggagcctgactgtagttctagttatagtaatcttcatattttcagtggttggcatgcagctgtttggtcggtcctttaacagccaaaagtctcctaagctctgcaatccgacgggacccaccgtttcttgtctgcgccattggcatatgggggatttttggcattcttttctggtcgtttttcgaatcctgtgtggagagtggatcgagaacatgtgggagtgtatgcaggaggccaatgcctcctcttctctgtgcgtcatagtgttcatcctgattactgtcatcggcaagctcgtggtgctgaatctctttatagcactactgttgaattcttttagtaacgaagaacggaacggaaacctggaaggcgaggccagaaagactaaagtgcaattagcactggaccggttccgtcgtgccttttgttttgtgagacacaccctggaacacttctgtcataagtggtgtagaaagcagaatcttccacaacagaaagaggtggcgggaggatgcgcggctcagtctaaggatatcattccactggttatggaaatgaaaaggggcagcgagacgcaagaggaactggggatattaacttcagtgcccaagactcttggcgtacgccacgactggacatggctcgcacctctggctgaagaggaggacgatgtcgaattctcaggagaggataatgcccaacgcatcacacagccagagcctgaacagcaggcatatgagctgcaccaggaaaataagaagccaacctcgcagcgcgtccagagcgtggagatcgacatgtttagtgaggacgagccccaccttacgattcaagacccaaggaaaaagtctgacgtgaccagcatcttgtcagagtgcagtaccatcgacctgcaggatggctttgggtggctgccggaaatggtccccaagaagcagccagagcggtgcttgccgaaaggctttggctgttgtttcccatgttgtagcgtcgataaacggaagcccccttgggtgatctggtggaacttaaggaaaacatgctatcagatcgttaaacattcttggtttgaatccttcatcatctttgtgattctgctcagtagcggagccctgatcttcgaagacgtccatttggaaaaccagcctaagatccaagaactccttaactgcactgatatcatctttacgcatattttcattctggaaatggttctgaagtgggttgccttcgggtttgggaagtactttacctcagcctggtgttgtctcgattttattatcgtaatcgtttcagtgactacactgatcaacctaatggagctgaagtcattcagaaccctgcgggctctccggcctttgcgcgctttgtctcagttcgaggggatgaaagtcgtggtgaatgccttgatcggagccatccccgctatactgaacgtgctgctggtctgtttgatattttggctggttttctgcatcctcggtgtgtattttttctctggtaaatttggcaagtgcatcaacggcacggacagcgtgatcaactacacaatcatcacaaacaaaagtcaatgcgagagtgggaacttctcctggatcaaccaaaaagtaaattttgacaacgtcggtaacgcctatctggcactgttacaggttgctacctttaaggggtggatggacataatctacgctgctgtcgacagcactgaaaaagagcagcagccagagtttgaatccaactctctcgggtacatttattttgtggtgtttattatctttggaagctttttcactctcaatttatttattggagtcattattgacaacttcaatcagcagcagaagaagctgggtggacaggacatctttatgacggaagagcagaagaagtactacaacgcgatgaagaagctcggatctaagaagccccagaagcccatccctagacccctcaacaagtgccaagggctagtgtttgatattgtaacatcccagatctttgatattatcatcatttccctgatcattctcaacatgatttccatgatggccgagtcctacaaccaacctaaagcaatgaaaagtattctggatcacctgaactgggttttcgtggtgattttcactcttgagtgcttgatcaaaattttcgccctccggcaatactactttaccaacggctggaatttgtttgattgcgttgttgttctgttaagcatcgtgagtactatgatatcgactttagaaaatcaggagcatatccctttcccccctacactgtttcggatcgtacggctggcacgcattggcaggatcctgcgtctcgtgcgagctgctaggggcatccgaacgcttttattcgccttaatgatgagtctcccttcactgttcaacatcggtctgctcctttttctaataatgtttatttacgctattctcggcatgaactggttttccaaagtgaaccccgagagtggcatagatgacatcttcaattttaagactttcgcaagctcaatgttgtgcttatttcagatcagcacttctgccggatgggatagcttactgagcccaatgctccgtagcaaagagtcttgcaattcaagctctgaaaactgtcacctccccggtattgccacctcctatttcgtatcgtacattatcatttcctttctgatcgtcgtgaatatgtacattgccgttatcctggagaactttaacactgctactgaggagagcgaggacccactgggggaagacgatttcgacatattttatgaggtctgggaaaagtttgatcctgaggctacacagtttattaaatacagtgcgctgagcgactttgccgacgccctccctgagccactccgagttgccaagccaaataagtaccaattcttagtgatggatctgcccatggtctcagaagatcgcctgcactgcatggatattctcttcgcctttactgcccgtgttctgggcggtagcgatgggttggatagtatgaaagccatgatggaagaaaaatttatggaggccaaccccttgaaaaaactctatgagccgatcgtgacaaccacaaagagaaaggaagaggagaggggggcagctataatccagaaagcttttagaaagtatatgatgaaagtgaccaagggcgatcagggagatcagaacgatttggagaacggaccacactcacctttgcagacactgtgcaatggggacctgtcatcttttggagtggcaaagggcaaagttcactgcgacta

SEQ ID NO: 240923 - DNA, 5217 bp, Artificial Sequence
  Description of Artificial Sequence: Synthetic coding sequence
atgctcaaacgcaaacagtcaagccgcgtcgaggctcaacctgtgaccgactttggtccagacgaaagtctcagtgataacgctgacatactatggatcaataagccatgggtccatagcctgctgcgcatttgtgctatcatctccgtcatatctgtatgcatgaacacacccatgacattcgagcactacccaccacttcagtacgtcacgttcacattagatactctcctgatgttcctgtacactgccgaaatgatcgcaaaaatgcacattagagggattgtgaaaggcgatagctcttatgtcaaagataggtggtgtgtttttgacggcttcatggttttttgtttatgggtgtctttggtcctgcaagtgttcgaaattgcggacatagtggatcagatgagcccctggggaatgctccgtattccacgaccattgattatgatcagggccttcagaatatattttaggttcgagttgccaaggaccaggatcacaaatatcttgaaaaggagcggcgagcagatctggtccgtgtcaatctttctgttattttttctcctgctctatggaattctgggggtacaaatgtttggcacttttacctaccactgcgtggttaacgacactaaacctgggaacgtgacatggaactcactcgccatccccgatacgcactgttcgccagagctcgaagagggctaccaatgtcctcccggattcaagtgtatggatttggaggaccttggcctgtctcggcaggaattgggttacagcggcttcaacgagatcggcacatcaattttcacagtgtatgaggctgccagccaggagggttgggtcttcctcatgtaccgggcaattgactcattcccaaggtggagatcatacttctacttcatcaccttaatcttcttcctggcatggttggtgaaaaacgtgtttattgccgttataatcgagactttcgcagaaatccgcgtacaatttcagcagatgtgggggtctcgctcctcaacaacttccaccgcgaccacacaaatgttccacgaagatgccgctggaggctggcagcttgtggcagttgacgtcaataagccccagggaagagcacctgcatgtcttcagaaaatgatgcgaagttccgtgtttcacatgttcatcctcagtatggtaacagtggatgtcatcgtggccgctagtaattactataaaggggagaacttccgcagacagtacgacgaattttacttggctgaggtcgccttcacggtcctgttcgaccttgaagcactgctcaaaatctggtgcttgggcttcacgggctatatttcatcctctctgcacaagttcgaactgctgttagtgataggcacaaccctgcatgtgtacccagatctttaccactcacagttcacctattttcaggttttgagggtcgtgagactgattaagatcagtcccgcattagaagacttcgtatataagatatttggccctggcaaaaagcttggctccctggttgtctttacggcatccctactcattgtgatgtctgccatcagtctacagatgttctgttttgtcgaggagctagacaggtttacaacgttcccacgtgcatttatgtctatgtttcagatacttacgcaagagggctgggtcgacgtgatggatcagactctgaacgctgtaggacacatgtgggctcctgtggtggcgatttactttattttataccacttgtttgcaacactaatcctactgtctctgtttgtagccgttatcctggacaacttggagctggacgaggacctgaaaaagctgaaacagcttaagcaaagtgaggccaacgcggacacaaaagaaaaattgccacttcgcctcaggatcttcgaaaagttccccaatcggccacagatggtgaaaatctccaaactgcctagtgattttactgtcccaaagattcgggagagcttcatgaaacagtttattgaccggcagcagcaggacacctgctgtctgctccggtctctgcctacaacatccagcagttcctgtgatcactccaaaagatctgcgatagaggataacaagtacattgaccaaaagttaaggaaaagcgttttctccataagggcgcgaaaccttctcgagaaggagaccgccgtgaccaaaatcctgcgagcctgtactaggcagcggatgttaagcggatcttttgaggggcaacctgctaaagagcgttccatcctgtccgtccaacatcatatcaggcaagaacgacggagcctgcgccacggtagtaatagccagaggatctcgagagggaagtccctggagaccctaactcaagatcacagtaataccgtgcggtaccgcaatgctcagagagaggacagcgaaatcaaaatgattcaggaaaaaaaagagcaggccgagatgaagaggaaggtccaagaggaggagcttagagaaaatcacccgtacttcgacaagcccctgttcattgtggggagggagcaccgcttccggaatttctgtagggtggtcgtgcgcgctcggttcaacgcgtcaaagactgacccggtgactggagccgtaaaaaatacaaagtaccatcagttgtatgacctgttgggcctcgtaacatacttagattgggtaatgattatcgtcaccatctgcagctgtatttctatgatgtttgagagtccttttagacgtgtgatgcatgccccaactctgcaaattgccgagtatgtattcgttattttcatgagtattgaactcaacctgaagatcatggcagacgggctgtttttcacacccactgccgtcattcgggacttcggcggagtaatggatattttcatttacctggtctccctgatttttttgtgttggatgcctcagaacgtaccagccgaatctggagctcagttactgatggtgctgagatgtctgcggcctctgcggattttcaaactggtgccacaaatgaggaaggtcgttagggaactcttctccggcttcaaagagatctttctggtgtccatacttctgctcaccctcatgctggtatttgcctccttcggcgttcagttattcgctgggaaactggccaagtgtaacgatccgaatattattaggcgggaggactgtaacggcattttcaggattaacgtatcagtcagtaaaaaccttaacctgaagctgcgccctggtgaaaagaaacctggcttctgggtccctcgagtgtgggctaatcctaggaacttcaatttcgataatgtgggaaatgcaatgttagcactgttcgaagtactgagcctgaaaggttgggtcgaagtgcgcgacgtgattattcacagagttggacctattcacggtatttatattcacgttttcgtttttcttggatgcatgataggcctgaccctcttcgtcggcgtggtgatcgcaaactttaacgagaacaagggcactgctctgctgaccgtcgaccagcgacgctgggaagacctgaaatcacgtctgaagattgcacagccgttacatctgccgcctcgacccgacaacgacggttttcgggctaagatgtatgacattacacaacatcctttttttaagcggacaatcgcactgctcgtgctggcgcagagcgtccttctgtctgtgaagtgggatgtggaagaccccgtgaccgtgccactagcgactatgagtgttgtgttcacgtttattttcgtgttggaggtgacaatgaagatcattgctatgagtcccgctggattctggcagagtcggagaaataggtatgacctcttggtgacgtccctgggcgtggtctgggtggttctccactttgccttgctgaatgcttacacatacatgatgggggcttgcgtcatcgtctttcgctttttctccatttgcggaaaacacgtgactcttaaaatgctgctgcttaccgtcgtggtgagcatgtataagtccttctttatcatcgtaggaatgtttttgctcctcctctgctacgcattcgccggagtggttctgtttggaaccgtgaaatacggagaaaatataaatcgccacgcaaacttctccagtgccggtaaggcaatcactgtgctttttcggatcgtaaccggagaagactggaacaagattatgcacgattgtatggtccagccccctttctgtacccccgacgagtttacatactgggccaccgactgtggcaattacgccggagcgcttatgtacttctgctctttttatgtgatcattgcctacatcatgcttaatcttctggtggcgatcatcgtggagaacttctctctgttttatagcacggaggaggaccagcttctgagctacaatgacctacgccattttcagatcatttggaacatggtagacgacaagagggaaggcgttattcctacctttcgcgtaaagttcttgttgaggctactgcggggacggctcgaggtggatctggacaaggacaagctcctgttcaagcacatgtgctatgagatggagcggctacataatgggggagatgtgaccttccatgatgtgctttcaatgttatcatataggtctgtcgacatcaggaagagcctgcagctcgaagaattgctggccagagaacaacttgagtacacaattgaggaagaagtggccaaacagacaattaggatgtggctgaagaagtgcttaaaacggatcagggctaaacaacagcagagctgttcaatcatacactctcttcgcgagagccagcagcaagaactgagcagattcctgaaccctcctagcatagaaacaacccagccttctgaagacaccaacgccaactcacaggacaattccatgcagccagagacctcttcgcagcagcagctgttgtccccaacactctctgacagggggggatcgagacaggatgcggctgacgcaggaaagccccaaaggaagtttggacagtggagactgccttcagcaccaaagccaatttcccatagcgtcagctccgtgaatctgcgatttggtggaaggaccactatgaagtccgttgtgtgtaaaatgaatccaatgacagatgcagcctcatgcggaagtgaggtgaaaaaatggtggacccggcagctgactgtcgaatccgacgagagtggcgatgatctcctcgatatctac

SEQ ID NO: 240924 - DNA, 2007 bp, Artificial Sequence
  Description of Artificial Sequence: Synthetic coding sequence
atgctgaaacggaagcagtcctccagagtggaggctcagcccgttaccgatttcgggccagacgagagcctgtctgataacgctgatatcctctggataaacaagccctgggtacatagccttctccggatctgcgctataatctccgttatctctgtatgtatgaatactcccatgacctttgagcattatccccctctgcagtatgtgaccttcactttggatactcttctgatgttcctgtataccgcggaaatgattgcgaaaatgcacattcgcggtatagtcaagggcgatagctcttacgtgaaagatcggtggtgtgtttttgacggctttatggtgttctgcctctgggtttccttagtgctccaggtgttcgagattgcagacatcgtggaccagatgagcccttgggggatgctcaggatccctcgcccactcattatgattagggcattcagaatatactttcgcttcgagctgccacgcacacgtattaccaatattctgaaaagaagcggggagcagatctggagcgtttccatcttcctgctcttctttttactgttgtacgggatcctgggggtgcagatgtttgggacattcacatatcattgtgttgtgaatgacaccaaacccggtaacgtgacttggaattcactggccatccccgatactcattgcagtcccgaactggaagaggggtaccagtgtcctcctggattcaaatgcatggatctggaagatctcggtctgagtcggcaggagctgggctattccggtttcaacgaaatcggcaccagcatctttacggtgtacgaggccgctagccaagagggctgggtgtttttaatgtacagagcaattgattcctttccacgttggagatcctatttctattttataacgctaatctttttcctcgcttggcttgtgaaaaatgtgttcatcgccgttatcattgagaccttcgcggaaatcagggtgcagttccaacagatgtggggaagtagatcctccactaccagtactgccactacacaaatgttccacgaagatgcagccggtgggtggcagttagtcgctgtggacgtcaacaaaccccaagggagggccccagcatgcttacagaagatgatgcgaagttcggtgtttcacatgtttatcctctctatggtcactgttgacgtgatagtggctgcctcaaactactacaagggggagaattttaggcgccagtacgatgaattctatctcgcagaagtggcattcactgtgcttttcgatctggaagctcttctcaagatttggtgtttaggcttcactgggtacatcagtagcagcctgcacaagttcgaactcctgctggttattggtaccactctgcatgtctacccagacctgtatcatagccagttcacatattttcaagtgctccgcgttgtgcggctgattaagatcagccccgctctggaagactttgtttataaaatatttggacctggaaaaaaactgggatccctagtggtttttacagctagcttgctgattgtgatgtcagccatctcattacagatgttctgcttcgtggaagagctagaccggttcacaacattccctcgggcatttatgtcaatgttccaaattctcacccaggaggggtgggttgatgtgatggatcagactttgaacgcagttgggcatatgtgggccccagtggtggcaatttattttatactgtatcacttgtttgcaaccctaccgccttccctgatcagggatctgtgcggtacacaggatgcatgcccaagttgcctccccttgcagcctcccaaccccctgcccggatcacagactctcgccaggcttacacatcaggcactcacaacacctccgggaatgaggtcttcccaacttttcagcaaaataagtctgctgttaggcatttgtgtggcttgggagtccatcctcggctcactgtccctctcccacaacctgcgctag

SEQ ID NO: 240925 - DNA, 657 bp, Artificial Sequence
  Description of Artificial Sequence: Synthetic coding sequence
atgctcaagcgtaaacaatcttcccgcgtggaggcacagccggtaaccgacttcggcccagacgagtccttgtccgacaacgctgatatcctctggattaacaaaccgtgggtgcactccttactgcggatctgtgcaataattagcgtaatcagcgtgtgcatgaacacccccatgaccttcgaacactaccccccattgcagtacgtcacctttacacttgatacccttctgatgtttttgtataccgccgaaatgatcgccaaaatgcacatccgtggcatcgtgaagggcgacagcagctacgtcaaagatcggtggtgtgtgttcgatgggttcatggtcttctgcctatgggtgtctctcgtgctgcaggttttcgagatcgctgatatagtagaccaaatgtcgccatgggggatgctccggattccccgtccccttattatgattagagcttttcgcatatactttaggtttgaactgccaagaactaggattacaaatattcttaaaaggtctggtgagcagatctggagcgtctcaatttttctgctcttttttttgctgttatacggtattttgggggtgcagatgttcggtacgtttacttatcactgcgtggtcaacgatacgaaaccgggactcagcctgtag

SEQ ID NO: 240926 - DNA, 657 bp, Artificial Sequence
  Description of Artificial Sequence: Synthetic coding sequence
atgcttaaacgcaaacagtcatcaagggtcgaggctcagcctgtgaccgacttcggaccagatgagagcctgtccgataatgccgacattctgtggattaacaagccctgggtccatagcctcctcaggatctgcgcgattatatcagttatttccgtgtgcatgaatacacctatgactttcgagcactaccctcctttacaatatgtgacattcacactcgatacgctcctgatgtttctgtataccgccgagatgatcgcaaagatgcatattcggggtattgtgaagggggactcctcttacgtgaaagaccggtggtgtgtgtttgatgggtttatggttttttgtttgtgggtatcacttgtgctccaggtattcgaaatcgcggacatagtcgatcaaatgtcaccttggggcatgctgcggatacccaggcccctaatcatgatccgggcttttcgcatctattttcggtttgagctgccaagaacccgcatcaccaatatattgaagcgatccggtgagcaaatatggtcagtttctatcttccttctgtttttcctactcctgtatggaattctcggagtccagatgtttggaaccttcacgtatcattgtgtcgttaatgatacaaaacccggacttagtatatag

SEQ ID NO: 240927 - DNA, 1725 bp, Artificial Sequence
  Description of Artificial Sequence: Synthetic coding sequence
atggcctcaaccgagggcgctaacaacatgcccaagcaggtggaggtgcgtatgcacgactcccatcttggctcagaagagcccaagcatcgtcatttgggcctccgtctgtgtgacaagctgggtaagaatcttctactaacactaacagtgtttggagtgatactgggggctgtttgcgggggactgctccgcttggccagtccgattcatcctgacgtcgtgatgttgatcgctttccctggcgatatactgatgcgtatgctcaaaatgctgatccttcccctgatcatctcatctctgatcaccggcctatcaggactcgacgccaaagccagtggtagacttggcaccagggctatggtgtactatatgagtactaccattattgctgccgtcctcggagttatccttgtactggcaatacaccccggaaatcccaagctgaagaagcagctcggacccggtaaaaaaaatgatgaggtgagcagcctagatgctttccttgaccttatacgtaacctcttccctgagaatcttgtgcaggcctgcttccaacaaatccaaacagtcactaaaaaagttttagtggcaccgcctcctgatgaggaagctaatgccacatcagcggtcgtatcccttctgaatgagacagtgaccgaggtgcccgaagaaaccaaaatggttatcaagaaaggcctggaatttaaggacggaatgaacgtgttggggctcattgggttttttatcgcctttggcattgcaatggggaagatgggggaccaagccaaattgatggtcgattttttcaatattctcaatgagattgtgatgaagctcgttatcatgattatgtggtactcgcctctcggaattgcctgcctgatctgcggcaagatcatcgcgatcaaggaccttgaggtggtcgccagacagctggggatgtatatggtgacggtgattattggcttgattatacacggcggaatattcctgcctttgatctacttcgttgtcacacgtaagaaccctttttccttctttgctggaatattccaagcgtggataactgcccttggcactgcatccagtgccggaactcttcctgtgacatttcggtgcttggaggagaacctggggatcgataagcgagtgactaggttcgtcctgccagtcggggctaccatcaacatggatggcacggcattgtacgaggctgtggccgcaattttcatcgcgcagatgaatggcgtggtgctggatggcggacagatcgtgaccgttagtttgaccgctacgctggcatctgtgggagctgcctcgattcccagcgccggacttgtgactatgctgttgatcttaaccgctgtgggactgcccactgaagatatctccctcctcgtggccgtggattggctgctcgacagaatgcgaacctctgtgaatgtcgtaggcgactcttttggcgctggcatcgtctatcatctgtcaaagagcgaactggatactatcgattctcagcaccgcgtacacgaagatatcgagatgactaaaacccaaagcatctatgatgacatgaaaaatcaccgcgagtccaatagcaatcagtgcgtttatgctgcacacaattctgtgattgtcgatgagtgtaaggtcacactcgctgctaatgggaaaagcgctgattgctctgtcgaggaggagccctggaaacgtgagaagtag

SEQ ID NO: 240928 - DNA, 1698 bp, Artificial Sequence
  Description of Artificial Sequence: Synthetic coding sequence
atgcccaaacaggtggaagtgaggatgcacgactcacatctgggatctgaggagcccaagcaccgccatttagggttacgactgtgtgataagttgggcaagaacctattattaactctgacagtgtttggtgtgatacttggggcagtttgtgggggactcctgcgccttgccagcccgatccacccagatgtggtcatgttgatcgcatttcctggggacattctgatgaggatgcttaagatgctgatccttccactcataatatctagccttataaccggtctctcagggctagatgccaaagcatctgggagattgggaacaagggcaatggtctattacatgagcaccacaataattgccgctgtgttgggtgtgatcctagtgttggcgattcatcctggtaaccccaagttgaaaaaacagctggggccaggaaaaaagaatgatgaagtgtcctctttggacgcgtttctagacctgatccggaacctgttcccagagaatctggtgcaagcatgctttcagcaaatccagacagtcacgaaaaaagtcctggtggcacctcctccagacgaggaagcaaatgcaacttccgctgtagtctccttgctgaacgaaacggtgacagaggtgcctgaagaaaccaaaatggttatcaaaaaaggcctggagtttaaggatggaatgaacgtgctgggcctcatcggcttctttatagccttcggaatagctatgggtaagatgggtgaccaggccaagctgatggtcgacttctttaacattctgaatgagatcgttatgaagctagtcatcatgataatgtggtactcgcccttgggtatcgcctgcctcatctgcgggaagatcatagcaataaaggacttggaggtcgtggccagacagctgggcatgtacatggtcacagtgatcattgggttgattattcatgggggaatattcctccctctgatttactttgtggtcactagaaagaatccattctcatttttcgccggaattttccaagcatggataactgccttgggcactgcctcgagcgctggaactcttccagtgaccttccggtgccttgaggagaatctgggtattgataagagggtcacccggtttgtcctcccggtgggcgcaacgatcaacatggatgggactgccctttatgaagccgtcgcagccattttcatagcgcaaatgaacggagtggttttggatgggggtcaaatcgtgaccgtgtctctgacagccactttggcctcggtaggggctgcctctataccctctgccggactagtgactatgctccttattttgaccgcagttgggctccctactgaggacatttccttgctagtggctgttgattggcttttagacaggatgaggacctctgtcaatgtggtgggtgactcgtttggcgctggaatcgtgtaccacttatcgaagtctgaactggacaccatcgactcccagcatagagttcacgaagacatcgagatgacaaaaacacaaagcatctacgacgatatgaaaaaccatagagagagcaatagtaatcagtgtgtgtacgccgcacacaattccgtcatcgtggacgagtgtaaagtcaccctggcagccaacggcaagtcggcggactgtagcgtggaggaagagccctggaaaagagaaaaatag

SEQ ID NO: 240929 - DNA, 1698 bp, Artificial Sequence
  Description of Artificial Sequence: Synthetic coding sequence
atgcctaaacaggtggaagtgcgaatgcatgatagtcacctcggtagcgaggaacctaagcatcggcacttaggtctcaggctgtgcgacaaactgggaaagaatttactcctgacactcaccgtgtttggggtgattctcggggcagtgtgtggagggctccttaggctggcctctccaattcatcccgacgtcgtaatgttgattgccttcccaggcgatattctaatgcgcatgctgaaaatgttaatcctaccactcattatctcaagcctgataaccgggctctcgggtctcgatgctaaagccagcgggaggctgggaaccagagcaatggtgtactatatgtctaccacgatcatcgccgctgtcttaggtgtaattctcgtcttagctattcatcctggcaaccccaagcttaaaaagcaactcgggcctggaaagaaaaatgatgaagtgagttccctggacgctttcctcgacttgatacgcaacctgtttcccgagaacctcgtccaggcctgtttccagcagattcagactgtgactaaaaaggtgctggtggcccctccacccgacgaggaggccaatgccacatcagccgtggtgtctttgctgaatgaaaccgtgaccgaagtgccagaggagactaaaatggtgattaagaaagggttagagttcaaggacgggatgaacgtgctggggctgatcggcttctttatcgcatttggcattgctatgggaaagatgggcgatcaggccaagcttatggtggacttcttcaatattcttaatgagatcgtgatgaagctggtgatcatgattatgtggtactcacctttaggaattgcttgccttatttgtggtaaaatcatagctatcaaggatttggaggtggtagcaagacaactgggaatgtacatggtgacagtgataattggcctcatcatccatggcggtattttcctgcccctcatctatttcgtcgtaacccggaagaatcctttctcttttttcgccggaatcttccaggcctggattaccgccttgggaactgcaagctctgcaggcacactgccggtgacattccggtgcctggaggagaatctgggcatagataagcgcgtcactcgattcgtcctcccagtgggggcaacgatcaacatggacggcacagctctctacgaggcagtagccgctattttcatcgcccagatgaacggggtggtgctggacgggggacagattgtgactgtctccctgactgctacactggctagtgtcggggcagcaagcatccctagcgctgggctcgttaccatgcttttgattttgaccgctgtggggctcccaactgaagatatctctctattggttgcagttgactggctgctggacagaatgcggacgagcgtgaacgttgtgggggactctttcggagccggtattgtataccatctgagcaagtccgagctggacaccatcgactctcaacaccgcgtccacgaagacatcgaaatgaccaaaacacagtcgatttacgatgacatgaagaaccatagggagtccaatagtaatcaatgtgtatacgctgcacacaattccgtgattgtggacgaatgcaaggtgaccctggccgcaaacgggaaatctgccgactgctccgttgaagaggaaccctggaagcgtgagaagtag

SEQ ID NO: 240930 - DNA, 1629 bp, Artificial Sequence
  Description of Artificial Sequence: Synthetic coding sequence
atgaccaagtccaatggggaagaacccaagatggggggtcgcatggagagattccaacagggcgtccggaagcgtaccttattggctaaaaaaaaggtgcaaaatattacaaaggaagacgtgaagtcatatctcttccgaaatgcctttgtgctcctaacagtcacagcagtgatagtgggcaccattctgggtttcaccctccgcccatatcgcatgtcatatcgcgaggttaaatatttcagctttcccggagagttgctgatgcgcatgctgcagatgctggtcctgcccctgataatctcatccctcgtgaccgggatggccgctctcgactccaaggctagcgggaaaatgggtatgcgagccgtggtctactacatgacgaccaccattattgctgtggtgatagggataatcatcgtgataattatccacccagggaagggcaccaaggaaaacatgcatagggaaggtaagatcgtgagagttactgcagcggacgctttcctagatttaatcagaaatatgtttcctcctaacctcgtagaggcctgcttcaagcaattcaagacaaattatgaaaaacgttcgtttaaggttccaatacaggccaatgagactcttgtaggcgctgtgatcaataacgtatctgaggcgatggagacactgacgagaatcaccgaagagctggttcctgtgccgggttctgtgaacggtgttaacgcgcttggcctagtggtcttcagcatgtgtttcgggttcgtgatcggcaatatgaaagagcagggccaagcattaagagagttttttgacagcctgaacgaagctatcatgagactggttgctgtcataatgtggtacgcccctgtggggatattgtttctaatcgctggaaagatcgtggagatggaggacatgggcgtgatcggaggccagctggctatgtacactgtcactgtgattgttggcctcctgatccacgctgtgattgtactcccacttctgtatttcctggtcacccggaagaatccctgggtgtttatcgggggactcctgcaggctctgatcactgcgctggggacttcaagctcttccgcaacattgcccataacatttaaatgtctggaggagaacaacggtgtggacaaaagggtgacccgcttcgttcttcctgtcggcgcaaccatcaacatggacgggactgccctgtacgaggctctggccgctatctttatcgcccaggtcaacaactttgaactcaatttcggtcagatcatcaccatatctattaccgcaacagccgctagcattggtgctgctggcattcctcaggctggtctggtgactatggttatagtgctgacatcagtgggtctgcccactgacgatatcacactcatcatcgcagtcgattggtttttagataggctgcgcactactacaaatgtgcttggcgactctctgggcgctggcatcgttgagcatctgtcgagacacgagttgaagaatagggatgtggagatgggtaactccgtgatcgaggagaatgaaatgaagaagccctaccagctcatcgctcaggacaatgagacagaaaagcccatcgacagcgaaaccaagatgtag

SEQ ID NO: 240931 - DNA, 1494 bp, Artificial Sequence
  Description of Artificial Sequence: Synthetic coding sequence
atgaccaagtctaatggagaggagcccaagatgggaggtaggatggaacgattccaacagggcgtcagaaaacgtacactgctggctaaaaaaaaggtgcagaatataaccaaagaggacgtgaagagttacctgtttagaaatgccttcgttctcctgacagtgacagctgtgatcgtcgggacaatcctgggtttcaccctgagaccgtacaggatgtcctacagggaggtgaagtatttctcattccctggggagctactgatgaggatgctgcagatgctagtgctcccactaatcatctctagtcttgtgactggaatggccgctctggattccaaagctagcggaaagatgggaatgcgggctgtggtgtactatatgacgaccacaatcatcgccgtggtcatcggcattatcattgtgatcattattcatccgggaaaaggaacgaaggagaacatgcaccgagaaggcaagatagtgagggtgacagctgcggatgcttttctagacctgatacgtaatatgttcccacccaacttggtagaggcatgcttcaagcagttcaagactaactatgagaaacggagtttcaaagtgccgatacaggccaacgagacccttgtgggcgcagtaattaacaatgtaagtgaagccatggagacactcactagaataactgaggagttggtgcccgtccctggcagcgtgaatggagtaaatgctttggggctagtggtgttctctatgtgtttcgggttcgttattggtaatatgaaagagcaggggcaagcgctgcgcgaattctttgattctctcaacgaagctatcatgcgtctcgtcgcagtcatcatgtggtacgcccctgtgggcatactgttcttgatagcaggcaaaatcgtggaaatggaggatatgggggtaatcgggggtcagctcgcaatgtacactgtcactgtcattgttggactgttaatccatgccgtgatcgtgctgcccctgctgtacttcctcgtaactaggaagaatccctgggtgtttattggaggactgctgcaggcactgattacagcactcggtacctcctctagcagtgccactctgcccatcacattcaagtgtctggaagagaacaacggcgtggataaacgcgtaactcgcttcgtgctgcctgttggcgcaacgatcaacatggacgggacagcgctctacgaagcactggctgcaatttttattgcacaggtcaataattttgagttaaatttcggacagatcataaccatcagggaccgcctccgcaccaccactaacgtcttaggggatagtctgggggcaggtattgtcgagcacctgtctcgccatgaattgaaaaatcgggatgtggagatgggaaattcggttattgaggaaaacgaaatgaaaaagccgtatcagctgatcgcccaggataatgagactgagaagcccatcgacagcgagactaagatgtag

SEQ ID NO: 240932 - DNA, 348 bp, Artificial Sequence
  Description of Artificial Sequence: Synthetic coding sequence
atgactaagagcaacggtgaagaaccgaagatgggaggacgcatggaaaggttccaacagggcgttagaaaacggaccttactggccaaaaagaaagtgcagaacattactaaggaagacgtgaagtcctatctgttccgcaacgctttcgtgcttctcacagtcacagcagttatagttgatgaaaagaccgaggcccagatcttgaccactcagctcatgaatacggagtgggactcaaatcctccttttagattacaggtactgattcaccatacagtcttgggtgcaattactccaatactcgcactacttcagcagttcgccgagggtctccccgaagtctag

SEQ ID NO: 240933 - DNA, 1473 bp, Artificial Sequence
  Description of Artificial Sequence: Synthetic coding sequence
atgacaaaatctaatggagaagagccaaagatgggcggaaggatggaaaggtttcagcaaggggtgcggaagagaaccctactggcgaaaaagaaagttcagaacattaccaaggaagatgttaaatcataccttttcaggaatgcatttgtactcctcaccggcatggctgcattggattcaaaagctagtggcaaaatggggatgcgggcagttgtgtactatatgactaccacaattattgcagtcgtgatcgggatcatcatcgtgattatcatccacccaggaaaagggactaaggaaaacatgcatcgggaaggaaaaattgtcagggtgacagctgcagacgcgtttctggacctgatacggaacatgtttcctccgaacctggtggaggcctgcttcaaacagtttaaaaccaattacgaaaagcggtccttcaaggtgcccatccaggccaatgaaaccctcgtcggagctgtgatcaacaatgtcagcgaggctatggaaacgttgacgcgcatcacggaggagcttgtccccgtgcccggatccgttaacggtgtgaacgcactgggcctggtggtctttagcatgtgctttgggttcgtcattggcaacatgaaagaacagggccaagcgcttagagaattcttcgatagcctcaatgaagccattatgcgcttggtcgctgtaatcatgtggtacgcgcctgtgggcatcttatttttaattgcagggaagatcgtcgagatggaggacatgggcgtgattggaggacagctcgcaatgtatactgtcacggtcattgtaggactgcttatacacgctgttatagtgttgcctctcctctatttcctggttactcggaagaacccctgggtattcatcggtggcctactccaagcacttattacagcccttggtacctcgtcctcctcggctaccctgcctattactttcaaatgtttggaagagaacaacggcgtggacaagagggtgacacggttcgtgctgcccgtcggggcaacaattaacatggatggaaccgctttatacgaagcactggctgctatctttatcgcacaggtgaataatttcgaactcaacttcggtcagatcatcactatcagtattactgcaaccgcggcttcgatcggagccgctggcatccctcaggcgggtttggtgacaatggtgattgtgcttacctcagtgggtctacctactgatgacataaccctgatcatcgccgtcgactggttcctcgatagacttaggactaccacaaacgtgctaggcgatagcctgggtgcgggaatagtcgagcacctctcccgacatgagttgaaaaaccgggacgtggagatgggtaacagtgtaattgaggagaatgagatgaagaaaccctaccagctcattgcacaagataacgagacagagaagccgatcgatagcgaaacaaagatgtag

SEQ ID NO: 240934 - DNA, 324 bp, Artificial Sequence
  Description of Artificial Sequence: Synthetic coding sequence
atgacaaagagcaacggggaagaacctaaaatggggggtcgaatggagcgctttcagcaaggagtgcgcaagaggaccctgcttgcaaagaagaaggtacagaacataacaaaggaagatgtgaagagctacttgttcagaaacgcctttgtgttactcaccgttacagccgtaatcgttggtactatcctgggattcaccctcagaccatacaggatgtcttaccgagaagtgaagtacttttcatttcccggtgagctgctaatgcgaatgctgcaaatgttagtattaccactaattatcagtagcttagtgaccggttag

SEQ ID NO: 240935 - DNA, 324 bp, Artificial Sequence
  Description of Artificial Sequence: Synthetic coding sequence
atgacaaagtctaatggagaagaacctaaaatggggggtaggatggagcgttttcagcagggagtaagaaagcggaccttgctggccaaaaagaaggtccagaatatcacaaaagaagacgtcaaaagttacttgtttaggaacgctttcgtacttctgacggtgacggcggtcattgtggggaccattcttgggtttactctgcgcccttacaggatgtcctacagagaggtcaaatacttctcattccccggagaattgttaatgaggatgctccaaatgctcgtgctgccattgatcatctctagtcttgtgacgggatag

SEQ ID NO: 240936 - DNA, 306 bp, Artificial Sequence
  Description of Artificial Sequence: Synthetic coding sequence
atgacgaagtccaacggagaagagccaaagatggggggaaggatggaaagattccagcaaggcgttaggaagcgcactctgctggctaagaaaaaagttcagaacatcactaaggaggatgtgaagtcgtatctgtttcgaaatgcttttgtactcctgacggtgaccgctgtgatagtcggcactattctgggattcacgctccgcccttatcgaatgagctatagggaggtaaaatacttttcttttcctggagagctgctgatgcgcatgctgcagatgcttgtgcttcctcttattatatag

SEQ ID NO: 240937 - DNA, 987 bp, Artificial Sequence
  Description of Artificial Sequence: Synthetic coding sequence
atgacgggggtgttcgattctctcgtcgccgacatgcattccacacagatcgctgcatcttctacctaccatcagcatcagcaaccaccttcagggggaggcgctggcccaggcggtaactccagctcaagctcatctctgcataagccacaagaatctcctaccctgccggtcagtactgccacagatagttcttactatacaaatcaacagcaccccgctggcggtgggggtggcggaggcagtccatatgctcacatgggctcataccagtatcaggcctctggacttaataatgtgccctactccgcaaagagctcatacgatctcggttatacagctgcctatactagttatgccccttacgggacctcctcctccccagccaataacgagccagaaaaggaagatctggagccagagatccggatcgtgaacggaaaacccaagaaagtgagaaagcccagaactatttattccagttttcaacttgctgctctgcagaggagattccaaaagacgcagtatctcgctctgccagaacgggctgaactggcagcatccctaggcctgacacaaactcaagtaaagatttggtttcagaataggagatcaaagttcaaaaagatgtggaagtctggcgaaattccctccgagcaacaccctggagcatccgcatcaccgccatgcgctagtccccctgttagtgcgccagcatcatgggattttggcgtgccgcagagaatggccggtggtggaggaccaggctctggcggaagcggggctggctcgagcggtagcagcccgagcagcgcagccagtgcctttctcgggaactatccatggtaccaccagacatctggtagcgctagccacttacaggcaaccgcacccctcctgcacccaactcagactccccagccacaccatcaccatcatcaccatgggggtggaggtgcccctgtgagcgcaggaaccatcttttag

SEQ ID NO: 240938 - DNA, 1359 bp, Artificial Sequence
  Description of Artificial Sequence: Synthetic coding sequence
atgctgctgagaatgctccgtatgattattctccctctggtcgtctgttctctggtgtcaggggcagcctccctcgatgcctcttgcctcggaagactgggagggattgctgtagcatacttcgggctcacaacgttgtccgcctctgcactcgccgtggcactcgcctttattataaaacccggatctggcgctcagactcttcagagttccgacctgggacttgaggatagcggcccacctccagtcccaaaggagactgttgactcattcctcgaccttgcaaggaacctttttccttcaaacctggttgttgctgcttttcgaacttacgccaccgactataaggttgtgacacagaactcatcctctggtaatgtgacccacgagaaaatccctatcggcactgagatcgagggtatgaatatactgggtctggtgctgtttgccctagtgctaggcgtggctctgaagaaactgggcagcgaaggagaagatctcattcgcttctttaactctctgaatgaggctacgatggtcctcgttagctggattatgtggtatgtcccagtgggtattatgttccttgtcggatctaaaatcgtggaaatgaaggacatcatagttcttgtcacatcactgggcaagtatattttcgcatcaatactaggccatgtcatccacggtggaatcgtcctgccattgatctattttgtctttacaaggaaaaaccccttcagatttctgctggggctgttagctcctttcgccacagccttcgccacgtgttcttcttctgctactttgccctccatgatgaaatgtatagaggaaaataacggcgtcgataagcggatctcccgtttcattttgccaattggggcaaccgtgaacatggatggcgcagccattttccaatgtgtcgccgcagtctttatcgcccagctgaataacgttgagttgaacgccggacagatcttcacgatccttgtgacagccactgcatcgtctgtcggcgctgcaggcgtgccagccggaggtgtgctgacaatcgcgatcatcctggaagccatcgggcttcccacacacgacttgcccctgatacttgctgtggattggatcgtcgatcgcaccaccactgttgtgaacgtggagggcgatgccctcggagcaggaatcttgcaccacctgaaccagaaggccaccaaaaagggtgagcaggaactggctgaagttaaggttgaggccatacccaattgtaaatctgaggaagagacctcgcccctggtgactcaccagaaccccgctggtccagttgctagtgcccctgagttagagagcaaggaaagtgtgctctag

SEQ ID NO: 240939 - DNA, 705 bp, Artificial Sequence
  Description of Artificial Sequence: Synthetic coding sequence
atgaacatactagggctcgtgctgttcgctctggtgctgggtgtggctctgaagaagctaggatcagagggcgaagacttgatcagatttttcaattctcttaacgaagccaccatggtcctggttagttggattatgtgctccgccacgctgcccagcatgatgaaatgcatcgaggaaaacaatggtgtcgacaagcgcatttcccgctttatactgccaataggcgctacagtcaacatggatggggctgcaattttccaatgtgttgccgcagtgttcatcgctcagctcaataacgtggagttgaatgcgggtcagatttttactatcctggtgacggcaaccgcttctagcgttggggcagcaggcgtgcctgctggcggtgtgctgacaatcgctattatcctggaggctatcgggctgcccactcacgacctcccattaatccttgcggtagactggatcgttgacaggacaacaacagtcgtcaacgtagagggagacgcgctgggcgctggtatcttgcaccatctgaaccaaaaagccaccaagaagggggagcaagaacttgccgaagtgaaggtagaagctatacctaattgcaagtccgaggaagagacttcccctctggtgacacatcagaatcctgccggacctgtcgccagcgcccctgaactggaatctaaagagtctgttttgtag

SEQ ID NO: 240940 - DNA, 1575 bp, Artificial Sequence
  Description of Artificial Sequence: Synthetic coding sequence
atggggaagcctgctcgaaagggatgcgagtggaagagatttctgaagaacaactgggtgctgctgtctaccgtggctgcggtcgttctcggcataactactggcgtgctagtccgcgaacacagtaatctatccactctcgagaaattctactttgcattccccggagagattctgatgagaatgcttaagctgatcatactccctctcataatctcttcgatgatcaccggggtcgccgctttggactctaacgtgtctgggaaaattggtctgcgcgcagtggtgtactacttctgcacaactctgattgccgtaatcctgggaatcgtccttgtggttagcattaagcccggagtgactcagaaagtcggtgagatcgccagaaccggtagcacccccgaggtttccaccgtggatgccatgctggatttaataagaaatatgtttcccgagaatttagtgcaagcttgctttcagcagtataaaaccaagcgtgaggaggtgaagccacctagtgatcccgagatgaacatgactgaagagagctttacagcggtcatgacgacagctatttccaagaacaagactaaagagtacaaaatcgttggcatgtactctgacggaatcaatgtcctaggcctcatcgtattctgcctcgtgttcggactggtgatcgggaagatgggcgaaaaggggcagatcctggttgacttcttcaacgcgctgtctgacgctacaatgaagatcgtccaaattatcatgtgctatatgccactaggaattctcttcctgatagcgggaaagattatcgaagtcgaggactgggagatcttccggaaattaggtctttatatggccaccgtgctgactggtctggccatccattcaatcgtaatcctgcctcttatctattttatcgtggtacgcaagaacccattccggttcgccatgggcatggctcaggccctgttgaccgccttgatgatcagtagctcttccgcaactctccccgtgacttttcgctgtgctgaagaaaacaatcaagtagataagcgcataactcgattcgtgttacctgtcggtgccaccattaatatggatggaaccgccctctatgaggccgtggcggctgtttttatcgcacaactgaatgatcttgacctgggaatcgggcagatcatcaccatatctattacggccacatcagctagcatcggggctgcaggtgtaccacaagcaggattggtcacaatggtgattgtcctttctgcagtgggtcttcctgccgaggacgttacgctgatcattgctgtcgattggttactcgacaggttccggacaatggtgaacgtactgggagacgcgtttggaacgggaatcgtggaaaagctgtctaaaaaagaactggaacagatggacgtcagctccgaggtgaacattgtgaatccgtttgccctagaatcaacaatcctggacaatgaggactcggatacaaagaaatcctacgtaaacgggggattcgccgttgataagtctgacacaattagcttcacacagaccagccagttttag

SEQ ID NO: 240941 - DNA, 729 bp, Artificial Sequence
  Description of Artificial Sequence: Synthetic coding sequence
taattctttaacgctctgagcgacgcgacgatgaagatcgttcagatcattatgtgttatatgcctcttgggatcttgtttttgatagccggtaaaataattgaagtagaggattgggagatttttagaaaactcggtctttatatggccaccgttctcacaggattggccatccacagcatcgttattctcccccttatttatttcattgtggtccgcaaaaatccttttcgcttcgccatggggatggcccaagcgctcctaaccgctcttatgatctcctccagcagtgcaactctccctgtgacattccgctgcgctgaggagaataaccaggttgacaaacggattacacggttcgtcctgcccgtgggggctaccatcaacatggacggtacagcattgtatgaagccgtggccgcagtctttatcgcccagctgaacgacttggatctgggaatcggccaaataattacgattcgcgacagattcaggactatggtcaacgtgctcggggacgcctttggcactggaatcgtcgaaaagctcagcaaaaaagaactcgaacaaatggatgtaagttcagaggtcaacatcgtgaaccctttcgcgcttgagagcacgattctcgataatgaggactccgatacaaaaaaaagctatgttaacgggggttttgcagtggataagagcgacaccatctcctttactcagacctctcaattttag

SEQ ID NO: 240942 - DNA, 1647 bp, Artificial Sequence
  Description of Artificial Sequence: Synthetic coding sequence
gaaactcccgtgctgcccataatggtggcggaccctccgcgagacagcaaggggttagctgcagctgagccgaccgccaatggcggacttgccttggccagtattgaagatcagggggctgccgcaggaggatattgtgggagccgtgaccaggttcggagatgccttcgtgcaaatctcctcgtcctgctaacggtagtagcagttgttgcaggggtcgccttgggactgggtgtgtcaggggcaggaggggctctcgccctaggccctgaacggttatccgcctttgtctttcctggtgagctgctcctccgactgctgcgcatgatcatcctaccgttggtggtatgtagtctgattgggggtgccgcatctttagatccgggagcccttggacgacttggcgcatgggccctgctattctttctggtcaccaccttactcgccagcgctttaggcgtagggcttgcactggctctgcagcccggagccgcttccgctgctataaatgcatccgtgggcgcagctgggagtgccgaaaacgcgcctagcaaagaagtcctggacagcttcttagacctggccagaaacatattcccaagtaacctggtgtccgcagcctttcgttcttactcaactacgtatgaggagcggaatattacaggcacgagggtgaaggtccccgtgggccaggaggtggaaggcatgaacatcttaggcctcgttgtgttcgccattgtcttcggagtggccctcaggaagctgggacccgaaggggagctcctaataaggttctttaattcattcaacgaggccaccatggtgttggtttcgtggatcatgtggtacgctccagtgggcattatgtttctggtggccggaaagatcgtggaaatggaggacgtggggttactgttcgcaaggctgggcaagtacattctttgctgtcttcttggacacgcaattcatgggctgctggtactgcctcttatatacttcctatttacccgtaagaatccctaccggttcctttggggaatcgtcacacctcttgctactgctttcggcacctcaagtagtagcgccaccctacccctgatgatgaagtgtgtggaggaaaacaatggcgtcgctaaacatatctctcgatttattctcccgattggcgctacggtgaacatggatggagcagctctctttcaatgtgtggctgctgtctttatcgcacaactctcacagcagagtttggacttcgtgaaaatcatcacaatcctcgttacagccactgcatcctctgtcggcgcagctggaattcctgccggaggtgtcctgactctggccattatccttgaggctgttaacctcccagtggatcacatttccctgatacttgctgtcgactggcttgttgatagatcctgtactgtgctcaacgtggaaggtgatgcactcggtgcgggtttgctgcaaaattatgttgatcggaccgagtcccgctccaccgagccggagctgatacaagtcaagtctgaactgcccctagatcctctcccggtgcccaccgaggagggcaacccattactgaaacactaccgtgggccagctggggacgccaccgtagcctcagaaaaggaaagcgtcatgtag

SEQ ID NO: 240943 - DNA, 942 bp, Artificial Sequence
  Description of Artificial Sequence: Synthetic coding sequence
atgaacatcctgggactggtggtcttcgcaattgttttcggcgtggcacttaggaagctgggcccagagggtgaactgttaatacgattctttaattcctttaacgaagcaacaatggtgttggtaagctggattatgtggtacgctcccgttggtatcatgtttcttgtcgcgggtaagattgtcgaaatggaggacgtggggttgcttttcgctcgactgggtaagtacatcctgtgttgtctcctgggccatgcgattcacgggttgctggtgttgccactgatctacttccttttcacaaggaaaaatccttatcggttcctgtggggaatagtaaccccccttgcgaccgccttcgggaccagctcctcttctgccaccctgcctcttatgatgaagtgcgtcgaagagaacaacggtgtggcgaagcacatctcccggttcatcttgcctatcggagctacagtgaacatggatggcgctgcgctgttccagtgtgtagctgccgtgttcattgctcagctgagccagcagtcactggatttcgtgaaaatcattaccatcttggtcactgctaccgcctccagtgtgggagcggctggtattcccgctggcggtgtcttgaccctggcaatcattcttgaggccgtgaacttaccagtggatcatattagcctcattctcgcagtggactggctagttgacagaagttgtactgtcctgaacgtcgaaggggatgctctgggagctgggcttctgcagaattacgtggatagaacagagtcaaggtccaccgagccggagctcatccaggtgaaatccgagttgcccttagacccactgcctgttccaacagaagaagggaacccactgcttaagcattacaggggacccgctggtgatgccacagtggccagcgaaaaggagtcagtgatgtag

SEQ ID NO: 240944 - DNA, 1020 bp, Artificial Sequence
  Description of Artificial Sequence: Synthetic coding sequence
atgtactcaactacgtacgaagagaggaatattaccggcactagggtgaaggtccccgtcggtcaggaggtcgagggcatgaacatcctggggctggttgtgttcgctatcgttttcggcgtagcactgcgcaaactcggacccgagggagagctgctgataaggttttttaatagttttaatgaagctaccatggtacttgtctcttggatcatgtggtacgccccagtcggcatcatgttcctcgtggccggaaagatcgtcgagatggaggacgtcggcctgctttttgctagattgggcaagtatattctgtgctgtctactaggacatgccattcacggactgctggtgttacctctcatatacttcctttttaccaggaagaatccctacaggtttttatggggcattgtgacacctcttgcaactgcttttggaacgtccagttccagcgctacgctgccattgatgatgaagtgcgtcgaagaaaataatggagtggcaaagcatatcagtcggttcattctgccaattggcgcaacagtgaacatggatggggctgctttattccagtgcgtcgccgctgtcttcattgcacaactcagccagcagtctttagactttgtcaagatcattaccatactggtgactgccactgccagtagcgtgggcgcagccggtatccctgccggtggagtcctcacgctcgctatcattctggaggccgtcaacttaccagtggatcacatcagtttgattctggccgtcgactggctcgttgatagatcctgtactgtgctgaacgtggagggtgatgccctcggcgctgggctcctacaaaattacgtggacagaacagagagccgtagcacagaacccgagctgattcaggttaagtccgaactgccactggaccctctgccggtccccactgaagaaggcaatcccctccttaaacactaccgagggccagccggagatgccaccgttgcctctgaaaaagagagtgtcatgtag

SEQ ID NO: 240945 - DNA, 1626 bp, Artificial Sequence
  Description of Artificial Sequence: Synthetic coding sequence
atggtggccgatccaccaagagattccaaaggcctagccgctgccgaacctaccgccaacggcggactggccctagccagcatcgaagatcagggtgccgcagctggaggctactgcggttcaagggatcaggtaagaaggtgcctgagagcaaacttgctcgtgctgctgacagtggtggctgtagttgctggggtcgccctaggcttgggtgtgtccggagcaggcggagctttggcccttgggccagaaagactgagcgcgttcgtgtttccaggcgaattactgctgaggttgctacggatgattatcctgcccttggttgtatgtagtctgatcgggggagcagcaagtctggaccccggtgccctgggacggttaggtgcctgggcactcctgtttttcttggttaccacactgctagccagcgctctgggggtaggactcgccttggccctgcagcccggagctgcctctgcagcgatcaacgcaagcgttggagctgctggcagcgctgaaaacgctcccagcaaggaggtcttggactcattcctggacctggccaggaacatcttccctagtaatctagtctccgccgcattcagatcttattcaacaacatacgaggagagaaacattacagggacaagagttaaggtgcccgtgggccaggaggtcgagggaatgaacattctcggcctggttgtatttgccatagtgtttggagtggccctaagaaagctgggccctgaaggcgaactcctgattcgcttctttaacagttttaacgaggccacaatggttttggttagttggatcatgtggtacgccccagtgggcattatgttcctggttgctggcaaaatcgtggagatggaagatgtaggcttgttgtttgcccgactgggcaagtatattctttgctgcctccttgggcatgcaatccatggactactggtgttacccctgatctatttccttttcacccggaagaatccttatagattcctgtggggcattgtgacccccctggcaaccgcattcggcaccagctccagttcagctacccttcctttgatgatgaagtgtgtggaagagaataatggggtagccaaacatatctcgagattcattctcccgattggagccacagtcaacatggacggggctgccctctttcagtgtgtggccgctgtcttcattgcccaactgagtcagcagagcctggatttcgttaagatcatcacaatcctcgtcacggccactgcttcttcagtcggggctgccggtatccctgcgggaggggtcctgacgcttgccatcattctcgaggcggtcaacctgccagtggaccacatctcactgattctggctgtagactggctagtagatcgttcctgcaccgtgctgaatgtcgagggcgacgctctcggagctggcctgctacagaactacgtggacagaactgagtctcgatccaccgagccagaattgatccaggtgaagtccgaactcccgttggaccctctgcctgtgcctacagaggaaggcaatcccctgttgaagcactacagaggcccagcaggggatgccacagtagcaagcgagaaggaaagtgtcatgtag

SEQ ID NO: 240946 - DNA, 1308 bp, Artificial Sequence
  Description of Artificial Sequence: Synthetic coding sequence
atggctgagtcaagcagcgagagcgatcacttcaggtgcagagatcgcctctcaccttgggcggctaggtcaacacaccgaggtaccagaagcctgccaacggtggaagtgacagagaaagtgaacacaattactagcactcttcaggacacaagcaggaatctcaggcaggttgaccagatgcttggccgttaccgagagtactctaatgggcaggccggtgcaattgaacacttgaaggagtccctagagcagtccatcgatcagctgcgttctcagcggctactgcggaactccggaggaaggtcaatctccgtgacatcactgtccgccagtgatttggacggcggtacaggcagcgaactgcaccacttcccccctactagccccctgaaggattacggggaccctcagggaataaagcgcatgaggtcgaggacaggagtcaggtttgtgcaggaaaccgatgacatgacccaactccacgggtttcaccagtcactccgggatctctcatccgaacagatcaggctaggggacgatttcaacagggagctgagccgacgctcaaggagtgatgccgaaactaaaagggccctcgaagaactcaccgagaaattgaacgaagctcaaaagcaagaagttgtgtctgaccgtgtggagaggcggctccaagagttggagcgggaaatgaggactgaacgagaactcgtggagcgacggcaagaccagttaggcctgatgtcacttcagctacaagaagctctgaagaagcaggaagccaaggcagacgaacacgagggcgcaattaagaacaagttgaggcagaccgagactgaaaagaaccaacttgagcaagagttagagctttctcgcaggctcctcaaccaaagcgaaggcagcagggagaccctgctgcaccaagtggaagagctccggacacaactcaccaaagctgaaggtgatcgcaaagggctgcagcaccaggtctctcagatatctaagcagcagagcaactatcaggatgagcagggagaggattggcggtttcggagaggtgtggagcgagagaaacaggatctcgagaagcagatgtctgaccttcgcgtgcagctgaatttctccgccatggcgtctgagttggaagaagtgaagcgatgtatggaaaggaaggacaaggaaaaggcgcaccttgcgagccaggtggaacatattaatcgcaagtgtctgttaaacctcgttcaggatctggattgcaaggacaatgaaatcctcacctacagcctgcagagtccactgcacgtgtag

SEQ ID NO: 240947 - DNA, 1047 bp, Artificial Sequence
  Description of Artificial Sequence: Synthetic coding sequence
atgaatgatcccaattcctgtgtggataatgccacagtgtgttccggcgcaagttgtgtagtccccgagtcaaatttcaataatatcctgtccgtcgtcctgtctacagttctgactattctgcttgccctggtcatgtttagtatggggtgcaacgtggaaattaagaagttcctgggccacattaagagaccctggggaatttgcgtaggattcctgtgccagttcggcatcatgcctctgacggggttcattttgagcgtggcctttgacatcctgccattgcaggccgttgtggtcctgattatcggatgttgtcccggaggcactgcatcgaacattctggcctattgggttgacggggacatggacctgagtgtaagtatgaccacatgctcaacgctcctcgccttaggaatgatgcctctctgtctcctgatttacactaagatgtgggttgacagtggatctattgtcatcccgtatgacaacatcggtacctccctggtgagtcttgtggtcccggtgtctatagggatgttcgtgaaccacaaatggcctcagaaggcaaagatcattctgaagattggctcaattgccggagctattctaatcgtccttattgcagtggtagggggaatcttgtaccagtcagcatggataatcgccccaaaactctggatcattggtacaatcttccctgtggctgggtattcgttgggatttctcctggccagaatcgccggactgccctggtatcggtgcaggaccgtagccttcgaaacaggcatgcagaatacccaactttgctccactatcgtacagctcagctttactcctgaagagctgaatgttgtttttactttcccactcatctattccatcttccaactggcctttgccgctatatttctaggcttttacgtcgcatataaaaagtgccacggaaagaataaagcagagatacctgagagtaaagagaacggcacggaaccagagtcttctttctataaagctaatggtgggttccagccagacgagaaatag

SEQ ID NO: 240948 - DNA, 1434 bp, Artificial Sequence
  Description of Artificial Sequence: Synthetic coding sequence
atggtgcttatgcaggataaggggtcgagccagcagtggcctggcttaggcggagagggaggcggaaccggacccctctctatgctgagggccgctctgctgctcatatccctcccttggggcgcacaggggactgcatctaccagcctgagcaccgctggcggtcatacggtcccccctaccggcggaagatacctttctatcggggacggcagcgtgatggagtttgagtttcctgaagacagtgagggaataattgtgatttccagccagtatccaggacaagccaatcgaactgctcccggacctatgctgcgggtaaccagtctcgacaccgaagtgctcaccattaaaaatgttagcgcgatcacctggggtgggggtggtggtttcgtggtaagcatccattccggactggctggcttggcccctttgcacatacagttggtggacgcccacgaagccccaccaactctgatcgaggagcgaagggatttctgtatcaaggtgagccctgccgaggatactcccgctactctaagtgccgacttggctcactttagcgagaatccgatcctctacctgctcctccctctgatctttgtcaataaatgctcctttggctgcaaggtggagcttgaagtgctcaaggggctgatgcagagtccccagcccatgctcctggggttgctgggccagtttctggtaatgccattgtacgcttttcttatggctaaagtgtttatgttgccaaaagccctggctttgggactgataattacctgcagtagtcccggtgggggagggtcttacctcttcagccttctgcttggcggagacgttaccttggcaatttctatgacattcctttcaacagtagcagctaccggctttctgcccctgtcctctgccatttactcacggcttctgagcatacacgagactctccacgttcctatttcaaaaattcttggtacccttctttttattgctattccgattgccgtcggcgtactcattaagtccaaactgccaaagtttagccagttgctgctccaggtcgtgaaaccgttttctttcgtactcttgctagggggtctgtttttagcttaccgcatgggtgtcttcattctggccggtatacggctgccaattgtgctggtcggcataacggtacccctggtgggcctcctggtgggctactgtctcgccacctgcttgaagctgccagtcgcacagagacgcacggtatctattgaagtgggggtccaaaattccctcttagccctggccatgctgcagctgtcgcttaggaggttgcaggccgactatgcctcccaagctccttttatcgtcgccctgagcggaacttcggagatgctggcactggttatcggccatttcatttactcctccctgttcccagtgccctag

SEQ ID NO: 240949 - DNA, 1347 bp, Artificial Sequence
  Description of Artificial Sequence: Synthetic coding sequence
atggtattaatgcaggacaagggcagcagccaacagtggcctggactaggcggagaaggcggagggactggacctctgagtatgctacgggctgcactgctgctaattagtctcccatggggggcacaggggacagcctccacttctttgagcacagctggcggtcacacagtcccccctactgggggaagatacttatctatcggcgatggctctgtcatggaatttgagtttcccgaagacagcgagggcatcatcgtcatatcttcccagtaccctggccaagccaaccgaactgccccaggccctatgctacgagtgaccagtctcgacactgaagtcctgacaatcaagaatctcgtggacgcacacgaagccccacccactctcatcgaggagcggagggacttctgcattaaagtgtccccagctgaggacaccccagccaccctgagcgctgacctggcacactttagcgagaatccaatcctctatctcttactgccattgatatttgtgaataagtgctcattcggatgcaaagtggagcttgaagtcctaaagggcctgatgcagtctccccaacccatgctgctcggactgttgggacagtttctggtgatgcccttgtacgcgttcctcatggctaaggttttcatgcttcccaaagccctggcacttggcctgattatcacatgttcctccccgggagggggagggtcctatctcttttctctgctgttgggtggtgacgtgacgctagcaatttccatgacattcttgagcaccgtcgcggcaactgggttcctaccgctgtcttccgccatttactcacggctgctttctatccatgaaactctgcacgtaccaatcagcaagattctgggcaccctgctctttattgctattcccattgctgtcggagttcttatcaagtccaagctccctaaatttagccaactgctgctccaagtcgtgaaacccttctcgtttgttctgttactggggggtctgttccttgcatataggatgggggtcttcatcctggcaggcattcgcctgcccattgtgcttgtggggatcactgtgccgctagtaggccttctcgtgggctattgtctagcaacctgcctaaagctccctgtggcgcagcggagaactgtgtcgattgaggtaggtgtacagaatagcctattagccttggcaatgctacagctctccctgcggagacttcaggctgactatgccagtcaggccccttttatagtggccttgagcggtacctcagaaatgctggccctggtgattggccactttatttacagctccctgtttcccgtgccatag

SEQ ID NO: 240950 - DNA, 1599 bp, Artificial Sequence
  Description of Artificial Sequence: Synthetic coding sequence
atggccggaccgcgacctcccggtgatagccctgccataaaagaggattctacgggtctggggccaacccacgagcccttcagtggacagcctaattcgaccagcggcgacgttttgctgagccgtcggggtcctggccacgcaattcggccaccaggacgagctatggtcctgatgcaggacaagggatctagccagcagtggcctggactcggaggtgaagggggaggcaccggcccactgtcaatgctgagggccgcactactgctgatatcactgccctggggagcccaggggactgcgtccactagtctgtcaaccgcaggcggacacactgtgcccccaaccggcggacgctaccttagcattggcgatggctcagtcatggagtttgagtttcccgaggactctgaggggatcattgttatcagtagccagtaccctggtcaggccaacagaactgcaccagggccaatgctgcgagttaccagtttggatacagaggtgctgacaattaagaatgtatctgccataacctggggaggcggtgggggttttgttgtctcaatccattccggcttggctggactggcgccactgcatatccaattagtggatgcccatgaggcccctcctactctgattgaagaacgccgtgatttctgtatcaaggtgagccccgctgaagatactccagctactctttcagcagatttggctcatttcagtgagaatcctattctatatttgttgctccctttaatttttgtcaataaatgttcattcgggtgcaaagtggagctcgaagtgttaaaggggctcatgcagagtccacagcccatgttgttgggacttctcggccaattcctcgtgatgccattgtatgcttttttgatggccaaagtctttatgctgcccaaggccctggccctggggctaattattacctgttctagtccaggtggaggcggttcctacctgttctccctgctgctgggaggtgacgtaacgctggccatcagtatgacctttctgagcacagtcgctgccacaggcttccttcccttatcatccgccatttacagcagactgctatccattcatgaaaccttgcacgtgccaatcagcaagattcttgggacactgctgttcatcgccatccctatagccgtgggggtgctcatcaaaagcaaacttcccaaattttcccagctgctgcttcaggtggtcaagcctttctcctttgtgctgttgcttggcggactgttcttggcttacagaatgggcgtcttcattctggctggtatcagactcccaatagtcctagtgggcataacggttcctctcgttggcctcctggtcggctattgcctagccacttgtctgaagctacccgtggcccaaagacgtacggtgtcaatagaggtcggtgttcagaactctcttctggctctagccatgcttcagctaagcctaaggaggctacaggccgactatgccagccaggcaccttttatcgtggcactgtccgggacctctgagatgctagctcttgtgatcggccatttcatttattcatctctttttcccgtgccctag

SEQ ID NO: 240951 - DNA, 1434 bp, Artificial Sequence
  Description of Artificial Sequence: Synthetic coding sequence
atggtgctcatgcaagataagggaagttcccagcaatggcctggcctcggcggtgaggggggaggcactgggccactcagcatgctgcgtgctgccctcttgctcatcagtctgccctggggggctcagggcaccgcctctacgtctctgtccaccgcaggtggtcacactgtaccaccaaccggtggccgatatctgagcattggggacgggtccgtgatggaattcgagtttcccgaagatagcgagggcatcattgtgatatcctcccaataccccggacaggccaatcggactgctcccggacctatgctgagagtgacatcgcttgacactgaagtgctgaccataaagaacgtgagcgccatcacttgggggggaggcggtgggtttgttgtgagcatccactccggactcgcaggtcttgcgccattgcacatccaactcgtggatgcacatgaagcccctccaaccctgatcgaggagcgacgggatttttgtatcaaggtgtcccccgctgaagacacacccgctacactgtccgccgaccttgcgcacttttcggaaaacccaatcctgtatctgctactgccactaatttttgtgaataagtgctctttcgggtgcaaggtggagctggaagtgcttaaggggctcatgcagtctccccagcctatgttgctgggactattaggccagtttctcgttatgcccttgtatgcctttcttatggcgaaagtttttatgttaccgaaggccctggcactgggtttgattatcacatgtagtagccccggaggaggaggctcctatctcttttccctgctgctgggaggggatgtgacactggcaatctcaatgaccttcctgtccaccgtcgctgccacaggcttccttccactaagctccgccatttactccaggctgttatcaatccacgagaccctgcacgttcccataagtaagatcctggggacactgctgttcattgccatccccatcgccgtgggtgtactgattaaaagtaagctacctaagttctcccagctgctccttcaggttgtgaagccgttctccttcgtgctactcctgggcggactgtttctggcttatagaatgggagtgttcatactggcaggaatacgcctgcccattgtgctggtcgggatcacagttccattagttggactcctggtaggatactgcctggcgacgtgcctgaaactgcctgtggcccagaggaggacggtgagcattgaagtgggagtgcagaatagcctcttggcgctggcgatgctgcagctgtccctgaggcgcctgcaggcagattacgctagtcaggctcccttcatagtcgcattgtcggggaccagtgaaatgctcgccctggttatcgggcacttcatctattcctctctttttccagtcccctag

SEQ ID NO: 240952 - DNA, 657 bp, Artificial Sequence
  Description of Artificial Sequence: Synthetic coding sequence
atggtgctgatgcaggataagggctcatcccaacagtggccagggttaggaggcgagggcggaggcactggccctctgagcatgctccgggctgccctcctgctgatctcactgccatggggcgctcaaggcactgcctcaacaagtctgtccactgcagggggacataccgttcctccaacaggcggacgatacctctcaatcggagatgggagtgttatggagtttgagttccccgaagactccgagggcatcattgtgatttcctcacaataccccggacaggcaaatagaactgcccctgggcctatgctgcgggtcacgagtctcgacaccgaggtcctaaccataaaaaacgtaagcgccattacctgggggggagggggtgggtttgtggtttctatccacagtggcttggctgggttggctcctctgcacatccagctggtggatgcacacgaagccccaccaactctcatcgaggagcggagggatttttgcatcaaagtatccccagctgaggataccccagccactcttagtgccgacctggcccacttttccgagaatccgatcctgtacctgctcctccccctgatcttcgtgaataagtgctccttcggatgcaaggtcgagctggaagtgctcaaggggtag

SEQ ID NO: 240953 - DNA, 1314 bp, Artificial Sequence
  Description of Artificial Sequence: Synthetic coding sequence
atggatggtaatgataacgtcactctgctgtttgctcccctattgcgtgataactacacgctcgccccaaatgcttcttctctggggccaggtacagaccttgctcttgctcctgcaagtagtgctggacctggaccgggtctttcgttgggcccaggaccttcttttgggttctcccctggacctactccgacccccgaacccactaccagcggcctggctggaggtgccgcaagccacggaccctcccctttccctcgcccatgggcaccacacgctctgccattctgggacactccgttaaaccacggtctgaacgttttcgttggtgctgctctgtgcattacgatgcttggcctgggatgtaccgtcgacgtcaatcattttggagcacacgtgcgtaggcccgtcggcgcacttctcgccgcactgtgccagtttgggctcttgcctttgctcgcattcctgctcgcactggcctttaagcttgacgaggtggctgccgtggccgtccttctatgtggttgctgtcccggtgggaacctctcaaacctcatgtccctgctcgtggacggcgacatgaatctctctatcataatgaccatctcctccactctgctggcactcgtgttaatgccactgtgtttatggatatactcttgggcatggatcaacacacctattgtccagctcctcccactgggcaccgtcactttaacactgtgctccaccttgatacctatcgggcttggcgtctttattcggtataagtacagcagggtggcagattatatagtgaaagtgtcgttatggtccctgctggtaaccctggtagttttgttcatcatgaccggaacgatgctcggccctgaactacttgcgtccattccagccgcagtttacgtgatcgcaatctttatgcccctggcgggatacgcttctgggtatggcctggcaaccctcttccatctgccgccaaactgtaagaggacagtgtgcttggaaactggaagccagaatgtccaattgtgtacggctattctgaaacttgcctttcccccacaatttatcggcagcatgtatatgtttcccctcctgtacgccctgttccagtccgctgaggcagggatctttgtcctgatctacaaaatgtatggatccgagatgctacacaagcgggatccactggatgaagacgaggacaccgacatttcttataaaaagctgaaggaagaagaaatggctgacacctcttacgggacggtgaaggccgaaaacattattatgatggaaactgcccaaacgagcttatag

SEQ ID NO: 240954 - DNA, 1134 bp, Artificial Sequence
  Description of Artificial Sequence: Synthetic coding sequence
atgcgcgctaattgctcctctagctctgcatgtccagcaaattcttccgaggaagagcttcccgtcggtctagaagtccatggaaatctagagctcgtgtttacggtcgtttccactgtaatgatgggccttctcatgttttccctgggctgctctgtcgaaatccgcaaattgtggtcccacatccgtcggccatggggtattgcggtggggctcctgtgtcagttcggattgatgcccttcacagcgtatctgctggccataagctttagtctgaagcccgttcaagccattgccgttctgatcatggggtgttgtcctgggggaacaatatccaatatctttactttctgggttgatggagacatggacttgtcaatttccatgaccacatgctccacagtggctgccctggggatgatgccactctgcatctacctgtacacgtggtcctggtctttgcagcagaacttgaccattccctaccaaaatattggcattacgcttgtgtgtttaacgatccctgtggcttttggagtttacgtgaactacagatggcccaagcagtctaaaattatactgaagattggcgctgttgtgggaggagttcttctgctcgtggtggctgttgcaggcgtggttctcgctaaggggagctggaacagcgatatcacattgctgaccatttcctttatctttcctcttattggacacgttaccggatttctactcgcgttgttcacacaccagtcctggcaacgctgcagaactatctcgctggagacaggagctcaaaatatccagatgtgtatcaccatgttacagctctctttcacagccgagcacctggtgcagatgctttcctttcccctggcttacgggctgtttcagctgatcgacggctttctgattgtagctgcttaccagacatataagaggcggctcaagaataagcacggcaagaaaaattccggatgcacagaagtatgtcacacccgcaagtccacatcatctagggagaccaacgcattcctagaggtgaacgaggaaggggcaatcactcccggaccaccgggacctatggactgccaccgggcattggaaccagtaggccacataacctcttgcgagtag

SEQ ID NO: 240955 - DNA, 2184 bp, Artificial Sequence
  Description of Artificial Sequence: Synthetic coding sequence
atgctgaggatccctgtgaggaaagctctggtcggcctgagtaagagcccaaaggggtgtgtgcgcaccactgctacagccgcatctaatctgattgaagtgtttgtcgatggccagtccgttatggttgagccagggacaactgtgctccaagcttgtgagaaggtaggcatgcagatcccacggttttgctaccacgagcggctttccgtcgctgggaactgccggatgtgcctcgttgagatcgaaaaagcaccgaaagtcgtggcagcctgcgccatgcctgtcatgaaagggtggaacattctgacgaactcagagaaatccaaaaaagctagagagggcgtcatggagttcctgctggctaaccatcctttggattgtccaatctgtgaccagggcggtgagtgcgatttgcaagatcagtccatgatgtttggcaacgatcggtctcgttttctggagggtaaacgagccgttgaggacaagaacatcggtcccctggtaaaaacaattatgacacgctgcattcagtgtacccggtgtatacgatttgcaagtgaaattgctggagtggatgatctcggtaccacgggtcgagggaatgacatgcaggtgggtacatacatcgagaaaatgttcatgtcagagttgtccggaaatatcatcgatatttgcccggttggagccttaacgtctaagccttatgcatttacagcccgtccatgggagacacgtaagaccgagtccattgacgtgatggatgccgtgggttccaatatcgtggtgtctacacggacgggagaggtcatgagaattctcccaaggatgcatgaggacattaatgaggaatggatttctgataaaactcgcttcgcttatgacgggctgaaacgacagagactgaccgaacctatggtccgaaacgagaagggtttgttaacttatacctcatgggaggacgcactgagcagagtggcaggaatgctccagtcttttcaagggaaagacgtcgccgctatcgctggcggactcgtggatgccgaggctctggtcgcgctgaaagatctgctgaaccgggtcgatagcgataccttatgcactgaagaggtcttccctactgcaggtgccggaacggatctgcggagcaactaccttttgaataccaccatcgccggtgtcgaggaggccgacgtggtgctactggtgggtactaatccacgattcgaagcccctctgtttaacgctcgcatacgaaagtcatggcttcataacgatctcaaggtggccctgattgggtcaccagtcgatctcacgtacacatatgatcatctgggcgattcacccaaaatcctccaagatatagcttccgggtcacatccgttttctcaggtacttaaggaagctaagaagcctatggtcgtcctgggttccagcgcgcttcagcgtaacgatggagctgccatcctggccgctgtgtcttcaattgcccagaagatccggatgacgagtggggtcactggagactggaaagtcatgaatattctgcatcgcatcgcaagccaggtggcagcacttgaccttggttacaagcccggtgtagaggctatcaggaaaaacccgccaaaggttcttttcctcctcggcgcagacggcggatgcataactcggcaagacctgccaaaggactgcttcatcatctaccaaggtcatcacggcgacgtcggtgcaccgatcgccgacgtcatactgcctggagcggcttataccgaaaaatcggcaacttacgtcaatactgagggcagggcccagcagaccaaggtcgccgtcactccacccggactggcccgtgaagattggaagattattcgagcactttctgagattgcgggaatgactctgccttacgacacattggaccaagtgcgtaaccgacttgaggaagtatctcccaacctggtccgatatgacgacatcgagggcgcaaactactttcagcaggcaaacgaactttctaagctagttaaccaacagctgctcgccgatcctctcgtgcctccacagctgacaatcaaggacttctacatgacagactctatcagcagagcaagccaaaccatggccaaatgtgtgaaagccgtgacagagggcgcacaagccgtggaggagccctctatttgttag

SEQ ID NO: 240956 - DNA, 492 bp, Artificial Sequence
  Description of Artificial Sequence: Synthetic coding sequence
atgactggcgacaaagggccacagcggttgagcggtagctcttacgggtcaataagttcccccacgtctcccacctcacctggaccccagcaggcgccaccgcgagaaacatatctctccgaaaagataccaatccccgacaccaaacccggtacgttctctctgcgcaagctgtgggcattcacaggcccaggctttctgatgtccatcgcctttttagaccccggaaatatcgagtcagatttgcaggctggcgctgttgctggctttaaactactctgggtgctgttgtgggccactgtgcttggcctgttgtgccaacgtctggcggcacggctcggggtggtgaccggtaaggatctgggcgaggtgtgtcatctttattaccccaagtcagagtctcgctctgttgcccagtcaggtgtgcagtggtgcgacgtgtcgagcctgcagccgctccccccacggtgcccggctccaagttccggatag

SEQ ID NO: 240957 - DNA, 1299 bp, Artificial Sequence
  Description of Artificial Sequence: Synthetic coding sequence
atggttagatgccagcttactgcaactagtaccagccaagtgcccagaactgtgttgtggctaaccatagagctcgccatcgtgggaagcgatatgcaagaagtgatcggaaccgcgatagcatttaatttactttctgccggtcggatccctctgtggggaggtgtgcttatcactattgtcgatacattcttcttcttattcctggataactacggcctgcgcaaattggaggcattttttggactgttaattacgatcatggcattgacattcggatacgaatacgtggtagcacgacccgagcaaggagctctactgcggggattgtttctgcctagttgccctggatgcggacaccctgaacttttacaagccgtagggatagtgggagcaattataatgccacataacatttacctgcacagtgcactggttaaaagtagagagatagaccgcgctcggagagctgatatccgagaagccaatatgtactttctgatagaggctaccatagcccttagcgtatcctttattataaatttgtttgttatggccgtgtttgggcaggcattttaccagaaaaccaatcaagcagcgttcaacatatgcgcgaattcgtccctgcacgactacgccaagatcttcccgatgaataatgccaccgttgctgtcgatatctaccaaggtggtgtgatacttgggtgtctgtttggacccgcagccctttacatctgggcaatagggctactggccgcaggccagtcatccacgatgacaggtacctacgccggacaatttgtgatggaaggttttctacgcctgagatggagtaggtttgcaagggtgctgctgacaaggtcatgtgctattttaccaaccgttctggttgctgtgttcagggatctgagggatttgagtggccttaatgatctgctgaatgtgctgcagtccttgctactgcccttcgccgtattgccaatcctgacattcaccagtatgccgacattaatgcaagagttcgcaaatggactcttgaacaaagttgtgaccagctccatcatggttttggtttgcgcaattaacctgtactttgtagtgtcttaccttccctcactgccccatcctgcttactttgggttggcggctttactcgccgcagcatatctgggcctatccacatacctggtgtggacttgttgtttagcccatggcgctactttccttgcgcacagcagccaccatcactttctgtatggcctacttgaagaagatcagaagggggagacaagtgggtag

SEQ ID NO: 240958 - DNA, 3351 bp, Artificial Sequence
  Description of Artificial Sequence: Synthetic coding sequence
atgctgaacaacctgaccgattgtgaggatggagacgggggagctaatcctggtgatgggaacccgaaggaaagcagcccctttatcaattctactgataccgagaagggcaaggagtacgacgggaaaaacatggctctgttcgaggaggagatggacactagccctatggtctcgagtctgctttccggccttgcaaattacacaaacttaccccagggcagtagagaacatgaggaggcagagaacaacgaaggaggaaaaaaaaaacctgtgcaggctccgcgtatgggaaccttcatgggcgtttatcttccttgccttcaaaacatctttggagtgatcttgttcctgaggcttacatgggtggttggtatcgccggtatcatggagtctttctgtatggtctttatttgttgcagctgtacaatgcttacagctatttctatgagcgccattgctaccaacggggtggtgccggctgggggatcttattacatgatctcaaggagcctgggacccgagtttgggggagcagtgggcctgtgcttttatctcggaactaccttcgcaggcgctatgtatatcctggggactattgagattctgttggcctacctatttcctgccatggctatctttaaagctgaggacgccagcggagaagccgctgccatgctgaataacatgcgcgtgtatggcacttgcgtgctcacatgcatggctactgtggtgttcgtcggtgtaaaatatgtgaataagtttgcactggtctttttagggtgcgtgatactttccatcctcgccatctacgctggcgtgatcaagagtgcctttgaccctccaaattttcctatttgcctgcttggtaatcgcaccctatcacgccatggttttgatgtgtgtgctaaacttgcctgggaaggaaacgaaactgtgacaacacgcctgtggggcctattctgctcatcgaggtttctcaatgctacttgcgacgagtacttcacccggaacaatgtcactgagatccaaggcataccaggtgcagccagcggtttgattaaagagaacctgtggagctcataccttacaaagggggttatcgttgaacggagcggaatgacttccgtgggacttgccgatgggactccgatcgacatggaccacccttatgtcttttctgatatgacttcttattttactttattggtcggcatatactttcccagcgtcaccggcataatggcgggaagtaaccgatccggcgatctgagggacgcacagaaaagcattcctaccgggactattctggccatcgccaccaccagcgccgtttatatttcaagtgtcgtgctgtttggggcatgtatcgaaggcgtggtgctccgggacaagttcggggaggcggtcaacggaaacctggtagtaggcaccctggcttggccctccccatgggtgattgtgattggcagcttcttctctacctgtggcgctggcctacagagtttaacaggcgcacctagacttctgcaggcgatcagcagagatggaattgtcccctttttgcaggtgttcgggcacggtaaggccaatggagagccaacttgggctctgctactgacagcatgcatatgtgagatcgggattctcattgcgtcactcgatgaagttgcccctattctatccatgttctttctgatgtgctacatgtttgtaaacctcgcctgcgcagtccagaccctgctgcggacccctaactggaggcccaggtttcgttactatcattggaccttgtcctttctggggatgtccctgtgcctggccctgatgtttatctgcagctggtactatgctttagtagccatgctgatagcgggtcttatctacaaatacatcgaatacaggggcgcagagaaggagtggggggatgggatacggggactcagcctcagtgcagcgaggtacgccctgctgcggctcgaggaaggacctccccacacgaaaaattggaggcctcagctcctcgtcctcgttcgggtagatcaggaccagaacgtagttcatccccagctcctgtccctgacttctcaactgaaagccggaaagggcctcacaatcgtgggatcagtcctcgagggcactttcctcgaaaaccacccacaggcccaaagagctgaagagtccataaggcggctcatggaggcggagaaggtgaaaggtttctgtcaggtggtcataagcagtaaccttagggacggcgtgagtcatcttatccaaagcgggggtctgggaggcctccagcacaacacggtgctcgtgggatggcccagaaactggagacagaaagaggaccaccaaacttggcgaaactttattgaactagtgcgggagactactgccggacacctagctttgctggtgactaaaaacgtcagtatgtttcctggaaatcctgagagattcagtgagggatctatcgacgtctggtggatagtgcatgatggaggtatgttgatgctcctcccattcttgctgagacatcacaaggtctggcgaaaatgcaagatgcgcatctttaccgttgcgcaaatggatgataattctattcagatgaagaaagacctcacgaccttcctctatcatttgcgcatcaccgccgaagtcgaagtcgtggagatgcatgaatcggatatctccgcctatacatacgaaaaaacactcgtgatggagcaacgctcgcagatcttgaagcagatgcacctcacgaaaaatgagcgagaacgggagattcagagtattactgacgagtctagaggctccatcaggaggaagaatccagctaacaccagactgcggctaaatgtccccgaagagactgctggcgacagcgaggagaaaccagaagaggaggttcagctgatccatgaccaatctgcccctagctgtccttcctctagcccctcccccggagaggagcccgaaggggagggggaaactgaccctgaaaaggtccacttgacttggacgaaagacaaatctgtggctgagaagaacaaaggaccatcgcccgtctccagcgaggggattaaagactttttttccatgaaacctgagtgggaaaatctgaatcagtcaaacgttcgcagaatgcataccgccgtgcgccttaatgaagtgatcgtcaagaagtccagagacgccaaactagtactgttaaacatgccgggacctccgagaaaccggaatggggacgagaattatatggagtttctggaagttctgaccgagcacctggatcgtgtgatgctcgtgcgtggtggaggccgtgaagtcattacaatctacagttag

SEQ ID NO: 240959 - DNA, 858 bp, Artificial Sequence
  Description of Artificial Sequence: Synthetic coding sequence
atgttaaataacctgaccgattgcgaggatggggatggtggagcgaatcccggagatggcaatcctaaggaatcatcaccttttattaacagcaccgatacagaaaaaggaaaagagtacgacggaaaaaacatggctctatttgaagaagagatggacacatctcctatggtgtcttcactgctcagtggcttagccaactatacgaacctccctcaggggtcacgggaacatgaagaggcagagaacaatgaagggggtaagaaaaaaccagtgcaggcccctcggatggggacgttcatgggcgtgtacctgccatgcttacaaaatatatttggcgtgatactgtttctgcgcctcacctgggttgttggcatcgccggaatcatggaatctttttgcatggtcttcatctgttgctcttgcaccatgctgaccgccatatccatgagcgctatcgccactaatggcgtggtaccagctgggggaagctactatatgattagtagatctctcggcccagagtttgggggagccgtggggctatgcttctatctcggaaccaccttcgcgggtgccatgtacatcttggggaccatcgagattctgctcgcctatcttttccccgcaatggcaatattcaaagctgaggacgcctcaggggaagcggcagccatgctgaataacatgcgcgtgtacggtacttgtgtgctgacctgtatggctacggtggtcttcgtgggagtaaagtatgtcaacaaatttgccctggtgtttttgggatgtgtgattctcagtattttggctatctatgctggtgttatcaagagtgctttcgaccctccgaatttcccttag

SEQ ID NO: 240960 - DNA, 3420 bp, Artificial Sequence
  Description of Artificial Sequence: Synthetic coding sequence
atgtccaggcgctttacggtgacctccctccccccagcaggacccgctcgaagccctgaccccgagtctaggaggcactctgttgctgatccccgtcacctgccaggcgaggacgtgaaaggggatgggaatcccaaggaaagttccccattcataaacagcaccgacactgagaagggtaaggaatatgatggcaagaacatggccctcttcgaagaggaaatggacactagccctatggtatcaagcctgctgagtgggctggctaattatacaaacctgcctcagggctcaagggaacacgaggaggcagagaacaacgaggggggaaagaagaaaccagtgcaggctcctcgtatgggtaccttcatgggggtgtacttaccatgtctccaaaatatattcggcgttatactgttccttcgactcacgtgggtggtcggaatcgccggaatcatggaaagcttctgcatggtgtttatttgttgctcgtgtactatgcttaccgcaattagtatgtcagctatcgccacaaatggagtggtgcccgctggaggctcttactacatgatatcacgctccctgggccctgagttcggtggggctgtcgggctctgtttctacttggggacaacctttgcaggggctatgtatatccttggtaccatcgaaattttgttggcatatttattccctgcgatggcaatttttaaagctgaggatgctagtggtgaggccgcagctatgttaaataacatgcgcgtctatggtacatgcgtcctgacgtgtatggcgaccgttgtcttcgtgggggtcaagtacgtgaataagttcgccctggttttcctcggatgtgttatcttatccatcttggcaatttacgcgggtgtcatcaagtcggcttttgacccacccaatttccctatctgcttgcttggcaaccgcaccttgagtagacatgggtttgacgtgtgcgccaagctagcctgggagggtaatgaaacagttaccactaggctgtgggggctgttctgctcatccaggtttctaaacgctacttgcgacgagtattttacgaggaataatgtgacggagatccagggcatcccaggcgctgcctctggactgattaaggaaaacctgtggtcgtcttaccttacaaagggcgtcatcgtggagcgctccggcatgacctccgtgggcctcgcagatggaactcccattgatatggaccatccctacgtcttttccgatatgacatcatatttcacactattggtcggtatatactttccttccgttaccggcatcatggccggatcaaaccgctctggcgatctccgcgacgcgcaaaagtcaatcccgactggtacgattttagctattgccacaacctctgctgtctatataagcagtgttgtgttgttcggtgcgtgtatcgagggtgtggtgttaagggataagttcggcgaggccgtgaacgggaatctggtggtaggtacccttgcgtggccaagtccatgggttatcgtgatcggctcgtttttttcgacctgtggtgccggtctgcagtctcttacaggggctccacgcttgcttcaggcaatctccagggatgggatagtccctttcctgcaagtttttgggcacggaaaggccaacggtgagcctacatgggcgcttcttctcactgcttgcatatgtgagattggcatcttgatcgcctcattggacgaggtggctccgattctaagtatgtttttcctcatgtgctacatgtttgtgaatctggcatgcgctgtccagaccctcctccgaactccgaactggcgccctcggtttcgttactatcactggaccctgagctttctcggcatgagcttgtgccttgccctcatgttcatctgctcttggtattacgccctggtggctatgttgattgcaggcttaatatacaaatacatcgaatataggggagccgaaaaagagtggggcgacgggatccgaggcctgagcctgagtgccgcacgatacgccctgctacgcttggaagagggaccccctcatacaaaaaattggcgccctcagctccttgtgttggtgagagtggatcaggaccagaacgtggtgcacccacagctgctgagtcttacgagccagctgaaggcaggtaagggattgaccatcgtcggaagtgtgttggaggggactttcttggagaaccatcctcaggctcagcgagcagaggaaagcatccgcagactcatggaagctgaaaaggtgaaggggttttgccaggtcgtcatatcctccaatctgcgagacggagtaagccacctgatacagagtggcggactgggagggctccagcacaacacggtgctggtgggctggccccgtaattggagacagaaggaggaccatcagacctggcgcaattttattgagctggtccgagagaccaccgcaggacacctggccctgttagtgactaagaatgtaagtatgttcccaggaaaccctgagcgattcagcgaagggagtattgatgtgtggtggattgtacatgatggcggtatgctcatgcttttgccgttccttctgaggcaccataaagtctggcgtaagtgcaagatgaggatcttcaccgtggcccagatggacgataattccatccaaatgaaaaaggacctaactactttcctgtatcacctgcgcatcacagcagaagtggaggtggtcgagatgcacgagagcgacataagcgcttatacctacgaaaagacccttgtgatggagcaaagatctcagatcttgaagcagatgcatctcacaaagaacgagagggagagggaaatccaaagcattaccgatgagtctaggggcagcattagaagaaaaaacccagctaatacaagattgcgcttgaatgtcccagaggagaccgcaggtgactctgaagaaaagcccgaggaagaagttcagctcattcacgatcagtcagcaccaagttgtccaagttcatcccccagtcctggagaggaaccggaaggggagggcgaaacagatcctgaaaaggtgcacctgacctggaccaaggataaatctgttgccgagaagaacaagggtccttcgccagtctcatctgagggaataaaagactttttctctatgaagcctgaatgggaaaacctgaaccaatcaaacgttagaaggatgcatacggcagtgagattgaacgaagtcatcgtaaagaaatcgcgtgacgccaaactcgtcctcttgaatatgccaggtccgccaaggaatagaaatggcgacgaaaactacatggaattccttgaggtactcactgaacatttagacagagtgatgctggtgaggggcggtggacgtgaggtcattacaatatactcctag

SEQ ID NO: 240961 - DNA, 561 bp, Artificial Sequence
  Description of Artificial Sequence: Synthetic coding sequence
atgcttaataacctgactgactgcgaggacggagacggcggtgccaacccaggagatggcaacccgaaagagagctctcccttcatcaactctactgatactgaaaagggtaaagagtacgacggcaagaatatggccctgttcgaagaggaaatggatacatcccctatggtcagctcactgctctccggcttggcgaattacaccaacctgccacaaggctcccgcgaacacgaggaggcagagaataatgagggcggtaagaagaaacccgtgcaggcaccacggatggggaccttcatgggcgtgtacttgccatgtctgcaaaatatcttcggtgtgatcttatttcttcgcttaacatgggtggtcggcattgccggaatcatggagtccttttgtatggttttcatttgctgcagttgcaccatgcttaccgccatttctatgtctgcaatcgcgacgaacggggtggtgccagcagggggttcttactacatgatctcccgcagcctggctatggcacggccaatggaatcccggccagggccttgctcctag

SEQ ID NO: 240962 - DNA, 3258 bp, Artificial Sequence
  Description of Artificial Sequence: Synthetic coding sequence
atgcctcatttcacagttgtgcctgttgatgggcctcggaggggagattacgacaatctggaagggctgtcatgggtggattatggtgaacgagccgaactggacgactcagatggccacggaaatcaccgagagtcctcaccctttctgtctccactggaggccagcagaggcattgactactacgaccggaaccttgcattgtttgaggaagagttggacatcagacccaaagtgtcatcccttctgggaaagttagtgtcctatacaaatctgactcagggtgccaaagagcatgaggaagcagaaagcggtgagggaactagacgcagagcagccgaagctccctccatgggaaccttaatgggggtctaccttccatgtttgcagaacatctttggcgtgatcctttttctgcgtctgacctggatggttgggactgctggcgtgctgcaggcactcctcatcgttcttatttgttgctgttgtaccctgctgaccgctatctcaatgtcggcaattgcgacgaacggcgtggtccctgccggtggatcatatttcatgatatcacgctccttaggaccagagtttggtggtgccgtggggttatgcttctacctggggacaacctttgcagcagccatgtacatcctgggagccatcgagatcctgcttacctatattgcaccacccgctgctatcttctacccctctggggctcatgacacatccaacgccacattgaataacatgcgagtctacggaacaatcttcctgacattcatgacccttgtcgtcttcgtgggcgtgaaatacgtcaacaaattcgcctctctgtttttagcgtgcgtcatcatcagtattctgagcatttatgcagggggaattaaatctatcttcgaccctccagtgttccccgtgtgcatgctgggcaaccgcaccctgagcagagatcagtttgacatctgcgcgaagacggctgtggttgacaatgaaacagtagcaacccagctatggagttttttctgtcacagccccaatcttactaccgactcctgcgatccttacttcatgctgaacaatgttaccgaaatccccggtatcccaggcgctgctgccggagttttgcaagagaatctgtggagtgcttatctggaaaagggagatattgtggaaaagcacggtttgccatcagctgacgcaccaagtctcaaggaatcactccccctgtacgtggtggcggacattgccacgtctttcacagttctcgtgggaatcttttttccatccgtgacaggtatcatggcaggcagcaataggtccggagacctccgagatgcacagaagtctatcccggtgggaacaatcctggctatcatcaccacatcgctggtttatttctcaagcgtagtcctatttggggcatgcattgagggcgtcgtgctccgagataaatacggggacggtgtatcccggaatctcgtggtggggaccctggcctggcctagtccctgggttatcgtcatcgggtctttcttttcaacgtgtggagctggcttgcagtccctgactggcgctcccaggctgcttcaagcaatcgctaaggataacattattccctttctcagggtctttggccacgggaaagtgaatggagaaccgacttgggcgcttctcctcacagctctcatagccgagctgggcatcctgatcgcttcattggacatggtagcgccaatcctttcaatgttttttttaatgtgttacctctttgtgaatttagcttgcgctgtccaaacactgctgaggacccctaattggagaccgcgatttaagtactatcactgggctctgagcttcctcggcatgtctctctgcctggctttaatgtttgtaagcagttggtattacgctctcgtcgcaatgcttatagcgggaatgatttataaatatatagagtaccaaggcgcagaaaaagaatggggcgatgggatcagaggtttaagcctgagtgcggcacggtacgcgctattgagactcgaagagggaccgccacatactaaaaactggaggccccagttgctcgtgcttcttaagcttgacgaggacctgcatgtcaaatatcccaggctgttaactttcgccagccaactgaaagcaggcaagggcctgaccatcgtcggatctgtcatacagggtagctttcttgagtcctatggcgaagctcaggctgctgagcagacaatcaagaatatgatggaaatcgagaaggtgaaaggcttctgtcaagtggttgtcgcgagcaaagtcagggagggcctagcccacctgattcagagttgtgggctcgggggaatgaggcacaattcagtggtcttagggtggccttatggctggcggcagtcagaagacccccgagcctggaagacctttattgacacagtccggtgcactaccgccgctcacctcgcccttctcgttccaaagaacatcgctttttacccttcaaaccatgagcgttacctggaggggcacattgatgtttggtggattgtgcatgatggtggcatgctgatgctgttacccttcctcctgcgacagcacaaggtgtggcgaaaatgcagaatgagaatcttcacggtagctcaaatggatgacaattcaatccagatgaagaaggacttagctgtctttttatatcatctcagactcgaagctgaggtggaggttgtggagatgcacaacagcgatatctctgcctatacctacgagcgcacactgatgatggagcagcgtagccaaatgctccgacagatgcggttgacaaagacagagagggaacgggaagcacaacttgtgaaggatcgtcattcagctcttagactggagtccctatacagcgatgaagaagacgaaagcgctgtgggcgctgataagattcagatgacatggactagggacaagtacatgaccgaaacatgggacccaagccacgctcccgacaactttagggaactggtacacattaagccggaccagtccaacgtccgacgcatgcacactgcagtgaagttaaatgaagtgatagtcaccaggtctcacgatgcacgccttgtcctgttaaacatgccaggcccacccaggaactctgaaggcgatgaaaattatatggaatttctagaggttttgaccgaaggcttagaacgggtgcttctggtaagaggtggcggtcgcgaggttatcactatctatagctag

SEQ ID NO: 240963 - DNA, 2343 bp, Artificial Sequence
  Description of Artificial Sequence: Synthetic coding sequence
atgccacactttactgttgtccccgttgatggccctagacgcggtgactacgacaatctcgaagggttgagctgggtcgattacggagaacgggcagagctggatgattccgatggtcacggcaaccacagagaatcttcccccttccttagtcccttggaggccagcagggggatcgattattatgatagaaaccttgcactgtttgaagaagagctagatatccggccaaaggtgtcttcattgctcggcaagctggttagctacaccaatctgactcagggggcaaaagagcacgaggaggccgagtcaggcgagggcacacgacgccgagctgccgaagccccatcaatgggaactctgatgggcgtgtacttgccatgccttcagaatatctttggggtcattcttttcctgcgtctgacttggatggtcggtactgcaggtgtgctccaggccttgctgatagttctgatctgctgttgctgcaccctgcttaccgcaattagcatgtctgccatcgcaacgaacggtgtggtgcccgcaggagggagctactttatgatttcccggtctctcgggcctgagttcgggggtgccgtgggcctgtgtttttaccttggaactacattcgcagcagctatgtacattctgggggcaatcgagatcctccttacctatatcgcaccacctgctgcaatattctaccccagtggcgcacacgatactagcaacgccactttgaacaatatgcgagtctacggcaccatcttcctaaccttcatgacacttgtggtgttcgttggggtaaagtatgttaataaatttgcaagtctgtttctggcctgcgtgatcatcagcatcttatcaatttacgcaggagggatcaaatccatctttgatcctccagtgtttcctgtttgcatgctcggaaacagaaccctgtcgagagatcagttcgacatttgcgccaaaaccgcggtcgtcgacaatgagactgttgccacgcagctttggtcatttttttgtcacagtcccaatctgacaacagatagctgtgatccctacttcatgcttaacaatgtgacggaaatccctggcattccaggagcagctgccggagtattgcaggaaaatctgtggagtgcctacctggaaaagggtgatattgtcgaaaaacacggattaccttccgctgacgccccaagcctgaaagaaagtctgccactgtacgttgtcgccgacatagctacttccttcacggttttagtcggaattttctttccctcagttaccggaattatggctggctcaaatagatcaggggatctaagggatgcacagaagtccatacctgtggggactatactcgcgatcatcaccacctctctggtgtacttttcctctgtagttctgttcggcgcatgcatcgaaggagtagtcctcagggataagtacggtgacggagtctcacgaaacctggtggtaggcaccctcgcctggcctagcccttgggttattgtgataggttccttcttctcaacttgcggcgctggtctgcagtccttgacaggagccccacggctcctgcaggccattgccaaagataacatcattccctttctcagggtgttcgggcacgggaaggtgaatggcgagcctacctgggcgctgcttctgactgccctgatagctgaactgggcatcctcatcgccagtttggacatggtcgctcctattctgtccatgttcttcctgatgtgctacctgtttgtcaatctcgcctgtgccgttcaaactttgctgagaactcctaattggcggcctcgtttcaaatattaccactgggccctgtccttcctaggcatgtcactttgcctggcgctcatgttcgtgtcatcttggtactacgccttggtagctatgctcatagcaggtatgatttacaagtacattgagtaccaaggggctgagaaggagtggggggacgggattcggggactttcactgagcgccgctcgctatgcccttctaaggttggaagagggccctccacacactaaaaactggcgcccacagttactggttctgctgaagctggacgaggacttgcatgtgaagtaccccaggctgctcactttcgcgtctcagttaaaagctgggaagggactcaccatcgtaggatccgtcatccagggttccttcctggagtcttacggggaggcccaggctgccgaacaaacaccatgtgctgccttacggctcccaacctggccgtgctcttgtcctaggacatcaccgtctactccggcaacaacatccgccacctggagagcaacgtag

SEQ ID NO: 240964 - DNA, 3264 bp, Artificial Sequence
  Description of Artificial Sequence: Synthetic coding sequence
atgcgtgcgggtggagcatgcaggcccggtgcagctggaactgccgctggcaccgctgcgggtggctgggatggcggttgcggcggagcagagcctgcacgctgcctcacttcaccctggtgccaatggactggaagaggcgctgctaccatgactacaagcaggggtagcgtggggtggaccacaggaagcgcaccttcttggatgacgcgtactgaagaacttgacattagaccgaaggtgtcgtcactccttggcaagctcgtgtcctacacaaatcttacccagggtgcaaaggagcatgaagaagcagaatccggggagggtactcgacggagggccgcagaggctccctctatgggcacattgatgggggtttacttgccctgcctgcaaaatatttttggcgtgattcttttcttgcggctgacttggatggtgggcaccgccggagtcttgcaagctctcctgattgtgctgatctgttgttgctgtacgctcctcacagccattagtatgtcggctatcgcaaccaacggggtggtgccagccggaggatcctactttatgatctcacggtctttgggaccagagtttggcggtgcggtagggctatgtttctacttgggcacaacctttgccgcagctatgtatattctgggggctattgagatcctgttgacttacatcgcgcctccggctgccatcttttacccatccggtgcgcacgacacaagtaacgccaccctgaataatatgcgtgtatatggtaccatttttttaacttttatgacactcgtggtgttcgtaggcgtgaagtacgtgaataaattcgcctcactctttcttgcctgtgtgattatttccatcctctctatctatgccggtggcattaagagcattttcgatcccccagtttttcccgtttgtatgttgggaaatcgcaccttgtcaagagaccagttcgacatctgcgctaagacagcagtagtggacaacgaaacagttgcaactcaactgtggtcgttcttctgtcattcccctaatctaacgacagacagctgcgacccatacttcatgctgaacaatgtgacagaaatcccaggcatccctggagccgctgccggagtcttgcaagagaatctgtggagcgcttacctggaaaaaggtgacatcgtagaaaaacatggccttccaagtgcggatgctccctccctcaaagaatccctgcctctgtacgtcgttgctgatattgccacatctttcaccgtgttagtgggtatttttttcccatccgttaccggaatcatggctggctccaatcgctctggcgatctgagggacgcacaaaagtctatccctgtgggtactattttggcaatcatcacaacctcgctagtgtatttctcttctgtagttcttttcggtgcatgcatcgaaggtgtggtgttaagggacaaatatggagacggggtcagcaggaaccttgtggtgggaacattggcctggccgtcaccctgggtgattgttatcggaagcttttttagcacctgcggagctggtcttcaaagcctgactggagctcctcgcctgctgcaggccattgccaaggataatatcatcccttttctgcgcgtgttcggtcacggaaaggtgaatggagagccgacctgggctcttctgctgactgctctgatcgctgagttgggtatacttatcgcttccttggacatggtcgcaccaatcctgagcatgtttttcctaatgtgctacctgttcgtgaatctggcctgcgccgtgcagacactcctccggacacctaattggagacccagattcaaatattatcactgggcactttcctttctggggatgtctctctgtctagccttgatgttcgtctccagttggtactacgcgctcgtagctatgctgatcgccggaatgatctacaagtacatcgagtaccagggcgctgagaaggaatggggagacggcattagaggcctaagtctatctgcggcacgatacgcgttgctcagattggaagagggcccaccccacacaaagaattggcgcccacagcttttagtgttattgaaattagacgaagaccttcatgttaagtaccctagactactgacctttgcttctcaactcaaagccggaaaagggctgaccatcgtggggagcgtgattcaaggctcatttctcgagtcttacggcgaagcccaggctgccgaacagactatcaagaatatgatggagatcgaaaaagtgaaagggttttgtcaggtcgtcgtggcttcaaaggtaagggaggggctggctcatttaatccagtcatgtggtctcggcggaatgagacataactcagttgttctaggttggccctatggatggcggcagagtgaggaccctcgagcctggaagacgtttatcgacactgtacggtgcaccactgcagcccatctggccctcctcgtacccaagaatattgcattctatccgtcaaaccacgagaggtacctggaagggcatattgacgtctggtggatcgtgcacgacggagggatgctgatgctcctgccctttttgcttaggcagcataaggtctggcgcaagtgtaggatgagaattttcacggttgcccagatggatgataactccatccaaatgaagaaagacctggccgtgttcctatatcacctgaggctggaagccgaagtggaggtggtggagatgcataactcagacatctccgcctacacgtacgaacgtacacttatgatggaacaaagatcacagatgctgaggcagatgagactgactaagactgagcgggagcgggaagcccagcttgtaaaggataggcatagcgcgctgaggctagaatctttgtacagcgatgaagaggatgaaagtgccgtgggagccgacaagattcaaatgacgtggactcgggataagtacatgaccgagacatgggatccatcacacgccccagataatttcagggagctggtccacataaaaccagaccagtctaacgtcaggcgcatgcacaccgccgtgaagctgaatgaagtgattgtaaccagaagccatgacgcgaggctggtcttgctgaacatgcccggacctcctaggaactcagagggtgatgagaattatatggagtttctcgaggtgctcaccgaaggacttgagagagtcctcctggtccgaggcggaggtagagaggttataactatctacagttag

SEQ ID NO: 240965 - DNA, 3240 bp, Artificial Sequence
  Description of Artificial Sequence: Synthetic coding sequence
atggctgcagaaggcgctgtttgcgggtttgtgtacctggaaggaaccgcatgggctgtgcccgaggatacagagccgctggcaagctgtactcttggacacggcaaccaccgggagagcagtcccttcctctcgcctttggaggcttccaggggaattgactactacgatagaaatctggcccttttcgaggaagaacttgacatccgccctaaggtctcttctttacttggcaagttggtaagctacaccaacctcacgcaaggggctaaagaacacgaagaggcagagagtggagaggggacgcggagacgcgcagctgaggctccttctatgggcacgctcatgggagtttacctcccatgccttcagaatatattcggtgttatcctatttctccgacttacatggatggtgggcaccgctggggtcctacaggctctgctgatcgtgctgatctgttgttgttgcaccctgctgaccgccatctcgatgtctgctatcgctaccaacggggtggtccccgctggcggatcgtactttatgatctccagatcactggggcctgaatttggtggggcagtgggcctgtgtttctacctggggacaactttcgccgctgccatgtatatcctcggcgcaatcgaaatactattgacgtacatcgctcctccagcagctatcttctacccaagtggcgctcacgatacaagcaacgcaaccctgaataatatgcgcgtgtacgggaccatcttcctgacttttatgaccctggtcgtgttcgttggggtgaagtatgtcaacaaatttgcaagcttgttccttgcctgtgtaattatttctatccttagcatctacgctggcggaattaaatcgatctttgacccgccagtgttccctgtatgcatgctcgggaatagaactctgagtagggatcagtttgacatctgtgcaaagaccgcagtggtagataatgagacagtggcgacccagctatggtctttcttctgccattctcctaatttgaccacagattcttgcgacccatactttatgctcaataatgtcacagagattccagggatacctggagcagccgcaggtgtccttcaagaaaacctgtggagtgcgtacctagaaaagggcgatatcgttgaaaagcacgggctgccatctgccgacgctccttccctcaaggaatccctaccgctgtacgttgtcgctgatattgccaccagtttcacggtacttgtcggaatattcttcccctccgtgacagggattatggcaggttcaaaccgatccggcgatcttcgcgacgcccagaagtctattcccgtggggaccatcctcgcgatcattacaacgtctctggtgtatttctcctccgttgtgctgtttggtgcctgcatagaaggggtcgtcctccgcgacaagtatggtgatggggttagccggaacttggtagtcggaaccctggcctggccatctccctgggttattgtcataggaagtttcttttctacttgcggggctggattacagtctcttacgggagctccaagactgcttcaagcgatagccaaagataatatcattccatttttaagagttttcggccacggcaaagtgaatggtgagcccacctgggctctgctgttaactgccttgatcgccgagctcgggatcctgattgcctccctggatatggtggctcctatcttatcaatgttttttctaatgtgctacctctttgtgaatctggcttgtgccgtacagacgcttctgagaacccctaattggaggccacgattcaagtactaccactgggcgctgagctttctgggtatgtctttatgcctcgccctcatgtttgtgtcatcatggtattatgcactcgtcgccatgctgatcgccggaatgatctacaaatatatagaatatcagggtgccgagaaagagtggggagacggcattaggggcttgtccttatcggctgctagatatgccctgctgcggcttgaggaaggaccaccacatacaaagaactggagacctcagctgttggtgttactcaagttagatgaagatcttcacgttaagtatcctcggttgttgacattcgccagccaactaaaagctgggaagggcttaactatcgtgggatcagtcattcagggttcattcctggagtcctatggcgaagcgcaagcggcagagcagacaattaaaaacatgatggaaatcgaaaaggtcaagggtttctgtcaagtggtggtggcgagcaaggttcgtgaaggcttagctcacctgatccaatcttgtggcctcggcggtatgaggcacaattccgtggtgctaggttggccatatggctggcgccagtccgaagatcctagagcctggaaaacttttatcgacactgtgcggtgcaccaccgcggctcatctagctctgctggtgcccaaaaatattgcgttttatcccagcaaccatgagaggtacctggaggggcatattgacgtctggtggatcgtgcatgacgggggtatgcttatgttacttcccttcctgttgcgacaacacaaggtgtggagaaaatgccgtatgcgtattttcaccgtggcacagatggacgacaatagcattcagatgaaaaaagaccttgccgtctttctctaccacctccggttagaggcggaggtggaggtcgtcgaaatgcacaattctgacatcagtgcttatacttacgagcgaactctcatgatggagcagaggtcgcagatgttgcggcaaatgagattgacaaaaactgagagggagcgggaggctcaactggtaaaagatcggcatagcgcccttcgactagagtctctttacagtgatgaggaggatgaaagtgctgttggagcagacaaaatccaaatgacttggacaagggataaatacatgacggagacgtgggatccctcacacgctccagacaatttcagggaactggtccacattaagccggatcagagtaatgtgagaaggatgcatactgcggtgaaactgaatgaagtgatcgtcactcggtctcatgatgccaggctggtcctgctgaacatgcccggaccgccaagaaacagtgagggcgacgagaattacatggaattcctggaagtgctgaccgaggggctcgagcgtgtgctcttggttcgcggaggcggtcgggaggtaataacgatttactcttag

SEQ ID NO: 240966 - DNA, 3165 bp, Artificial Sequence
  Description of Artificial Sequence: Synthetic coding sequence
atgggggacaccttgtccccgggacacggtaaccaccgagagtccagccccttcctcagtcccctggaagccagccgcggtattgattattacgatagaaacctcgcactcttcgaggaggagctcgacatccggcctaaagtcagcagcctgctaggcaaactcgtctcttataccaatcttacgcagggggctaaggagcacgaagaggctgagtcgggggaagggaccagacggcgagcagccgaagctccttcgatgggtacgctgatgggtgtttacctcccttgcctccaaaacatttttggagtcattctattcctccggctgacatggatggtggggactgctggtgtcctgcaggctctgctcatcgtgcttatttgctgttgttgtacattattaactgctatatccatgtctgccattgcaactaacggggtggtccccgcagggggttcctacttcatgattagcagaagtctgggcccagagtttggtggcgctgtgggtctatgtttttacttaggcaccacgttcgcagcagccatgtacattctgggagctatcgaaatccttttgacgtatattgccccacccgctgctatcttctatccttctggagcacatgatacctccaacgcgacccttaacaatatgagggtctatggaaccatatttctgacattcatgaccctggtggtctttgtcggcgttaagtacgtgaacaaatttgcctccctgttcctcgcctgtgtgattatttctatcctttcaatttatgcaggcggaatcaaatcaatcttcgacccacccgtgtttcctgtgtgcatgctcgggaacagaacactgagtcgggaccaattcgacatctgtgcaaagaccgcagtcgtagacaatgagaccgtggctacccagctttggtccttcttctgccactcacccaatttgaccactgactcttgtgacccatattttatgctgaataacgtcacggagataccagggatccccggagctgctgccggagtgctgcaggagaatttgtggagtgcctacctggaaaagggagacattgtggaaaagcatggcctgcccagcgccgatgctccatcactcaaagaatcactgccactgtatgtcgtcgccgacattgctacgagttttacagtgctcgtaggaattttttttccctccgtgactggaataatggccggaagtaacaggagcggggatttgcgagacgcgcagaaatcaattcccgtgggcacaatcctcgctatcattactacctctttagtatacttttccagcgtggtgctgtttggcgcatgcattgaaggcgtcgtgttaagggataaatacggagacggtgttagtcgcaacttggtggtaggcacactggcgtggcctagtccgtgggttatagttatcggttcgtttttctccacatgcggcgctggtctgcaaagccttacgggagctccacggttgttacaagccatcgccaaagacaatattatccctttcctgagagtgttcggccatggcaaggtaaacggcgaaccgacatgggcacttcttctgacagccctgatcgcagaactcggtattttaatcgcatctctggatatggtggctccaatcttgtctatgtttttcctcatgtgttatctattcgtgaatctcgcttgtgctgtccagacattgctcaggacacccaactggcgcccaagattcaaatattaccactgggcgctctccttcctgggcatgtctctttgccttgccctgatgttcgtctcttcctggtattacgcattagtcgcaatgctaatcgcagggatgatatataagtacattgagtatcagggggcagagaaggagtggggcgacggaattagagggttgtcgttgagtgccgcacggtacgcattgcttcggctggaagaaggaccgccacacacaaagaactggcgaccccagctgctggttctgttgaagctggacgaggatctgcacgtcaaataccctaggctgttgacattcgcctcccaactgaaagccggtaagggtctcacaattgttggatctgtcatccagggcagctttctggaaagctacggagaggctcaggctgcagagcagacaatcaaaaatatgatggaaatagaaaaggtcaaaggattctgccaggtggtcgtagcttccaaggttcgggaaggcctggcccatctgatccagagctgcgggctgggagggatgagacacaatagcgtggtgctggggtggccctatgggtggaggcagtctgaggaccctcgggcatggaagacttttatcgacactgtaaggtgtaccacagctgcacacctcgcactcttagttcccaaaaatatcgcattctacccctcaaaccacgagcgctacctggaggggcacattgatgtctggtggatcgtgcacgacggtggtatgttaatgttgttacctttccttctgcgtcagcacaaggtgtggaggaagtgcaggatgcgaattttcacggtcgcccaaatggatgacaatagcattcaaatgaagaaagacctcgccgtcttcctgtatcatctgagattggaggcagaggtagaggtcgtggaaatgcataacagtgacataagcgcctatacatacgagagaacactcatgatggagcagaggtcacagatgttgcgccagatgcgattgaccaaaacagagcgagagagggaagctcaattggttaaggacaggcacagcgcccttcgattggaaagcctgtacagtgacgaggaggacgaaagcgccgtaggcgctgataaaatacagatgacttggactcgcgataagtacatgactgaaacctgggacccgagccacgcaccagacaattttcgagagctcgtccatatcaagcctgaccagtccaacgtgagaaggatgcatacagcggtcaagcttaacgaagtgattgttacccgctcccacgacgccagactggtgctgctgaatatgccagggccacccagaaatagtgagggcgacgagaattatatggagttcctcgaagtgcttaccgagggtttagagcgtgtacttctggttcgtgggggtggtagagaggtcataaccatctactcgtag

SEQ ID NO: 240967 - DNA, 3300 bp, Artificial Sequence
  Description of Artificial Sequence: Synthetic coding sequence
atgccacattttacggtgaccaaagtcgaagacccggaagagggcgcagccgcaagcattagtcaggagcccagcctggccgatatcaaggccagaatccaggatagcgacgagcccgatctttcccagaacagtattactggagaacactcacagttgcttgatgacggccacaagaaagctcgaaatgcttatctgaataactctaattatgaggagggagacgaatatttcgataaaaacttggctttgtttgaggaagagatggatacccgaccgaaagtctcttcactgctgaataggatggccaactacaccaatctgacgcagggcgctaaagagcatgaggaggccgagaacatcaccgagggaaagaaaaagcctaccaaaacaccccagatggggacatttatgggcgtgtacctgccttgcctccagaatatattcggcgtcattctattccttcggcttacatgggtggtcggcaccgcaggcgtgctgcaagcgtttgctatcgtgctgatctgttgctgctgcacgatgctgacggctatatctatgtctgctatcgccacgaacggtgtcgtgccagccggagggtcttatttcatgatttctcgcgctctcggaccagaattcggaggagcagtgggactctgtttctatctcggcacgacgttcgcagccgctatgtatatcctgggagcaattgaaattttcctggtttatatagtgccccgagccgcaatttttcacagtgatgatgcattgaaggagtcagcagccatgcttaataatatgcgcgtgtacggaacggctttcctagtgttaatggtgctagtggtgttcattggcgtgcggtatgtcaacaagtttgcatcactctttctcgcctgtgtgatcgtatctatactcgccatttatgcaggagcgataaagagtagttttgccccacctcatttcccagtgtgtatgttgggcaaccgcactctgagttcccgtcacatcgatgtgtgcagcaagaccaaagagattaacaatatgaccgtcccctctaagctttggggatttttctgtaatagttcccagttctttaacgccacatgtgatgaatacttcgtgcataacaacgtcactagtatccagggcatccctggcctggcaagtgggataatcaccgagaacttatggagcaattacttgcccaagggcgaaatcatagagaagccttcggcaaaaagctcggatgtgctcgggagtctaaaccatgaatatgtgttggtggacattaccacatccttcacactcctggtggggattttttttccctcggtcactgggattatggccggttctaatcgctcaggtgatctgaaagacgcccagaaatcaatcccgattggcaccatactggcaatcctaaccacatctttcgtgtacctttccaatgtggtattgtttggtgcctgtatagagggagttgtactgcgagacaagttcggagacgcagtaaaaggtaatctggtcgtcggtactctctcatggcctagtccctgggtgatcgtgatcggtagtttcttcagtacttgcggagctggcctccaaagcctcaccggcgcacctaggctgcttcaagctatcgctaaagacaacattatccctttcctgagggttttcgggcattctaaagccaacggagaaccgacctgggccttgcttttgaccgccgctattgctgaactcggtatacttatcgctagcctcgatctagtcgctccaatactcagtatgttctttctaatgtgctacttgtttgtgaacctcgcttgcgccctccagacactgctcagaactcccaattggcggcctcggttccgttactatcactgggctctttcattcatggggatgtcaatttgccttgcacttatgttcatttcatcatggtactacgctatcgtggcaatggtaatcgcaggtatgatctacaagtacattgagtatcagggggcagaaaaagagtggggtgacggaatcaggggtctcagcttgtcagcagctagatttgcattgctgcgcctggaggagggaccaccccatactaaaaactggcgcccacagctgctggttctgttgaaacttgacgaggacctgcacgtgaagcacccaaggcttcttaccttcgcaagtcagcttaaggcaggtaaggggctaacaatagtgggctctgtaatcgtcggaaatttcctggaaaactacggcgaggctcttgccgctgaacaaacaatcaagcacctgatggaggctgaaaaagtgaagggtttctgtcagttggtcgtcgcagccaaattgagagaaggtatttctcacctgatacagagctgcggtctgggtgggatgaagcataacaccgtggtcatggggtggcccaatggctggaggcagagcgaagacgcacgggcttggaaaaccttcatcggcaccgtgcgagtgactaccgccgctcatctggcactgctagtcgcgaaaaacatatctttttttcctagtaacgtagagcaattttccgaaggcaacatcgacgtgtggtggattgtccacgatggaggtatgctcatgttgctgccctttcttctcaagcagcataaggtgtggcgaaaatgcagcattcgaatctttactgtagcgcagctcgaagacaattctatccaaatgaaaaaagacttagcaacgttcctgtaccatttacgcatcgaggctgaagtggaggtggtcgagatgcacgatagtgacatatccgcctatacatacgagcgcaccctgatgatggagcagcgatcccaaatgcttagacacatgcggctatccaaaactgagagggacagagaagcacaactcgtgaaggacagaaattcaatgttgcgacttacatcgatcggaagcgatgaagatgaagaaaccgagacataccaggagaaggttcatatgacctggactaaagataaatacatggcaagccgcggacagaaggcaaaatctatggaaggctttcaggatctcctgaatatgcggccagatcagtccaacgtacgtcggatgcacaccgctgtcaaattgaatgaagtcattgttaataagtcacatgaggcgaaactcgttctcctgaatatgcctgggcctcccaggaaccccgaaggcgatgagaactacatggaatttttagaggtgctcaccgaaggcctggaacgcgtacttctcgtgcgcggaggaggaagtgaggtcattacaatctactcatag

SEQ ID NO: 240968 - DNA, 3453 bp, Artificial Sequence
  Description of Artificial Sequence: Synthetic coding sequence
atgcacccgccagagacgacaacaaagatggcatcagttagatttatggtgactcctaccaaaattgatgacattccgggacttagcgacacatctccggacttgagcagtcgaagctcctctagggtccggtttagtagccgggaatctgtgccggaaacgtcaaggtccgagcccatgtctgagatgagcggcgctaccacctccctagctacagtggcactggaccctccatccgataggacttcacatcctcaggatgtcatcgaggatctctcacagaattccatcacaggcgaacactcccagcttcttgacgatggtcacaagaaggctcggaacgcttacttaaataattctaattacgaagaaggcgacgagtacttcgacaaaaacctcgccctcttcgaggaagaaatggatacccgaccaaaagtttcgtctctcctgaaccgaatggcaaactacacaaacctgactcaaggcgctaaggagcatgaggaagccgagaacatcacggaaggcaagaagaagccgactaaaactccacaaatggggactttcatgggagtatacctgccctgcctacagaatattttcggcgtgatcctgttccttcgtctgacttgggtcgttggtaccgctggtgtgttacaggcttttgccattgtactgatctgctgctgctgcacaatgctgaccgctatcagcatgagtgccatcgccactaatggcgtggtcccagccggagggtcatactttatgatttcccgggcactgggtcctgagttcggtggcgctgtgggcctctgcttctacctcggcactactttcgcagctgccatgtacattctgggagcaatcgaaatttttctggtgtatatcgtgccccgagctgcaatttttcacagcgatgatgccctgaaggagtccgctgccatgttgaataacatgcgtgtgtacggtaccgcatttctcgtcctcatggtcctggtggttttcataggtgtacggtacgtcaacaagtttgctagccttttcttagcctgtgtgattgtgtccattctggcgatttacgccggagctatcaagtcatcttttgcgcctccccacttccccgtgtgtatgcttggcaatagaactctgtcatccagacatatcgacgtgtgtagcaagaccaaagagataaataatatgacggtgccctctaagttatgggggtttttctgtaactcctctcagttctttaatgccacctgcgacgagtacttcgtccacaataacgtcactagcatccagggcatacctggcctagcctctggcattattacggaaaatctgtggtctaactatttaccaaaaggtgaaattatagagaagcctagcgcaaaatctagtgatgttctgggcagcctgaaccatgagtacgtgctggtggatataactacgtctttcacgctcctcgtgggaatctttttcccaagcgtaactggtattatggccggatccaatcggagcggcgacttgaaagacgcgcagaagtctattcctatcggaactatcctcgccatactgacaacctcctttgtatatttgtctaatgtggtattattcggagcttgtattgagggcgtggtgctccgcgataagtttggggacgcggtcaaaggaaatctagtggttggcaccctctcctggccaagtccgtgggtaatcgttatcggttccttcttttccacatgcggtgcgggactgcagagcctgaccggcgcaccgaggctgttgcaagccattgctaaagataacatcattccttttctgagagtgttcggacactccaaagccaatggggagccaacctgggcacttctgttaacggccgctattgccgagctgggcatcttaattgctagcctggatcttgttgcacctatacttagtatgttctttctaatgtgttatttgttcgtcaatctagcatgcgcactgcagaccctcctgcggacccccaactggcgaccgaggtttcgctattatcactgggccctgagttttatggggatgagcatctgtctcgcgttaatgtttatcagtagctggtattatgctatcgtggctatggtgatcgcgggaatgatctacaaatacatagagtaccaaggcgctgagaaggagtggggggacggaatccggggtctttccctttcagctgcacggttcgccctgctcaggctggaagagggcccaccacacacgaagaactggcgaccccagctgcttgtcttactaaagctggacgaagacctgcacgttaaacaccctcggctcctcacttttgcatcccagctgaaggccggaaagggcctgaccatcgttggatctgtgatcgtgggcaattttctcgagaattacggtgaggccctggctgcagaacagaccatcaagcatctcatggaggccgagaaagtcaaggggttctgtcagctcgttgtcgcggcaaaattacgggaaggcatctctcaccttatccaatcgtgtggattaggaggcatgaaacataatactgtcgtcatgggctggccaaatggctggcgtcaaagtgaggacgccagagcttggaaaacattcattgggactgtgagagtcacaactgcagctcatctggcgctgctagtggccaaaaatatctccttctttccttcgaacgtggagcagtttagtgaaggaaacatcgatgtgtggtggatagttcatgatgggggtatgctgatgctgctgccctttctactgaagcaacacaaggtctggcggaagtgttcaattagaatatttacagtcgcacagctggaggataatagcatacagatgaagaaggatctagcaactttcctatatcacctgagaattgaagcggaggttgaggttgtggagatgcatgactcagacatttccgcctacacatatgaaaggacattaatgatggaacaacggagtcagatgttgcggcacatgaggctcagtaagacagagcgtgaccgcgaagcccagttggttaaagaccgcaactccatgttgaggctaacctcaataggaagtgacgaggatgaggagaccgaaacttatcaagagaaggtccatatgacctggactaaggacaagtatatggcttcccggggtcagaaggccaaatccatggagggcttccaagacctattaaatatgaggcccgatcagtctaacgtgaggcggatgcacaccgcggtcaaattaaacgaagtaatcgtgaataaatctcacgaggcaaaactggttctcttaaacatgcctggcccacctaggaaccccgagggcgacgaaaattacatggagtttttggaagttctaacagagggtctcgagagggtcttgctcgtcaggggtgggggatcagaggttatcactatctacagttag

SEQ ID NO: 240969 - DNA, 3276 bp, Artificial Sequence
  Description of Artificial Sequence: Synthetic coding sequence
atgtccgaaatgtccggtgctaccacatccctggctacagttgcacttgacccaccaagtgaccgaacttcgcatcctcaagatgtgatagaggacctcagccagaattccattactggcgaacattcccagctactcgatgatgggcacaagaaggcgaggaacgcatacctgaataatagcaactacgaggaaggtgatgaatactttgataagaatcttgctttgttcgaggaggagatggatacccggcctaaagtcagttccctcctcaaccgcatggccaactacactaatctcacgcagggagcaaaagaacatgaggaggccgaaaacatcacggaggggaagaaaaagcccacaaaaacaccccagatgggaacgtttatgggcgtctacctcccttgtctgcagaacatatttggggtaatcctcttcctccgcctcacctgggtcgtggggacagctggtgtgctacaggcctttgctattgtcctcatctgttgctgttgcactatgctcacagccatctccatgagtgcaatcgctactaacggcgtagtgccagcagggggatcttactttatgatttccagggcgcttggcccagagttcggtggagccgtaggactttgcttctacttgggaactacctttgccgctgccatgtatatcctcggggctatagagatctttttagtctatatagtgcctcgcgctgccatttttcactccgatgacgcattgaaagagagcgctgccatgttaaacaacatgcgcgtgtatggcactgccttcctcgttcttatggtgttggtggtgtttattggggtccgttatgtgaataaattcgccagcctattcctggcctgtgtaatagtaagcattttggccatttatgcgggagcaatcaagagctctttcgccccaccacattttcccgtctgcatgctgggcaatcgaacacttagcagccgccatatcgatgtctgttctaaaactaaagaaattaataacatgaccgtcccttccaaattgtgggggttcttttgcaactcttcccagttcttcaacgccacgtgcgatgagtacttcgtgcataacaacgttacgtctattcaaggaataccgggtcttgcctctgggatcatcaccgagaacctctggtccaattacctgccaaaaggtgaaattatcgagaaaccatctgctaagtcctcggatgtgcttgggagcctcaatcacgagtacgtgctggtggacattacaacatccttcaccttgctcgtcgggatattttttccctccgtgactggtatcatggcgggatcaaacaggtccggcgatctcaaagacgcccagaaaagcatacccattggaaccatcctcgcgatcttaacaacctccttcgtgtatctgagcaatgtggtgctgttcggtgcgtgcatagagggcgtggtccttcgggacaaatttggcgatgcagttaagggcaatctagtcgtggggacactctcatggccaagcccctgggtcatcgtaatcggatcgtttttcagtacgtgcggggctggtctccagagcttgacgggagcaccacgcctgctgcaggctatcgccaaagataatatcattccatttttacgcgtgttcgggcactcgaaagccaatggcgagccgacttgggctctgctgctgaccgccgcaattgccgaattgggtattcttatcgcatccttggacctggtggcaccaatattatcaatgttttttctcatgtgctatttgttcgtgaacctggcatgtgccttgcaaactctgttgcgcacaccaaactggcgacccagattcaggtattaccactgggcactgtcattcatgggcatgtccatttgtctggctcttatgtttatctctagctggtactacgccatagtggctatggtgatcgcagggatgatctataagtatattgagtaccagggggctgagaaggaatggggggatggaatccgcggtttaagcctgtccgccgctagatttgcccttctgcgtctagaggaggggcctccccacactaaaaactggcggcctcagctcttggtgttgctcaaactggacgaggatctccatgttaagcacccaagactcttgacatttgctagtcagttaaaagccggtaaggggctcacaattgtggggtccgtgatcgtcggcaacttcctggagaattatggagaagcactcgcggcagaacagacaattaaacacttgatggaagctgagaaggttaaggggttctgccaactggttgtggctgccaaattacgggaaggcatctcccatcttattcagtcttgcggtctcggaggcatgaagcacaacaccgtcgtaatggggtggcccaacggttggcgccagtccgaagacgcgagggcctggaaaactttcattggcacagtgcgagttactactgccgctcacctggccctactggtagccaagaacatatccttcttccctagtaacgttgagcagttcagcgaaggcaacatcgatgtctggtggatcgtacacgacggaggtatgctgatgcttctgccttttttgctgaaacagcacaaggtttggcgcaagtgctctattaggattttcaccgtggcgcaattagaagataacagtatacagatgaaaaaggatctagccaccttcctttatcacctaagaatcgaggcagaagtagaggtggtcgaaatgcacgacagcgacatatccgcctacacctatgagagaacgctgatgatggagcaaagaagccagatgttacggcatatgaggctctctaagacagagagggaccgtgaagctcaacttgtcaaggatcggaattccatgctgaggcttacttccataggcagtgatgaggacgaggaaacggagacctaccaggaaaaagttcatatgacttggacaaaagataaatacatggcgtctcgaggtcagaaggccaagagtatggaagggtttcaagacctgctgaacatgaggccagaccagtcgaacgtccgacggatgcatacagccgtcaaattaaacgaagttatcgtcaacaagtctcacgaagcaaaattggttcttctgaatatgccaggccctcctcggaatccagagggggatgagaactacatggagtttctggaggtattaaccgagggactggaaagagtcctattggttagagggggagggtcagaggtcatcaccatttattcatag

SEQ ID NO: 240970 - DNA, 3408 bp, Artificial Sequence
  Description of Artificial Sequence: Synthetic coding sequence
atgcacccccctgagacaaccaccaagatggccagcgtacgctttatggtgacacctaccaaaatagacgatattccaggcctgtccgatacaagcccagacctcagttcaagaagcagctcgagagtgcgatttagctcacgtgagtctgtgcctgagaccagtcgaagcgaacctatgtcagaaatgtcaggcgcaaccacttcgttggcaaccgtggccctggaccccccttccgatagaacgtcccaccctcaggatgtgatcgaggacgacgggcataaaaaagccagaaacgcttatctcaacaacagtaactatgaggaaggagatgaatacttcgacaagaaccttgccctgttcgaggaagagatggacacaaggccaaaagtgagcagcctcttgaacagaatggctaactatacaaacctcactcagggagcaaaggagcacgaagaagctgagaacataaccgaggggaaaaaaaagcctacgaagacaccccagatgggcacatttatgggggtgtacctcccatgcctccagaacatcttcggcgtgatcctgtttctgagattgacatgggtggtgggaacggccggagtgttacaggcttttgccattgtcctgatctgttgctgttgcacaatgttaacggccatttcaatgagtgctattgccacgaacggggtagttccagctggcggaagctacttcatgatctctcgcgctttaggcccagagtttgggggagcggtgggcctctgcttttacctcggaacgacatttgcagcagccatgtatattctgggagcgatcgagatatttcttgtgtacatagtgcccagagccgcaatctttcactctgacgatgccctgaaggaatccgccgcaatgctgaataatatgcgcgtctatgggacagccttcctggtgctcatggtcctcgtggtattcattggtgtgagatatgtaaataagttcgctagccttttccttgcgtgtgtaatagtgagtattttagctatctacgccggagccattaagagctctttcgctcctccgcacttcccagtgtgtatgcttggcaacaggactctgagctctcgccatatcgatgtgtgctccaagactaaagagatcaacaacatgacggttccgagcaagctgtggggctttttctgtaactcaagccagttcttcaacgccacctgcgatgagtattttgtgcacaataatgtgacttccattcaagggatccctggacttgcgagcggcatcattacagaaaatttatggagcaattacctgcctaaaggtgagataatcgagaagccatcagctaaaagctctgatgtgctgggctccctgaatcacgagtatgtgctggtggacattacaacatcttttacgctgctggtgggaatattttttccaagcgtgactggcataatggcaggaagtaaccggtccggcgacctgaaggacgcccagaaatctattcctattggtaccatcctggccatcctgactacatctttcgtgtatctgagcaatgtggtgctgttcggggcttgcatagagggtgtcgtgctcagggataagttcggcgatgccgtaaaaggaaatctggtggtaggcactttgagctggccatctccctgggtgattgtcataggctctttcttctccacatgcggagctggacttcagtccctcacgggggctcctcggcttcttcaggccatcgccaaggataatataattccttttttgagggtttttgggcactctaaggctaatggcgaacctacttgggctttgctgttgactgccgcaatcgccgagttagggattctcatagccagcctggatctcgttgcccctatactttctatgttctttctaatgtgctacttgttcgtaaatctcgcctgtgctctccagactctgttacgcactcccaactggcgccctagattcagatattaccactgggccctcagctttatgggcatgtcaatctgtcttgctctcatgtttatctcctcctggtattacgcgatcgttgccatggttatagctgggatgatatacaagtatattgagtatcaaggcgctgagaaggaatggggtgatggaataagaggactctccttatcagctgcacgcttcgctctcctcaggcttgaggaggggcctccgcacactaagaattggaggcctcagttgctggtgctgctcaaactggacgaagacctccatgtgaaacatccgaggctgcttaccttcgcttcccagcttaaggcagggaaggggcttacaattgttggatcagtgatcgtagggaactttctggaaaattatggcgaggccctcgcggcagagcagacaattaaacacctgatggaagccgagaaagtgaaaggattctgccagctggtggtggccgctaagctgagggagggcatatctcatctaatccagagctgtggcctgggcggtatgaagcataacactgtggtaatgggctggcccaacggctggaggcagagcgaagacgccagggcgtggaaaacctttattggcacggtcagagtcacaaccgcagctcatttagccctgctagtcgcaaagaatatctccttttttcccagcaatgttgagcagttctctgaaggcaatattgacgtctggtggattgtgcatgatgggggaatgttgatgcttttaccttttttgctgaaacagcataaggtgtggcgaaaatgcagtataagaatatttactgtcgcacaactagaagacaacagcatccaaatgaagaaagacctggcgacgtttctctaccacctgcgtatcgaggccgaagtcgaggtagtcgaaatgcacgacagtgatatcagcgcatatacctatgagagaactcttatgatggagcaaagaagccagatgttgcgccatatgaggttgtccaaaaccgagcgggatagagaagcccagcttgtaaaggacagaaattccatgctgcgcctgaccagcatcgggagtgacgaggacgaagaaacggagacttatcaggaaaaagtgcacatgacatggaccaaagataagtacatggctagcagaggacagaaggctaagtcgatggaaggcttccaggatctgctcaacatgcggccagaccaatctaatgtcaggcgaatgcacacagccgttaaactcaatgaagtaatcgtgaacaagtcccatgaggccaagctggtgctgctcaatatgcctggtcccccaagaaatcccgaaggtgacgagaactacatggaattcctcgaagtgctcacggaggggctggaaagagttttgctcgtgcgcggtggagggagcgaagtgataactatctactcctag

SEQ ID NO: 240971 - DNA, 2889 bp, Artificial Sequence
  Description of Artificial Sequence: Synthetic coding sequence
atggacacacggccaaaagtgagttcgcttctgaacaggatggcgaattacaccaacctcacccagggcgcaaaagaacacgaagaagcagaaaacattacagagggtaagaagaagcctactaagacaatgttgacggctataagcatgagcgctatcgccaccaatggggtggtgcctgcaggaggcagttacttcatgatttcaagagccctgggaccggaattcggcggtgcagttggattgtgcttttacctaggaaccacatttgcagctgccatgtacattttgggggctatagaaatctttctggtctacatcgtgccaagggcagcaatattccactccgacgacgcccttaaggaaagcgccgcaatgttgaataatatgcgagtttacggcacagcgttcctggtcctcatggtgttggtggtgttcatcggtgttcgatatgttaataagtttgcatccctgtttctcgcatgtgtcattgtatctattctggcaatctatgcgggtgccatcaaatctagctttgcgccaccacacttcccggtctgcatgctggggaatagaactcttagttccaggcacattgacgtctgctctaaaacaaaagagattaataacatgacagtgccatcaaagctctggggattcttctgtaattcatcacagttcttcaatgctacttgtgatgagtattttgtgcataacaacgtaaccagtattcaagggataccaggactggctagcggcatcatcacagagaacctgtggtccaattacctgccaaagggagagatcatcgagaagcctagcgctaagtcatccgacgtccttggaagcctgaatcacgaatatgttcttgtggatattacaacgagtttcacccttcttgtggggattttctttcccagtgtgacaggtattatggccggttcaaacagatccggagacctcaaggacgcacaaaaatcgatacccatcggcactatattggccattttgacgacaagcttcgtttacctcagcaatgtagtgttgtttggcgcttgcatcgaaggagttgtgctccgcgataagtttggcgatgcggtgaaaggtaatttggttgtggggacccttagctggccatctccctgggtgatcgtgatcggtagcttcttttccacgtgcggggcaggtctgcagtccctcacaggagcccctagactgctgcaggccattgcgaaagataatattattccttttctcagggtgttcgggcacagcaaggccaacggggaaccaacatgggcgctgctgctgaccgccgcaatcgccgaactgggcattcttattgcaagcctggatctggttgccccaatactgtcgatgttctttctcatgtgctatctctttgttaatctagcatgcgccttacagacactactaagaactcctaactggcgtcctcggttcagatactaccattgggctctgtccttcatgggcatgtcaatctgcctagccctcatgttcatctcctcctggtactacgcaatcgttgctatggtaatcgccggtatgatctataaatacattgagtatcaaggtgcagagaaagagtggggcgatgggatcagggggctgtcccttagcgcagctagatttgccctgctgcgcttggaagagggccctccacatacaaaaaactggcgaccacagctcttggtcctcctgaagctggacgaagacttgcacgtgaagcatcctcgcctactcaccttcgcatctcaactcaaagcgggtaaaggtctcacgattgtggggagcgttatagtcgggaatttcctcgagaactacggggaagccctcgcagccgagcaaacaatcaagcatttaatggaagcagagaaggtcaaaggcttctgccaactggtggtggctgccaagttgagggaggggatatcccatctgattcagagctgcgggctcggtggaatgaagcataatacagtggtgatgggctggccaaacggatggcgccagagtgaggacgccagggcctggaaaacttttatcgggacggtacgcgtgactacagccgctcacctggctttgcttgtggccaagaacattagtttctttcccagcaatgtagagcagtttagcgagggtaacatcgacgtgtggtggattgtccacgacggcggaatgctgatgctcctcccctttctccttaaacagcacaaggtgtggaggaaatgctccatcaggatctttactgtggctcagttggaggataacagcattcagatgaaaaaagacctggcgacttttttgtatcatctccgaatcgaggcggaagtcgaagtagtggagatgcacgactccgacatctcggcctacacgtatgagagaacactgatgatggagcagcgctcccagatgttgagacacatgcgcctgtcgaagaccgagagggaccgagaggcgcagttagttaaagaccgtaactcaatgctgcggttgacaagtatcggctctgatgaggatgaggaaaccgagacataccaggagaaagtgcatatgacttggaccaaagacaaatacatggccagccgaggacagaaagcgaaaagcatggagggatttcaggacctgctcaacatgaggccagatcaatccaatgtgaggcgcatgcacactgcggttaagctcaacgaggtgatcgttaacaagtctcacgaggcaaagttagtcctgctcaatatgcctggaccgccacggaaccccgaaggggatgagaactacatggagttcctggaagttctaactgaggggctcgagcgagtactgctggtccggggtggcggatctgaggttattaccatctactcctag

SEQ ID NO: 240972 - DNA, 3276 bp, Artificial Sequence
  Description of Artificial Sequence: Synthetic coding sequence
atgagcgaaatgtccggggcaaccacttctctcgcaaccgtcgccttagatcccccaagtgacaggacctctcaccctcaggacgtaatcgaagatctgtcacagaactcaatcacaggggaacatagtcagctgcttgacgacggccacaagaaagcaaggaatgcatatctgaacaactccaattacgaggagggggatgagtactttgataagaaccttgcactgtttgaagaggagatggatacccgcccaaaggtgagttcactcttgaacagaatggccaattatacgaatcttacccagggggctaaggaacatgaggaggcagagaatatcacggaggggaagaagaagcccaccaaaacgccccagatggggaccttcatgggggtctacctgccttgcctccaaaatatattcggagtcatcctatttctgaggcttacatgggtggtggggacagctggggtgcttcaagccttcgcaatcgtgcttatctgttgttgctgcacaatgctgaccgccatatctatgagcgcaatagccactaatggcgtagtaccggcaggaggtagctacttcatgataagcagggcactgggtcccgagttcgggggagctgtaggcctttgcttttatcttggaaccacctttgccgcagccatgtacatccttggagccattgaaatcttcttggtctacatagtcccacgggctgccattttccattctgacgacgcgctgaaggaatctgctgccatgctgaacaatatgcgcgtatacggaactgccttcctggtgcttatggtgttggtggtctttatcggcgtccgctatgtgaataaatttgcctccttattcctggcatgtgtcatagtatcgatccttgccatatacgctggagccataaagtcttccttcgcaccaccacatttccccgtgtgtatgctcggaaaccggacactaagcagtcggcacatcgatgtctgctcaaagacgaaggaaatcaataatatgacagtgccaagtaagctgtggggattcttctgtaacagttcgcagttttttaacgcgacatgcgatgagtattttgtgcataataatgtgacatctattcaggggatacctgggctggcatctgggatcataacagagaatctgtggtccaactatctgccaaagggcgaaattatagagaagccatctgccaagtcaagcgatgtgctgggatcactgaatcatgaatacgtgctcgtggacatcacgactagttttacattactagtcgggattttctttccatcagtcaccgggattatggcaggctccaaccgcagtggagatctaaaggatgcacaaaagagcattccaatcggaaccatattggcaatcctgaccacctcattcgtctacctgtcaaatgtggttcttttcggtgcatgcattgagggtgtggtgctgagagacaaattcggggacgctgttaaagggaatctggttgtcggaacactgagctggccatcaccctgggtgatcgtgattgggtccttcttctctacatgtggggcaggactgcaaagcctgacaggagctccacgcctgctccaagcaatcgcgaaggataatataatacctttcctcagagttttcggacatagcaaggccaacggcgagcccacatgggctctgctcctgactgcggctattgccgagttgggcatactcattgctagcttagaccttgtcgcaccaatcctttcgatgtttttccttatgtgttacctctttgtgaaccttgcgtgtgctctgcagacactgttgcgaacgcctaactggagaccaagatttagatattaccattgggccctgtcgtttatgggcatgtctatctgtctggcgctcatgttcatctcttcatggtactatgccattgttgctatggtgatcgcgggaatgatttacaagtacatcgagtaccagggggctgagaaggagtggggagatggcatacggggactatctctgtccgccgctcgcttcgcgctcttacgccttgaggagggcccaccccacactaaaaattggagacctcagcttctcgtgctgctgaagctagatgaggacttgcacgtgaaacatccgcgactcctaaccttcgcctcacaactgaaagccggaaaggggctgaccatcgtgggttccgttattgtcggaaactttctagagaattacggcgaggctttggcagccgagcaaactataaagcaccttatggaggccgaaaaagtaaaggggttctgtcagctcgtggtggccgctaaacttagggaaggcatcagtcacctcatccagtcgtgtggtctaggcggaatgaagcataacactgtggtcatgggttggccgaatggctggcgacagtcagaggatgcacgggcttggaaaacgtttatcgggaccgtgagggtcacaaccgcagcccacctggccctgctcgtggccaagaacataagtttcttccctagtaacgtggaacagttttctgagggaaatatagacgtgtggtggatcgtgcatgacgggggaatgctgatgctgcttccgttcctattgaaacagcacaaggtgtggagaaagtgcagtatccgaatcttcacagttgcgcagctggaagataattcaattcaaatgaagaaggacttagcgacgttcctgtaccacctgcggattgaggctgaggtcgaggtcgttgaaatgcacgacagcgatatcagcgcatacacatacgaacgtacccttatgatggaacagaggagccaaatgctgagacacatgcgcttatcaaaaaccgaacgggaccgggaggctcagctggttaaggaccggaattctatgcttagattaacttccataggcagcgacgaggacgaggaaactgaaacataccaggaaaaggtgcatatgacatggaccaaggataaatacatggctagtcggggacagaaggctaaatccatggaaggattccaggatcttttaaacatgcgcccagatcagtctaatgtccgtagaatgcatacagcagtaaaattaaacgaagtcattgtgaataaatcacatgaggctaaacttgttttattgaatatgcctgggccaccacgcaaccccgagggggacgagaattatatggagtttctggaggtgctcactgaggggctggagcgggtacttctggtcaggggtggcggatccgaggttatcactatttactcttag

SEQ ID NO: 240973 - DNA, 3426 bp, Artificial Sequence
  Description of Artificial Sequence: Synthetic coding sequence
atggcctccgttaggtttatggtgacccccacgaagatagacgatataccaggcctgagcgacacttcccccgatctttcaagtagaagttcatccagagtgcgtttttcctcacgggaatccgtgcctgaaacgtctaggagcgaaccaatgtctgagatgagtggagccactacgagtctggcaactgtggccctcgatccccctagtgaccgaaccagccatccacaagatgtcatcgaggacctcagccagaacagcatcaccggcgagcattctcagctgctggatgatggacataagaaggccaggaatgcttatctgaataacagtaattacgaggaaggcgatgagtatttcgacaagaacttagctctctttgaggaagaaatggacacacggccaaaggtgtcatctctcctgaacagaatggccaactatacgaatcttacacagggcgcaaaggagcatgaggaggcggagaatattacggagggtaagaaaaaaccgaccaagactcctcagatgggcacgttcatgggcgtctaccttccatgcctgcagaacattttcggagttattctctttttgcgactgacctgggttgtgggtacggcaggcgtcctccaggcgttcgcaattgtgttgatctgctgctgctgcaccatgctaacagccattagcatgtctgccattgccaccaatggggtagttcccgctggtgggagctattttatgatcagccgggctttggggccagagttcgggggagccgtgggtttgtgcttctaccttgggaccacttttgccgctgctatgtacattttgggtgcgatcgagatcttcctggtttacattgtgccgagggcagcaattttccactccgatgacgcattaaaggagtctgccgctatgctgaacaacatgagagtgtatggcacagcttttttagtgttgatggtgctagtcgtgttcatcggcgtcagatatgtgaacaagtttgctagcctgttcctagcgtgcgtgatcgtgagcattttggcaatctacgccggtgctataaagagtagctttgcccctccgcattttcctgtgtgcatgctgggcaacaggacgctgtcttcgagacacatcgatgtgtgctccaagacaaaggagattaataatatgacggttccctcaaaactgtggggctttttctgtaattccagccagtttttcaatgccacgtgcgacgagtacttcgtgcacaacaacgttacaagtattcagggtatacctggattggcatcaggtatcatcacagaaaatttatggagcaactatctcccgaaaggagaaattattgagaaaccttcagcaaagtcatccgacgtgctgggatcacttaatcatgagtacgttctggtggatattacaacatctttcaccctgcttgtcggtatatttttcccgtctgtgacagggatcatggcgggatccaacaggtctggtgatttgaaggacgctcagaagagtataccaatcggcacaatcctggcgatcctgaccacgtcatttgtgtatctgtctaatgtggttctgttcggggcttgtattgaaggtgtggtgctgagagacaaatttggcgacgcagtcaaaggcaatctggtagtcggaaccctctcatggccatctccctgggtgattgtaatcggatcattcttctccacatgtggtgcaggcctgcagagcttgacaggagcacctaggttgctccaggccattgcaaaagacaatatcatcccatttctgcgcgtgtttggacattcaaaagctaatggggagcccacttgggctctgttattaaccgccgcaatcgctgagctgggaatcctgatcgcgtcgctggacctggtggccccaatcctgtccatgttttttcttatgtgttacctctttgttaatcttgcgtgcgcgttgcagacattgcttcggacccctaactggcgcccaaggttcaggtattatcattgggctctttccttcatgggcatgagcatctgcttagcgcttatgttcatttccagctggtattacgcaatcgtggccatggtgatcgccggaatgatatacaagtacattgaataccagggagcagaaaaagaatggggcgatggcattcgaggcctgtctctgtctgcagccaggttcgcactgctgcgactggaggaaggacctccacacaccaagaattggcggcctcagctgctggtgctgctaaaactggacgaggacctgcatgtgaagcacccacgtctgttgacatttgcctcccagctgaaggcgggtaagggcctgaccatcgttggctccgtgattgtgggcaactttctggaaaactacggtgaggccctggctgccgagcagaccatcaagcatcttatggaagcagagaaagttaaagggttctgccagctggtggtggcggctaaactgagagagggcatttcccatcttatccagagctgcggtttaggaggtatgaaacacaataccgtcgtcatggggtggccaaatgggtggaggcagtccgaggacgcaagggcttggaagacatttatcgggacggtgcgagtgacaacagctgcacacttagctttactcgtggctaagaacatctctttctttccatcaaatgtagaacaattctccgagggaaacatcgacgtgtggtggattgtccacgacgggggaatgctgatgttattgccctttctccttaaacaacataaagtgtggagaaaatgtagtattcgcatttttaccgtggctcaactcgaagacaattccatccagatgaagaaagacctggccacgttcctataccacttaagaatagaggctgaggttgaggtggtggagatgcacgactcagacattagtgcatatacatatgagcggaccttgatgatggaacagcgctcacaaatgctgcgccatatgcggcttagcaagaccgagagagatcgagaggcacagttggtgaaagatcggaacagtatgttacgcctcacatcaatcggctcagatgaagatgaggaaaccgagacatatcaagagaaggttcatatgacctggacaaaggacaagtatatggcctctcgcggacagaaagcgaagagcatggagggcttccaggacctcctcaacatgcgaccagaccagtcgaatgtgcgcagaatgcacacagcagtcaaactcaatgaggtgatagtaaataaaagtcatgaagccaagcttgtgctgttaaatatgcccggacctccaaggaaccctgaaggcgatgagaattacatggagttcctggaggttctgaccgaaggccttgagagggtcttgctcgtgagggggggtggttccgaggtgataactatatattcctag

SEQ ID NO: 240974 - DNA, 3453 bp, Artificial Sequence
  Description of Artificial Sequence: Synthetic coding sequence
atgcaccctcccgaaacgacaacaaagatggcgagcgtccggttcatggttacgcccaccaagatcgacgacattcctggcctgtccgatacctcacccgatctgagctcacggagctctagtcgcgtccgattcagtagtcgagagtctgttccagagacaagccgctctgagccaatgtcagagatgtcaggggctaccacaagcctggccaccgtcgctctcgaccccccttctgaccggacttctcaccctcaagatgttatcgaggacctcagtcagaatagtataacaggagagcactctcagttattggacgacgggcataagaaagcaagaaacgcttacctgaacaactctaattatgaggagggggatgagtatttcgacaagaacttggccctatttgaggaggagatggacacccgacccaaagtgtcgtccctactcaataggatggcaaactacaccaacctgactcagggggctaaggagcatgaggaagcagaaaatatcaccgaaggcaagaagaaacctactaagactccgcagatgggaacgttcatgggagtgtacctcccctgcctccagaatatattcggggtgatcttgttcctgagactgacatgggtggtgggcacagctggcgtcctgcaggcctttgctatcgtcctgatctgctgctgttgtacgatgcttaccgcgataagcatgtccgccattgctaccaatggggtcgtgccagctgggggaagctactttatgatttccagagcacttggccctgagtttggaggcgctgtaggtttgtgcttttacctgggaacaaccttcgcggctgccatgtacatcctgggtgccatcgagattttcttagtgtatatcgtgcccagagccgctatttttcacagcgacgacgcattgaaagagagtgcagctatgcttaataatatgagagtgtacggcactgccttccttgttttgatggtgctggtggtctttattggcgtgaggtatgtgaacaagtttgctagtctcttcctcgcctgtgtaattgtgtccatcctcgccatttacgctggtgcaatcaagtcttcctttgcaccaccccacttcccagtatgtatgctgggtaatagaacgttgtcctcccgacacatcgatgtttgctccaagaccaaggagatcaacaacatgacagtccctagcaagttgtggggattcttttgcaattccagccaatttttcaatgctacctgcgacgagtacttcgttcacaacaatgttacctcgatccaggggatcccaggactggcgagtggaataatcaccgaaaatctctggtctaattacctgcctaaaggcgagatcatcgagaaaccatctgcaaaatccagcgacgtcctgggttcccttaaccatgaatatgttttagtggatatcaccacttctttcactctcctcgttggaattttctttccctcagtgaccggcattatggccggatccaaccgatcaggggatttgaaggatgctcaaaagtccattccgatcgggaccatcctggctatccttactacctcttttgtttacttatccaacgtcgttttgttcggggcatgcattgagggagtggtgctgcgagataaattcggcgatgccgtgaaaggtaatcttgtcgtggggactcttagttggcctagcccatgggtgattgtgattgggagcttcttctccacgtgcggtgccggactccagtcactcactggcgctcctagactgctccaagcgatagcaaaggacaatatcatcccatttctgcgcgttttcggccattccaaagccaatggagaaccaacatgggcacttctactgacagccgctattgcagaactcggtatcttgattgccagcctcgaccttgtggctcctatactgtccatgttcttcctgatgtgctacctctttgtcaatctggcatgcgcactacagacactgctgagaacccctaactggcgacccagatttaggtactatcattgggcactcagtttcatggggatgtcgatttgcctggccctgatgttcatctccagctggtattacgccattgttgctatggtgatcgcagggatgatttacaagtacattgagtaccaaggcgctgagaaggaatggggcgatggcatccgcggactttctctaagtgccgcaaggtttgcgctccttcggctggaggaaggaccgccacacacaaaaaattggcgtccgcagttgctcgtgctcctgaagctagacgaggacctgcatgttaaacaccccagattgctcacatttgccagccagctgaaagccggaaagggcctcacaatcgtgggatccgtgatcgtcgggaatttcttagaaaactacggagaggctctggcagccgagcagaccattaagcacttaatggaggctgaaaaggtcaagggattttgtcagctagtggtcgctgctaagctcagggaaggaatatcacatctcattcagtcttgtggcttgggaggtatgaagcacaacaccgtagtgatgggttggccaaatgggtggagacagagcgaggatgcaagggcttggaagacttttatcggcactgttagagttaccactgctgcgcatctggccttgctggttgccaaaaatatcagcttcttcccgtccaacgtggaacaatttagcgaagggaatatagacgtatggtggatagtgcatgacggaggcatgttaatgcttttaccattcctgctgaagcaacacaaagtttggaggaaatgtagcattcgcattttcacggtggctcaactggaggataactctatccagatgaaaaaagacttggccaccttcctgtaccatctccggattgaggccgaggtggaggtggtcgaaatgcacgacagtgacatatctgcatatacctacgagaggactttaatgatggagcaacggagtcagatgttgaggcacatgcggctatccaaaacagagagagacagggaggctcagctggttaaagataggaacagcatgctccggctgacctccattgggtccgacgaagatgaggaaaccgagacctaccaggagaaggtgcatatgacgtggacaaaggataagtacatggcatctagaggccagaaggctaagtctatggaggggttccaagatctattaaacatgcgccctgatcagagcaacgtccggaggatgcacacagccgtcaaattgaatgaagttatcgtcaacaagagccatgaggctaaactggtacttctgaacatgcccggaccaccacgcaaccccgagggggatgaaaattatatggaatttctagaggtcctgaccgaagggctggaacgcgtgctgctggtccgcggaggtggatctgaagtgatcacaatctactcctag

SEQ ID NO: 240975 - DNA, 186 bp, Artificial Sequence
  Description of Artificial Sequence: Synthetic coding sequence
atgagtgagatgtccggggctacgacaagcttagcgacagtggccttggatccacctagcgatagaacctcccatcctcaggatgtcattgaagacctatcgcaaaatagcataaccggagaacactcccagttgctcgatgatgggcacaagaaagcaagaaatgcttacctgaataactcctag

SEQ ID NO: 240976 - DNA, 2889 bp, Artificial Sequence
  Description of Artificial Sequence: Synthetic coding sequence
atggatactcgacctaaggtatcctccctactgaacaggatggctaattataccaatctgacccaaggcgcaaaggagcacgaagaggccgaaaacattacagagggaaaaaagaagccgaccaaaaccatgttgactgcaatctcaatgagtgctatcgctacaaatggcgtcgtcccagcaggagggtcttactttatgatcagtcgcgctctgggaccagagtttggtggcgcagtcgggctgtgtttctacctgggcaccacgttcgcggcagctatgtatattttgggagccatagaaatatttctcgtctacatcgtcccaagagctgctattttccactccgatgacgccctgaaagaaagtgccgcaatgctgaacaacatgcgcgtgtatggaactgcatttctggtgcttatggtcttagtagtctttatcggagtgcgatatgttaacaagttcgctagcctgtttctggcttgtgtaatagtgtcaattctggctatctacgctggcgctattaagagcagtttcgctccaccccattttccagtttgcatgctggggaatcgcactctcagcagtcgccacatcgacgtctgcagcaaaaccaaagagattaataacatgacagtgccctctaagctctggggatttttctgcaattcttctcagttcttcaatgccacttgcgatgaatatttcgtacacaacaatgttacgtctattcaggggattcctggcctggccagtggcatcattactgaaaacttatggtctaattacttacccaagggagagataatagagaaaccctccgccaagtcctcagacgtccttggttcgctcaaccacgagtacgtattagttgatatcaccacatccttcaccctcctggtaggaattttcttcccaagtgtgacgggtatcatggcagggagcaaccggagcggtgacttgaaggatgctcagaagtcgatccccataggaactatcttagccatcctgactacgagctttgtgtatctttcgaatgtcgtcctcttcggagcgtgtatcgaaggtgtggtcctacgggacaaattcggcgacgcggtcaagggaaacctggtggtgggcacactcagttggccttcaccttgggttattgtcataggttcctttttcagcacctgcggcgctggactccagtccttgacaggagctcctcgactattgcaggctattgcgaaagacaatatcattccgtttcttcgggtgtttggtcatagtaaggccaatggtgagcctacttgggcactcctcctcacagctgccatagctgagctgggcatattaatcgccagcttagatttggttgctccaatcctcagtatgttctttcttatgtgctacctgttcgtcaacttagcctgcgcgcttcagaccctgctgaggactccaaactggcggcctagatttcgctattatcactgggctttgagcttcatgggcatgagcatttgcttggccctgatgtttatctcgagctggtattacgccattgtggctatggttatagcaggtatgatttataagtacatcgagtatcaaggtgctgagaaggagtggggagacggtatcagaggcctctccctgtcggcggctcggttcgcactgctgcgcttggaggagggccctccccataccaaaaactggagaccacagcttctggtcctgcttaagcttgacgaagatctacacgtgaagcatcccaggctgttgacgtttgcttcccagctcaaagccggaaagggtttgaccatagtgggctcagtaattgtagggaacttcctagagaactacggcgaggcgctagctgccgagcagactatcaagcacttgatggaggcggaaaaagtaaaaggcttctgccagctcgtcgttgccgctaagctcagggaagggattagccatctaatacaatcctgtggccttggaggaatgaagcacaacacggttgtgatgggttggcctaacggatggagacagagcgaagatgcaagagcctggaaaacctttatagggacagtgagagttactacagcggctcacctagctctgctagtggccaagaacatctcattctttcctagtaatgtagagcagttttcagaaggaaatatcgacgtttggtggatagtgcacgatggcggaatgctaatgctcctgccattcctgctcaaacagcataaggtgtggagaaagtgtagcatcaggatttttacagtggcacagcttgaagataattcaatccagatgaagaaggatctggcaacatttctgtatcatttacggatcgaggctgaggtcgaagtggtggagatgcacgattcagacatctccgcatacacttacgaaagaacgttgatgatggagcagagatctcagatgttgagacatatgcgacttagcaaaaccgaacgggacagagaggcccagttggtcaaagacaggaacagcatgctccggctcactagcatcggcagtgatgaggatgaagagaccgagacctaccaggaaaaggtgcatatgacctggactaaggacaagtacatggctagtcgtggacagaaagctaaatccatggaaggatttcaggacctgcttaatatgaggcccgaccagtccaatgttagaagaatgcacactgcggtgaagctgaacgaagtcattgtgaacaagtcacacgaagccaagctggtgctgctcaacatgcctggtccgcctagaaatcctgagggggacgagaattacatggaattcctcgaagtgttaacagagggtctggaacgggtgttgcttgtgaggggcggaggcagcgaggttattacgatctattcctag

SEQ ID NO: 240977 - DNA, 3453 bp, Artificial Sequence
  Description of Artificial Sequence: Synthetic coding sequence
atgcacccacctgagacgacaacaaaaatggcctctgtgcgctttatggtcacacctaccaaaatagacgacattcccggtctatcagacacatcccctgatttaagtagccggtcatcatctcgagttcgcttctcctcgcgagaatcggtgcccgaaacctctcgctctgagcctatgtccgagatgtccggcgctaccacaagccttgccacagttgccttggatccccctagcgaccgcacatcccatccacaggatgtaattgaggatttatctcaaaattccataacaggcgagcattcgcagcttctggacgacggccataagaaagcccgaaacgcatacctgaataattccaattacgaagaaggagatgaatactttgataaaaacctggctctgtttgaagaggaaatggataccagacccaaggtcagcagccttctgaaccgaatggccaattacacaaatcttactcagggtgcgaaagaacatgaggaggcagagaatattaccgaagggaagaagaagcccacgaagactccacagatggggactttcatgggcgtatatcttccttgcctgcagaatatcttcggcgtgattctcttcctaagactcacatgggtggttggcaccgccggagtgctacaggcttttgctatcgtgctgatttgttgctgttgcaccatgctcacagcaatctccatgtccgcaatagcaactaacggtgtggtgccggcagggggaagctatttcatgattagcagggcattgggtcctgagtttggtggcgctgtaggcctgtgcttttatttgggcactaccttcgcagccgctatgtacatactgggcgctatagaaatctttctcgtgtacatcgtgcctcgcgctgccatatttcattcagacgacgcactaaaagaatccgccgctatgctgaataacatgcgcgtgtacgggacagcgttcttggtgctgatggttcttgtagtgttcatcggagttcgatatgttaacaaatttgcctctctgtttcttgcatgtgttatcgtgtcgatcctggctatatatgccggtgccatcaagtcttcattcgcgcctccacattttcctgtgtgtatgctagggaatagaaccctgagcagccgccacattgatgtctgtagcaagactaaagaaatcaacaacatgactgtcccctccaaactgtggggctttttttgcaacagctctcagttcttcaacgccacgtgtgatgagtacttcgttcacaataacgtaacaagcattcagggcataccagggctggccagtgggataatcacggagaatttgtggagtaattacctgccaaaaggagagatcattgaaaaaccctccgcaaaatctagcgacgtattgggttccctgaatcatgagtacgtgctcgtggacatcacgacttcgttcaccttgctcgtagggatcttctttccatcagttacgggaatcatggctggtagcaaccgatctggtgacctcaaagacgcacagaaatccattcctattggtaccattctcgctatcctcactaccagcttcgtatatctttcaaatgtagtgttgtttggcgcatgcattgagggtgtggttttacgcgacaaattcggagatgctgtcaagggcaacttagtggttgggacactgtcctggccatctccttgggtgatcgtgatcggcagctttttctccacttgtggcgctgggctgcagagcctcacaggcgctccacggttgctgcaagctattgccaaggacaacattatccctttcttgagggtgtttggacactctaaagccaacggcgagcctacttgggccctgttgctcacggccgctattgccgaactgggcattcttatcgcgtccctagaccttgtggcgccaattctttccatgttctttctgatgtgttacttattcgttaacttggcttgcgcacttcagacactcttgcggaccccaaactggagacccagattccggtattaccactgggctttgagctttatgggcatgtctatctgcctggctctcatgttcatctcatcctggtactatgcgatagttgcgatggtaatagccggtatgatttacaaatacattgagtatcagggtgcagagaaggagtggggcgatggaatcaggggcttgagcttgtctgcggctcgtttcgcccttctgcggctggaggagggcccaccccacaccaaaaattggagaccacagcttttggtgctgctcaaattggacgaggatctccatgtgaaacatcctagactgctgacatttgcgtcccaactcaaagcaggcaaaggtctgacgattgttgggtccgtgatcgtcgggaacttcctcgagaattacggcgaggcattagctgccgagcagacaataaagcatctcatggaagctgagaaagtgaagggcttctgtcagttagtggtcgcagcaaagctgagagagggcatcagccacctgattcagtcatgcggcctaggcggaatgaagcataatactgtagtaatgggctggcccaacggatggagacaatccgaagacgccagggcatggaagactttcatcggcacagtccgtgtcacaacggcagcgcatttagcacttctcgtggccaagaacatctcgtttttccccagcaacgtagaacagttctctgagggtaatatcgatgtctggtggatcgttcatgacggtggcatgctgatgcttttgccgttcctcctgaaacaacacaaagtgtggcgtaagtgcagcattaggatctttaccgtcgcccaactggaagacaatagcatccagatgaagaaagatctggccacctttctgtaccacctccgcatcgaggcagaggtagaagtcgtagaaatgcacgatagtgacatttcagcgtacacctacgagcggacgctaatgatggagcagaggagccagatgttgcgccatatgcgactgtccaagacggagagagacagggaggctcagttagtgaaagatcggaattccatgcttcgactgacaagcatcggaagcgacgaagacgaagagactgagacctaccaggagaaagtgcacatgacctggactaaggacaaatatatggcctctcgcggacagaaagcaaaaagcatggaaggctttcaggatctgttgaacatgcgccctgatcagagcaatgtccgcagaatgcatactgcggtcaagcttaacgaagttatagtaaacaagagccatgaagccaagttagtactgttgaacatgcctgggcctccccgtaatcccgagggtgacgagaactacatggagttcctggaggtgctgactgagggcctggaaagagtcctgctggtgcgtggaggcggttccgaagttatcacgatatattcctag

SEQ ID NO: 240978 - DNA, 459 bp, Artificial Sequence
  Description of Artificial Sequence: Synthetic coding sequence
atggcgtcagtgcggtttatggttactccaaccaagatcgacgacattccgggactgagcgacaccagtccagatctgtcctcaaggagctcgtctcgggtgcgtttttcatctcgcgaaagcgtcccagagacatctagaagcgaacccatgagcgaaatgtccggcgctacaacaagtcttgctaccgtcgcactcgaccctccctctgaccgaacatcccatccccaagacgttattgaagatttaagccagaatagcatcaccggcgagcacagccagctcctggatgacggacataaaaaggccaggaatgcttatttaaacaattccaactacgaagagggcgacgaatacttcgacaagaacctcgcactgttcgaagaggagatggacacccgccctaaggtcagctcactgctcaatagaatggctaattatacaaatttgactcagtag

SEQ ID NO: 240979 - DNA, 3252 bp, Artificial Sequence
  Description of Artificial Sequence: Synthetic coding sequence
atgccaaccaatttcaccgtggtaccggtggaggctcacgcagatggtggtggtgatgagactgcggagcgaaccgaggcccctgggacaccagaaggccctgagccggaaagaccaagccctggagacgggaacccaagagaaaattcccccttccttaacaatgtagaggtggaacaggaatccttttttgaaggaaagaatatggcactgtttgaagaggaaatggattctaaccccatggtatctagtttgcttaacaagcttgcgaactacacaaatttgagccaaggcgtggtggagcatgaagaggatgaggagtcacgcaggagggaggcgaaagcccctaggatgggcacctttattggtgtgtacttgccctgcttgcagaatatcctgggagttatcttgtttctacgcttgacttggattgtcggagtggccggagtgttggagagtttcttgatcgtagctatgtgctgtacatgcaccatgctgacagcaattagcatgtccgcaatcgctaccaatggagtagtacccgctggcggatcttattacatgatcagcaggtcactgggtccagaatttgggggagccgttgggctgtgtttttacctggggacaaccttcgcgggagcaatgtatatcttgggtaccatagagatatttttaacctatatctctccaggtgctgcaatcttccaagctgaggccgctggaggagaggccgcagccatgctccacaatatgcgcgtttatggcacatgtacactggtgctaatggccctggttgtattcgtgggcgtgaaatatgtgaacaagctcgcccttgtgtttcttgcttgtgtggtcctaagcattctggctatctacgctggcgttatcaaaagtgcattcgacccccctgacattcccgtatgtctcttgggcaacagaaccctgtcacggcgatccttcgacgcctgtgtgaaggcctacggtattcacaataatagcgctacttccgccctttggggacttttctgcaacggatctcagcctagtgccgcatgcgacgagtacttcatccagaataatgtgacggaaatccaaggcattcccggagccgcatcaggggtctttttggaaaacctgtggagcacttacgcacacgccggagcatttgtggagaagaagggcgtcccatcagtgcccgtcgcggaagaaagtcgggctagcgccctgccatatgtgctgactgacatagctgcgagcttcaccttacttgttgggatctacttccctagtgtcacaggcattatggccggtagcaaccgctctggcgacctgaaggacgctcaaaagagcatacccaccggtacaatcctcgcaatagttactacatcatttatttacctgagctgtattgtccttttcggcgcttgcatcgaaggcgtggtcctgcgggacaagttcggggaggccttacaaggcaatttggtaattggcatgctggcttggccatctccttgggtgatcgtgatcgggagttttttctctacctgtggcgctggccttcagtctctgacaggtgcccctcgcctgttacaggccattgccagggacggcatcgttccctttctccaggtttttggccacggaaaagccaacggagaacccacatgggcacttctgcttacagtactgatatgtgagaccggaatcctcatcgcttccttggactctgtcgctccaatactatccatgtttttcctcatgtgctacctcttcgtgaatctggcctgcgctgttcagaccctgctgaggactccgaattggcggcctagatttaaattttaccattggactttatcattcctgggaatgagtctatgccttgcactcatgttcatttgctcttggtactatgcattgtccgccatgctgatcgcaggttgcatctacaaatacatcgaatatcgcggagctgaaaaagagtggggagacggcatccgtggcctatctcttaatgcggctcgatatgctttgctgcgggtagaacacggtcccccacacactaaaaattggagacctcaggttcttgtaatgttgaacctggacgctgaacaggctgttaagcatccccgtctgctgtctttcacctctcaattaaaggctggcaaaggactgacaatcgtgggatccgtgctggaaggcacctatttagataagcatatggaggctcagcgcgcagaggaaaacatcaggtctcttatgtcaacagaaaagacgaagggattttgccagctggtggtgtcctcttccctaagagacggtatgtcgcatcttatccaatccgcaggactgggcggattgaagcataatactgtactcatggcatggcctgcctcttggaaacaggaagacaatccgttttcgtggaagaattttgtggacaccgtacgagacactactgcagctcaccaggcgttattagttgcaaagaatgtggattcttttccccagaaccaagagagatttgggggaggccacatcgatgtgtggtggattgtgcacgatggaggcatgctcatgctgttgccgtttctgctccggcagcataaggtttggcgcaagtgcagaatgcggatcttcactgtggcccaggtcgatgacaattcaatccagatgaaaaaggatctccagatgtttctttaccacctgcggattagtgcggaggtagaagttgtggagatggtcgagaatgatatatctgcatttacatacgagcgaactctgatgatggaacaaagatcacagatgctgaaacaaatgcagctgtccaaaaacgagcaggagagagaggctcagttaatacatgacagaaataccgccagccatacagccgcagccgctagaacccaggccccacccactcctgataaggtgcagatgacgtggacaagagagaaacttatcgcagaaaagtaccgtagccgcgacaccagcctgtctggctttaaggacttgtttagtatgaagcctgaccagtccaatgttcgtcgaatgcacaccgccgtgaagctgaatggcgtcgtcctgaataagtcccaagatgcacaactggtcctgctgaatatgcccggtccccctaaaaacaggcagggtgacgagaactacatggaattcctggaggttttaactgaaggactgaacagggtcttgcttgtcaggggtggcggaagggaggtcataactatctacagttag

SEQ ID NO: 240980 - DNA, 801 bp, Artificial Sequence
  Description of Artificial Sequence: Synthetic coding sequence
atgcccaccaatttcactgtggttccagttgaggctcacgccgacggtgggggagatgagaccgctgagcggaccgaggcaccaggtaccccagaaggaccggagcctgaacgacctagccccggagacggcaatccgcgtgagaactctcctttcctcaataatgttgaagtcgaacaggagtcctttttcgaggggaagaatatggcactgttcgaggaagaaatggacagtaatccaatggtaagcagcttattaaacaaactggcgaactacactaatctcagccagggcgtcgtggaacatgaagaggatgaagaatcacgtagaagagaggcaaaagcaccccgaatgggcacttttatcggtgtttatctcccgtgtctccaaaatattctgggggtgatattatttttacgacttacatggatcgtaggagtcgccggtgttcttgaatcctttctgatcgtcgccatgtgttgcacctgcacgatgcttactgccatcagtatgagcgccatcgctacgaatggcgtggtccctgcaggcggatcatactacatgattagcagaagcctcggaccagagttcggcggtgccgtgggactgtgtttttatttagggaccacttttgctggagccatgtacattctcggaactattgagatcttcttaaccggcaccgaagacggagttggtagcctgggcctagggctggcgcagggcaataggcggcagacacatctttctcccagtgacgcggcacaggccgctcacggtgccagctatggttccttctag

SEQ ID NO: 240981 - DNA, 3066 bp, Artificial Sequence
  Description of Artificial Sequence: Synthetic coding sequence
atggcagaactccccaccactgagacacctggcgacgccaccctttgtagcggaaggtttacaatcagtaccctgttaagctccgatgaacccagcccccctgccgcatatgacagctcgcatccttcccacctgacccactccagcacattctgcatgcgcacatttgggtacaacacgatcgacgtcgtgcccacatatgagcactatgctaactccacacagccaggcgagcctcgtaaagtgaggcccactctggccgatctacatagcttcctgaagcaagagggtaggcacctgcacgccttggcatttgactcccggccttcccacgagatgacggatgggctggtggagggtgaggccggaacatcatcggagaagaaccctgaggagcccgttcggttcggatgggttaaaggcgtgatgatccgttgcatgttgaacatttggggtgtgatcctctacctgcggctgccctggatcaccgctcaagctggaatagtcctgacgtggatcattatccttcttagtgtcactgtgaccagcataaccggtctcagtatttcagctatttctactaatggaaaagtcaagtccggcggaacgtactttctcatctcacgcagcctgggaccagagctcggaggatctatcggactgatctttgccttcgctaacgctgtgggggtggctatgcatacagtaggatttgccgagaccgtgcgagaccttcttcaagagtacggtgctcccatcgtggatcctataaacgacatccgcatcatcgccgttgtgtctgtgaccgtgcttctcgcaatcagtctggccggtatggaatgggaaagcaaagcccaggtccttttctttctcgtgataatggtgtcatttgctaattatctagtgggcacactgatcccaccatccgaagacaaagcatcaaagggatttttttcctacagggccgatattttcgtgcaaaatctggtgcctgactggaggggacctgacggcactttcttcgggatgttttccatttttttcccttctgccacgggtatcctagctggcgctaacatctccggtgacctgaaagatcccgctatcgctatacctaagggaactctcatggctattttttggacaacaataagttatttagccatttcagccactatcggctcctgtgtggtgcgcgatgcctcaggtgttctcaacgacacagttaccccgggttggggagcatgtgaggggctggcgtgttcctacggctggaattttaccgaatgcacacaacagcattcctgtcattacgggctcatcaactattaccaaacaatgtcaatggtgtctgggtttgcacctctgatcactgcaggaattttcggcgctactctgagttccgccttagcctgcctcgtgagcgccgcaaaagttttccagtgcttatgtgaggatcagctgtatccattgataggtttctttggcaaggggtacggcaagaataaggagcccgtgagaggctacctcctcgcgtacgctatcgccgttgccttcatcataatcgcggagctcaacacaatcgctccgatcatttcaaacttttttctttgttcttatgcactgatcaacttctcttgttttcacgcctcaatcaccaactcgcccggttggcggccatctttccagtactataacaagtgggccgcactattcggggctattatctctgttgtgatcatgtttctgctcacctggtgggcagcgctgatcgcaatcggcgtagtgcttttcctgctgctctacgtcatctataagaagcccgaggtaaattggggaagtagtgtccaagccggtagctacaatctggcactgagctatagtgtggggcttaatgaggtcgaagaccacattaaaaattatcgtccccagtgtctcgttcttacaggaccccctaactttcgaccggcactggtggatttcgtcgggacattcacacggaatctatccctcatgatctgcggccatgtgctcattgggccacataaacaacgcatgcccgagctacagctgatagccaacgggcacacaaaatggctgaataaacggaagataaaagctttctatagcgatgtcattgccgaggatctcaggaggggggtacagatccttatgcaagccgctggtctgggaaggatgaagcctaacatcctggttgtgggatttaaaaaaaattggcagtcggcgcatccagccaccgtggaggactatattggcatcctgcacgacgcttttgattttaactacggcgtgtgtgtcatgcgtatgagagaggggctgaatgtgtctaaaatgatgcaggctcacatcaaccctgtcttcgaccccgcagaggacggtaaggaggcctcggcccgtgtcgatcctaaggcactcgtgaaggaggagcaggcgacaactatttttcagtccgagcaagggaagaaaacaattgacatttactggctgttcgatgatgggggactaaccctgttgatcccatatcttctggggcgaaagcgcagatggagcaagtgcaagatacgagtgtttgttggcggacagatcaacaggatggaccaagaacgaaaagctatcatctccctgctgtccaagttcaggctgggatttcacgaggtacatattcttcccgatatcaaccagaatccgagggctgagcacactaagagattcgaagatatgattgcgcctttcagactgaacgacggattcaaagacgaagcaacagtgaatgagatgcgacgcgattgtccttggaaaattagcgacgaggaaataaccaaaaacagagttaagtctcttcggcaagtaaggctcaacgagattgttctggattactctcgggatgctgccttgatcgtcatcactctgccaatcgggcgaaaaggcaagtgcccaagcagcctgtacatggcttggctcgagaccttaagccaggatttgagaccgcctgtcatcctgattcgcggtaatcaagagaatgtgctgacattctattgtcagtag

SEQ ID NO: 240982 - DNA, 3090 bp, Artificial Sequence
  Description of Artificial Sequence: Synthetic coding sequence
atggccgaactgcctactacggagacaccaggtgatgccaccctttgctcgggaagatttacgataagtaccctcttgtcttcagatgaaccatctcctcctgcggcatacgattccagtcacccgtcacacctgacccactccagtacgttttgcatgcgaaccttcggctataatactattgatgtggtccccacatacgagcactacgccaatagcacccagccaggcgagcccagaaaggtgcgcccaaccctcgctgacttgcattcttttctgaaagagggcagacatctgcacgctctcgccttcgattcccgtccttcacatgaaatgactgacggcctagtagaaggcgaagcgggaacgtcatctgagaagaatccggaagagccagtccgattcggctgggtcaagggggtcatgattcggtgtatgctcaacatctggggcgtgatcctctatctgagattaccctggattacggcccaggccggaatcgtgctgacatggatcataatcctcttaagtgtgactgtgacatccataactggactaagcatttccgctatatctacaaacgggaaggtgaaatcaggcggaacctactttttgatcagcaggtccctcggacccgaactggggggttctattggactgatttttgcgttcgctaatgctgtaggagtggctatgcacacagtggggtttgctgagaccgtacgcgacctcttgcaggagtatggcgctcctatcgtcgatcccattaatgacatcaggataatcgccgtggtaagtgtgacagtgctgctggctatctcgctggctggcatggagtgggaaagcaaggcccaggtcctcttctttttggtgatcatggtgtctttcgcaaattacctggtcggtacattaattccgccttccgaggataaggcctctaaaggcttcttctcataccgagccgatatctttgtgcagaatttggtgcccgactggagagggccagacggtacattttttggaatgtttagcatatttttcccttctgccacagggattctggccggagctaatatcagtggcgacctcaaggatcccgctattgccattcccaaaggaacactgatggcaattttttggacaacaatctcgtaccttgctatttcagccaccattggctcatgcgtcgttcgggacgcctccggagtgttaaacgacacagttacccccggttggggggcttgtgaagggcttgcctgttcttatgggtggaattttaccgaatgcacgcagcagcacagttgtcactatgggctgatcaattattaccaaacgatgagcatggtctccggtttcgcacccctcattactgctggcatctttggagctactctgtcatcggcattggcctgcctggtatctgccgctaaggtgttccagtgtctgtgcgaagatcagctgtatcccctgatcggattctttggcaaaggttatggaaagaacaaagagccagtgaggggttacctgttggcttatgcaatcgcagtagctttcatcattatagctgagcttaacacgattgcccctattatcagcaatttctttctgtgctcatacgcgctcataaatttctcatgttttcacgcctcaataaccaatagcccagggtggagacccagttttcagtactacaataaatgggccgctctttttggagccatcatttccgtagtcataatgttccttctcacctggtgggcagccctgatcgccattggagtagtgctctttttgctcctgtacgtcatatataagaaaccggaggtcaactggggtagtagcgtacaggctgggtcgtacaacttagcgctcagctactccgttggactgaatgaggtggaggatcacatcaagaattataggccccagtgcctggtacttaccggacctcccaacttccgcccagctctcgtggacttcgtgggaacgttcacacgaaacctgagtctgatgatctgtggtcacgtgttgattgggcctcataagcaacgcatgcccgaacttcagctgatagcaaatgggcataccaaatggctcaacaagcgtaaaattaaggctttttatagcgatgtcatcgctgaggacttgagaaggggcgtgcagatcctgatgcaggctgctgggcttggcaggatgaagccaaacattttggtggtgggttttaaaaagaactggcagtcagcccaccccgcaacagtggaggactacatcggaattcttcatgatgctttcgacttcaattacggcgtgtgcgtcatgaggatgcgggagggcctgaatgtatcaaagatgatgcaggcccacatcaatcccgtctttgatcccgcagaggatggaaaggaggctagtgctcgcggagctaggccctccgtgtcgggggcattggacccaaaggcactcgtgaaagaagagcaagctaccaccattttccagtcagagcaagggaagaagaccatagacatatactggctgtttgacgatggaggacttaccttgctaattccctacctattagggcgtaaacggaggtggtcaaaatgtaagatacgggtgtttgtggggggtcagatcaataggatggatcaggagcggaaggcgattatatcgctgctctccaagttccgtctgggatttcatgaggttcatattcttcctgatattaaccagaacccaagagccgaacacacaaagcgtttcgaggatatgattgcgccattcaggctgaacgatggttttaaggatgaggcaacagtgaatgagatgaggagagactgcccatggaagatttctgacgaggaaataacaaagaaccgcgtgaaatctctgcggcaggtacgcttaaatgagatagtgcttgattactctcgggacgccgcattaatcgtgatcaccctacccatcggacggaaagggaagtgtccctcctccctgtatatggcatggttggagaccctcagtcaggaccttagaccaccggtaatattgatccgcggtaaccaggagaatgtgctgaccttctattgtcagtag

SEQ ID NO: 240983 - DNA, 3093 bp, Artificial Sequence
  Description of Artificial Sequence: Synthetic coding sequence
atggccgaactcccaaccaccgaaacgccaggggatgcaacactctgttcagggagatttacaatctcaacactgctttctagcgacgagccatcacctccagccgcttacgactcctcccacccgtctcacctcactcattcctctacattctgcatgagaacgttcgggtataacaccatcgatgtagttcctacatatgaacattacgcaaattctactcagcctggagagcctcgcaaggtccgcccaaccttagccgaccttcactcatttctgaagcaggaaggcagacacctgcacgctcttgctttcgatagtaggcctagccacgaaatgaccgacggactagtggagggagaggctggcacgagctcagaaaagaatcctgaagagcccgtacgcttcggatgggtgaagggcgtcatgattcgctgcatgttgaatatctggggcgtaatcctgtacctgcggctgccatggattactgcccaggcaggaatcgtcctgacatggatcataatcctgctgtcagtcaccgtaacttccataacaggtcttagcatcagcgcgatatccacaaacggtaaggtgaagagtggtggcacctattttctaatcagtaggtcgctaggcccagagttggggggttctattggactgattttcgccttcgctaacgccgtgggcgtcgcgatgcacaccgtaggatttgcggaaaccgtccgagatcttctgcaagagtacggagctccaattgtggacccaatcaacgatatccgaattattgcagtcgtcagcgtgacagtcttactcgcgatatctttggcgggtatggagtgggagagcaaggcccaagtgctcttctttctggtgattatggtctcttttgccaactacctcgtcggaacactcatccccccaagcgaagacaaggcctccaaagggtttttttcatacagggcggacattttcgtgcagaatcttgtaccagactggcgcggaccggacgggacattctttggcatgttttctatcttctttccaagcgctacgggcattcttgctggtgccaacatctctggcgatctgaaggatcctgccatagctattccaaaaggcactcttatggctattttctggacgacaatttcgtacctcgccattagtgctaccatcgggtcttgtgtcgtccgtgatgcatctggggtgctcaatgacacggtcacgcctggctggggagcatgcgaagggctggcatgctcttatgggtggaattttacagaatgcacccagcagcattcttgccactatgggctgattaattactaccagacaatgtctatggtgagcgggttcgcgcctttgatcacggccggaatcttcggtgccaccctcagttctgccttggcttgcctggtctccgcagccaaggttttccagtgtctgtgtgaggatcagttgtatcccctcattggcttctttgggaaaggctatggtaaaaacaaggagcccgtcagggggtatctgctcgcttacgctatcgctgtcgccttcataatcatcgccgagttaaataccatcgcgccaatcattagcaatttctttctgtgttcttacgcactgataaatttcagttgctttcatgcctctattactaattcccccggatggcggccatcctttcagtactataataagtgggcagcactttttggggctatcatatcggttgtcatcatgttccttctcacttggtgggcagcactcatcgctatcggagtcgtgctgtttttattgttgtacgttatctacaagaagcctgaggtgaattggggctcttcagtgcaggccggaagttacaacctcgcgctcagctacagcgtggggttaaacgaggtagaggaccatataaagaattacagaccccagtgcctggtgctgactgggccacctaacttcagaccagccttggtggactttgtcgggacatttaccaggaacctctcactgatgatctgtgggcatgtgcttatcggaccccataaacaaagaatgccagagctgcagcttattgccaatggacataccaagtggctgaataaacgtaaaatcaaggccttctattctgatgtcatagcagaggatttgcgtaggggagtccagatcctgatgcaagccgctgggctaggcaggatgaagccaaacattcttgtggtgggcttcaagaagaactggcagtcagcgcatccagcaacagttgaagattatattggcattttgcacgatgcgttcgacttcaattatggagtctgcgtgatgagaatgcgggaaggcctgaatgtgtccaagatgatgcaggcacatattaaccccgtctttgatccggcagaggatgggaaagaagccagcgcccgaggcgctagaccttccgtctctggggctctcgaccccaaagctctggtaaaagaggagcaggctaccactattttccaatccgaacaggggaaaaaaaccatcgatatctactggctgttcgatgacggaggcttaactctcctgataccgtacttattaggcaggaagcggaggtggagcaaatgtaaaatccgggttttcgtcggtggacaaataaatagaatggaccaggagcgaaaagccatcatctctctcttatcgaagtttcggcttggatttcacgaggtgcacattctgcctgatatcaaccagaacccacgggctgaacacaccaaacgattcgaggatatgattgctccctttcggctgaacgacgggttcaaggatgaggccaccgtcaacgaaatgagacgtgattgcccgtggaagatttccgacgaggaaatcacaaagaaccgggtaaagagtcttcgccaggtgagactcaacgagatcgtgctggactatagccgggacgccgcactaattgtgatcactctccctatcggcaggaaaggtaaatgccccagttctctgtacatggcatggctcgagacattgagtcaggatttaaggccaccagtcatactcattaggggtaaccaggaaaatgttttgactttttactgccagtag

SEQ ID NO: 240984 - DNA, 3090 bp, Artificial Sequence
  Description of Artificial Sequence: Synthetic coding sequence
atggccgagttgccaactacagagactcccggtgacgccaccctttgtagtggtaggtttaccatctccacccttttaagtagcgacgagccttctcctccagccgcatatgatagtagccacccgtctcatttaacacactcgtccactttttgcatgcgaacttttggttacaatactatagatgttgtccctacatatgagcactatgctaactctacccagccaggagagccccgaaaggtgcgccctacattggcagacctgcacagctttctgaaggagggtcgccacttgcacgcattagcctttgactccagaccatctcatgaaatgactgacggtctggtcgagggagaagctggcacatcttccgaaaagaatccagaggagcccgtgaggttcggatgggtgaagggagttatgatccggtgcatgctgaatatatggggggtcatcctttacttgagactcccctggatcactgcacaggccggtatcgttctcacgtggatcatcatcctgttgagcgtcactgtcaccagtatcactgggctcagtatttctgccatatcgactaatggcaaagtgaagagcggcggaacgtattttctgatcagtcgatcccttggtccagaacttgggggatctatcggcttgatcttcgcattcgctaatgccgtgggtgttgccatgcatacggttggttttgccgaaacggtaagagatctactgcaggaatacggcgcacccattgtggaccctatcaacgatattcggattatcgccgtcgtctcggtcacagttctgcttgcgatttctctggcagggatggagtgggagtcaaaggcccaggtcctcttcttccttgtaattatggtgtccttcgccaactatctggtgggtaccctcattccaccctctgaggacaaagctagcaaaggctttttctcttaccgcgcagacattttcgtccagaatctcgtcccagattggcgtggtcctgatgggaccttttttgggatgttttccatcttctttcctagcgcaactggcattctcgctggcgctaatatttctggcgacctgaaagatccggctatcgccatccccaaaggtacactgatggcaatattctggacaacaatctcttatctcgctatttctgccaccataggttcgtgcgtagtgagagatgctagtggcgtgttgaatgacacagttacacctggctggggggcatgcgaaggactggcctgctcctacgggtggaacttcaccgaatgcactcagcaacatagttgtcattacggcctgattaattactaccagaccatgagcatggtttccggcttcgccccactgatcaccgcaggaatttttggagccaccttaagctctgccttagcttgtttggtatcagctgcaaaagttttccaatgcttgtgtgaagatcagctatatccccttatcggcttcttcgggaagggatacgggaaaaacaaggaaccggtgcgagggtacctgctcgcctatgctattgcggtggcgttcatcatcatagcagagctgaatacaatcgcaccaatcatttctaacttctttttatgtagctatgccttgatcaacttctcatgtttccatgcctccattaccaatagccctggatggcgcccttcttttcagtattacaataagtgggccgctctgttcggcgctataatctctgtagttatcatgttccttttgacgtggtgggccgctctgatagctattggcgtcgtcttattcctcctcttgtatgtgatctacaaaaagcctgaggtgaattggggatctagcgttcaggctgggtcttataatcttgcactttcttactcagtagggctaaacgaagtggaagaccatatcaagaactacagaccgcaatgtctcgtcctcacaggaccaccaaattttcgcccagctttggtggatttcgtgggcacctttacgagaaacctcagtttgatgatttgcgggcacgtgctgattggtcctcataagcagagaatgcctgaattacagctgatcgctaacgggcatacaaagtggctgaacaaacgcaaaattaaagcgttttactctgacgtgatcgcagaagatttgcggagaggtgttcagattttgatgcaggccgctggccttggccgaatgaaacctaacatcctggttgtgggtttcaagaagaactggcagagcgctcaccctgctactgtcgaggactatatcggaattctccacgacgcgttcgactttaactatggcgtatgcgtaatgagaatgcgcgaagggctcaacgtctccaaaatgatgcaagcgcatataaatcccgtgttcgacccagctgaggacgggaaggaagctagcgcaaggggggctcggccaagtgtgagcggggctctggaccctaaagctcttgttaaggaagagcaggccaccacaatcttccagagtgaacagggtaaaaagactatcgacatctattggctgtttgatgacggcggtcttactctgctgatcccatatctcctgggtcgcaagcgcagatggtccaagtgtaaaattagagtgttcgtcggcggtcagatcaacaggatggatcaggaacggaaggcgataataagtctcctgtctaagttccgcctcggtttccacgaggtgcatatcctgcccgatatcaatcagaacccacgagctgaacacaccaaacggttcgaggatatgatcgccccttttcgtctgaacgacgggttcaaagatgaggccactgtgaatgaaatgagacgggactgtccttggaaaatcagcgacgaggagatcactaaaaatagggtaaaaagcctgagacaggtcagactgaacgaaatcgtcttggactacagccgggacgctgccctgattgtgatcacactcccaatcggtagaaaggggaagtgtccttcttccctgtatatggcttggcttgagacactgtcacaagatctgcgtccgcctgttattctaataagggggaatcaggagaatgtccttaccttttattgtcaatag

SEQ ID NO: 240985 - DNA, 1293 bp, Artificial Sequence
  Description of Artificial Sequence: Synthetic coding sequence
atgagtctgaataactccagcaatgtgttcctggacagcgtaccgagcaacaccaatcggttccaagtctccgtgatcaatgagaaccatgaatcctccgccgcagcagacgacaacacggacccaccacactatgaggagactagttttggggacgaggctcagaaacggcttcgcatttccttccgcccaggaaaccaggaatgctacgacaattttctgcagtctggggaaacagctaagactgatgctagctttcatgcatatgacagccatacgaacacctactatctgcagacttttggccacaatacaatggatgctgtcccaaagattgagtattaccgaaacaccggcagtatctctggacctaaggttaataggccgtcactcctagagatccacgaacagctggctaaaaacgtggcggtgaccccctcctccgccgatcgcgttgccaacggagatggtataccaggtgacgaacaggctgaaaataaggaagatgatcaagctggtgtcgtcaaattcggttgggtcaaaggcgtcctggtaaggtgcatgttaaatatctggggggtcatgctttttatcaggcttagttggattgtcggcgaggctgggatcggcctaggtgttctcatcatattactttccacgatggtgacaagcattacgggcctgagcacctctgctatcgccacaaacggctttgtcaggggcggaggcgcttattacctgattagcagatctttgggacccgaattcggaggtagcattggtctgattttcgccttcgctaatgctgtagccgtggctatgtacgtggtcgggttcgcggaaaccgttgtagatctgctaaaggagagtgactcaatgatggtcgaccctactaacgatatcagaattattgggtctattacggtggtgattctcttaggaatctcagtggccggaatggaatgggaggctaaggcgcaggtcattctcctcgttatcctgctcattgccatcgccaatttcttcattggaactgttatacccagcaacaatgaaaagaagagccgcggattcttcaactatcaggcatcaattttcgctgaaaactttggcccacgattcacaaaaggtgaaggctttttctccgttttcgcaattttcttccctgctgccacggggatccttgccggagcgaacatctcaggagaccttgaggctctgagaaagcagggcgcttccccgttgccccagggcgctcagtcacgcaggcgcaggcagacaagtctgatttag

SEQ ID NO: 240986 - DNA, 3300 bp, Artificial Sequence
  Description of Artificial Sequence: Synthetic coding sequence
atgtccttgaataacagctccaatgtttttctagactcagtcccttccaatactaatcgattccaggtgagtgtgattaatgaaaaccacgagtcttccgccgcagctgacgacaataccgatccccctcattacgaggaaactagtttcggggatgaggctcagaaaagacttaggattagctttcgcccaggaaatcaggagtgctacgacaacttcctccagagcggcgaaacagctaaaactgatgcttccttccatgcctatgacagccataccaacacctactacctccagacattcggacacaataccatggatgcggtgcccaagatcgagtactataggaataccggatctatcagtggacctaaagttaacagaccctcacttctcgagattcatgaacagctggccaaaaatgtagctgtgactccatcatcagctgaccgtgtggcaaacggcgatggaattcctggggacgaacaggccgagaacaaagaagatgatcaggctggcgttgtgaagttcggatgggtgaaaggtgttctagtgcggtgcatgctgaacatttggggcgtgatgttgttcattaggctgagctggattgtgggcgaggctggtataggactgggcgtgctgatcattttactgtctaccatggtgactagcatcacgggattaagcacctcggctatagcaactaatggttttgttcgcggaggcggagcttactatctgattagcagaagtcttggccctgaattcggcggttctattggccttattttcgctttcgccaacgccgtggcagtcgccatgtatgtcgttggcttcgccgaaacagtggtcgacttgcttaaagaaagcgatagtatgatggtggaccccaccaatgacatcaggataatcggaagcattaccgtggtcatcctgcttggtattagtgtcgctggcatggaatgggaagccaaggctcaggtgatactgctggtgatcctgctcatcgctatcgcgaactttttcatcggtactgtgataccgtctaataacgagaagaaatccagagggttctttaattaccaagcatccatcttcgccgagaattttggccctcgcttcactaaaggggaagggtttttctcggtgttcgcaatcttcttccctgctgcaacaggcatccttgctggcgcaaacatttccggcgatctggaagatccgcaggatgccatccccagggggacaatgctagcaatcttcatcactaccgttgcctatttaggggtggctatatgcgtgggtgcatgtgtcgttcgagatgccacgggtaacatgaacgacactataatctccggtatgaattgtaacggttcagccgcatgcggacttggatacgatttcagtcggtgcagacacgaaccttgtcaatacgggttaatgaataactttcaagtgatgtctatggtgtctggcttcggccctctcatcacagccggaatcttctctgcaaccttgagtagtgcattggcctcgctggtctccgccccaaaagtgttccaagcgctgtgcaaggataacatttacaaagcactgcagttttttgccaagggttacggtaaaaataatgagcctctgaggggatatattctgaccttcctaatcgctatggctttcatcctgattgcagagctgaacaccatcgccccaatcatctctaacttcttcctggcttcttacgccctaatcaatttcagttgctttcacgcgtcgtacgccaaatcacctgggtggaggccagcgtatggaatctataatatgtgggtgtccctgttcggtgccgtcctgtgttgcgccgtgatgttcgtcataaattggtgggcagccgtaatcacctacgtgattgaattcttcctctatgtgtacgttacctgtaaaaagccagacgtgaactggggctcatcgacccaggctcttagttatgtgagcgcgctggataatgcactagagctgaccactgtcgaggatcatgttaaaaacttcaggccgcagtgcatcgtgctcactggaggacccatgacccggcctgccttgcttgacattacgcacgcattcacgaagaactctggcctgtgtatttgttgtgaggtctttgtaggaccaagaaagctctgtgtgaaggaaatgaattctggcatggccaagaaacaggcctggttaatcaagaataagatcaaagccttttatgctgccgtagctgcagactgctttagggacggtgtgcggtcactactgcaggcctctggcctggggaggatgaagccaaataccctcgtgatagggtacaagaaaaactggagaaaggcaccactgacggagatcgaaaattacgttggtatcattcacgatgcctttgactttgaaatcggggtggtgattgtgaggatttcacagggatttgacatatcacaggtcctgcaggtccaagaggagctcgagagactggaacaggagcgactggccctagaagcaacgattaaggataacgagtgcgaggaggaatcaggaggcatacggggactgttcaagaaagccggaaaattgaatatcactaaaactacacccaagaaagacggctccattaatacctcacaaagcatgcacgttggcgaattcaatcaaaaactggtggaagccagcacccagtttaaaaaaaagcaggaaaagggcaccatcgacgtctggtggctctttgacgatggtggcttaactttgctgatcccttacattctgacacttcgaaaaaaatggaaggattgcaaactgcggatctacgtgggtggcaagatcaaccgcatcgaggaagaaaaaatcgtgatggcgagccttctttctaagttccgcataaaattcgctgatattcatattattggggatattaacatccggccaaacaaggaatcttggaaagtttttgaagagatgattgagccctatagattacatgaatcttgcaaggacttgaccaccgcagagaagctcaaacgtgaaacgccctggaaaatcaccgacgcagagttggaagccgtgaaagaaaaatcttaccgtcaggtgcggctcaatgaacttctacaggagcattcacgtgcggcaaatctgatcgtgctaagcctgccagtggccagaaaaggctctatatccgaccttctatatatggcttggttagagatcctgacaaagaacttgccccctgtgttattagtaaggggaaatcacaagaacgtgcttaccttctactcttag

SEQ ID NO: 240987 - DNA, 3300 bp, Artificial Sequence
  Description of Artificial Sequence: Synthetic coding sequence
atgagtcttaacaactcatcaaatgttttcctcgactctgtgccaagcaacacaaacaggtttcaggtctctgtgattaacgaaaaccacgaaagcagtgccgcagctgacgacaacaccgacccaccacactacgaagagaccagttttggtgacgaagcacagaagcgcctgcggatttcattccggcctggcaaccaggagtgttatgacaattttctgcaatcaggggaaacagccaaaaccgacgcctcattccatgcttatgatagtcacactaacacctattacctccagacctttggtcacaacacaatggatgccgtgcccaagatcgagtattacaggaatacaggcagcatctccggcccaaaggtgaacaggccgtctcttctggagatccacgaacagctggctaagaacgtggccgttacaccttccagcgccgatcgcgtcgcaaacggcgacggtatccccggtgacgaacaggccgagaataaggaggatgaccaggctggagttgtgaaattcggctgggtgaaaggcgtgctagtacggtgcatgcttaatatctggggggtgatgttatttatcagattatcatggatagtgggcgaggctggaattgggttgggtgtgatcatcatagggctctccgtcgtggtcactaccctgactggcatctccatgtcagctatttgtacaaacggggtcgtgaggggcggtggcgcttactacctgatctcaaggtctctcggtcctgagttcggcggttcgatcggcctaatctttgccttcgcaaatgcagtggccgtggctatgtacgtggttgggttcgctgaaaccgtggttgacctcctgaaagaaagcgacagtatgatggtagacccaacaaacgatattagaattatcggcagtataacggtggtaattctcctgggaatctccgtggcagggatggagtgggaagcaaaagcacaggtgatcttgctggtcattctgcttattgccatcgcgaatttttttattggcaccgttatcccatctaacaacgagaagaagtctagaggcttctttaactatcaagcttctatattcgccgagaactttggacccagatttaccaaaggcgaaggctttttcagtgtgtttgccattttctttcctgccgctaccgggatcttagctggggctaacatctcaggcgatcttgaggacccacaagacgccattcctcggggaactatgcttgccatcttcataacaacagtggcatacttgggggtggcgatctgtgtgggggcttgcgtggtacgcgacgcaacaggcaacatgaacgacaccattatctccggaatgaactgtaatggctccgctgcgtgcgggctcggctatgatttttccaggtgccgccacgagccctgtcagtacggcctcatgaacaactttcaagtcatgtcgatggtgtctgggttcgggcctctgatcactgctggaatatttagcgccactctctcaagcgcccttgcaagcctagtgagcgcaccgaaggtgttccaagccctctgtaaagacaacatctataaggcattgcaattcttcgcaaaaggctacgggaagaataacgagcccctgagagggtacatcctgacattccttattgctatggcatttattctgatcgccgaacttaatactatcgcccctataatttcaaatttctttttagcatcttacgctctcatcaacttttcctgttttcacgctagctatgcaaaatcacccggatggcgcccagcctacggaatctataacatgtgggtttccctgttcggcgctgtgctttgttgtgcagtgatgttcgtcataaattggtgggctgccgttattacatatgtcatcgaattctttttatacgtgtacgtgacatgcaagaaaccagacgttaactggggctccagcacccaggctctttcctacgtctccgcattagacaatgctctcgaattgaccacggtcgaagatcacgtgaagaatttccgccctcagtgcatcgtccttacgggtgggccaatgaccagaccggcactgctcgacattactcatgcctttactaagaactctggattgtgtatctgctgcgaggtgttcgttggtcctcggaaattgtgtgttaaagagatgaactctggtatggcaaagaagcaggcctggctgatcaaaaataaaattaaagcattctatgccgctgtggcagccgactgcttccgggacggcgtgaggtcacttttgcaggcgtctggcctcggcagaatgaagcccaatacgctcgtaatcggctataagaaaaattggcgtaaagccccactcaccgaaatcgaaaactatgtgggcattatccacgatgcatttgacttcgagataggtgtcgtgattgtgcgcatatcccaggggtttgatatctcacaggtgctgcaggtgcaggaggagctggagcgactcgagcaggaaaggcttgcattggaagcaacaattaaagacaacgagtgtgaggaggagagtggagggatacgaggcctattcaagaaggctggcaagctgaatattaccaaaacaaccccaaaaaaggatggatccattaacacctctcaaagcatgcacgtcggcgaatttaaccaaaagcttgttgaagccagcacccagtttaagaaaaaacaggagaagggcaccattgatgtgtggtggttatttgatgatggtggcctgaccctgctgattccatacatcctgactctgcggaaaaagtggaaagactgcaagctaagaatttatgtcggaggaaaaatcaacagaatagaagaggaaaagatcgtgatggcctcactcctctctaagtttaggattaagtttgcggatatccacataatcggagacatcaatattcgccctaataaggagagctggaaggtgtttgaagagatgatcgaaccctataggctgcacgaaagttgcaaagatcttaccacggcggagaaactgaagagggaaaccccatggaagatcaccgatgccgagctggaggccgtgaaagagaagtcgtacaggcaggtccgtctgaacgaactgctgcaggagcacagtcgggcagcgaacctgatcgtgctgtctctccccgtggcacgaaagggcagcatatccgacctcttgtatatggcctggctggagatcttaacaaagaatctacctccagttctgctagtgaggggtaatcataaaaacgtgctgaccttctattcgtag

SEQ ID NO: 240988 - DNA, 1782 bp, Artificial Sequence
  Description of Artificial Sequence: Synthetic coding sequence
atgctaaatatctggggagtgatgctatttattcgcctctcttggattgtgggagaagcaggaatcggactgggtgtactgattatcctcctgtccacgatggtaaccagtattaccggacttagcacgtcagccattgccaccaacgggttcgtaagaggcggaggagcctattacttaatatctagatcgctgggtccggaattcggcggttccatcgggctcatctttgcctttgctaatgcagtggctgtcgctatgtacgtggtgggctttgcagaaaccgtggtggacttacttaaggaaagcgatagtatgatggtggaccctaccaacgatatcagaattataggctcaattaccgtggttatcttactgggtattagtgtggccggaatggaatgggaggcgaaggctcaggtaattcttctcgtcattctgttaatcgccatcgccaactttttcattgggacagttattccttccaataacgaaaaaaagtcccgtggatttttcaactatcaggcctcaatctttgccgaaaatttcggcccaaggttcacgaaaggagagggtttcttctccgttttcgccatcttctttcccgcagctaccggtatcttggccggagccaatatctcgggcgacctagaagaccctcaggacgcaatcccgagggggacaatgcttgctatctttattacaaccgttgcttaccttggtgtggctatttgcgtcggcgcatgcgtagtgagagacgcaacagggaacatgaacgacaccattatcagcgggatgaattgtaacggcagcgcggcatgtggcttgggctatgacttttcgcgatgtcgccacgagccttgtcagtacggactaatgaataacttccaggtgatgtcaatggtgagcgggtttggtcccctgatcaccgcgggtattttctcagcaacccttagcagcgcactggcatcattggtgtccgcaccaaaagtgtttcaggcactgtgtaaagataacatttataaggcacttcaattcttcgctaagggttatggaaagaacaatgaacctctgagggggtacatcctgaccttcctgatagcgatggcttttatacttatcgctgaactgaacaccatcgcgcctatcatcagcaatttttttcttgccagctacgcgctaataaacttctcctgcttccacgcgtcctacgctaagtctcccggttggcgaccagcgtacggaatttataacatgtgggtgagtttattcggcgcagtgctgtgctgcgccgtcatgttcgtgatcaattggtgggccgcagtcattacatatgtgattgagttttttctgtacgtgtacgtaacctgcaaaaaacctgatgtgaattggggttcatccacacaggccctgtcttacgtgtcagcccttgacaacgccctggaactgacaacagtggaagaccacgttaagaattttaggccacagtgcatcgtgttaaccgggggaccgatgacaagacccgctcttttggacattacacatgccttcactaagaactcggggctgtgtatatgctgtgaagtgttcgtgggccctaggaagctgtgtgttaaagagatgaattctggcatggctaaaacaggacttgcctacaaggaacagaatcagggtttcttgtgctgtagcggcggtcgcctcttccaggggtggtgcccaaagagcagttccggcttacggctacgcaagaatgagacgaagcacagcggagactggatctag

SEQ ID NO: 240989 - DNA, 540 bp, Artificial Sequence
  Description of Artificial Sequence: Synthetic coding sequence
atgaggacaatgcgagctgttcagctgcagatgactatcctgacacaccacatcatgaagaaacccctgttgggaatgaagctgaggaaagacagtgaatccgccctggggcttgggatccggtctgcgatgacaatcagcagcaaacaggctctaagttatgtgtctgcgctggacaacgccttggagctgactactgtggaagaccatgtaaagaacttccgtccccagtgtatcgtattaacaggaggccctatgacccgcccagcactgctagatatcacccatgcttttaccaagaactcaggtctgtgcatatgttgcgaagtgtttgtgggcccaagaaaattgtgcgtcaaagaaatgaatagcggcatggccaagaagcaggcctggcttatcaaaaataagattaaagcgttctacgcagccgtagcggcagattgtttcagagatggcgtccggtcacttttacaagcttctggcctggggagaatgaagccaaacaccttggttataggctacaaaaagaattggtag

SEQ ID NO: 240990 - DNA, 3300 bp, Artificial Sequence
  Description of Artificial Sequence: Synthetic coding sequence
atgagcttgaataacagttccaacgtctttttagatagcgtgccaagtaatacaaaccgtttccaggttagcgtaatcaacgaaaatcacgagtcaagcgccgcagccgacgataataccgacccaccccattatgaagaaacctcatttggcgacgaggcccaaaaaaggcttcgcatttccttccggccaggaaaccaggagtgttatgacaacttcctgcaaagtggtgagaccgcaaagaccgatgcatcttttcatgcttatgacagtcatactaacacctactatttgcaaacctttgggcacaacacaatggacgccgtcccaaagatcgaatactaccgaaacaccgggtctatatccggcccaaaggttaataggccatccctgctggagatacacgagcaattggcaaaaaatgtcgctgtcacccccagctccgccgatcgcgtggccaatggcgatggcattcccggagatgagcaagctgaaaataaagaggacgatcaggctggagttgttaaatttgggtgggttaaaggagtgttggtgagatgtatgctgaacatctggggagtcatgcttttcatccggctctcctggatcgtgggggaagctggaattggattgggggtgctcatcattctgctctctacaatggtcacctctattacagggttgagtacaagcgctattgctactaatgggttcgttcgcggagggggagcctactacttgatctctcgctctctgggaccagaattcggcggatcgattggtctgatttttgcattcgccaatgccgttgcggtggccatgtatgttgttggatttgctgagaccgtcgtcgacctcttaaaggagtccgattccatgatggtagatcccactaatgatatccgtatcatcggatctataaccgtcgtgattctgctggggattagtgtggcaggcatggagtgggaggcaaaggcacaggtaatcctgttagtcattctcttaattgcgatcgcaaattttttcatcgggaccgtgataccaagtaataacgagaagaagagccggggattttttaattaccaggccagcatctttgcagaaaatttcggacccaggttcactaagggcgagggatttttcagtgtgtttgccattttcttcccagcagctactggaatactcgccggtgccaatatctctggcgaccttgaggacccccaggatgctattcccagaggcaccatgcttgcaatctttattaccacagtcgcctatttgggggtggcgatatgtgtgggagcctgtgtggtgcgcgacgccactggcaatatgaacgacactatcatctcaggcatgaattgtaatggatcagccgcttgcgggcttggctatgattttagccgctgcaggcatgagccatgccaatatggcctgatgaacaattttcaggtgatgtcaatggtctcggggtttgggccactgataaccgccggaattttttctgcgactctctcttctgctctggccagcctcgtgagtgcccctaaagtttttcaagcattatgtaaggataacatttacaaagccctgcagtttttcgcaaaaggctacggaaagaataacgagccattgcgagggtacatcttaacctttctcatagcgatggcctttattctcattgcagagctcaacacaatagctcctattatttctaatttttttctggcaagctatgctttaatcaacttctcttgcttccacgcttcctatgcaaagtccccgggttggcggcctgcatacggtatttataacatgtgggtgtccttatttggcgcagttctctgctgcgcggtgatgtttgtcatcaattggtgggccgctgtcatcacttacgttattgagttctttttgtatgtttatgtcacatgtaaaaagcccgatgtcaactggggaagttcaacacaggccttgtcgtatgttagcgccctggacaatgcccttgaactgaccacggtggaggaccacgtgaaaaatttccggccacagtgtatagtccttactggcggtcccatgacacgcccagcattgcttgacatcactcacgcgttcacaaagaattccggcctttgcatttgctgcgaagtgtttgtgggtcccagaaaactttgcgtcaaggagatgaatagcggcatggccaagaagcaagcctggcttatcaaaaataaaattaaggctttttacgctgcagttgcagccgattgctttcgcgatggtgtgagatcactcctccaggcttcaggcttagggagaatgaagcctaacacactggtgattggctataagaagaattggagaaaagccccactgacggagatcgagaactacgtgggcattattcatgacgccttcgatttcgaaattggagtggtaatcgtacggattagtcaaggcttcgacataagtcaggtgcttcaggtgcaggaagagctggagcggctcgagcaggaacgacttgccttggaggccacgataaaagataatgagtgcgaagaggagtccggcggtattagaggattatttaaaaaggctggcaaacttaatatcacaaagacaactcccaagaaggatggctccataaacacatcacagtctatgcacgtcggagagtttaatcagaaattggtcgaagcatctacacaatttaagaagaaacaggaaaagggaactattgatgtgtggtggctttttgatgacggaggccttaccctcctgataccctatattcttaccctgagaaaaaagtggaaggactgtaagttaagaatctacgtgggtggaaagattaaccgtatcgaggaggaaaaaatagtgatggccagtctccttagcaaattccgaattaagtttgccgatatccacatcattggtgacataaacattagacctaataaagaatcatggaaagtctttgaagaaatgatagagccatacaggttacatgagagctgtaaagatcttactacagctgagaaattgaaaagggagacaccctggaagatcactgatgctgagctcgaggccgtgaaagagaaaagctaccggcaagtaaggcttaacgaactacttcaggagcattcaagggccgctaatttaattgtacttagccttcccgtggctcggaaagggagcatctcggacctgctctacatggcctggctcgagattctgacaaaaaatttgcctccagtgctgttggtcagaggcaaccacaaaaacgtgctgacgttctacagctag

SEQ ID NO: 240991 - DNA, 1947 bp, Artificial Sequence
  Description of Artificial Sequence: Synthetic coding sequence
atgctcaatatttggggcgtcatgctgttcattagactgagctggatcgtgggggaggccggaatcgggcttggcgttctcatcattctattatctaccatggttacctctattacagggctgtctactagtgcaattgctaccaatggcttcgtgcgcggaggaggcgcttattacctgattagcaggtctcttgggccagagtttggaggatccatagggctcatcttcgctttcgctaatgctgtggcagttgccatgtatgtggtgggcttcgcggaaaccgtcgtggatctcctgaaagagagcgattcgatgatggtggacccaactaatgacattcggataatcggtagcataacagtcgtgatccttctgggcatctctgtcgcaggcatggaatgggaagcgaaggcccaagtgatcctgctggtcattctgctcatagccatagctaactttttcattgggacagtgatcccctctaataatgagaaaaagagccgcggattctttaactaccaggcatccattttcgcggagaatttcggtcctcgctttactaagggggagggcttttttagtgtatttgccatcttcttcccggcagcaacaggcatccttgctggagcaaacatcagcggggacctcgaggatccacaagacgccattcccaggggtacaatgcttgcgatctttattaccaccgttgcttatttgggagtggctatttgcgtcggggcatgcgttgtacgcgatgccacgggaaatatgaatgacacaattatctctggcatgaactgtaacggttctgccgcatgcggtctggggtacgacttttctcgatgccgtcacgagccatgtcagtacggcctaatgaacaatttccaggtgatgtcaatggtgtcaggctttggcccactcattactgccggaatcttcagtgctaccctaagcagcgccctggccagcctcgtgtccgctccgaaggtgttccaggctctttgcaaggacaatatctacaaggctctccagttctttgccaaagggtacggaaagaataacgaaccgctgagagggtacattctgacatttctcatcgccatggccttcatcctgatcgctgaactcaacacaattgcccctattatcagcaacttcttcctagcaagctatgcgctgataaacttctcttgtttccacgcgtcatatgccaagtctccagggtggaggcctgcctacggcatttacaacatgtgggtgagcctgttcggtgccgtgctgtgctgtgctgtgatgtttgtgattaactggtgggcagctgtgattacttacgtcatcgagtttttcctgtacgtttacgtgacctgcaagaaacctgatgttaactggggctcctccactcaggcattgagctacgtgtctgctctcgacaacgctttagaactgaccactgttgaggatcacgttaaaaattttcgtcctcaatgcatcgtgctgaccggcggtccgatgactaggcccgcattgcttgatattacccatgcttttacaaagaattctggcctgtgtatctgttgcgaagtttttgtcggccctagaaaattatgtgtgaaagagatgaattctggtatggcaaaaaagcaggcttggctgatcaagaataaaattaaagccttctacgccgctgtggcggcagattgcttccgagacggcgtccggtcactgctgcaggcgagcggcttggggagaatgaaaccaaatacactggtgattggttacaaaaaaaattggcgaaaggcccctctgacagagatcgagaactacgtgggcatcattcacgatgccttcgacttcgaaattggggttgtgatcgttcgaatttcgcaagggtttgacatttcccaggtgctccaggtgcaggaggagcttgagcgactggagtag

SEQ ID NO: 240992 - DNA, 3639 bp, Artificial Sequence
  Description of Artificial Sequence: Synthetic coding sequence
atggagccaagacccaccgcaccgtcgagcggggcacctggtctggcgggagtgggcgaaacaccaagtgctgcggctctggccgcagcacgtgtagaactgccaggcaccgcagtcccctctgtaccagaagacgcagctccagcctctcgcgacggaggtggtgttcgcgatgagggcccagctgcagcaggtgacgggctggggagacccctcggccctactccttctcagagtcgattccaggtcgacctcgtgtcagagaacgctggaagagctgcagcagccgcagcagctgcggcagctgctgccgctgctgcgggtgcgggtgcaggagccaagcagactccagccgatggagaggcaagcggtgaaagtgagcccgctaaggggtccgaagaggcgaaggggaggttcagggtgaacttcgtcgaccccgctgccagctcatcggcagaggacagcctgagcgatgcggcaggtgttggtgttgacggcccaaacgtctcgtttcagaacggcggtgataccgtgttgtccgagggaagctccctgcatagcggcggagggggaggctccgggcaccatcaacactactactacgacacccacactaatacatattacctgagaactttcggtcataacaccatggacgcagtccccaggatcgaccattaccggcacaccgcggctcagctgggggagaagctgcttcgtcctagcctagccgagttacacgatgagctggaaaaggagcccttcgaggatggttttgccaacggtgaagagtccactcccacccgggacgcggtcgtgacttatacggccgagtcaaaaggtgtcgtgaaattcgggtggatcaagggtgtcctcgttagatgtatgctgaacatctggggagtgatgctgttcataagactgagttggattgtcggacaagccggtatcggcctgtccgtgttggtgataatgatggccacagtggttaccaccatcaccgggttaagtaccagtgcgattgcgacaaatggattcgttcggggaggcggagcgtactatctgatcagtcggtctctgggacctgagttcggtggggcaattggtcttatttttgcgtttgccaatgcagtcgcagtagctatgtatgtggtggggtttgctgaaactgtcgtggagttgttaaaggaacattcaatcctgatgattgacgaaataaacgatattcgcataatcggagcaatcacagtagttatcttgctaggaatttctgtagcaggaatggagtgggaggctaaagcacagattgtcttgctggtgattctccttctggccatcggagacttcgtgataggcacgtttatccctctcgagtccaaaaagcctaaggggttctttgggtacaagagcgaaatcttcaacgaaaatttcgggcctgacttccgggaggaggaaaccttttttagcgtcttcgccattttctttccagcggctaccgggatactggccggtgcgaatatttcaggagacctcgccgatccccagtccgcaatcccgaagggcacgctgcttgctattcttataacgacattggtttatgttggcatcgcagtcagtgttggttcctgcgtggtacgagatgctacaggaaatgtcaacgacacgatcgtgactgagttgacaaactgcacttctgctgcttgcaaactcaatttcgatttcagctcatgtgagtcgagcccctgtagttatgggttaatgaacaacttccaggttatgtccatggttagtggtttcactccactgatcagtgccggtatcttttcagctactctgagctcagcgctggcttctctagtaagcgccccaaaaattttccaggctttgtgtaaggacaatatatatccagcattccagatgtttgctaagggctacggaaaaaataacgaacccttgcgcggatacatattgaccttcctgattgctctaggtttcatcctcatcgcagaactgaacgtcattgctcccatcatttcgaacttctttctggcatcttatgcgctgatcaatttctctgtgtttcacgcctcacttgccaagagcccagggtggagacccgcatttaagtactacaatatgtggattagcctcctcggtgccattctttgttgcattgtcatgttcgtgatcaattggtgggctgccctgctgacctacgtgatcgtgctcggtttatacatctatgtgacttataaaaagccagatgtgaactggggctcgtctactcaagcattaacctacctcaacgccctgcagcacagtatcaggctgtccggagtggaagaccacgtgaagaatttcaggccacagtgtctggtaatgactggggctcctaattctagaccagctctgctgcatctcgtgcacgacttcacaaagaacgtggggctgatgatttgtggccacgtacatatgggccctcgcagacaggccatgaaagaaatgagcatcgatcaggctaaataccagagatggctgatcaagaataaaatgaaagctttttacgctccggtgcacgccgacgacttaagagagggcgcacagtatcttatgcaggccgcaggcctgggtcggatgaaacccaacacccttgtacttggcttcaagaaggactggctacaggctgacatgagagacgtggacatgtacatcaatctgttccatgatgccttcgatatccagtatggtgtggtagtaatccgactcaaggagggtctggatataagtcatctgcagggccaggaagagctgctgtctagtcaggagaagagcccaggaacgaaagatgtagtagttagcgttgagtattcaaaaaagtctgacctagacacatcaaaaccattatctgaaaaacccattacccacaaggtagaagaagaagacggaaaaaccgccactcagcccctactcaagaaagaaagtaaagggcctatcgttcctctcaatgtggccgaccagaagctgcttgaggcgagtactcagtttcagaaaaaacaggggaagaacacaattgatgtgtggtggctctttgacgatggcggtttaacgcttctcattccttacctgctcacaactaaaaagaagtggaaagactgcaagattagagttttcatcggaggcaaaatcaataggatcgaccacgaccgcagagcgatggctacactcctgtccaagttccgtatagacttcagtgacatcatggtcttaggcgatatcaacacgaaaccgaagaaggagaatattatagcttttgaggaaattatcgaaccctaccggctacacgaggacgataaggaacaggatatcgccgataagatgaaggaagacgagccgtggcggattacagacaacgaacttgaactgtacaaaactaagacataccgccagattaggcttaatgagctacttaaagagcactcatcgacagccaacatcatcgtgatgagcctccccgttgcacggaaaggagctgtgtcttctgcactgtacatggcctggttagaagccttatcaaaggatctgccgcctattctgcttgtccgcggtaatcaccaatccgtgctgactttctatagctag

SEQ ID NO: 240993 - DNA, 3591 bp, Artificial Sequence
  Description of Artificial Sequence: Synthetic coding sequence
atggaacctagacccacagcgccatccagcggtgcccctggcttagcgggtgtcggggagactccaagtgctgcggcactggctgcagctagggtggagttgcctggaactgctgtgcctagcgtgccagaggacgcagctcccgcatccagagatggtggcggtgttagagatgaagggcctgccgcagccggtgacgggttggggcgtcctctgggcccaacaccaagccagagcagatttcaagtcgatctggtgtccgaaaatgccggacgcgctgccgctgctgccgctgctgcagccgctgctgcagcggcagcaggtgcgggagcaggtgccaagcaaacgcccgcagacggggaagcgtccggtgagtccgagccagcgaagggctctgaggaagcaaaaggcagattcagggttaatttcgttgaccctgctgcgagttcctctgctgaggactccttgtctgacgcagctggagtcggggtcgatggtcccaatgttagcttccagaacggaggtgataccgtcctgagcgaggggtcctcactccacagtgggggagggggtggaagtggacatcaccaacactactactatgacactcacacaaatacatactacctgcggactttcggacacaataccatggacgctgtccctaggatcgatcattatagacatacggctgcccaattgggtgagaagctacttcggccatctctggctgaactacacgatgaactggaaaaagagccattcgaagacggcttcgcaaatggagaggaatctacgccaacccgcgacgccgtggtgacgtataccgccgaaagcaagggtgttgtgaagtttggatggattaaaggggtattggtcaggtgtatgttgaacatttggggggtaatgcttttcatccgcctttcatggatagtggggcaggcaggaataggcttatccgtgctcgtgataatgatggccactgtggtaactaccattaccggattatctacctccgcaatcgctaccaatggctttgttcggggtggaggggcatattaccttatctctcgctcgctaggccctgagtttggcggagccatcggcctaatcttcgctttcgctaacgccgtcgccgtagcaatgtacgtcgtcgggtttgctgagacggtggtagagctgctaaaggagcacagtatcttaatgattgacgaaattaacgatatacgcataatcggtgcaatcaccgtcgtcattttgttgggcatctccgtggctggaatggagtgggaggcaaaagcgcagatcgtgcttctcgtgatacttctgctggcgattggcgactttgtcattggaacgttcatccccctggaaagtaagaaacctaagggatttttcggctacaagtcagagatatttaatgaaaacttcggcccagatttcagagaggaagaaacatttttcagcgtgtttgctatattctttcctgccgctaccgggattctggccggtgccaacatcagcggcgatctggcggatccgcagtcagcaatccctaaaggcactcttctcgctattctgattactaccctggtgtatgtggggattgcagtgtctgtgggttcatgtgtagtgcgtgatgcaaccggaaacgtcaacgacacaatcgtgaccgaacttaccaactgcacctccgccgcatgtaagctgaactttgatttctcctcctgtgagtcctcaccctgctcctatggcctgatgaataactttcaggtgatgagcatggtcagcgggttcaccccgctcatcagcgcaggtatcttctctgccacgctgagctctgccctggcctctttagtgagcgcgcctaagatattccaagctctttgcaaggataatatttatcccgctttccaaatgttcgctaaggggtatgggaaaaataatgagcccctccgaggctacatcctgaccttcctgatagccttaggattcatcttgatcgcggagttaaatgtcatcgccccaataatcagcaactttttcctcgcgtcttacgccctgatcaacttttccgtgtttcatgcctccctcgccaaatctcctggatggcggcctgcctttaaatactacaatatgtggatttccttgttgggtgccatcctttgttgtattgtcatgtttgttattaattggtgggcagctcttctgacctacgtgattgttttagggctgtatatctatgtgacttacaagaagcctgatgtgaactgggggagtagcacccaggccctcacatacctgaatgctctccagcattccattcgactgtcgggagtcgaggatcatgttaaaaactttaggcctcagtgtttggtgatgactggcgcacccaattcaagacctgcgctgctgcatctcgtgcatgacttcacaaaaaacgtggggctcatgatatgcggacatgtccatatggggccaagaagacaagctatgaaggagatgtccatcgatcaggccaagtaccaacgctggcttatcaaaaataaaatgaaggctttctacgctcctgtccacgccgacgatctgagagaaggtgcacaatatctgatgcaagcggcaggattgggccgaatgaagccgaatacactcgtgcttggttttaaaaaggattggctgcaggccgacatgagggacgttgatatgtacatcaatctgttccatgatgcattcgacatccagtacggcgttgtggtaatcaggcttaaagagggcctggatatttctcatctgcaaggccaggaagagctactgtcctctcaggaaaagtctcctgggacgaaggatgtcgtggtaagcgtagagtatagcaagaagtccgatttggatacatctaaacctttatctgaaaagcctatcacccacaaggagagtaaaggacccatcgtgcctctgaacgtcgcagatcagaaattgctcgaagcctccacacaatttcagaagaaacaaggcaaaaacacaatcgatgtgtggtggctgttcgatgacggaggtctcacactcctgattccatatctcctcacgaccaaaaaaaaatggaaagactgcaaaatacgggtcttcatcggaggcaaaatcaacaggattgaccacgaccgtagagcgatggcaaccttgctctccaaattccgcatagacttttctgatataatggtgttgggtgacataaacactaaaccgaaaaaagagaacatcatcgctttcgaggagataattgaaccatatcggctgcatgaggatgataaggagcaagatattgcagacaagatgaaggaagacgaaccatggagaatcaccgacaacgaactggagctgtacaaaacaaagacctaccggcagatccggctgaacgagctgctgaaagaacattcctctaccgcaaacatcatcgtaatgtctttgccagtggctcgcaagggggctgtgtcctctgcgctgtatatggcctggctggaggccctgtctaaagatctgccacccatccttctcgttcgtggcaatcatcaatctgtgctaacattctattcatag

SEQ ID NO: 240994 - DNA, 1788 bp, Artificial Sequence
  Description of Artificial Sequence: Synthetic coding sequence
atgaagttctttagctatattcttgtatatcgtaggttcttgtttgtggtattcacagttctcgtactactgcccctcccaatagtgctgcatacaaaggaggctgaatgtgcctacaccctattcgtcgtggctactttttggcttacagaggcattgcccctcagcgtcacggcgttgcttccatcgctaatgctgcctatgtttggaattatgccgagtaaaaaggtggcatcagcctatttcaaggactttcatctgttgctgataggcgtgatctgcttagctacttctattgaaaaatggaacctgcacaagaggattgcactgaaaatggtgatgatggtgggtgtcaatcccgcatggctaaccctcgggttcatgtctagtacagcattcctgagtatgtggctgtctaataccagcaccgcggctatggttatgccaatcgccgaagcagtcgtgcaacaaatcattaatgctgaagcagaggtggaagcaacacagatgacctactttaatgggtccaccaaccacgggctggagattgacgagagcgtcaacggacacgaaatcaacgagcgcaaggagaaaaccaagcccgtgccaggctataacaatgatacggggaaaatcagcagcaaggtggagctggaaaaaaatagcggtatgaggaccaagtatcggacaaagaaagggcatgtgacccggaaactcacgtgtctctgtattgcctactcatctacaatcggcggtcttacaacaattaccggcacaagcacgaatctcatttttgccgaatatttcaatacacgttaccccgactgccggtgtctgaattttgggtcatggttcactttcagtttcccagctgctctcattattcttcttctgtcatggatatggctacagtggttgtttctgggttttaacttcaaggagatgtttaaatgtgggaagactaagaccgtgcagcagaaggcatgcgccgaggtgatcaaacaggagtatcagaaacttggccctataagataccaggagatcgtgaccctcgttctctttatcatcatggctttactttggttctccagagaccccggattcgtaccagggtggtccgcacttttttccgagtaccccggatttgccacggactctaccgtcgccctcctgatcggattactcttcttcctgatcccagccaagactctgactaagaccaccccaacaggagaaatagtggcctttgactatagcccattgatcacttggaaggaattccagtcattcatgccttgggacattgccattctggtagggggagggttcgcgttagctgacggatgcgaggaaagcggcctgagtaaatggatcggcaataagctctctcccttaggctcacttcctgcctggcttattatcctgatctcctccttaatggtgacatcgctaacagaagtggcatcaaacccagccactatcactcttttcctccctatcctgtctccgcttgccgaagctattcatgtgaatcccctctacattctgatccccagcaccttgtgcacaagtttcgcctttttactccccgtcgctaaccctccaaatgctatcgtgttctcgtacggtcacctcaaggtgattgatatggtgaaggcaggactgggggttaacattgttggggtggcggtcgtgatgctggggatctgcacctggatcgtcccgatgtttgacctctatacatacccttcttgggccccagctatgagtaacgagacgatgccttag

SEQ ID NO: 240995 - DNA, 486 bp, Artificial Sequence
  Description of Artificial Sequence: Synthetic coding sequence
atgctgcccatgtttggcatcatgccgtccaagaaggttgcgtctgcgtatttcaaggacttccatttgctgttgatcggagtgatctgcctggccaccagtatcgagaagtggaatctgcacaagaggattgccctgaaaatggtgatgatggtcggcgttaatcctgcttggctcaccctagggttcatgagttctacggcgtttttaagtatgtggctatccaacactagtaccgccgctatggttatgcccatcgccgaggccgtagtccagcagatcataaacgcagaggctgaggtcgaagcaacccagatgacttatttcaatgggagtacaaaccacggtctcgagattgatgagagcgtgaatggacatgagattaacgaacggaaggaaaagacgaaacccgtccctggatataataacgatactggaaagatcagcagtaaagtcgagctggaaaaatatcttcaggtgcgctag

SEQ ID NO: 240996 - DNA, 1881 bp, Artificial Sequence
  Description of Artificial Sequence: Synthetic coding sequence
atgggcctgctacagggcctgcttagggtgcgcaagcttcttcttgtggtgtgcgtgcccctcttgctcctccctctgcctgtgttgcacccttccagcgaagcgagttgtgcatacgtgctcattgtgaccgctgtctactgggtgtcagaagccgttccgctgggggcagccgctctcgtgccagcctttctgtatccatttttcggggtgctccgctcgaacgaagtcgcggctgaatacttcaagaacaccaccctactgctggttggggtcatttgtgtggctgctgctgtagagaaatggaacctacataaacgaatcgcgctgcgcatggtcctgatggctggggctaaaccgggtatgctccttttgtgctttatgtgctgtaccactctcctgagcatgtggctttctaacacttcgacgaccgccatggtgatgccaattgtggaagccgttttacaggagttagtgtccgctgaggatgagcagctggtcgctggaaacagcaatacagaggaagccgaaccaatctcccttgatgtcaagaacagtcagccatccctggaactgatcttcgtaaatgaggagtctaacgctgatcttactaccctgatgcataatgagaatctcaatggcgtaccgtcaatcacaaatcccatcaaaactgccaatcagcaccaggggaaaaagcagcaccctagccaggagaaaccacaagtgttaacaccttctcctaggaaacagaagttgaatcgaaaatacagaagccatcacgaccagatgatttgcaaatgcctttccctgagtatcagctacagtgctacgataggcggactgactactattataggcacaagcacaagtctcatttttttggagcacttcaataatcaatatcctgccgctgaagtcgtcaatttcgggacctggttcctcttttcatttcctatttccctcatcatgcttgtggtcagctggttttggatgcattggttgttcctgggatgtaatttcaaagaaacttgtagtttgagtaagaaaaagaagacaaaaagagagcagcttagcgagaaaaggattcaggaggaatacgagaaactaggagacatctcctaccccgaaatggtgacaggctttttctttattttgatgacagtgctatggtttacaagagaacctggatttgtgcccggttgggactcgttcttcgagaagaaaggttaccgaacagatgctacagtgagcgtttttttaggattccttctgtttctcatcccagcgaagaagccctgcttcggtaagaagaacgacggcgagaatcaggagcacagtttggggactgaacccattattacatggaaggatttccagaagactatgccatgggaaatcgtcatcttggtgggtggcggatacgcattggcaagcggttccaagtcatccggcctgagtacgtggatagggaaccagatgctctccctctctagtctcccaccgtgggcagttaccttactcgcgtgcatcttggtatccatcgttacagagtttgtatcaaatcctgcaaccatcacgatctttcttcccatcctgtgctccctttccgaaaccctgcacattaatcccctgtatacactgatacccgtgacaatgtgtatcagcttcgcagtgatgctcccggttggcaatccacctaacgctattgtgttcagttatgggcactgtcaaataaaagacatggtcaaggctggactgggcgtgaacgtcattgggttggtcattgtcatggtggccattaacacctggggagttagcctgtttcacttagatacatatcctgcatgggctcgagtttctaacataaccgaccaggcctag

SEQ ID NO: 240997 - DNA, 1569 bp, Artificial Sequence
  Description of Artificial Sequence: Synthetic coding sequence
atggcctccgcactgagttacgtgtctaagtttaaaagctttgtgattctcttcgttacacctctcctcctgttgccactggtcatcttgatgcctgccaaattcgtgcgctgcgcgtatgtgattattttaatggctatttactggtgcactgaggtgattccacttgcagttaccagcctcatgccggtcttacttttccccttattccagattctcgattctcgacaagtttgcgtgcaatatatgaaagacactaatatgctgtttttagggggactgatcgtggctgtggccgtagagagatggaatctgcacaagcgtatcgccctgcgcaccctgttgtgggtgggtgctaagccagcccgtcttatgctgggatttatgggtgtcacagcccttctgtctatgtggatatcaaacactgccacgactgccatgatggttccaatcgtggaggctatcctgcagcagatggaggctaccagcgcagcaactgaagccggactggagcttgtcgataaaggtaaagccaaggagctccccggttcccaggtcatcttcgaaggaccaacgctgggccagcaggaagaccaggaacggaaaaggctgtgtaaggcgatgacactgtgcatttgctacgctgcatccattggcggaacagccaccctgacaggcacgggtcccaatgtggtgttgctggggcaaatgaacgaactgttccctgacagcaaagacttggtcaatttcgccagctggttcgcatttgcatttcccaacatgctggtaatgctcctgtttgcctggctgtggctgcagtttgtttacatgcggtttaacttcaaaaagtcctggggctgtggcctggaaagcaagaaaaacgaaaaggctgcgttaaaagtgctgcaagaggaataccgcaaattggggccactgtcctttgctgagattaacgttctgatctgtttttttttgctcgtgattctctggttttcaagagaccccggattcatgccgggttggctcacggtggcctgggtcgaaggagaaaccaaatacgtgagtgatgccacagtcgccatttttgtcgccactttgttatttattgtccctagccagaaacctaagtttaatttcagatcccaaacggaggaggagagaaagacacctttctaccccccaccactgctggattggaaagtgacacaggagaaagttccatggggcatcgtccttctgctgggcggaggctttgcactggccaagggctcagaagcgtctggactttcagtctggatggggaaacagatggaacctctgcacgctgtgccgcctgcggcaatcactcttattctatcactgctagtcgctgtgttcacagaatgtactagcaacgtcgcaacaacaacacttttcttgcccattttcgccagcatggtgaaaactggagttatcatgaacatcatcggcgtattttgcgtgtttttggctgtgaatacctggggccgtgccatcttcgatctggatcacttccctgactgggctaacgtcacacatatcgagacctag

SEQ ID NO: 240998 - DNA, 1707 bp, Artificial Sequence
  Description of Artificial Sequence: Synthetic coding sequence
atggcaagtgccctttcttacgtgtctaagttcaaaagttttgtgatcctgtttgtcacgccactccttctactcccgctggttatccttatgcccgcaaaattcgtgcgatgtgcatacgtcatcattttgatggcaatctattggtgcacggaagtcattccgctggccgtgaccagtttgatgcctgttctgctgtttcccttattccaaattctggatagccgccaggtgtgtgtgcagtacatgaaagatacgaacatgctcttcctcgggggactaatcgtggcagttgccgttgagaggtggaacctccataagcgcatcgccctcaggacgctactgtgggtgggggctaagccagccaggttaatgttgggattcatgggggtgaccgccctcctatctatgtggatttcgaatactgctacaaccgcaatgatggtgccgatagtggaagctatccttcagcagatggaggctacctctgctgccacggaggctggattggagttagtggataagggtaaagccaaggaacttcctggaagtcaagtgatctttgagggcccaacactgggccagcaagaagatcaagaacgcaagcgtttatgtaaggctatgaccttatgcatatgttatgctgcaagcatcggcggtacagctaccctgacaggtacaggtccaaacgtggtgctgctgggccaaatgaatgagctattcccagactctaaagatttggtgaacttcgcttcttggttcgccttcgcttttcctaatatgctcgtgatgctccttttcgcttggctgtggctccagttcgtgtacatgagattcaacttcaagaaaagctggggttgtggtttagagagcaaaaagaatgaaaaggctgcattgaaggtgttgcaggaagaatataggaaattaggccctctgtcttttgccgaaatcaacgtgctcatttgtttcttcttattggtcatcctttggttcagcagagacccgggtttcatgccaggctggctcacagttgcctgggtagaaggcgagaccaaatatgtttctgacgctaccgtcgctatcttcgtagctacactgctgttcatcgttcccagtcagaagccaaaattcaacttcaggagccagacagaagaagagaggaagacccccttttatccgccaccattgctggactggaaggtgacacaagaaaaggtcccctggggaattgtgctgctgttgggcggaggtttcgccctggcaaaaggatctgaagcctctggtctgtccgtttggatggggaagcagatggagcccctgcatgccgtgccacccgcagctatcacactgatcttgtccctactcgtcgctgtcttcacagaatgtacctctaacgtggctactactactcttttcctccctatcttcgcttccatgtcacgtagtattggtctcaatcctttgtacataatgttgccgtgcaccctcagcgctagtttcgcctttatgctcccagtggccactccaccaaatgcaattgtcttcacgtacgggcacctaaaagtggcggacatggttaagacaggggtgattatgaacatcataggtgttttctgtgtgttcttggctgtgaatacatggggacgcgctatatttgacctggaccactttccagattgggcgaacgtgacccacattgaaacgtag

SEQ ID NO: 240999 - DNA, 1578 bp, Artificial Sequence
  Description of Artificial Sequence: Synthetic coding sequence
atggcctctgccctctcgtacgtgtcgaagttcaagagcttcgtcattctgttcgtgacacctctgttgttgctgcccctggtcatattgatgccggctaaagtgtgcgttcaatacatgaaggacaccaatatgctctttctgggcggactcatcgtggcagtggctgtagaacgctggaacctgcacaaacggattgcactaagaacactgctttgggtgggtgccaaacctgcacggctgatgttgggtttcatgggcgttactgcactgctgtccatgtggatctccaatacagccaccactgccatgatggtaccaattgtcgaagctatactgcagcagatggaagccacatcagccgctaccgaagccggactcgagttagtcgataagggtaaagccaaagaattgcccggaagccaggtgatcttcgaggggcctacactggggcaacaggaggatcaagaacgcaagagactgtgcaaggccatgactttgtgcatctgctatgctgctagtattgggggaactgctacacttaccggcactggccctaatgtcgtcctgctgggccagatgaatgagctttttcccgattcaaaggacttggtgaattttgcatcttggtttgcgtttgcgttccccaacatgctggtgatgttgctttttgcttggctgtggctgcagttcgtgtacatgaggtttaactttaagaagagttggggatgtggccttgagtctaagaagaacgagaaggcggcactgaaggtgctgcaggaggagtacagaaagctgggtccactcagtttcgccgagatcaacgtgctgatctgttttttcctactggtgattctctggttttccagggatccaggatttatgcccggatggctcacagtggcttgggtggagggagagaccaaatacgtgtccgacgccaccgtggccatctttgtcgctacactgctctttatcgtcccttcccagaagcctaaattcaacttccggtctcagacagaggaggagcgaaagacaccattctatccacctccactgctggattggaaggtaacacaggagaaagtcccatggggtattgtactcctgctggggggaggattcgcattggccaagggtagtgaggcctcaggcctcagcgtgtggatgggcaagcagatggagcccctccatgcagtcccccctgcagctatcacacttattctatcccttttagtggcggtattcaccgaatgtacttcgaacgtcgccacgacaactctcttcttaccgattttcgcaagcatgagcaggtccataggtcttaatcccctctatatcatgctcccttgtaccttgagcgcctcattcgcatttatgctgccagtagccacacccccaaacgccattgtgttcacctacggtcatctgaaagtcgcagacatggttaaaacaggcgtcatcatgaacattattggggtgttttgtgtcttcctggccgttaacacctggggtagagcgatattcgaccttgatcactttcctgactgggctaacgtgacacacatagagacatag

SEQ ID NO: 241000 - DNA, 1569 bp, Artificial Sequence
  Description of Artificial Sequence: Synthetic coding sequence
atggcctccgcattgtcctatgtcagcaagttcaagtccttcgtcatcttattcgtcactcccctgctgttgctacccctggtcattttgatgcccgctaagttcgtccgttgtgcatacgtgatcattctgatggcaatctactggtgtacagaagtgattcccttagctgttacgtccctgatgcccgtccttctcttcccattatttcagatcctggatagccgccaggtctgtgttcagtacatgaaggacaccaacatgttgttccttggagggctgatcgtagccgtagctgtggagagatggaacctgcacaaaaggatcgccctgagaacactgctttgggtgggggctaaaccagcgagattgatgctcgggtttatgggggttacagcactgctgtcaatgtggatctcaaataccgcgaccactgcaatgatggtccccatcgttgaggctatcctccagcagatggaggcaacatcggccgcaaccgaagcagggctggagctggtggataaaggaaaagcaaaagagctgcccggatcgcaagtgatattcgagggacctactttaggtcaacaggaagaccaggagcgtaaacggctgtgcaaagctatgactttgtgtatctgttacgcagccagtattggcggtaccgcgaccctgaccgggaccggccctaatgtggttctgctgggccaaatgaacgaactattcccagattctaaggatcttgtgaactttgcttcgtggtttgccttcgccttcccaaatatgctcgtgatgcttttattcgcttggctatggttacagtttgtgtacatgcggtttaattttaagaaatcctggggctgcggtctggagtccaagaagaacgagaaggcagcacttaaggttctgcaggaagaatatagaaaactgggaccactgtccttcgccgagatcaacgtactgatctgttttttcctcctagttatcctgtggttctccagggacccaggattcatgcctggctggttaactgtcgcctgggtcgaaggcgaaacgaaatatgtctcagatgccaccgtagcaatctttgtggccaccctcctattcatagtaccatctcagaaaccgaaatttaatttcaggagccagacagaggaggagcggaagacacctttttatcctccccctctgctggactggaaagtcacgcaggagaaggtgccttgggggattgtgctgctccttggaggagggttcgctctcgcaaagggctctgaagcctccggcttgagtgtgtggatgggcaagcagatggaaccccttcatgccgtccctccagcagctatcacgcttatcctgagcctcctggtagctgtgttcacagagtgcaccagtaatgtggccactacaactttgtttctgcctattttcgcctcgatggttaaaactggggtcattatgaacatcatcggtgtgttttgtgtgtttctggcagtgaatacatggggccgagctatcttcgatttagaccacttcccagactgggctaacgtcactcacattgagacctag

SEQ ID NO: 241001 - DNA, 1779 bp, Artificial Sequence
  Description of Artificial Sequence: Synthetic coding sequence
atggccacatgctggcaggccttgtgggcgtacaggtcttacttaattgtgttcttcgtgcccatcttgttactgcccttgcctattctcgtgccctccaaagaggcctattgcgcctatgcgattatactgatggccctcttttggtgtaccgaagcactgcctctcgctgtgactgccttgttccctctgatcttatttcccatgatgggtatcgttgatgcctccgaagtggccgtggagtacctgaaggattcgaatctgctgtttttcggcggtcttctcgtcgctatcgccgtcgaacattggaatctgcacaaaagaatcgcccttcgcgtgctcttgatcgtcggcgttagacctgctcccttgatacttgggttcatgctggttaccgcctttctttccatgtggatttctaacaccgcaacgagcgctatgatggtccctattgcccatgccgtgttagatcaacttcacagcagccaagcatcttcgaacgtcgaagagggttcaaataaccccacattcgaactgcaggaaccttctccacagaaagaggtgacaaaactcgataacggccaagcattacctgtcacatccgcctcttctgagggccgtgcgcatttgagtcagaagcaccttcaccttacccagtgcatgtcattgtgtgtctgttactcggcatccatcggcggaatagccaccttgacaggcactgcacccaacctggtgttgcaggggcagattaactccctgtttcctcagaatggcaatgttgtgaatttcgcttcatggttttcctttgcattcccaaccatggtgatcttactgctgttagcctggctgtggctgcaaatcctctttctcggcttcaacttccgaaaaaactttgggattggggagaaaatgcaggaacagcagcaggccgcatattgcgttatccagacagagcatagactgctggggcctatgacctttgccgaaaaagctatctccatcctttttgtcatactggtcctattgtggttcactcgcgagccgggatttttcttgggctgggggaatctggcattccccaacgctaaaggcgagtccatggtatcggacgggacagtggccatcttcatcgggatcattatgttcattattcccagcaaattcccaggcctgacccaggatcccgagaatccaggaaagctcaaagcaccactaggacttctggactggaagacggtaaaccagaagatgccgtggaacattgtgctcctcctggggggagggtatgctctggcaaagggctcagagcgctctgggctatccgagtggttgggaaacaaactgacacctctccagagtgtgccggctccagctattgccatcattctcagcctcctcgtggccacttttaccgagtgcacaagcaacgttgcgaccaccacgattttccttccaattctggcaagcatggcccaagcaatatgtctgcacccactgtacgtgatgcttccatgtacattggctacttctctggccttcatgctgcccgtggcaacgccccctaatgctatcgtcttctcgttcggtgatctgaaagtgctagatatggctcgggctggatttctcctcaacatcataggtgtcctgataatcgcactcgcgatcaacagctggggtatccccctgttctctttacattccttcccatcatgggcccagtctaacacgactgcacagtgcctccccagtctggccaacaccactactccctctccttag

SEQ ID NO: 241002 - DNA, 1926 bp, Artificial Sequence
  Description of Artificial Sequence: Synthetic coding sequence
atggccacctgctggcaggctctgtgggcatacagaagctatctaatagtgttttttgtccccatcctgctcctccccctccctattttagtccctagcaaggaggcctattgcgcctatgccattatactcatggcgctgttctggtgcaccgaggctcttccactggccgtgaccgccctgtttccgctgattctattccccatgatggggatcgtggacgctagcgaaatcatccagcggccatttccttctagcttcgagtcccccggagagtgccagagcgtgggtatgagcgttaccgccagtcataatttaggtggcactgtaggcgactcgcgcgtttttcccccattaagccacgtctcaacttgtcaggtcgctgttgaatatctgaaggacagcaatcttctatttttcggcggacttctcgtggcgatcgccgtagagcactggaacctacataaacggatcgctttgcgcgtcctgctgatcgtgggagtgagaccagcacccttaattcttgggtttatgctggttacagcgttcctctctatgtggatcagcaataccgccacatctgctatgatggtgccgattgcccacgcagtgttggaccagctgcacagctctcaggcttctagtaacgtggaagaggggagcaacaatccaaccttcgaactgcaggaaccttcccctcaaaaggaggtgacaaaattggacaacggtcaggcactgcccgtgaccagcgcatcatctgagggcagagctcatctgtcacagaagcaccttcacttaacccagtgtatgagcctgtgcgtatgttactcagcctctatcggcggtattgccaccctcactggaaccgcccctaacctggtcctgcaaggccaaattaactcccttttccctcaaaatggcaacgtcgtcaacttcgcctcatggttcagcttcgcctttccaactatggtgatactcctgctcctggcttggctctggctacagatcctgtttttgggttttaatttcaggaagaactttggtatcggcgaaaagatgcaggagcagcagcaggccgcatactgcgtcatccaaactgagcacagactgctgggtcccatgacatttgccgagaaagcaatatccatcctgttcgttatcttagtcctgctttggttcacgcgagagcccggatttttcttgggctggggaaacctcgcatttcccaatgctaagggcgaatctatggtgagcgatggcaccgtagccatctttattggaattatcatgtttataatcccatctaaatttccagggctaacccaggacccagagaatcctggcaagctaaaagcacccttagggttgttggattggaaaacagttaaccaaaagatgccgtggaatatagtactgctgctgggaggaggttacgccctggctaaaggtagcgagaggagcggcctgagcgagtggcttgggaacaagctcacaccattacaatccgtacctgcccctgctattgctattattttgtcgctcctggtagccaccttcacagagtgtacatcaaatgtggctacaacaactatcttcctgcctatccttgcttccatggcccaggccatttgcctccacccactgtacgtaatgttgccatgcacgttagccactagcttagctttcatgctacccgtggccaccccccctaacgctattgtattctcctttggagatctaaaagtgctggacatggccagagcaggcttcctgctcaatattataggtgtactgatcatcgccctggcgataaactcctggggtatcccactgttcagcctgcacagcttccccagctgggctcagtcaaatacgaccgcccagtgcctccctagtttagccaatacaactactccttcaccctag

SEQ ID NO: 241003 - DNA, 1566 bp, Artificial Sequence
  Description of Artificial Sequence: Synthetic coding sequence
atgcccgtgtgtggcaacgttgcagttgagtacctgaaggacagcaacctgctctttttcggtggcttgctcgtggctatagccgtggaacactggaacctgcataaacgcatcgcactgcgggtattactgatcgttggcgttcgtcccgcacctctgattctcggtttcatgttagtgacagcattcttgtctatgtggattagcaataccgcaacctctgctatgatggtgcctatcgcccacgcagtgcttgaccaactccactcatcccaggcttcctccaatgtagaggagggctctaataaccccacttttgaactgcaggaacccagcccgcaaaaggaagtaacaaagctcgacaatggccaggccttgccggtcaccagcgcatcatctgaaggtagagcacatctgtctcaaaagcacctccatctcacgcagtgtatgagtctttgtgtttgctactcagcgtctattggaggtatcgcaacactgactggcacagctcctaacttggtactgcagggtcagattaactctttgttccctcagaacggaaacgtggttaattttgctagctggttttcattcgctttccctactatggttatactcctgttactagcttggctgtggctgcaaatcctcttcctggggtttaacttcaggaagaatttcggcataggagagaaaatgcaggaacaacagcaagccgcatactgcgtgatccagactgagcacagattgctgggtcctatgacattcgcagagaaagcaatttctatcctgtttgtgattctcgttctcctgtggttcactcgcgaaccgggtttcttcctcggctggggtaacttggcattccccaatgccaaaggagaatccatggtgtcagacggcacggtagccatcttcatcgggatcattatgtttatcatccccagcaagtttccaggtctgacacaagatccagagaaccccggaaagctgaaggccccactagggctcctcgattggaagaccgttaaccaaaagatgccttggaacatcgtgcttttactgggcggaggttatgctctcgcaaagggtagcgagcgatccggcctttctgaatggttgggaaacaagctgacaccactccagtccgtgcctgcacccgctatagcaatcatcctttcgctacttgtggcaaccttcactgaatgtacatccaacgttgcaactaccacaatattcctgcccatactcgcctctatggctcaggcaatttgcttgcacccgctgtatgtgatgctgccctgcacactggctaccagtctggcattcatgttgcctgtggccacacctccaaatgctattgtcttttcttttggggaccttaaagtgctcgatatggccagagccggttttctgctgaacatcatcggggtgctaatcatcgcgttggcaatcaactcatggggcattcctctcttttctttgcattcctttccttcctgggcacagtccaacacaacagcccagtgccttccctccttggccaacaccacaactcccagcccctag

SEQ ID NO: 241004 - DNA, 1035 bp, Artificial Sequence
  Description of Artificial Sequence: Synthetic coding sequence
atggcactcttttggtgtacagaagctctccctctggcagtgactgccttgttccctctgatcctgtttcctatgatgggcatcgtagacgccagcgaggtcgctgtcgagtatctcaaggatagcaaccttctgtttttcggtgggcttttggtcgccatagcagtggaacattggaacctgcacaagcgtatcgccctacgagtgctgctgatcgtgggggtcaggcccgctccattgatcctgggattcatgctggtcacagcgtttctgtctatgtggattagcaataccgccacaagcgctatgatggtcccaatagcccacgcagtgctggaccagctgcattcatctcaagcatcttcaaacgtggaagaaggctctaataatccgacatttgaactgcaagagccctcccctcagaaggaggttacgaaactcgataacggacaggccctccctgtaacctcagccagcagcgaaggcagggcccacctttctcagaagcacctgcatctgacacagtgtatgagcctgtgcgtgtgctattccgcgtccattggtgggatagctacgttaactggcacggcacctaacctcgtgcttcaagggcagatcaattctctattcccccaaaatggtaatgtggttaactttgcatcctggttttcatttgcttttccaacaatggtgattctcctcctactggcctggctgtggctacagattctctttcttggatttaattttaggaaaaacttcggtatcggcgaaaaaatgcaggagcaacagcaggccgcttactgcgtgattcagaccgagcacaggctgctgggccctatgacatttgctgaaaaagccattagcatccttttcgtgattttagtgcttctatggttcacccgtgagcccggtttcttctggctcggccaatttggattctctcagtgccaaggaggggaagttcgagtggcaggcgtcggaagacgcacccatctcggcctgacttgcagcgggcgtagagaggggtactag

SEQ ID NO: 241005 - DNA, 1650 bp, Artificial Sequence
  Description of Artificial Sequence: Synthetic coding sequence
atggcaacctgttggcaggccctgtgggcctatcgatcctacctgatcgtgttttttgtgcctatcctgttactcccactgcccattctcgtcccatccaaggtggcagtggaatatttgaaggattcaaacctgcttttctttgggggtctgctggttgcgatcgcggttgagcactggaatctacacaaaaggatagcacttcgcgtgctgctgattgtcggtgttaggcctgcaccactaattttaggtttcatgctggtgactgcattcctgtcaatgtggatatcaaatacggccacatcagctatgatggtcccaattgcgcatgccgtgctggatcaattgcacagcagccaggcgtcttctaacgtggaagagggcagtaacaatccgactttcgagctgcaggaacccagcccgcagaaagaagtgactaagctagataacggccaggctctccctgtgacttccgcgtcttccgagggaagggcccacctaagtcagaagcacctccacctgacccagtgtatgtccctgtgtgtgtgttactccgccagcattggcggaatcgcgacacttaccggaaccgcccctaacttagttctccaggggcagattaactctctgtttccccagaatggtaatgtggtgaattttgcctcctggttttcgtttgcctttcccacgatggtcattcttttactgttagcgtggctctggctccagatcctgtttctgggttttaatttcagaaaaaacttcgggatcggcgagaagatgcaggaacagcagcaggccgcttattgtgtgatccaaaccgaacaccggctgctcggccctatgacttttgccgagaaagcaatctccatactgtttgtgattttagtactcctatggttcacccgtgagcccggattcttcttgggctggggaaacctggctttccctaatgcaaaaggtgagtctatggtatctgacggcacagtggcaatttttatcgggataatcatgttcatcatccccagcaaattcccaggtctgacccaggaccctgagaatccgggtaagctaaaggctcccttaggactgcttgactggaaaaccgtgaaccaaaagatgccctggaacattgtgcttctgttaggcggaggctacgctctggccaagggttctgaacgctcaggcctatctgaatggttgggaaacaaactgaccccgctccagagcgtgcccgctcctgccatcgctatcatcctgagtttgctggtggctacttttaccgagtgcacctcaaacgttgccaccacaactatctttcttcctatactggcttccatggcccaggctatttgtctccatcctctgtatgtgatgctgccatgtaccctcgctacgagtctggcttttatgctccccgtggcgacacccccaaatgccatagtattctcttttggcgacctgaaggtactggacatggcaagagcaggattcctgttaaacatcatcggcgtgcttattatagccctggctatcaacagctggggcataccccttttcagtttgcattcatttcccagctgggcccaatccaatacaacagcccagtgcttgccctctctcgcaaacacaacaaccccaagcccctag

SEQ ID NO: 241006 - DNA, 1809 bp, Artificial Sequence
  Description of Artificial Sequence: Synthetic coding sequence
atggctgccttagctgccgctgcgaaaaaagtctggagcgccagaagattacttgtgttgctgttcacacccctagccctcctgcccgtcgtgttcgccctcccccctaaggagggaaggtgtctgttcgtcatactgttgatggcagtatattggtgtacggaggccttgccattgtcggttaccgcactgttgcccattgttctgttcccatttatgggcatcctcccatcaaacaaagtttgtcctcagtactttctagataccaattttctcttcctttccggccttatcatggcctccgccatagaagaatggaaccttcaccggcgtattgccctcaagatacttatgctggtgggggttcaaccggcaaggctgatcctggggatgatggtgactacaagtttcctttccatgtggttgtccaatacagcctcaacagccatgatgttaccgatagctaacgccattctaaaatccctctttggccagaaggaagtgcggaaagacccttcccaggagtcggaggagaacacagccgcagtgcggcgaaacggtcttcacactgttccaactgagatgcaattcctcgcttcaaccgaggcaaaagatcatcccggtgaaaccgaggtgcccttagacctccctgccgatagccgtaaggaggacgagtaccgccgtaatatctggaagggctttctgatctcaatcccctatagtgcgagtatcggtggcaccgctaccctgacgggtaccgcgcctaatctgatacttctcggccagcttaagtcattcttcccccagtgcgacgtggttaatttcggaagctggttcatattcgccttccccctcatgttgttgttccttctggctggctggttatggatctcattcctctacgggggactgtctttcagaggatggcggaagaataagagtgagatcagaactaacgcagaggatagagccagagcggtaatccgagaggaatatcaaaatttaggacccatcaaattcgccgagcaagctgtgtttatccttttttgcatgttcgctatactcttgttcactagggaccctaagtttatcccaggatgggcatccttattcaaccccggattcctgtccgacgccgtaaccggtgtcgccatcgtaaccatcctatttttttttccctcccagaggccaagtctgaaatggtggttcgatttcaaagcacccaacactgagaccgaaccacttctaacttggaaaaaagctcaggaaaccgtaccttggaatatcatcctgctgttaggcggaggatttgccatggcaaaagggtgcgaggagtccggcctgtccgtttggatcggcggacagctgcaccctctggagaacgttccacctgccctggcagtgctcctcattacagtcgtcatagccttctttacagagttcgcgtcaaatactgcaacaatcattatcttcctgccagtgctcgctgagctcgcaatacgtctgcgcgtgcacccactgtacctgatgattcctgggaccgtcggctgctcctttgctttcatgcttccagttagcactccgcctaacagtatagcgttcgccagtggacatcttctcgtgaaggacatggtccgtaccgggttgctcatgaacttgatgggggtgctcctcctttcattagctatgaatacatgggctcaaacgatattccagctgggaactttccctgactgggccgatatgtattccgtgaacgtgaccgcattgccgcctacactggcaaatgacacttttcgaaccctttag

SEQ ID NO: 241007 - DNA, 1668 bp, Artificial Sequence
  Description of Artificial Sequence: Synthetic coding sequence
atggctgtttattggtgcactgaggcccttcctctttctgtgactgcactgctgcctattgtccttttcccctttatggggattctgcctagtaacaaggtttgcccccaatacttcctggacaccaacttcttattcctctccggtctgatcatggcatctgctatcgaagagtggaacctgcataggcggattgcattgaaaatcttgatgttggtcggagtgcagccagcccgtctcattctgggcatgatggtaactacaagtttcctgtccatgtggttatccaacactgcttccacggcaatgatgctgcctatcgccaacgccatcctgaaatccctcttcggtcagaaagaggttcgcaaggaccctagtcaagaatccgaggagaataccgctgcagtccgcaggaacgggctgcatactgtcccgaccgagatgcaatttctggcttcaacagaggccaaggaccatccgggtgaaacagaggtcccactggacctgccagcagattcccgcaaagaagacgaatatcgcaggaacatttggaagggttttctcatatctattccatacagtgccagcattggcggtacagccactttgacgggaaccgctcccaacttgatcctcctaggccagctgaaatcgttcttcccccaatgcgacgtcgtgaactttggctcctggtttatcttcgcttttcctttgatgttgctctttctgctcgcaggatggctgtggatctcattcctgtatggcggactttcctttcgcggttggcgcaagaacaaatctgagataagaactaacgccgaggatcgcgctcgagcagtcattcgcgaagagtatcaaaacctgggacctattaagttcgcagagcaagccgtcttcattctcttctgcatgtttgctatcctgctgttcactagagaccctaaattcattcctggctgggcctctctcttcaatcccggtttcttgagtgacgcagtgaccggagtggctatcgtcactatactgttcttttttccctctcagcgcccttccctgaaatggtggttcgacttcaaggcaccaaatacagaaaccgagcccctgctgacatggaagaaagctcaggagaccgtcccctggaacatcatcctgctgctgggtggcggttttgcaatggccaaaggctgtgaggaatcaggcctttcggtttggatcggtggtcagcttcatcccttggagaatgtaccgcctgccctggccgtgctcctcatcacagtggtgattgcattttttactgaatttgcctcaaacactgccacaataatcatcttcctccctgtacttgccgagctcgccattcggctgcgagtgcatccactttacttaatgatacccggaaccgtgggctgcagctttgctttcatgttgcccgtgagtactccacccaatagcatcgcttttgcctccgggcaccttctcgttaaagacatggtcagaaccggcctgctgatgaatttaatgggcgtactccttctgagtctcgcaatgaatacttgggcgcagacgatctttcagttgggaacgtttcctgattgggctgacatgtattctgtcaacgtgacagcgctccctcctacccttgccaatgatacctttaggacactatag

SEQ ID NO: 241008 - DNA, 699 bp, Artificial Sequence
  Description of Artificial Sequence: Synthetic coding sequence
atggccgctctggccgctgctgccaaaaaagtatggtccgcaaggcggctgcttgtcttgcttttcactcccctcgcactgttgcctgtggtgtttgctttaccgccaaaagaaggacggtgcctgtttgttattctcctgatggccgtctattggtgcactgaggccttacctctgtccgtgactgctctactgcccatcgttctgtttcccttcatgggaatcttgccttcaaacaaggtgtgcccccagtactttctggacaccaactttctgtttcttagcggcctcattatggcgtcggcaatcgaggaatggaatttacaccggaggatcgccttaaaaattctgatgcttgtgggggtgcagcctgcccgactcatcctggggatgatggtgactacaagtttcctgagcatgtggctgtctaacacagcatctactgcaatgatgctgccaatagctaacgctatattgaagtcactgttcggccagaaagaggtgcggaaggatccttctcaggagtcagaagaaaacaccggtatcgagcccaacacatttctatcggaggagcggctgaagctccaggctcctctggtgattcgcttgggacagatcacagaaagcggccagtggaacatgagcgggaacgacgtgtgtaactttagggtactgtctttccttcctggagggatgtag

SEQ ID NO: 241009 - DNA, 1017 bp, Artificial Sequence
  Description of Artificial Sequence: Synthetic coding sequence
atggccgcattagctgctgctgcaaagaaggtttggtcggcaaggcggcttttggtgctactgttcacaccacttgctctcttgcccgtggtgttcgctttaccccctaaagaaggcaggtgtctctttgtcatcctgctaatggccgtgtattggtgcactgaggccctgcccttgtccgtaacagctctattgcctatcgtactcttcccattcatggggattctgccctctaacaaagtttgcccacagtactttctagacaccaattttctgtttctgtctggactcatcatggccagcgcgatcgaggagtggaaccttcaccgtcgcatcgcattgaagatcctcatgttggtgggggtccaacctgctcgcctgattctgggtatgatggtaaccacttcctttctgagcatgtggctgagcaacaccgcctccaccgcaatgatgttgcccatcgccaatgcgattctgaagtccctcttcggccagaaggaggtccgcaaagacccaagtcaggaatctgaggagaataccgccaaaacaaccctgggcaggcagagatttcactggatctgcaggctcacccccggaaggaggatgaacattgttggcaccagtgggagggcctcatctagcccctcaccaacccagcccgtcttaggggctcagccccattcaagagcacagcctctgaccagtagctgtttggcatcaagtaggggctggctatggattagctttctgtatggtgggctctccttccgcggatggagaaagaataagtctgaaattcgcaccaatgccgaggatagagccagggccgtgatacgggaggaataccagaacctgggacctatcaaatttgccgaacaggcagtgtttatactcttttgcatgttcgcgatcttgctcttcactagagacccaaagttcatcccgggttgggcctcgctgtttaaccccggatgtaaaatgggaatcatcagcatctccactatccaaaagatgtag

SEQ ID NO: 241010 - DNA, 1563 bp, Artificial Sequence
  Description of Artificial Sequence: Synthetic coding sequence
atggctgtttattggtgtacagaggcattgcctctgagtgtgaccgctctgttgccaatcgtgctgtttcccttcatgggcatcttgccctcaaataaagtctgcccacagtacttcctggatacaaacttcctcttcttgtccgggctgattatggcatcggccatcgaagaatggaacctgcacaggcgcatcgctcttaagatccttatgctggttggcgtgcagcccgcaaggttgattttgggaatgatggtaactacttccttcctgagcatgtggctgtcgaacaccgctagcaccgcaatgatgctgccaatcgcgaacgcaattctgaaaagtctctttggacagaaggaggtgaggaaggatccttcccaggagagcgaggagaacaccgccgcagtccgcaggaacggtctccataccgtcccaacagagatgcagttcctggcgtctaccgaggcgaaagatcatcctggagaaacagaagtccccctggacctaccggcagacagtcggaaggaagacgagtatcgccgaaacatttggaaggggtttctgatatcaattccttactctgcgtctattggcggtacagcaaccctgaccggcaccgcccctaacctgatcctcctgggccagctcaagtctttctttccacagtgtgacgttgtgaattttggctcctggttcatcttcgcatttccgttaatgctgctattcctgttggcgggttggctctggatttcgtttctgtacggcggtctgagcttccggggatggaggaagaataaaagtgaaatacggacgaacgctgaggacagagccagggctgtaatcagggaggagtatcagaatcttgggcctatcaaattcctctccgacgctgttacaggagtggcgatcgtcaccatcctgttcttctttcccagtcaacgaccctctttgaaatggtggttcgatttcaaggctccaaacactgagaccgagccccttctgacatggaagaaggcccaggagactgtgccctggaacatcatcctactcctaggtggaggatttgccatggcgaagggatgcgaggagagcggattgtctgtttggattgggggtcaacttcacccacttgagaacgtgcccccagccctggccgttcttctgatcactgtggtgatcgccttctttactgaatttgccagtaacactgctacaatcattatcttcttgcccgttttggcggaactagcaatccgcctcagggttcatccactttacctgatgatccctggaacagttggctgctcctttgcgtttatgctcccagtcagcactccgccaaattctattgcatttgccagtggccacctgctcgtgaaggacatggtgagaacaggcctcctgatgaatctaatgggcgtacttctgctgagcctagcaatgaacacatgggcgcagactatctttcaattgggaacctttccagactgggcagacatgtattcagttaacgtcacagccttaccccctacattagcgaacgataccttcagaacactatag

SEQ ID NO: 241011 - DNA, 1659 bp, Artificial Sequence
  Description of Artificial Sequence: Synthetic coding sequence
atggccgctcttgcagcagcagcgaaaaaagtttggtccgcccgacgcctgctcgttctcctgtttacccccctagccctgcttcccgtcgtctttgccctgcctccaaaggaaggtcgttgtctgtttgtgattctactcatggccgtctattggtgcaccgaagctttgccattatcagttacggcactgctccctattgtgctgtttccatttatgggcatccttccctcaaataaggtctgtcctcagtatttcctcgatacaaacttcctttttttaagcggcttgattatggcctcagccatagaggagtggaacctgcaccggagaattgctcttaaaatccttatgttagtgggtgtccaacccgctaggctaatcctaggcatgatggttactacatcttttttaagcatgtggctgtcaaatacggcttccacagcaatgatgttgcctatcgcgaatgccattctcaagagtctgtttggccaaaaggaagtgcggaaggatccgtcccaggaatccgaggaaaatactgcaaaaaccacgttgggtcggcagaggtttcactggatctgccgactcaccccaggtaggagaatgaacattgttggtacctctgggcgagcctcatcctccccgagccccacccagcctgttctgggggctcaaccacactctcgggctcaaccactgacctcttcctgcttggcctcatcaaggggatggctgtggatctcattcctgtacggaggattatccttccgcggttggagaaaaaataagtccgaaatcagaacaaatgccgaagatagggcccgtgcggtgatacgtgaagagtaccagaatctgggacccataaagtttgccgaacaagccgtttttatcctgttctgtatgttcgccattctcctgtttacaagagatccaaagttcatccctgggtgggccagcctgttcaacccgggatttttgtccgacgctgttaccggcgtggcaatagtaactatactatttttttttccgtcacagcggccatctcttaagtggtggtttgattttaaagcgccaaatacggaaactgagcccctccttacatggaagaaggcacaggagaccgtgccatggaacattattctgctgctgggcggaggttttgctatggcgaagggctgtgaagagagtggactgagcgtatggatagggggtcaacttcatcctttggagaatgtgccaccagccctggcagttctgctcatcacagttgtgatagccttctttactgagttcgccagtaatacagcaacaatcatcatcttcctgcccgtgctcgccgaacttgctatccgactgcgcgtccaccctttgtaccttatgattcctggcaccgtcggttgcagctttgccttcatgttacccgtaagcacaccccctaactctattgcctttgccagtggccacctgttagtaaaggatatggtcaggacaggtcttttgatgaacttaatgggcgtgttactgctctcccttgcgatgaacacatgggcccagacaatcttccagctcgggactttcccagactgggctgacatgtactccgtcaatgtaaccgcactacccccaacactggccaacgatacatttaggactctgtag

SEQ ID NO: 241012 - DNA, 558 bp, Artificial Sequence
  Description of Artificial Sequence: Synthetic coding sequence
atggccgtgtattggtgtactgaggctctgcccctcagcgtaaccgccttgttgcccatcgtgctgtttccgtttatgggaatactgccatccaataaggtgtgtccacagtacttcttggacaccaactttcttttcctgtccggcttgataatggcctctgccatcgaggagtggaatctgcatcggagaattgcgctcaagatattgatgttggtcggcgtccaaccagcgcgactgattttggggatgatggtgacgacaagttttctttccatgtggctgtctaacaccgcatcaaccgcaatgatgctgcctattgctaacgcgatcctgaagagcctgttcgggcagaaggaagttcgtaaggacccatcccaagaaagcgaggaaaacaccggcattgagcctaatacattcctttccgaagagcggctcaaactgcaggctcctctggtgatccgtctagggcagatcaccgaatccgggcaatggaatatgtccggaaacgatgtatgcaatttccgtgttctctcttttcttcctggtggcatgtag

SEQ ID NO: 241013 - DNA, 564 bp, Artificial Sequence
  Description of Artificial Sequence: Synthetic coding sequence
atgctaagccccgcatggctgttgagtccctcttgctcttcatcacgacccaagggcccactgtcctctggaggacttacatccaaagagagcggcctatcagtatggatcggcggacaactgcatcccctcgagaatgtaccgccagctctcgcagtgctgctgattacagtagttattgcatttttcactgagttcgcttccaacactgcaacaatcatcatcttcctgccagtgctggcagaactggctatccgtctgagagtgcacccactgtatcttatgatacctggcacggtgggctgctcctttgcctttatgctgccagtcagcacacctccaaattctatcgctttcgcatcggggcacctgctcgtgaaagacatggtccgaacggggctgttaatgaatttaatgggggtattgctgctctccttagctatgaacacatgggcacaaactattttccagctgggtaccttccccgactgggctgacatgtattctgtcaatgtcacagcattgccgcctacactagctaacgacactttcagaactttgtag

SEQ ID NO: 241014 - DNA, 1230 bp, Artificial Sequence
  Description of Artificial Sequence: Synthetic coding sequence
atggccgtgtactggtgtactgaagcattgccccttagcgtgaccgcgctgctacccatagttctgtttccatttatgggtatattgccaagtaataaggtgtgccctcagtactttctcgacactaactttctcttcctgtccggcctaattatggcatccgcaatcgaggagtggaacctgcacagacgtatcgccctgaagatcctcatgctggtgggagtgcagccggcacggttgatcctcggcatgatggtcacaacaagtttcttgagcatgtggctctctaataccgccagcacggccatgatgctcccgatagctaacgccattctcaaatccttattcgggcagaaagaggttaggaaagatccgtcccaagaatccgaagaaaataccgcagccgtacggagaaacggcctccatacagtgccaacagagatgcagttcctagccagtaccgaagccaaagaccatcctggcgagactgaggtgccgctcgacctccccgcagatagtagaaaggaagacgaatatagacgtaatatatggaaaggatttttgatttcaatcccctactccgctagcataggtgggacagcaactttaacaggaacagcccctaatctcatattacttgggcagctcaaaagtttcttcccgcagtgtgacgtggtgaactttggttcttggttcatctttgccttcccgctcatgcttctgtttcttcttgcgggttggctatggatatctttcttgtacggaggattaagtttcagaggctggaggaagaacaaatcggagatccgcactaacgccgaggatcgcgcacgtgcggtcattcgggaggaataccagaacttgggtcctatcaagtttgccgagcaggcggtctttattctgttctgtatgttcgctatcctgctgtttactagggacccaaagttcattccaggctgggcctccctcttcaatccagggtttttatcggatgcagtcacaggcgtcgccattgtcactatcttgttcttttttccgagccagaggccgtccctgaaatggtggtttgattttaaagcaccaaatacagagactgaaccactcctgacttggaagaaagcacaggagacagtgccatggaacatcatcctactgctgggcggagggttcgcaatggcaaagggttgcgaggagtctggactgtctgtctggattggagggcagctgtag

SEQ ID NO: 241015 - DNA, 1668 bp, Artificial Sequence
  Description of Artificial Sequence: Synthetic coding sequence
atggctgtatactggtgcactgaggcactcccattgagtgttaccgccctgctgcctatagtgctgttcccgttcatgggtatcttgcctagcaataaggtgtgccctcaatactttctcgatactaactttctgttcctgagcggtctgatcatggcaagtgccattgaggaatggaatttgcatagaagaattgctttaaagatcctcatgttggtgggcgtgcaaccagccaggctgatcctgggaatgatggtgaccacgagtttcctgagcatgtggttgagtaacaccgcgagtactgccatgatgttgccgatcgccaacgcaatcctgaaaagtctgtttggacagaaagaagtccgcaaagacccttcccaggaaagtgaggaaaataccgccgcagtgaggcgcaacggactgcataccgtgcccaccgaaatgcaattcttagccagtaccgaagcaaaggatcatccaggggagaccgaagtccctttggatttacctgccgatagtcgtaaggaggacgaatatcgaaggaacatttggaagggatttctgatcagcatcccttattccgccagtatcggtggtacggccacgctgacagggaccgctcctaacctcatcctactagggcaactgaaaagtttctttccccaatgcgatgtcgtaaatttcgggtcttggttcattttcgccttcccgctgatgttgctgtttttactagccggatggctgtggatcagcttcttgtacggaggactgtccttccgaggatggcggaaaaataagagcgagattaggacgaacgctgaggatcgcgcacgagccgttatcagggaggagtatcagaatctgggcccaattaagtttgccgaacaggctgtgttcatcctcttttgcatgttcgctatcctgctgtttactagagaccctaagttcatccccggttgggcctcactgttcaatcccggatttttatccgatgcagtgaccggtgtggccatcgtgaccatcctgttttttttccctagccagaggccatctttaaagtggtggttcgactttaaagcccctaatacggaaacggagcccctcttgacttggaaaaaagctcaggaaacagtgccatggaatataattctgcttctgggcggtggctttgccatggccaaagggtgtgaggagtcaggtctcagcgtctggattgggggacagctccatccacttgaaaatgtgccgcctgcactggccgtcctgctcataacagttgtgattgctttttttacagaattcgccagcaacactgccactatcattatattccttccagtattggcagaacttgcgataaggctgcgggttcaccctctatacctcatgataccaggcaccgtgggctgcagctttgctttcatgctgcccgttagtacacctccaaactctattgcattcgcatccggacaccttctggtaaaggacatggtgcgcacaggtctcttaatgaatttaatgggggtccttctgctaagcctcgcgatgaacacatgggcccagactatctttcagttgggcacttttcccgattgggccgatatgtacagcgtgaatgtgacagcactccctcctacactggccaacgacacctttcgaaccctgtag

SEQ ID NO: 241016 - DNA, 2763 bp, Artificial Sequence
  Description of Artificial Sequence: Synthetic coding sequence
atgagcgacccacactcttcgccactattacctgagcccttaagctctagatataagctttacgaagctgagttcacaagtccgtcttggccgagtacttctcccgatacccaccccgctcttcccttgttagaaatgcccgaagaaaaagacttacgaagctccaacgaagacagtcacatcgtaaagatagaaaaattgaatgaaagatcaaagcgcaaggacgatggcgtcgctcatcgagattctgctggccagaggtgcatatgtctgtctaaagccgttggttatctcaccggggacatgaaagagtatagaatctggttgaaggataaacacctggctctgcagttcattgactgggtcctgagaggaaccgctcaggtcatgttcatcaacaatcccctgtccggcttaatcatctttatagggctgctcattcagaacccttggtggaccataacagggggactcggtacggtggtcagcactcttactgcattggcactgggacaagaccggtcagctatcgcctcaggtcttcatggctataacggcatgctggtgggattgctcatggccgtcttcagtgaaaagctcgactactattggtggctccttttcccggtgacgttcacagcaatgtcttgtcctgtgttgagcagcgccctgaatagtatcttttctaaatgggacctccccgtgttcaccctcccctttaatattgcggtgacattgtacctggccgcaacagggcactataatctattctttccaacgacacttgtagaaccggtgtcttctgtgcccaatattacctggacggagatggagatgcccctacttttgcaggcaatacctgttggggtgggacaggtgtacggctgcgataacccttggactgggggagtgttcctagtcgcactttttatatcttctccacttatatgtttgcacgccgctataggatctattgtggggttgctggcggcactctctgtggccaccccattcgaaacaatttatacagggttatggagttacaattgtgtgctgtcttgcattgcaattggcggaatgttctatgctctgacctggcagacgcatcttctcgctttgatttgtgcactattctgtgcatacatggaggccgcaatctctaacatcatgagtgtggtgggagtcccccctggaacttgggctttctgtttagctaccatcattttcctgctcctcacaactaataatcccgctattttccgactgcccctttctaaggtgacctacccagaggcaaacagaatttactacctaactgtgaagagtggcgaggaggaaaaagccccatctggaggcggtggtgagcatcctcccacagccggaccaaaagttgaggagggttccgaagcagtgctgtcgaagcatagatcagtttttcacatcgagtggtcctcaatccgcagaagatctaaagtatttgggaaaggggaacatcaggaaaggcagaataaggacccattcccatataggtacagaaagcctacagttgagctgctggatctggataccatggaggagagttccgaaattaaggttgagacgaatattagcaagaccagttggattagaagctccatggctgctagtggcaaaagggtaagcaaggctttgtcttatatcacgggggagatgaaggagtgtggggagggcctgaaggataagtcgcctgtgttccagttttttgattgggttctgcggggaacaagtcaggtgatgttcgtgaataatcccttgtccggcatcctcatcattctcggcctcttcatacagaacccgtggtgggcaattagcggatgtttagggaccataatgagtacactcactgctctcatactgagtcaggataaatccgccatcgcagctggattccacgggtataacggcgtgttggttggtctgctcatggctgttttcagtgacaaaggagactactattggtggctgctcttacccgtgattattatgtccatgagctgtcctattctctccagtgctctcggaaccatcttctccaagtgggacttgcctgttttcaccctgccgttcaacattaccgttaccttgtaccttgcagccaccgggcactataatctcttcttccctaccacactattgcagcctgcgagtgcaatgcccaacatcacgtggtctgaggtccaggttcctttacttttacgggcaattcctgtgggaatcgggcaagtgtacggttgcgacaacccctggaccggtgggatcttcctgatcgctcttttcatatcttctccattgatctgcctccatgctgccatcggatcgactatggggatgttggcagcactcacaatagccacccctttcgattcaatctactttggactgtgcggatttaatagcactctggcatgcatcgcaatcgggggtatgttctacgtgatcacatggcagactcaccttctcgcaatcgcatgcgccctgttcgccgcataccttggcgctgcgctcgcaaacatgctttccgtatttggcctcccaccttgtacatggcccttctgcttaagcgctctcacattcctgctgctcacaacaaacaatccggctatttacaagctgcccctgtccaaagttacgtaccctgaggcaaaccgcatttattatttgtctcaggagcggaataggagagcttcaattataaccaaatatcaagcctacgatgttagttag

SEQ ID NO: 241017 - DNA, 1170 bp, Artificial Sequence
  Description of Artificial Sequence: Synthetic coding sequence
atggaagactctccaacaatggtgagagtcgattctcccacaatggtgcgcggagagaaccaggtgagcccgtgtcagggaagaaggtgctttcctaaagccctcgggtacgtgaccggtgacatgaaagaactggccaaccagctgaaggacaaaccagttgtgctccagttcattgactggatcctgcggggaatttcacaggtggtattcgtgaacaacccagtcagcggtatcctgatcctcgtgggtctgttggtgcaaaatccgtggtgggcgctgactggatggttggggacagttgtatccacactgatggccctgctcctgagtcaagataggagcttaatagcctccggcctgtatggctacaacgctaccttggttggagtgcttatggccgtatttagcgataaaggggactacttctggtggctgttgcttcccgtttgcgctatgagcatgacttgccccattttctcgagtgcactgaactcaatgctgagcaaatgggatttacccgttttcaccctgcccttcaacatggctctgtcaatgtacctgagtgccaccggacactacaaccccttcttcccagccaaactagtaattccaatcaccacagcccctaatatctcttggtctgatctaagcgctctggaactcctgaagtctatcccagttggggtgggacagatttacggctgcgataatccatggacaggaggaatcttcctgggtgccattctcctgtcatcccccttgatgtgcctgcacgccgctatcggctccttgctgggcattgctgcaggcttgagtctcagcgccccttttgaggacatctatttcggactgtgggggttcaactcaagcctcgcatgcattgccatgggcggaatgttcatggccctgacttggcagacccacttgctagccctcggatgtgcactttttaccgcttacctgggtgtgggaatggcaaatttcatggctgaggttgggcttcccgcttgcacctggcctttctgtctggccaccctcctgtttctgatcatgacaaccaaaaacagcaacatctacaagatgcccctgagtaaggtgacttacccagaggagaatagaatcttctatctgcaggcaaagaaaaggatggtggagtccccgctgtag

SEQ ID NO: 241018 - DNA, 855 bp, Artificial Sequence
  Description of Artificial Sequence: Synthetic coding sequence
atggctctgctgctgagccaagacaggagtctcattgcgtcaggcttatacggttacaacgctaccctcgtaggggtcctgatggccgtattttcagacaagggagattatttttggtggctgctcctgcctgtctgcgccatgtccatgacctgcccaatcttcagttccgcgctcaattccatgctgtctaagtgggaccttcccgtcttcaccctgcccttcaatatggccctttctatgtatttaagcgccactggtcattacaatcctttttttccggcaaaacttgtaatcccaatcacgacagcccctaatatctcttggtccgatctgtcagccttggaattgctgaagtcgatccctgtgggggtcggccagatctatggttgcgacaacccatggactggaggtattttcctgggagctatcctgttgagtagtccattgatgtgcctgcatgctgccattgggagcctgctcggaatcgcagcaggtttgtccttgtccgcaccttttgaggacatctacttcggactctgggggtttaattcatcattagcttgtatagctatggggggtatgtttatggctctgacatggcagacacatctactcgctttgggttgcgcactgttcaccgcatacctgggggtgggcatggcgaactttatggccgaggtaggtcttcccgcttgcacgtggcccttttgtctggctaccttgctgttcctaatcatgacaacaaaaaacagtaatatttataagatgcctctgagtaaagtgacttaccctgaggaaaatagaattttttatcttcaggccaaaaagcgcatggtggagagccccctttag

SEQ ID NO: 241019 - DNA, 1338 bp, Artificial Sequence
  Description of Artificial Sequence: Synthetic coding sequence
atgaatggcaggtcactcattggtggggcaggagacgctaggcatggacctgtttggaaggacccttttgggaccaaggccggtgacgcagctcgaaggggaatcgcgcgtcttagcctggcgctggctgacggaagccaggagcaagaaccagaagaagaaattgcaatggaggattcaccaaccatggtacgggtggattctcctacaatggtgcggggagagaaccaggtgtccccatgtcagggacgacgatgcttccctaaagcactgggctacgtgactggggacatgaaagagctcgctaaccaactgaaagacaagcccgtggttttacagttcatcgactggatattacggggtatctcccaggtcgtcttcgttaacaatcccgtgagcgggattctgattcttgtgggcctgctagtacagaacccttggtgggcattgaccgggtggctggggaccgtggtgtccaccttgatggccctcctactgtcacaggacaggtcactgattgccagcggtctgtatggctataatgccactctggtaggggtcctaatggccgtgttcagcgataagggagattacttttggtggctgctcctcccagtgtgcgctatgtctatgacctgcccaatcttttcctccgcactgaatagcatgctatcaaagtgggatttacctgttttcacgctgccattcaatatggccttgtccatgtacctttctgccacaggacattataaccccttcttccccgctaaactggtgatccctatcactaccgctccaaatatcagctggagtgatttaagtgccttagagctgttaaaatctattccagtcggggtaggtcagatctatgggtgtgataacccatggacaggaggcatatttctcggtgcaattctactgtcaagtcctctgatgtgtctgcacgccgcaattggttctttactgggtatagcagctggactgtccctaagcgccccttttgaagacatatattttggactgtggggctttaattcaagcctcgcgtgtatcgcaatgggaggcatgttcatggcactgacgtggcaaacccacttactagcactcggttgtgcactatttactgcttatctcggtgtagggatggcgaactttatggctgaggtaggcttgccggcatgcacttggcctttctgcctggccaccctcctgtttctgataatgaccaccaaaaattccaacatttacaagatgcccctgtcaaaggtaacttacccggaggagaacagaatcttctacttgcaggccaaaaagaggatggtagagtcccctctctag

SEQ ID NO: 241020 - DNA, 1338 bp, Artificial Sequence
  Description of Artificial Sequence: Synthetic coding sequence
atgaacggccgaagcctgatcggaggcgctggagatgcgcgtcacgggcctgtctggaaggatccattcgggactaaagctggggacgctgccaggagaggcattgccaggcttagtctggcattggccgacggcagccaagaacaggaacccgaggaggagatagcaatggaggattcccccaccatggtgagggtggacagccccacgatggtgcgtggggagaaccaggttagtccttgccaaggccgaagatgcttccctaaagcccttggctacgttactggggacatgaaagagctggcaaatcaactgaaggacaaaccagtggttctccagtttatcgattggatccttcgaggtatatcccaagtagtgttcgtgaacaaccctgtcagcgggatcctgatattagttggacttctggtgcagaatccttggtgggctctcacagggtggctgggcaccgttgtctcaactttaatggcattgctattgagccaggaccggtccctgatcgcttcgggactctacggctataatgctacactggtgggcgtgctcatggccgtgtttagcgataagggagactacttctggtggttactgttgcctgtgtgtgccatgtctatgacctgcccaattttctcctccgctttgaacagcatgctgagcaagtgggacctgcccgtcttcacattgccatttaacatggccctgagtatgtatctcagcgctacgggacactacaacccctttttccccgcaaagcttgtgattccaattaccacagcacccaacatcagctggtcggacctgtcagctttagagctgctcaagtccatccccgtgggggtgggccagatctacggatgtgataacccgtggacgggcggtatcttcctgggagctattctgcttagctcccctctgatgtgcctgcatgcagccataggctccctgctcggaattgccgcaggtctctctctgtcagcccctttcgaggatatatatttcggactgtgggggtttaactccagtctagcttgcatcgcaatgggaggaatgttcatggcgctcacgtggcaaacacatttactcgcactcggatgcgccttgtttacggcctacctaggagtgggcatggcaaattttatggctgaggtgggcctgcccgcatgcacttggcctttctgccttgcaacccttcttttcttgatcatgaccacaaaaaatagcaacatctataagatgccgctctcaaaggttacgtaccccgaggaaaataggattttctacctgcaggctaaaaagaggatggtagagtcccccctgtag

SEQ ID NO: 241021 - DNA, 645 bp, Artificial Sequence
  Description of Artificial Sequence: Synthetic coding sequence
atgaatggacgcagtctgatcggtggagcaggtgatgcccgacacgggcctgtctggaaggatcctttcgggaccaaagctggagatgcggctcggaggggaatcgctagactgagtctggccttagccgacggatcacaggaacaggagcctgaggaggaaattgccatggaagactccccaacaatggttcgggtagactctcccaccatggtccgaggagaaaaccaggtatcaccatgccagggacggaggtgttttcccaaagcacttggctatgtgaccggagacatgaaagagctcgcgaatcagctcaaggacaagcctgtagtcctgcagtttatcgactggattcttagggggatttcacaggtggtttttgtgaataatcccgttagcgggattttgatactagtcggcttgttggtgcagaatccctggtgggccctaaccggttggctcggcaccgtggtttcaactctgatggccctgctactgagccaagatcgctcactgattgcctcaggtctgtacggatataatgccactctggtcggcgtgctgatggccgtgttctcagacaagggggattatttctggtggttgctgcttcctgtctgcgcaatgtctatgacttgttgctag

SEQ ID NO: 241022 - DNA, 846 bp, Artificial Sequence
  Description of Artificial Sequence: Synthetic coding sequence
atgggtcgacggaatcgttcgctaatagcttcagggttatacgggtataacgcgacactcgtgggtgtgctcatggccgttttctctgataagggggactatttctggtggttgctgctaccggtgtgtgctatgtccatgacttgtcccatatttagcagcgctctcaactcgatgctgagcaaatgggatcttcctgtgttcactcttcccttcaacatggctttgagtatgtacttgagcgcaacgggacactataaccccttctttcccgcaaaactggtgatacccattacaaccgcacccaacatcagctggtctgatctgagcgcgttggagctcctgaaatccatcccagttggggtcggccagatctatggctgtgacaacccgtggacaggcggtatttttctgggcgctatcctgttgtcctcccctctcatgtgtctacacgctgcgattggctctctgctgggtattgcagctggattatctctatctgccccttttgaagacatatattttggactctggggatttaattccagcctggcctgtattgccatgggaggcatgttcatggcgctgacctggcagacccatctgctcgccctgggttgcgccctgttcactgcatatcttggggtgggaatggcgaatttcatggccgaggtgggcttgcccgcatgtacatggcctttttgcttggctacgctgttgtttcttatcatgaccactaagaatagtaacatttacaagatgccacttagcaaggtgacctatccagaagagaataggattttctatctccaggctaaaaagcgcatggtcgaatcccccctctag

SEQ ID NO: 241023 - DNA, 774 bp, Artificial Sequence
  Description of Artificial Sequence: Synthetic coding sequence
atggccgtcttcagcgataaaggtgattacttctggtggctgcttctgcccgtttgcgcaatgagtatgacttgccctatctttagctcagcgctcaattctatgctcagcaagtgggacttgccagtgttcacacttccctttaacatggctttaagtatgtacttgtctgctacaggacattacaacccattttttcctgcaaagttggtaatccctattacgacagcaccaaacatctcttggtccgacctctctgcactcgaactgctcaaatcaatcccagtgggggtgggccagatatacggttgtgacaacccctggaccggaggcatatttctgggtgccatcctccttagttctccactcatgtgcttgcacgccgctatcggcagcctgctgggcattgccgcaggacttagcttaagcgctccatttgaggatatatacttcggcctatggggtttcaatagttcccttgcgtgcattgcaatggggggtatgttcatggcgctgacctggcagacacatcttctggctttaggctgcgccctctttaccgcgtatctcggcgtggggatggccaatttcatggctgaggtgggtctgccggcttgcacttggccattctgccttgccacccttttgttcctcattatgaccacaaaaaacagcaacatctacaaaatgccgctgtcaaaagttacctaccccgaggaaaacagaattttctatctccaggccaagaagcgaatggtcgagtcaccactgtag

SEQ ID NO: 241024 - DNA, 2763 bp, Artificial Sequence
  Description of Artificial Sequence: Synthetic coding sequence
atgtctgacccacactcatcaccactgttaccagagcctctcagtagtagatacaagctgtatgaggccgagtttactagcccatcttggccgagtacgtctcctgatactcacccagctctaccactgctggagatgcctgaggaaaaggacttacgcagttctaacgaggactctcacattgtcaagattgagaaactgaacgaaaggtcaaagaggaaagacgacggcgttgcccatagggactcggcgggacagcgctgcatttgtttgagtaaagcagtagggtacttgacaggtgatatgaaggagtacagaatatggctgaaggacaagcacctggcactgcagttcattgactgggtcctcaggggtacagctcaggtgatgttcattaacaatcccctgagcggactaataatctttataggccttctgatccagaacccttggtggacgataaccgggggactggggacagtggtgtccactcttacagcccttgctctcggtcaagaccgatccgcgatcgcttcaggccttcatgggtataatggcatgctcgtagggttattaatggcagtgtttagtgaaaagctggactattactggtggctgctgtttcctgtcacttttacagccatgagctgcccagtcctttcatccgctctgaacagtatcttttctaagtgggacttgcctgtctttacactgccctttaacattgcagtgaccctgtacctggctgccaccgggcactacaatctgtttttcccgacaacactcgtggagccagtcagctccgttcctaacatcacatggacagagatggagatgccactactgctacaggcaatcccagtgggtgtgggacaagtctacggctgtgataatccatggacagggggagtgttcctggtggctcttttcatcagtagcccgctcatctgtttgcacgcggctatcggttcgatcgtcgggttgctcgccgcattaagtgtggctaccccctttgaaacaatatacacaggtctgtggtcatataattgcgttctgtcgtgtatagccattggcggtatgttttatgcattgacatggcaaacgcatttgcttgcactgatttgtgccttgttttgcgcctacatggaggcggctatttccaacatcatgtcagtcgtgggcgtccccccaggcacctgggccttttgcctcgctacgatcatcttcttgctgctgactacgaacaatccagcgatatttcggctgccactcagtaaagtgacctatcctgaggcgaatcgaatatactaccttaccgtaaagtcaggagaagaggagaaggcgccaagcggcggtggaggcgaacacccaccaaccgctggcccaaaagtggaggagggttctgaggccgtcctgtcaaaacatcggtcagtcttccatatcgaatggtcctccatcagacgacggagtaaagtgttcggaaaaggagaacatcaagagaggcaaaataaggacccctttccttacagatacaggaagcctactgttgaattgttagacctggatacaatggaagagtcaagcgaaattaaggtggagacaaatatctctaagacgtcttggattaggagctccatggccgctagcggtaagcgggtgtccaaggccctctcatatatcaccggggagatgaaagagtgtggagagggacttaaagacaaatccccggtttttcagtttttcgattgggtattacgcggaacatctcaggtgatgttcgtcaacaatcccctgagcggcatcctgatcatcctgggcctcttcatacagaatccttggtgggccatctctggctgtttgggaaccatcatgagtacactgacagctctcatcctgtcccaggacaaatctgctatcgctgcaggcttccatgggtataacggcgtgcttgttggcctgctgatggccgtcttttcagacaaaggtgactactattggtggctgctgctgcccgtcattattatgagcatgtcatgcccaattctcagcagcgccctgggtaccattttctctaaatgggatctgcccgtcttcactctcccattcaacattactgtcactctgtacctcgcagcgacaggacactataatcttttttttccaaccaccttgctgcagccagccagtgccatgccaaatatcacctggagtgaggttcaagtccctttgttgctccgcgcaatacccgttggcatcggccaggtttatgggtgtgacaacccttggaccggtggaatttttctcatagcattgtttatctcctcacctctgatctgcctgcatgcagccattggatctacgatgggcatgctggcagccctcaccatcgcgactccctttgacagtatttactttggcctgtgcgggtttaacagcaccctggcctgtatcgccattggtggcatgttctatgtgatcacctggcagacccatctcttagcgatcgcttgcgccctgttcgccgcttacctcggcgcagcgctcgcgaacatgctgagtgtcttcgggctgcctccatgcacctggccattttgtctgtcagccctgacctttttgctacttaccaccaataaccccgctatatataaactgccgttgtcaaaggtgacatacccggaggccaatcggatctattacctgtctcaggagagaaatcggagagcttccatcattacaaagtatcaggcgtacgatgtcagctag

SEQ ID NO: 241025 - DNA, 708 bp, Artificial Sequence
  Description of Artificial Sequence: Synthetic coding sequence
atgtccgacccccattcatctcctcttctccccgagccgttatccagtcgttataagctctatgaagctgaatttacatccccctcatggccctcaaccagccctgacacacaccctgccctacctctgctggaaatgcctgaagagaaggacctgcggtcgtcaaatgaggactcccacatagtcaaaatcgaaaaattgaacgagagaagtaagaggaaggatgacggcgtcgcccatcgtgattctgcaggacaaaggtgtatatgtctgtctaaggcagtgggttacctgacaggcgatatgaaggagtacaggatctggctgaaggataagcacttggccctgcaattcatagactgggtgctacgcggaacagctcaagtcatgttcattaacaaccctttatcagggctgattatttttatcggcctgttaattcagaatccatggtggacaatcacaggtgggcttgggaccgtggtgagcacattgactgccctggctcttgggcaagaccggtcagccatcgcctctgggctccacggttacaacggaatgttagtaggcttgttaatggccgtcttctccgagaaattagattactactggtggctgctcttcccggtcaccttcaccgctatgagttggatggagacagacttcaattggtcaaagtcaggatgttggaagcatctcctgcagtag

SEQ ID NO: 241026 - DNA, 627 bp, Artificial Sequence
  Description of Artificial Sequence: Synthetic coding sequence
atggatcagtggggagtgtattttaatcctgtcttggtaagtttttgccaatccttctttggttaccctctgtcaatcttctttattgtggtgaacgagttttgcgagcgattctcttattacggcatgcgcgctatcctgatcttatacttcacaaattttatcagctgggatgacaacttgtctacagccatttatcatacttttgtggccctgtgttacttgacaccaatactgggagctctgatcgccgactcttggctggggaagtttaagactatcgtgtccctttccatagtttacaccattggacaagctgtgacgagtgtgagctcaattaatgacctcactgaccacaatcacgatggaacccctgatagcctccccgtacacgttgttctctccctgattgggctagcactcattgcactgggcacaggaggcatcaaaccctgtgtctcagctttcgggggagatcagttcgaggagggtcaggagaagcagaggaatcgctttttctcaatcttctacttagccattaacgctggatctctcctaagtactattattacccccatgctgagaggaaagcgatacttaaagggaaccagcgtcggcttattctag

SEQ ID NO: 241027 - DNA, 849 bp, Artificial Sequence
  Description of Artificial Sequence: Synthetic coding sequence
atgagagccatcctcatactgtatttcactaactttatttcctgggatgataatctctcaaccgccatataccacacctttgtagcgctgtgttaccttacccccatactgggagccctgattgccgatagctggttgggtaaatttaagaccattgttagcttaagcatcgtctacactattggtcaagctgtcacttccgtcagctctatcaatgatctcaccgaccacaatcatgatggtactcccgactcccttcccgtgcacgtggtgctgtctttaatcgggctggccctgatcgccctgggaacaggaggtatcaaaccgtgcgtaagtgcctttgggggagaccagtttgaggaggggcaggaaaaacagcggaaccgcttcttctccattttctatttggccattaatgccggttccctgctgagcactattataacacccatgctgagagggaagcgctatctgaagggcacaagcgtgggactattccttgtgcgccctagcccatgtctcctaagattcgtactgttttttccctcggctctgtttagctcatgccaactgcacgctggcatgcacgtgggaatttggtcaaagtgtttcctgccttgtgagtttcacttgctgtttgtcctgttcaagtccctgatccccgtcacaactggcgagagtaaaccctcacttgcttgggctagcatcttcctcaattgctactcttgcaaagtcatgctggttgtccggggtaagaggcaagaacgctgtctgggaagccaggcagggggtagatcctgtcacttcagcctgcaggcactgctgccttcagacatatctgtcacgtag

SEQ ID NO: 241028 - DNA, 2127 bp, Artificial Sequence
  Description of Artificial Sequence: Synthetic coding sequence
atgggcatgagcaagtctcactctttttttggctacccgctttcaatttttttcatagtagtgaacgaattctgcgaaaggttctcatattacggcatgcgcgctatcctcatcctatactttacaaatttcatctcgtgggacgataatctatctaccgcaatttatcacacatttgtcgccctgtgctatttgacaccaatactgggggctcttattgcagactcctggcttggaaaattcaaaacgattgtgtcactcagcattgtctacactatcggtcaggccgtcacctccgtgagctccattaacgacttaacggatcacaatcacgatggcacaccagactccctgccggttcatgttgtcttatccctaattggccttgcactgattgcgctgggaactgggggaatcaagccatgtgtctccgcctttggaggagaccagttcgaagagggtcaggagaagcagcgtaataggtttttctccattttctacctcgctataaacgccggttcgctgctgtcaactattattactcccatgttacgcgttcagcagtgcgggattcactctaagcaggcttgctatccactcgcctttggtgttcccgctgctctgatggcagttgccctgatcgtttttgtgctaggtagtggcatgtacaagaaattcaagccccagggtaacataatgggcaaggtggccaagtgcatcggtttcgctatcaaaaatcggtttaggcatcgtagcaaggcttttcccaagagagaacattggctggattgggcaaaagagaaatacgatgaaaggctgatctctcaaattaagatggttacccgagtaatgttcttatatatccccctgcctatgttctgggcactgtttgaccagcaaggcagtcgatggactctgcaggctactaccatgagcggtaagatcggtgcgctggaaatccaaccagatcagatgcagacagttaacgcaattcttattgtaattatggtccccatcttcgatgcggtgctgtatcccctgatcgctaaatgtggctttaactttacttcccttaagaagatggctgtaggtatggtcctggcttcgatggcctttgtcgtggctgctatcgtgcaggtggagatcgacaagacattgcccgtatttcccaaaggcaacgaagtacagatcaaagtgttgaatatcggcaataacaccatgaacataagccttcctggggagatggtgaccctgggccctatgtcacagactaacgcctttatgaccttcgacgtaaataaactgacacggatcaatatctctagtcccggttcaccagtgacagccgtgactgatgacttcaaacagggccagaggcatacacttttggtatgggctccaaaccattaccaagtcgtcaaggacgggttaaatcagaagccagagaaaggagagaatggtatacggttcgtgaatacgttcaacgaactcataaccataaccatgagcggcaaagtatacgccaatatttcttcctacaacgcgtccacgtaccagtttttcccctccggaatcaaaggatttactatcagcagcaccgaaatccccccacaatgccagcccaacttcaacacattttatctggaatttgggagcgcttacacgtacatcgtgcagagaaaaaacgatagctgtcctgaggttaaagtgttcgaagacattagcgcaaatacagttaacatggccctgcagattccacaatacttcctcttgacatgcggtgaggtggtcttctcagtaaccgggctggaattcagctactctcaggcgccatcaaacatgaagagcgtgctccaggcaggctggctgcttaccgtggcggtaggcaacatcattgtgctgattgtcgctggtgccggacaattttccaagcagtgggccgagtacattctcttcgcagctctgttactggtggtgtgtgtgatctttgccattatggccagattctacacctacataaatcccgcagaaatcgaagcccagttcgacgaggacgagaaaaaaaatcggttggagaaatccaatccttattttatgtctggcgcaaactcacagaaacaaatgtag

SEQ ID NO: 241029 - DNA, 1503 bp, Artificial Sequence
  Description of Artificial Sequence: Synthetic coding sequence
atgcccccagcggttggcggtccggtcggatacactcccccagacggcggttggggctgggctgtggtgataggcgcatttatttcaataggcttcagttacgctttcccaaagagtatcacagtgttcttcaaagaaatagaggggatctttcacgccaccacttcagaggtgtcctggatctcaagcattatgcttgcggtgatgtatggaggcggaccgatctcgtccatcctggtgaacaagtacgggagccgcattgtcatgattgttggagggtgcctgtcaggctgcgggctgatagcagcctctttctgtaacacagtgcaacagttatacgtttgtatcggtgtgatagggggtctcggcttggctttcaatctgaaccctgcgctgactatgatcggaaaatatttctacaaaaggaggccgttagcaaatggactcgcgatggcaggcagtcccgtattcctttgcacactggcacctctgaatcaggtttttttcggcatatttgggtggcgagggagcttcctaatactgggcggactcttgctgaattgttgcgtggcgggtgcgctgatgcggccaataggtccaaaaccgacaaaagccggtaaggataagagcaaggcctcattggagaaggctggtaaatctggcgtaaagaaagatttgcacgacgcaaacacagatttgattggtcggcatcctaagcaggagaaacgtagtgttttccagactatcaaccaattcctggacctcactctgttcacccatcgtggctttctcctttatctgtcgggaaatgtgattatgttttttggtctgtttgcacccttggtctttttatcatcctacggtaaatctcagcactactccagcgaaaagagcgcattcctgctatccatcctagcttttgttgacatggtcgcacgccctagcatgggcctggtggccaataccaagccaatccgaccgcgaatacagtactttttcgctgcttccgtggtcgccaatggagtatgtcacatgctagcgcctctctccaccacctatgttggattttgtgtctacgccggattctttggcttcgcttttggatggctgagttcggtcctgtttgagacgcttatggacctagtggggcctcagcgtttcagcagcgccgtggggctcgttactatcgttgagtgctgcccagttctactgggtccacccctgctcggacgcctgaacgatatgtacggcgattacaagtatacatattgggcctgcggagtcgtgcttattatctctgggatttatctgttcattgggatgggcattaattaccggttattagctaaagagcaaaaagcgaacgagcagaaaaaggaatccaaggaggaggaaacgtcaatcgatgttgcgggaaagcctaatgaggtaacaaaggccgctgagtcccctgatcagaaggacaccgacggcggtccaaaggaggaggagtcccccgtatag

SEQ ID NO: 241030 - DNA, 648 bp, Artificial Sequence
  Description of Artificial Sequence: Synthetic coding sequence
atgcctcccgcagtgggtggaccagtgggctatacgccccctgacgggggatggggttgggcagttgtaatcggggcattcatcagcatcggcttttcctacgctttccccaagtctataaccgtcttttttaaagaaatcgaggggatcttccatgctaccacctctgaagtctcttggatcagttccatcatgctggccgtgatgtatggcggagggccaatctcgtccatcttggtaaacaagtatggtagcaggatcgtcatgatcgtcggcggttgcctgagcggttgtggcctgatcgctgcatctttttgcaacacagtgcaacagctctacgtctgtattggtgtaattggcggactcggtttggctttcaatttaaaccccgctctgacaatgatcggtaagtacttctacaagcgcagaccattggccaatggcctggcaatggccggtagtcctgtattcctttgcaccctggcaccgctcaaccaggttttttttggcatattcggctggcggggtagcttcctcatcctggggggacttctgctgaactgttgtgtggcgggagccttgatgcgtcctatcgggccaaaaccaacaaaggccggaaaggataagagcaaggcctctctagagtag

SEQ ID NO: 241031 - DNA, 1293 bp, Artificial Sequence
  Description of Artificial Sequence: Synthetic coding sequence
atgccccctgccgttggcggtccagtcggttatacccctccagacggcggatggggttgggccgtcgttattggagcctttatttctattggtttcagctatgctttccccaaatccatcactgtattctttaaggaaatcgaggggatctttcacgccacaactagtgaggtcagctggatatcttctattatgctcgccgttatgtatggtggcggacccattagttctatactcgttaataaatatggttcacggattgtgatgatcgtaggcggttgcctatccggctgcggtctgatcgccgcatccttctgtaacacggtgcagcagctgtacgtctgtatcggtgttattggcggtctgggtttagctttcaacctgaacccagccctaacaatgatcggcaaatacttctataaacgacggcctctggctaatgggctcgcaatggccggttcccctgtgttcttgtgcactcttgcccctctcaatcaagttttttttgggatttttggatggcgcggtagttttctcatcttagggggactgctactgaactgctgcgtggccggtgctctcatgcgacctatagggccaaaaccaaccaaggcaggaaaggataagtctaaagcttccctggagaaagctggcaagtcaggggtcaaaaaagacttgcacgatgccaacaccgacctcattggacgccacccaaaacaggagaaaaggagcgtattccagacaatcaatcagtttctggacctaactttgttcacgcatagaggattcctgttatatctgagcgggaatgtcatcatgtttttcggtctgtttgccccactggtgtttctatcaagctatggcaagtcccagcactacagttcagagaagagcgctttcttactgtccatcctggcattcgtcgacatggttgccaggccgtctatgggtctggttgctaacaccaagccgatcaggccgcgaatccaatacttctttgccgcatccgtggttgctaatggcgtgtgccatatgcttgcaccactgtctacaacttacgtgggattctgcgtgtacgctggctttttcggcttcgccttcggctggctctctagcgttctgtttgaaaccttgatggacctcgtgggcccacagcgtttctccagcgccgtgggcttagtcacaattgttgagtgttgcccagttctacttggccctccactcctgggcatcgtgtacctgcctacaaatgtgggtcttcttcagaataaacacgtaaggtgggagtgttag

SEQ ID NO: 241032 - DNA, 891 bp, Artificial Sequence
  Description of Artificial Sequence: Synthetic coding sequence
atgcctcccgcagttgggggacctgtcggatatacaccaccagacggcggatggggctgggccgtggttatcggcgcatttatctccatcggtttttcatatgctttccctaagtctattacagtgttctttaaggagattgaggggattttccatgcgactacaagcgaggtatcttggatctcatctatcatgctcgccgtgatgtatggcggtgggccaattagctctattctcgttaacaaatacggctcccgaattgtaatgatcgtgggcggttgtctgtctgggtgcgggctcatagcagcatctttctgcaacaccgtccagcagctgtatgtatgtataggtgtgattgggggactgggtctcgcattcaatctgaaccctgccctcaccatgatcggaaaatacttttacaaaagacgcccacttgctaatggactggcgatggccggaagccccgtatttctatgcaccctcgctccactaaaccaggtcttctttggcattttcgggtggaggggatcatttctgatccttggtggcctgttgctcaattgctgtgtggccggagctctgatgcggcctattgggcctaaacctactaaggccggaaaagacaaatccaaagccagcttagaaaaagctgggaagagcggcgtgaaaaaggatttgcatgatgccaacactgacctgatcggaagacaccccaaacaggagaagcgtagtgtgttccaaaccatcaaccaattcttagacctaaccctgtttactcatcgcggattcctgctgtacttgagcggcaatgttatcatgtttttcggactctttgcgcctctcgtatttctgtctagctacggaaagtctcaacactatagcagcgagtag

SEQ ID NO: 241033 - DNA, 1371 bp, Artificial Sequence
  Description of Artificial Sequence: Synthetic coding sequence
atgccaccggctgtggggggtccggtcgggtatacccctcccgatgggggttggggttgggcggtcgtaataggcgcttttatatcgataggtttctcatatgccttcccaaagtcaattaccgttttctttaaagaaattgagggtatctttcatgctaccacttcagaagtgtcatggattagctcaatcatgttggcagtcatgtatgggggagggccaatctcctccatccttgtgaataagtacggcagcagaattgtgatgatcgtggggggatgtttgtcgggttgtggtctcattgccgcttctttttgcaacactgttcagcagctctacgtttgtattggtgtcatcggaggtctcggactggccttcaacctaaatcccgcactgacaatgataggtaagtatttctacaagagaagacccttagctaacgggttggcaatggccggaagccctgtgttcctgtgcactcttgcccctcttaaccaggtcttctttgggatcttcgggtggcgcggatcctttttgatactaggcggtctcctgttgaactgttgcgtcgcgggagccctgatgcgtcctatcgggcctaaaccgacgaaagcgggtaaggacaagagcaaagcatctttggagaaagccggaaagtccggagttaagaaggatctgcacgatgcaaatacagacctgataggtagacatccaaagcaggaaaaaaggtccgtctttcagaccattaaccaatttctggacctcaccctcttcactcatcgtggttttcttttgtacctcagcggcaatgtcattatgttttttggactgttcgcaccactggtcttcctcagttcctatgggaaaagccagcactactctagtgagaaatccgcatttctgttatccattctcgccttcgtggacatggttgctcggccatccatgggactggtggccaatacaaagcccattaggccccgtatccagtacttctttgctgctagcgttgttgccaacggcgtatgtcatatgctcgctcccctgtcgaccacctatgtcggattctgtgtctatgcaggatttttcggattcgcattcggctggctgagcagtgtgttgtttgagactctgatggatttagtgggcccacagaggtttagtagtgccgtcggtctcgtcacaattgtcgaatgttgtccggtgctgctgggcccacccttgctcggccgacttaacgacatgtacggcgactataagtacacctactgggcctgcggtgtcgtgttgataatttcagggatctacctgttcattggcatgggaattaactacagactgttggcgaaggaacaaaaggctaacgagtag

SEQ ID NO: 241034 - DNA, 1503 bp, Artificial Sequence
  Description of Artificial Sequence: Synthetic coding sequence
atgcccccagctgtgggcggacccgttgggtatacaccccctgacggagggtgggggtgggccgtggttattggggctttcatctccattggctttagttatgcatttcctaaatccatcactgttttttttaaagaaattgaaggcatcttccatgcaactacttccgaagttagttggatcagctcaatcatgctggccgtcatgtatgggggaggaccaatcagttcaatcctggtgaataagtatggaagtcgcattgtgatgatagtaggcggttgcctcagcggctgcggcctcattgcggctagtttttgtaatacagtgcagcaactttacgtctgcattggggttatcggaggactgggcctcgccttcaacctcaaccctgccctcacaatgatcggtaaatatttctataaacgaagacctctcgctaatggactggccatggccggttctcctgtgttcctttgcaccctggcacctcttaaccaggtcttttttgggatctttggttggcgcggaagctttctcatactcgggggtctgttacttaattgctgtgttgctggcgcattgatgagaccaattggaccaaaacctaccaaggcgggtaaggataagtccaaggccagtctggaaaaggctgggaagtcaggtgtcaagaaagaccttcacgacgcaaatacagatctcatcgggaggcacccgaagcaagagaagaggagcgtcttccaaacaatcaaccagtttttggatcttaccctgtttacccatcgcggattcttgctgtatttgagcggcaatgtgattatgttttttgggctcttcgcacccctggtgttcctgtcatcatacgggaaaagccagcattacagttcagagaaatctgcatttctgctgagtatcttggcattcgtggatatggtggctcgcccatctatggggctggttgccaataccaagcctatccggccaagaatccagtattttttcgctgcatcggttgtggcgaatggagtgtgccatatgctggctccgctgagtactacatacgttggtttctgtgtgtacgcagggttctttggatttgcttttgggtggctgtccagcgtcctgtttgagaccctcatggatctggtgggacctcagcggttcagctccgccgttggccttgtgactatcgttgaatgttgcccagtgctgctcggacctcctctgctgggcagactgaacgacatgtatggagactacaagtacacctactgggcttgcggggttgtcctgattatatccggtatctacttattcataggtatgggcatcaattatagactgctggccaaggaacaaaaggcaaatgaacaaaagaaagaatcaaaggaggaagagacttcaattgatgtggccggtaaacctaatgaagtcaccaaggccgcagaatcacccgaccaaaaagatacagacggcggtcccaaggaagaggagagccccgtctag

SEQ ID NO: 241035 - DNA, 606 bp, Artificial Sequence
  Description of Artificial Sequence: Synthetic coding sequence
atgaagcatgtgaacgagcgcttccaagacgaaaagaacaaagaagtcgtgctgatgtgcataggggtgacttccggcgttggacgacttttattcgggaggatagccgattacgtccccggagtcaagaaagtgtacctccaggtgctgtctttttttttcattggcctgatgagtatgatgataccactgtgcagtatattcggagcactgatagcagtctgtctgattatgggactcttcgacggttgttttatatccatcatggccccaatagcttttgaattggttggggctcaggatgtgtcacaagccattggatttctgctaggcttcatgagcataccgatgacagtggggccacctattgccggacttctgcgcgataagcttggatcctacgacgtggccttctatctggctggcgttcctcccctaatagggggagctgtgctttgcttcatcccctggatccactctaaaaagcagcgcgagatcagcaagaccacgggcaaagagaagatggagaagatgctcgagaatcaaaacagcctcctgtcgtctagctccggcatgttcaagaaggaatccgactcgattatctag

SEQ ID NO: 241036 - DNA, 1548 bp, Artificial Sequence
  Description of Artificial Sequence: Synthetic coding sequence
atggttctgtcccaggaggaacccgacagtgcccgtggtacctccgaggctcaaccattgggaccggcaccaaccggggctgcgcctcctcccggtcctggtccttccgatagccccgaggccgcagtggagaaagtggaggtggaattggccggaccagccacagccgagcctcacgaaccgccagagccgcctgagggaggctggggttggcttgttatgttagctgcgatgtggtgcaacggttccgtgttcggaatccagaacgcctgtggcgtattattcgtatctatgcttgaaactttcggtagcaaggatgatgacaaaatggtgtttaaaaccgcctgggtaggttcactgagtatgggcatgatcttcttctgttgcccgattgtgagtgtgttcacagatcttttcggttgcagaaagacagctgtcgtaggagcagcagtaggattcgtcggacttatgtctagtagtttcgtgtccagcatcgagcctctgtacctgacctacgggattattttcgcctgcgggtgttctttcgcctaccagccaagcctcgtgattttagggcattactttaagaagagacttggcctggtgaatgggattgtgacagcaggctcgtcagtgttcaccatcctcctccccctgttactccgggtcttaatcgacagcgtgggattgttttacacattgagggtgctctgcatctttatgtttgtcctgtttctggccggtttcacatataggccactcgccacaagtacaaaggacaaggagtctgggggatcaggaagtagcctgttcagtcgtaaaaaattcagcccacccaaaaagattttcaacttcgctatttttaaggttacagcatacgccgtgtgggccgtgggcatcccactcgcattatttggatatttcgttccatatgtgcatctgatgaagcacgtcaacgaacggtttcaggatgaaaaaaacaaggaagtggttctgatgtgtatcggtgtcacatcgggcgtcggccgacttctgtttggcaggattgccgactacgtgccgggagttaagaaggtgtacttgcaagtcctgtcgttctttttcattggtctgatgagcatgatgattcccctctgttctatctttggagccttgatcgccgtctgtttgataatgggcctgttcgatggttgttttattagcattatggccccaatcgcctttgagctggtgggagctcaggacgtgtcacaggccatcgggtttctccttgggtttatgagcataccgatgactgttggcccaccaattgccggattactgagggacaagctcgggtcctacgacgtcgctttctatctggcaggagtccctccacttatcggcggagccgtcctctgcttcatcccctggattcacagtaaaaagcagcgggagatctctaagaccaccggcaaggaaaagatggaaaaaatgcttgagaaccagaacagcctgctgtcatcatctagcggaatgttcaagaaagagagcgatagcataatctag

SEQ ID NO: 241037 - DNA, 651 bp, Artificial Sequence
  Description of Artificial Sequence: Synthetic coding sequence
atggtgttcaagactgcctgggtcggctccctgtctatggggatgatttttttttgttgtccaatagtctccgtctttactgatctatttgggtgccgcaaaacagccgtggttggcgctgcggtgggcttcgttggcctgatgagcagttcctttgtgagcagcatcgagccactgtacttgacttacggcattatcttcgcatgtggctgtagctttgcataccagcccagcctggttattcttgggcactacttcaagaagcgccttggcctggtgaatggtattgtgaccgctggaagctcagtgttcaccatcctgcttccgcttctgctgagggtgctcatagactccgtggggctcttctatacactgagagtattatgcatctttatgtttgtcctttttctggctggctttacctatcggccactggccactagcacgaaggacaaggagtcaggagggtccggctcgtccctcttttcccgcaagaaattttctccacccaaaaagatctttaatttcgccatcttcaaagttacagcatatgccgtttgggccgtgggaattccgctcgccttatttggatactttgtgccatacgttcatctggccaaattctcattcgttatcctgaaatatgagtag

SEQ ID NO: 241038 - DNA, 636 bp, Artificial Sequence
  Description of Artificial Sequence: Synthetic coding sequence
tgatgggtaggcagcctgagtatggggatgatttttttctgctgcccaatcgtgtcagtgttcaccgacttgttcggatgccgaaagactgcagtggtgggcgcagctgtgggcttcgtgggtcttatgagttcttcattcgtgtcgtcaatcgagcctttgtacctgacatatggaatcatcttcgcatgcgggtgctcttttgcctaccagcccagtcttgtcatactagggcactacttcaaaaagcgcctcggcctcgtcaacggcattgtaacagctggcagcagcgtcttcacaattctcttaccccttctgctccgagtgctcatcgactcagtgggattattttacacacttcgtgtgctgtgcatcttcatgttcgtcctgtttctggccggtttcacttacagacctctggcaactagtaccaaggataaagaaagtggtggctctggaagctccctgtttagtcggaagaaattttcacctcccaagaaaatattcaattttgctatctttaaggtgaccgcctacgcggtttgggcagttggaattccgctcgcattgttcggttactttgttccctacgtccatcttgcaaagttcagtttcgtgattctgaaatacgaatag

SEQ ID NO: 241039 - DNA, 621 bp, Artificial Sequence
  Description of Artificial Sequence: Synthetic coding sequence
taatgggtgggatccctcagcatgggaatgattttcttttgctgtccaattgtgagcgtgttcacagatctcttcggatgccggaagaccgcagtggtgggagctgcagtagggttcgtagggctcatgtcatcttcattcgtgagcagcatcgagccactgtatctgacttacggaatcattttcgcctgcggttgttcttttgcctaccagcccagcctagtgatcctgggtcactattttaagaaacggttagggcttgttaatggtattgtaacggctggttcaagtgtcttcaccattctgttaccactgctgctccgggtgcttattgactccgtgggcttgttttatacactacgggttctgtgcattttcatgtttgttctgttcctggcagggtttacttacagacccctggcaactagtactaaggataaagagtcaggaggtagcggcagctccttgttttcgaggaagaaattctcaccacctaaaaagattttcaactttgcaatatttaaagtgacagcatacgccgtgtgggctgtcgggatacctctggcactttttggttacttcgtcccctatgtgcacctcgtgtctatgctgctgcactag

SEQ ID NO: 241040 - DNA, 981 bp, Artificial Sequence
  Description of Artificial Sequence: Synthetic coding sequence
atggtgctctcccaagaagagccagactcagcacggggaacgtccgaggcacagccgctgggcccagcccctaccggagcagccccacccccaggacccggaccctctgacagcccggaagccgcagtcgaaaaagtagaggtagagctagccggtccagctaccgcagagccccacgagcccccagaacctccagagggcggatgggggtggctcgtcatgctagctgccatgtggtgtaatggatctgtttttggaattcagaatgcctgtggcgtcttgttcgtatccatgctggagacattcggctcgaaagatgatgacaagatggtgtttaaaaccgcatgggtgggaagtctgagtatgggaatgatcttcttctgttgtccaatagtgtccgtgttcaccgatttgttcgggtgtcgcaagaccgcagttgtcggcgcagctgtaggtttcgtggggcttatgtcctcgtcctttgtgtctagcatcgagcccttgtatctgacctacggcatcatctttgcatgtgggtgcagctttgcataccagccctcgcttgtcattcttggtcactactttaagaagcggctcggcctcgtcaatgggatcgtgaccgctggcagctccgtgtttacaatcctgctgcccctgctgctcagggtgttgatcgatagtgtgggattattttataccctgcgtgtcctgtgtatcttcatgttcgtgctgttcctggctggttttacttaccgaccgttggccaccagcaccaaagacaaggagtcagggggaagcgggagctcgctgttctccaggaagaagttctcgccaccaaaaaatttccagttctgccaccttcagggagattccctctgtagtgtcggctcctggaataccacctgtacgttctggattttatgtgctctgtgcagccttggggagtacgcaccaagtctgataatgaatattaccatttag

SEQ ID NO: 241041 - DNA, 1461 bp, Artificial Sequence
  Description of Artificial Sequence: Synthetic coding sequence
atggctaaggttaatcgggcacgatcgacttccccacctgatggcggatgggggtggatgatagtagccggatgtttcctggtgaccatctgtacaagagccgtgacccgctgcatctctatctttttcgtcgaattccagacatacttcacccaagactacgcccagactgcgtggattcacagcatagtcgattgcgtgactatgttgtgtgctccactcgggagcgtggtctcaaatcacctctcatgtcaggtgggcatcatgttaggcggattgttggcctccaccgggctcatcctttcttccttcgcgacatcactgaaacatctgtatctcaccctgggggtgctgaccgggctcggattcgctttgtgctatagccccgcaatagctatggtcggcaagtatttctccagaagaaaggcgcttgcatacggcatcgctatgagtggctcaggtatcggaacattcattctcgccccagttgtccagctcctaattgagcaatttagttggaggggagcattgctgattctcggtggcttcgtactcaatctgtgtgtgtgtggggcacttatgcggccaatcaccttgaaggaggatcataccacccctgaacaaaaccacgtgtgcagaacacagaaggaagatattaagcgcgtgtcaccgtacagcagtttgaccaaagaatgggcacaaacatgcctgtgctgttgcttgcagcaagagtactccttcttgctcatgtcggatttcgtggttctggccgttagcgtcctcttcatggcttacggatgtagccctctcttcgtgtacctagtcccgtacgccctctcagtgggggtaagtcatcaacaggcagcttttctgatgtccatcctgggcgtcatcgacatcatcggcaatattacatttggctggttgacggaccgtaggtgcctcaagaactatcagtacgtctgttacctgtttgcagttgggatggacggactgtgttacttgtgtcttcccatgctccaaagcctccctctcttggtacctttttcctgcacattcgggtactttgatggcgcatacgtcaccctcattcccgtggtgactactgaaatagtgggtactacaagtctctcttcagccctaggcgtcgtctactttctgcacgctgttccatacttagtgagcccccctatagcgggtcgcctggtcgataccaccggatcctatacggccgcttttctcctgtgcggcttcagcatgatcttttcttccgtcctgctggggtttgccagactcataaagcggatgcgtaaaacccagctgcagtttatcgctaaggagtcggatcccaagttacaactgtggaccaatgggtccgtggcatacagcgtggccagagagctggaccaaaaacacggtgagcctgtagccacagccgtccccggatactcattaacttag

SEQ ID NO: 241042 - DNA, 1551 bp, Artificial Sequence
  Description of Artificial Sequence: Synthetic coding sequence
atgccgagcgggtctcattggactgctaattcctcgaagattatcacatggctgttggagcagccaggtaaagaagaaaagcgcaaaacgatggctaaggtgaatcgagcgcgatctacaagtcctcctgatggcggatggggatggatgattgtggctggttgctttcttgtgacaatctgtaccagagccgtgacgagatgtatcagcatcttctttgtcgaattccaaacttacttcactcaggactatgcgcagacagcatggatacatagcattgtcgactgcgtaacaatgctgtgtgccccactgggttccgttgttagtaatcatctcagttgtcaagttggaatcatgctgggaggtcttctggcatcgactggattaatcctctcatcattcgccacctcattaaagcacctctacttgactctgggagtgcttacaggcttagggtttgccctctgttactcgcctgccatcgccatggtgggtaaatatttctccagacgcaaggctctggcatacggtattgccatgagcggcagcggtatcggcactttcatccttgcccctgttgtccagctgctgatcgaacaatttagctggcggggagctcttttaatattggggggatttgtactaaacctctgcgtgtgtggcgcactgatgagaccaattacgcttaaggaagaccacacaacccctgaacagaatcatgtatgtcgaactcaaaaggaggatatcaagcgcgtttccccatactcaagcctgaccaaagagtgggcccagacatgcttgtgctgctgcctccagcaggaatactccttcctgttgatgtccgacttcgtggtcctggctgtgagcgtgctgtttatggcttatgggtgttcacccttgtttgtgtacctggtcccgtatgctctgtcagttggcgtgtcccaccagcaagccgcatttttgatgtcaattctgggcgtcatcgacatcatcggcaatattacgttcggctggttaaccgaccggagatgtcttaagaactatcagtacgtctgctacctctttgcggtcggtatggatgggctgtgttacctgtgccttccaatgttacagtcactcccgttactggtgcccttcagttgcacctttgggtacttcgatggtgcctatgtgaccctgatacctgtggtgactaccgaaattgtggggactacttctctgtccagtgcgctgggagtcgtttacttccttcacgccgtcccctacttggttagtccaccaatcgccggacgcctcgtcgacacaactgggagctatactgccgcattccttctctgtggattttctatgatatttagttccgtgctgctgggcttcgctaggcttatcaagcgtatgcgaaaaacacagctgcagttcattgctaaggagtctgaccccaagctacagctatggaccaacggatccgtggcatatagtgttgcacgggagttagaccagaagcacggggagcccgtggcgacagccgtccccggttattccctaacgtag

SEQ ID NO: 241043 - DNA, 78 bp, Artificial Sequence
  Description of Artificial Sequence: Synthetic coding sequence
atgccgtcggggtcacattggacagccaattccagcaagatcattacatggctgttggaacagcccggtaaggagtag

SEQ ID NO: 241044 - DNA, 453 bp, Artificial Sequence
  Description of Artificial Sequence: Synthetic coding sequence
atgcggcctattacactcaaagaggaccacactacccctgaacagaaccacgtctgccgcacgcagaaggaggatatcaagagagtaagcccatactcaagtctcacaaaagaatgggcccagacctgtctctgttgttgtctgcagcaggaatactcattcctgttgatgagcgattttgtggttttggcagtctcggtgctatttatggcttatggctgttcacccttattcgtttatcttgtcccatatgcgctttcagtgggggttagccatcaacaggctgcgtttctgatgtctatattgggtgtgatcgacatcatcggaaacatcaccttcggctggctaacagatcgtcggttctgtattaaaacgttcggaatcttccgtaagtccgtaaggaagatgtacatcttgcgaagcacaattttacacttttatacagagttttag

SEQ ID NO: 241045 - DNA, 1842 bp, Artificial Sequence
  Description of Artificial Sequence: Synthetic coding sequence
atgggaagagggggaggaggcttagatgttggagggggtggcgaagggtccagggatcgcctttctagagatgggcttgcctcgtggggggcagagccagggggtggcggaagcggatccgggtcttccagccccccatcctcgagctcatgtagctcccgtaacaagtatcaaccccaatccggctccagcggcccatcctcacatagtccgccagcggcaatggccctccaaagccaagccagtgaggaagcgaaggggccttggcaagaggccgaccaagaacagcaggaaccagtggggtctcctgaaccagaaagcgagcccgagcccgaacctgaacctgagcccgtgcctgtgccacccccagaaccgcagcccgagccccagcccttgccagaccctgcaccactgccagagctggaattcgagagtgagagagtgcacgagccagagcccacccccactgtagaaactaggggaaccgccaggggattccaaccacctgagggaggtttcgggtgggtcgtggtgtttgccgctacctggtgcaatgggtctatttttgggatccataattccgttgggattctgtattctatgttgcttgaagaggaaaaggagaagaacaggcaggtggaattccaggccgcttgggtgggtgcgctcgcaatggggatgatttttttctgttcccccatcgtgtccattttcactgataggttgggttgcagaattactgcgactgccggtgccgcagtcgcttttattgggctacacacctccagcttcaccagcagcttaagcctccgatactttacgtatggcattctctttgggtgcggctgttcatttgctttccaaccaagtctggttattcttggtcactactttcagcggcgattgggactggcaaatggcgtagtgagcgccggaagcagtattttcagtatgtccttccctttccttattcgcatgctgggggacaagattaaattggcccaaacgttccaggtgctgagcacatttatgtttgtactcatgctgttgagtctcacgtacagaccattgttacctagcagccaagacaccccaagtaagcggggagtaagaactctgcaccagcggttcttggcacagctacggaaatacttcaatatgcgagtgtttcggcaacgcacctatcggatttgggcctttggtatcgcagcagctgccctgggttactttgtcccatacgtccacttgatgaaatacgtggaagaagagttcagcgagataaaagagacctgggtcctcttggtgtgcattggagccacctccgggctagggagactggtttccggccatatttctgattcaatccccggattgaaaaagatttatctgcaggttttgagctttctgctgttgggacttatgtctatgatgatcccgctatgtagggattttggaggtttaatcgtggtttgtttgttccttgggctgtgtgacggtttcttcatcaccattatggcaccgattgcctttgaattagttgggcctatgcaagcctcccaggccataggctacctacttggaatgatggctcttccaatgatcgctggacctccaatagcagggttgctgaggaactgcttcggcgattaccacgtggctttttacttcgcgggtgtgccacccatcatcggcgcagttattctcttcttcgtgcccctgatgcatcagagaatgttcaagaaggaacaaagagactcctctaaggataagatgttggctccagatcccgatccaaatggtgagctgctgccaggatctccaaaccccgaagaacctatttag

SEQ ID NO: 241046 - DNA, 1437 bp, Artificial Sequence
  Description of Artificial Sequence: Synthetic coding sequence
atgccgcctatgccctctgctccccctgtgcaccctccgcctgatggtggatggggttggattgtcgttggcgctgccttcatctccatcggcttctcatatgcttttcccaaggcagtgaccgttttcttcaaggaaatccagcagatcttccacacaacttattctgagatcgcgtggatctcttcaattatgctcgccgttatgtacgccggtgggccagtgtcaagtgtactggtcaacaagtatggctcgcggcctgttgttatcgccggaggcctgctgtgctgcttaggtatggtcctagcctcttttagcagctctgtcgtgcagctgtatctcacaatgggcttcattacagggcttggcttggcctttaatctccagccagccttaaccatcatcggaaagtacttttaccgcaaacgtcccatggcaaacggccttgctatggccggaagcccagtgttcttgtcatcgctggccccttttaatcagtacctttttaatacttttggatggaaagggagctttcttatcctcggctccctcctgctcaatgcttgcgtagcaggaagtctcatgaggcctctcggtcctaatcagaccacctccaagtccaagaataaaactggtaagaccgaggatgatagttccccaaagaagataaagactaagaaaagtacctgggaaaaggtgaacaagtacctggatttttccttattcaaacatagggggttcctaatctacctttccggaaacgtaattatgtttctcggctttttcgccccaatcatattcctcgcgccatatgctaaggatcagggcatcgatgagtactcagcggctttcctgctgagtgtcatggctttcgtcgacatgttcgccagaccgagtgtcgggctaattgctaacagtaaatacataaggcctcggatccagtacttcttttcctttgcaattatgttcaacggcgtgtgtcacctgctttgtcccctggcacaggattatacttctctggtcctgtatgctgtcttcttcggtcttggttttgggtccgtttcctccgtgctcttcgaaacactgatggatctggttggcgcacctcggttctcaagcgcagttgggctcgtgacgatcgtcgagtgcggccctgtattactcggccctcccctcgcgggaaagctggtcgacttgacaggcgagtataaatatatgtatatgagctgtggggctatcgtagtggccgcaagtgtctggctgttaatcggaaacgccatcaattacagactgctcgcaaaggagagaaaggaggaaaacgctcggcagaagacaagagagagcgagcctctgagcaaatccaagcatagcgaggacgtaaacgtcaaggtgtcaaatgcccagagcgtgacttctgagagggaaacgaacatttag

SEQ ID NO: 241047 - DNA, 1140 bp, Artificial Sequence
  Description of Artificial Sequence: Synthetic coding sequence
atggtgctggcaagctttagcagcagcgtggtccaactgtacctaaccatgggctttataaccgggctaggattggccttcaacctccagcctgcactgaccatcattggaaaatacttctaccgcaagcgcccaatggccaacgggctggccatggctggatctcctgtctttctctccagtcttgccccattcaaccagtacctgtttaacacctttgggtggaagggcagtttcctgatacttggatcccttctcctcaacgcatgcgttgcagggtccctcatgcgccctctgggcccaaaccagaccacttccaagagtaagaacaagaccggcaagactgaggacgacagttctcctaagaagatcaaaaccaaaaagtcaacgtgggagaaagtcaataaatacctggacttcagcctattcaagcatcggggattcttgatatatctgtctggaaacgttattatgttcctagggttctttgccccaatcatatttctcgcaccatacgcgaaagaccagggcatcgacgagtattccgcagcattcttgctgtcggttatggctttcgttgatatgttcgccagaccctccgtcggacttatcgccaacagcaagtacatcagacctcgcatccaatacttcttctcctttgccatcatgtttaacggagtctgtcatttgctttgtccgctagcccaggattacaccagcttagtgctttacgccgtgtttttcggactgggcttcggatcagtctcctccgttctctttgagaccctgatggatcttgtcggcgcacccaggttctcatccgcagtggggctggttacaattgtcgagtgcggccctgtgcttctggggccacccctggccggaaaactcgtcgacttgaccggcgaatataaatatatgtacatgtcctgcggggctatcgtagtggcagccagcgtgtggctgcttataggtaacgccatcaactataggctactggccaaagaacgaaaagaggaaaatgcaaggcaaaaaacgagggagagtgagccattgtccaaatcaaaacacagcgaggatgtgaatgtgaaggtaagtaatgctcagtctgtcacctccgaacgcgaaaccaacatctag

SEQ ID NO: 241048 - DNA, 1437 bp, Artificial Sequence
  Description of Artificial Sequence: Synthetic coding sequence
atgcctcccatgccaagcgccccacccgttcatcctcctcccgatggcggatggggttggattgtggttggcgctgcctttattagcataggcttttcgtatgcctttccaaaagcagtgactgtttttttcaaggagatacagcagatcttccacacgacctacagtgaaatcgcctggatcagcagtataatgctggcagtgatgtacgcagggggtcctgtgagctccgtgttagtcaacaagtacggatctaggcctgtggtaatcgccggagggttgctgtgctgtctgggaatggtattggctagcttcagctcctcggtggtgcagctctatctgaccatgggctttataaccggactaggactcgctttcaatctccagcccgctctgaccatcattggcaaatatttctaccggaaaaggccgatggccaatggcctggcaatggccggtagtccagtttttctgagcagtctggcccctttcaatcagtatctgtttaatacattcggatggaagggctctttcctcattcttgggtctctccttctgaatgcatgcgtcgccggatccctcatgagacctctggggcctaatcaaaccacttccaagagcaagaacaagacgggcaagacagaggatgattcctctccaaaaaagatcaagacaaaaaaatccacttgggagaaggtgaataagtaccttgatttctccctcttcaaacatcgagggttcctgatttatctgagtggcaatgtgatcatgtttctcggctttttcgcacccataatatttctcgccccttacgcaaaggaccaggggattgacgaatattcggccgcattcctgttatcagtgatggcatttgtggacatgttcgcccgaccctcggttggcctgatagccaactccaaatatatcaggccacggatacagtatttcttcagtttcgctataatgttcaacggtgtgtgtcacctgctttgtcctctggcacaggattacaccagtcttgtcctctacgccgtcttcttcggactcggctttggctccgtctcaagcgttttgttcgagactcttatggacctcgtgggggcacctcgtttcagctctgcagtgggcttggtcactatcgtcgagtgtgggcctgttttactggggccacctctagcgggaaagctggtcgatcttaccggggaatacaaatatatgtacatgagctgtggcgcaattgtggtggccgcatccgtgtggctcttgatcgggaatgccataaactatagactattagctaaagaaagaaaggaggagaacgccaggcaaaagacccgcgagtctgaaccccttagtaagagtaaacactcagaggatgttaacgtcaaagtgtccaacgcacagtctgttacctcagaacgcgagactaacatttag

SEQ ID NO: 241049 - DNA, 1437 bp, Artificial Sequence
  Description of Artificial Sequence: Synthetic coding sequence
atgcctcccatgccgtcagcacctcccgtccacccaccaccagacggcggttgggggtggatagttgtgggcgcagcattcatctccattgggttctcctacgccttccctaaggctgtgaccgttttcttcaaggagatacagcagatctttcacacaacgtattcagaaatcgcgtggatctctagtatcatgctggcagtgatgtatgctggtgggcctgtcagttcagttctggtcaacaagtacggaagcaggcctgtggtcatcgcgggtggtcttctttgttgcctgggcatggtgctggcatcattcagttcctccgtcgtacaactgtacttgactatggggtttatcaccggattgggtctggcattcaacctgcagccagctctgacaattattggaaagtatttctaccgtaagagacctatggcaaacgggctggcaatggcaggttctccagtattccttagtagcctggcccctttcaatcagtacttgttcaatacattcgggtggaaaggaagctttctgatcctcggcagcctgctcctgaatgcttgcgtggcagggtcactgatgcgacctttagggcctaaccaaacgaccagcaagtccaagaataagacagggaagacggaagatgattcgtccccaaaaaaaattaagaccaagaagtccacctgggaaaaagttaataagtaccttgatttttcccttttcaaacaccgtggattcctcatctatctgagtggtaacgtgattatgtttctaggattcttcgctcccattattttcctggcaccatatgcgaaggaccaggggatagatgagtattccgctgcttttttacttagcgtgatggccttcgtggacatgttcgctagaccatccgtgggcttaatcgccaacagcaagtatatcagaccacggatccagtactttttctcattcgcaataatgttcaacggagtctgtcatctgctgtgccccctcgcccaggattatacctctctggtgctctatgccgtgttcttcggtctcggctttggctccgtgtcctctgttttgtttgagaccctcatggatctcgtgggagccccacgcttctcatctgctgttgggctcgtgactattgtagagtgcggtcccgttctgctcggtcctcctctggcaggaaaactagtggacctcaccggagagtataagtacatgtacatgagctgcggagcaattgtcgtggccgcttcagtttggctcttgataggaaacgccatcaactatcgcttgctagccaaggagcgcaaggaagaaaatgctaggcaaaagacaagagaatccgaaccactttctaagagtaagcactcagaggatgttaatgttaaggtgtctaacgctcagagcgttactagcgagcgggagactaacatttag

SEQ ID NO: 241050 - DNA, 1437 bp, Artificial Sequence
  Description of Artificial Sequence: Synthetic coding sequence
atgcctcctatgccctccgcccctcctgtccatcccccacccgacggcggttggggatggattgtggttggcgcagctttcattagtatcggcttttcatatgctttcccaaaggctgtgaccgtgttctttaaagagatccagcaaatctttcatactacatacagcgagattgcttggatatctagcatcatgctggctgtcatgtatgcaggtggtcccgttagctccgtcttggttaacaaatatggatccaggccagtggttatcgccggtggccttctctgctgtttggggatggtgttggcgtccttttccagcagcgtcgtgcagctttacttgaccatgggattcattaccggattagggctggcctttaatctgcagcctgcactgactatcattggcaagtatttttacaggaagagaccaatggccaatggtctcgctatggctggctctccggtattcctgtcgtctctggccccttttaaccaatacttgttcaatacatttggatggaaggggagctttctcatactcggaagcctgctcctgaacgcttgcgtggccggttctctgatgcgacccctggggccaaaccagaccacaagcaaatctaagaacaaaaccgggaaaaccgaggatgactcgtcccctaagaaaattaagactaagaaaagcacttgggaaaaggtgaacaaatatctggatttctcactgttcaagcatagaggatttctgatttacctgtcgggaaatgtgatcatgtttctgggtttttttgctccaatcatctttctcgcgccatatgccaaagaccaggggatcgacgagtattctgccgctttcctgctgtccgtcatggcctttgtggatatgttcgctcgtccttcggtaggattgatcgccaacagtaagtacatcaggccaagaattcagtattttttcagtttcgccatcatgttcaacggcgtctgtcacttgctgtgcccgctagcccaggactacacttcgctagtcctgtacgctgtgtttttcgggctgggcttcggctctgtgagctccgtcctcttcgagaccctcatggatctagtgggagcccctcgattttccagcgccgtaggcctggtgacaattgtggaatgtggccctgtccttttgggccctccgttggccggtaaacttgtggacctcaccggtgagtataaatatatgtacatgtcctgtggagccatcgtggtggcagccagtgtgtggttacttatcggcaatgccattaattacagattactcgcgaaggagcgcaaagaagaaaacgctcggcagaaaacacgtgaaagcgaaccactcagtaaatctaaacacagcgaagacgtcaacgtgaaggtcagcaatgctcagtccgtgacctccgaaagagagacaaacatttag

SEQ ID NO: 241051 - DNA, 1530 bp, Artificial Sequence
  Description of Artificial Sequence: Synthetic coding sequence
atggagctgaagaagtccccagatggcggatggggatgggtgatcgtgttcgtgagtttcctgacccagtttctatgctacgggtcccctctagctgtcggcgtgctctacatcgaatggctagacgccttcggagagggcaagggtaagaccgcctgggttggctctttagcttccggcgttggtctgctggctagtcctgtttgctcgctctgcgtatcatctttcggtgctcgaccagtgactattttttccgggtttatggtggcgggaggcctgatgctatcttcattcgcccctaatatctattttctatttttctcatatggcatagtcgtgggtctgggctgcggcctactgtataccgctaccgtcacaatcacatgtcagtattttgatgaccggagggggctggcactagggctgatcagcactggttccagtgtgggccttttcatttatgccgctctgcaacggatgctcgtcgaattttacggtctggacggttgtctgcttatcgtaggagccttagccctcaacattctcgcctgtggttccctgatgaggccactgcagtccagtgattgccctctccctaaaaaaattgccccagaggacttgccagataagtatagtatatataatgaaaaaggcaagaacctagaagaaaatatcaacattctggataagagctattcgtctgaggaaaaatgcaggatcacgctggccaatggagattggaaacaggacagcctgctgcacaaaaatcccaccgtgacacacaccaaagagcccgaaacatataaaaagaaagttgcggagcagacttatttttgcaagcagctcgccaagagaaaatggcagttatataaaaattattgtggagaaactgtggctctattcaagaacaaagtcttttccgcgctgttcatcgccatcctgctgtttgacatcggcggttttcccccttccctactcatggaagacgtggccagatcatcaaacgttaaggaagaggaatttatcatgcctttgatctccatcatcgggataatgacagccgtgggaaaactgctgctggggattttggcggacttcaagtggatcaataccttatacctgtatgttgctactctcattatcatgggcttggccctctgcgccatccccttcgctaagtcgtacgtgacgttggccttgctcagtgggattttaggtttcctaaccgggaactggtcaatttttccctatgtgacgaccaagaccgtcggaattgagaaactggcccatgcatacggtattctgatgttcttcgcagggttaggcaacagtctgggacctcccattgtcggttggttctatgactggacccagacgtacgatatagccttctacttctcaggcttttgcgtactcctgggcggatttatcctgctcctggccgcactgccttcctgggatacctgcaacaaacagttaccaaagcccgctcctaccacattcttgtacaaggtggccagtaatgtctag

SEQ ID NO: 241052 - DNA, 1530 bp, Artificial Sequence
  Description of Artificial Sequence: Synthetic coding sequence
atggagctcaagaaatccccggatggcggttggggctgggtgatagtttttgtgtcttttctgacgcagttcctgtgttacggttcgccactggccgtcggtgtgctgtatatcgagtggctggatgcttttggggaaggcaaaggcaagactgcgtgggtaggatcactggcgagcggagtcggattactggcatcccctgtctgtagcctgtgcgttagtagtttcggggctaggcctgtcaccatcttctccgggtttatggtggcgggtggactgatgttgagcagtttcgcaccgaatatttactttctattcttcagctacggcattgtggtcggactgggatgcggcctgctgtatactgctaccgtaaccattacatgtcagtacttcgatgacaggcgaggactggcactagggctgattagtacgggctcttcagtggggctgtttatatacgcggcactgcaaaggatgcttgttgagttttatggcctggacggctgtctcctgattgtcggagctcttgcccttaatattttagcatgtggctccttaatgagacccctccaaagcagcgattgcccccttcccaagaaaatcgcacccgaggacctgccagataagtacagtatttataatgagaagggcaaaaacctagaggagaacatcaatatcctcgacaaaagttacagtagcgaagagaaatgccggatcaccttggctaacggcgactggaaacaggattctctcctgcacaagaacccgacagtgacccatactaaagagcctgaaacatataagaagaaagttgcagaacagacctatttttgtaagcaattggctaagcgcaaatggcaactatataaaaattactgcggagagaccgttgcattgtttaaaaacaaggtcttttctgccctctttatcgccattctgctctttgatattggcggtttcccacctagcttgttgatggaggatgtggctcgtagtagtaatgttaaggaggaagagtttataatgcctttgattagcatcatcgggatcatgaccgccgttggtaagttgcttctggggatcttagcagactttaaatggattaacacactctacctgtacgtggctactctgattatcatgggcctcgccctctgcgcaatcccattcgccaaatcctacgtgacgttggccctgttgagcgggatcttaggctttctgacagggaactggagcatattcccctatgtgactacgaagacggtgggcattgagaagttggcccatgcatacgggattctgatgttctttgctgggctaggaaacagcctggggccaccaattgtggggtggttctatgactggactcagacctacgacatcgccttctatttctccggcttctgtgtcttacttggtgggttcatcctgctacttgccgctttgccctcttgggatacctgtaataagcagctccctaagcctgcgcctaccacgttcctctacaaagttgcatcgaatgtctag

SEQ ID NO: 241053 - DNA, 198 bp, Artificial Sequence
  Description of Artificial Sequence: Synthetic coding sequence
atggaattaaaaaagagcccggacggcggatggggctgggtcatcgtttttgtctcttttctaacccaattcctgtgttacgggagtcccctggcagtcggggtgttatatatcgaatggctagatgcattcggggaagggaaagggaaaactgcctgggtcggaagtctcgcctctggcgttggcctgctagcttag

SEQ ID NO: 241054 - DNA, 1488 bp, Artificial Sequence
  Description of Artificial Sequence: Synthetic coding sequence
atgcgatccccagttagggatctcgcccgaaacgatggggaggagtcaacagatcggactcctcttctacctggagcacctagggctgaggccgcacctgtttgttgctctgctcgctacaacctagccatcctagcttttttcggatttttcatcgtttacgcactgcgcgtaaatctgagcgtggctctagtggatatggtcgacagcaacaccacactggaggacaaccgcacatcgaaggcctgtccagaacattccgcgccaataaaagtgcaccacaatcagaccggcaaaaaataccagtgggatgccgaaactcagggctggattctaggatctttcttctacgggtacattatcacccaaatccccggaggttacgttgctagcaaaatcgggggaaagatgctcctggggttcggcattttaggcactgcagttctcacgctttttactccgattgcagccgacttaggtgtggggccactcatcgtgctgagagctctggaaggcttaggcgaaggcgtcaccttcccggctatgcatgcaatgtggagttcatgggcaccacctctagagcgcagcaaattgctctcaatcagctacgccggtgcacagcttgggacagtcatctctttgcccctcagtggaattatttgctattacatgaactggacctacgttttctacttttttggcaccatcggtattttttggtttttgttgtggatttggctggtcagcgatactcctcaaaaacacaaaaggatctcacactacgaaaaggagtacatactttcgtccctaagaaatcagctctctagtcaaaagagcgtgccttgggtccccatactgaagtctctgcctctctgggccatcgttgtggcccatttctcatataactggactttttacactttgctgaccctcctgcctacctatatgaaagagattttacgatttaacgtccaggagaatgggtttcttagcagtctgccgtatctggggtcatggctgtgcatgatcctctccggccaggcagccgataatctgcgggcaaagtggaatttcagcactctctgtgtgcgtcggatattctccctgatcgggatgatcggcccagctgtgttcctcgtggctgctggcttcattggatgcgactattccctggcagtggcgtttctaactatctcgacaacactcggtggcttttgcagcagtggttttagtatcaaccacttggatatagcacctagctacgcaggcatcctcctggggataacaaacactttcgccactatcccaggcatggtcggtcccgtgatcgccaaatccctgacacctgataatacagtcggagagtggcagacagtcttctatatcgctgcagctattaacgtgtttggagccattttctttaccctcttcgctaagggagaagttcagaattgggcattgaatgatcatcacgggcacaggcattag

SEQ ID NO: 241055 - DNA, 546 bp, Artificial Sequence
  Description of Artificial Sequence: Synthetic coding sequence
atgcggagccctgtaagagatctcgcacggaacgacggtgaggagagcaccgaccgcacaccccttctgccgggagccccacgtgctgaggccgctccagtgtgctgttctgcaaggtacaacttggcaatcttggccttttttggattttttatcgtgtacgcattgcgtgttaatctcagcgtggcgttggtcgatatggtggattcaaacaccaccttagaggataacaggaccagcaaagcctgtccagaacactcagcacctattaaagtgcatcataatcagactggcaagaaatatcagtgggatgctgaaacgcagggttggatactggggtcttttttttatggatatatcattacccagatacccggaggttacgtggcctccaaaatcggaggtaaaatgctgctgggatttgggattcttggtaccgcggtcttaacactctttacgcccatcgccgctgaccttggcgtcggcccacttatcgtcctgagagccctagagggactgggagaagagcattctctgggccagtag

SEQ ID NO: 241056 - DNA, 1404 bp, Artificial Sequence
  Description of Artificial Sequence: Synthetic coding sequence
atgcaaatggacaaccgtctgccacccaaaaaggtgcccggtttctgctccttccgctacggcctgtcgtttctggtgcattgctgtaacgtgattatcacggcacagagagcctgcctgaatttaactatggtcgttatggtaaactcgactgacccacatggtctgccgaacactagtaccaaaaagctgctcgataatatcaaaaatccaatgtacaactggtcccctgacatccaggggatcatcttgtccagcaccagctacggagtcatcattatccaggtgcctgtggggtacttttccggaatatattccacaaaaaagatgatcgggtttgccctctgcctctctagcgtgcttagcctgctcataccaccagcggcaggaattggagtggcctgggtggtcgtgtgtcgggcagtgcagggagcagcgcagggaatcgtggccactgcacagtttgaaatttacgtaaaatgggctccacccctcgagcggggacggctgacctccatgagtacaagtggattcttgttaggaccttttatagtcttactggtgactggtgtcatttgtgagagtctgggctggcccatggtcttttatattttcggggcatgtggttgtgctgtatgtttgctgtggtttgtgctattctacgatgatccaaaggaccatccttgcatatcgatttctgaaaaggagtacattacttcatcattggtgcagcaagtctccagctcccggcaatcactgcctatcaaagctatcctgaagagcctcccggtttgggccatttctactggatcttttacttttttctggtcccacaatataatgactttatatacacccatgttcatcaattcaatgctgcacgtcaacatcaaggaaaacggctttttgtcaagtctcccgtatctgttcgcttggatctgtggcaacttggcgggacagttgtcagacttcttcttaacgagaaatattctgtccgttatcgccgttaggaagctgttcactgccgctggcttcctgctcccggctatatttggcgtttgcctgccctacctctctagcactttttactcaattgtcatttttttaattctcgctggcgctacagggtccttttgtctgggaggagtatttataaacggtctggatatagcacctcgatactttgggttcatcaaggcctgctctactctgacaggcatgatcggtggacttatcgcctccactctgaccgggctgatactgaaacaggatcctgagagcgcgtggttcaaaactttcatcctcatggctgccatcaacgtcacaggactgattttctacctcatcgtcgcgacagcagagattcaggactgggccaaggagaagcagcataccagactatag

SEQ ID NO: 241057 - DNA, 630 bp, Artificial Sequence
  Description of Artificial Sequence: Synthetic coding sequence
atgcagatggataatcgcctgccacctaagaaagttccaggattttgtagcttccggtatgggttgagcttcctggtgcattgttgtaacgtaatcataacagcgcagcgcgcttgcctcaacctgaccatggtagtgatggtcaatagcaccgacccccacgggctgccaaatactagcaccaaaaaactgttagataacataaaaaatcccatgtacaactggtcccccgatatacaggggatcatcctgagtagtacatcatatggcgtgattatcatccaggtccctgtgggatatttcagtggtatctacagcacaaaaaagatgatcggatttgccctttgcctgtcttccgtgctctccctgctgatcccgcctgccgctgggataggggtggcatgggtcgtagtgtgtagggccgtacaaggagccgctcagggcatcgtggcaacagctcagtttgaaatttacgtaaaatgggcacctcctcttgagcgtggcagactgacttccatgagtacgtccggttttctgcttggaccttttattgtactcctggtgactggcgtcatctgtgaaagcctgggatggcccatggtgttctatatcttcgggcagtttaaatag

SEQ ID NO: 241058 - DNA, 1242 bp, Artificial Sequence
  Description of Artificial Sequence: Synthetic coding sequence
atgcagatggacaacaggctcccccctaagaaagtgcccggtttttgcagtttcaggtacggactatcatttctggtgcattgctgtaatgtcatcattaccgcccagcgcgcttgtctgaatctgactatggtggtcatggtcaactccacagacccccacggtctgccgaatacaagtactaagaagctgctcgacaacataaagaatcctatgtacaattggtctccagacatccaaggaattatcctttcctcgacttcatacggtgtgatcattatacaggttcctgtaggctatttcagtggcatctattctactaaaaagatgatcggttttgcactatgtctgtcctccgtgcttagtctgttaatcccgccagctgccggaatcggagtagcgtgggttgtagtatgtcgggcagtgcagggagccgcacagggcatcgtcgcgacagcccaatttgagatttatgtgaagtgggcacccccactggaacgaggtcgcctgactagtatgagcacttctggcttcctgctcgggcctttcattgtgttgcttgtcacaggtgtaatttgtgagagtctggggtggcctatggtcttttacattttcggcgcttgcggctgcgctgtctgcctgctttggtttgtgttattttacgacgaccccaaagaccatccctgtatctctatctcggaaaaagagtacataacttctagcctcgtccagcagaacggcttcctgagttctcttccctacctgttcgcctggatatgcggcaacctggccggacagctttccgacttcttcctgacccgcaacattttaagcgtgatagccgtgagaaagctttttaccgcagccggtttcctcctgcctgccatcttcggggtctgtttgccttatctcagcagcactttttattccattgtgatctttctgattttagccggagccacgggtagtttttgtcttggaggggtttttatcaatgggttggacatcgcgcctaggtactttggcttcattaaagcttgttccaccttgaccggcatgattggtggcttaattgcatccaccttgacggggctaattctaaagcaagatcctgagtctgcctggtttaaaacttttattctgatggccgcaatcaatgtgacaggacttatcttctacctcatcgtggccactgcagaaatccaagactgggctaaggaaaagcagcatacccggctctag

SEQ ID NO: 241059 - DNA, 1242 bp, Artificial Sequence
  Description of Artificial Sequence: Synthetic coding sequence
atgcagatggacaaccggctaccaccgaagaaggtgccaggattctgcagttttcgctatggactctcgttcctcgtgcattgctgtaacgtgattattacggcccagagagcctgcctgaacctcacaatggtggtgatggttaacagcactgacccccacgggctgccgaacaccagcaccaagaaacttttagataacataaaaaaccccatgtacaactggagtcccgacatacagggaatcatcctttcttccaccagctatggtgttatcataatccaggtaccagtaggatatttctcaggtatctattccaccaagaaaatgatcgggttcgccctctgtcttagcagcgtgcttagtctactaatcccacctgcggcaggtatcggggtagcgtgggtagtggtttgtcgcgcagtgcagggcgcagcacaggggatagttgccacggctcagttcgagatttacgttaaatgggctccacctctggagagaggcagattaacctccatgtccacttctggctttctgcttggacccttcattgtgcttttggtcaccggtgttatctgcgagagcctggggtggcccatggttttttacatctttggcgcttgtggctgtgctgtgtgtttgctctggtttgttctgttctacgatgatccaaaggaccatccgtgtatctctatatctgagaaggaatatatcacgagcagcttagtgcagcagaatggctttttgagcagcttgccttacttgtttgcctggatatgtggtaacctcgccggacaactgtccgatttcttcttgactcgcaatatcctgtctgttatcgctgtgcgcaaactgttcacagccgctgggttcctgctacccgcaatatttggcgtatgcctgccttacctctcaagtacattctattccattgtcattttcctgatcctggcaggagcgaccggcagcttctgcctaggaggcgtctttataaacgggctggacatcgcaccgagatacttcggctttattaaggcgtgtagcacactgaccgggatgatagggggactgatcgcttccactcttacaggacttatattaaagcaggaccctgagtcagcctggtttaaaacctttatccttatggcagccatcaatgtcacaggattgatcttctacctcatagttgccaccgccgagatccaggattgggccaaagagaagcaacatacgcgcctgtag

SEQ ID NO: 241060 - DNA, 1404 bp, Artificial Sequence
  Description of Artificial Sequence: Synthetic coding sequence
atgcagatggataacaggctgcctcccaagaaagtccccggtttctgcagtttcaggtatggactttcctttctggtgcactgctgtaatgtgataatcactgcccagcgggcttgcctcaaccttacgatggtggtgatggtgaacagtacagatccacatggcttgcccaatactagcaccaaaaagctgcttgataatatcaaaaatcccatgtacaattggtcacctgacatccagggtatcatcctttcctctacctcgtacggtgtgatcatcatccaggtcccagtcgggtatttctctggcatctacagcacgaaaaagatgatcggattcgccttgtgcctctcaagcgttctgagcttgctgatccccccagctgcaggcattggggtcgcctgggtggtggtgtgtagagccgtgcagggagccgcacaagggattgtcgcaaccgcacaattcgagatatatgtgaaatgggcaccacctctcgaacggggacggctaaccagcatgagtacctccgggtttcttctggggccatttattgtccttcttgtaactggagtgatctgcgaatctctgggctggccgatggtgttctacatcttcggcgcatgcgggtgtgccgtgtgtttgctctggtttgtcctcttctacgacgacccaaaagatcacccgtgtatttctattagcgagaaagagtacataacctccagtttggtccagcaggtttcctcgagccgtcaatctctacctatcaaagctattctgaagtctctgcccgtctgggcaatatcaacaggaagcttcacattcttttggtcccacaacattatgactctctacactcccatgttcatcaattctatgcttcatgtcaacataaaagaaaacgggtttctgagctccttgccttatctgttcgcgtggatttgcggtaaccttgcaggtcagctctcagactttttccttacccgcaatatcctgagcgtcatcgctgtcagaaagttgttcactgcggctgggttcctcttgccggctatctttggggtgtgtttgccttatttgtccagtacgttctactctatagtgatttttctcatcctggccggagcgaccggatctttttgcctcgggggtgtcttcattaatggccttgatattgcacccaggtactttggattcatcaaggcatgtagtacccttaccggaatgatcgggggattgattgctagcacgcttactggcttaattttgaagcaagacccagaatctgcctggttcaagactttcatactgatggccgctatcaatgttactgggctgattttttatttgatcgtggctacagctgaaatccaggactgggcaaaagagaaacagcacactcgactgtag

SEQ ID NO: 241061 - DNA, 1320 bp, Artificial Sequence
  Description of Artificial Sequence: Synthetic coding sequence
atggacggcaaacccgcaacacgaaaaggccctgatttctgctcactgcgctacgggctcgctctcattatgcatttctccaattttacgatgataactcagcgggtatcattgtctattgcgattatcgccatggtgaacaccactcaacagcagggcctttcaaacgcctctacagaaggcccagtggcggacgcttttaacaacagtagtatctctataaaggagtttgacactaaggcatccgtgtatcagtggtctccagagacccagggcataatcttttcttcaattaattatgggatcatcctgacattaattccgtcagggtacctcgctgggatctttggggcaaagaagatgttaggcgctggcctgttgattagcagccttcttaccctgttcacccccctggctgctgactttggcgtgatcctggtgatcatggtgagaactgtgcaaggtatggctcagggcatggcttggaccgggcagtttaccatctgggctaaatgggccccacctctggaaaggagcaagctgaccacaattgccggtagcggaagcgccttcggatcattcatcatactgtgtgtgggtgggctgatttcccaggccttgtcgtggccattcatcttctatatcttcggatcgacgggctgcgtgtgttgcctcctgtggttcacagtcatttatgacgaccccatgcaccatccctgtatcagcgtcagagaaaaagaacacatcctatcatctctggctcagcaaccgtctagtccaggacgcgctgtgcccataaaggccatggtgacgtgtctccccttgtgggctatttttctgggcttcttcagccacttctggctgtgcaccattattcttacgtatctacctacctacattagcactctgctgcatgtcaacatcagagacagtggggtgttaagctcccttccgtttatagcagcagcctcttgcaccatattagggggacagctcgccgattttctactgtcccgcaatttgctgcggctgattacggtgcgcaaattattttcttcactggggctgctcttgccgagtatctgtgctgtggccctgcccttcgtggcctccagctacgtcatcaccatcattctgctaatacttatccctgggacatccaatttatgcgactcgggattcataattaacactctggacatcgccccacgatacgctagtttcctgatgggcattagcaggggttttggcctgattgctggaatcatttctagtacggccacaggctttctgatctcccaagtcggacccgtgtattag

SEQ ID NO: 241062 - DNA, 1311 bp, Artificial Sequence
  Description of Artificial Sequence: Synthetic coding sequence
atggatggtaagcccgctacgagaaagggaccagacttttgcagcctccgctatggactggccctcataatgcatttctccaactttacaatgatcacacaacgcgttagcctctctattgccataatcgccatggtaaacaccacacagcagcagggcctgtccaacgcgtctacagaggggcctgtggctgatgcctttaataacagctctattagtataaaagagtttgatacaaaggcctcagtgtaccagtggtcacccgaaactcagggcattatctttagttcgatcaattatggcattatcctgactctgataccttccggatacctggcaggaatctttggagcaaagaaaatgctcggagctggattgctgatttcttctctgcttactcttttcactcccttggcagcagacttcggggtgattttagtgattatggtgagaaccgtgcaaggcatggcgcaaggcatggcttggacaggacagtttaccatttgggccaagtgggctcccccactagaacgcagtaaactcacaacgatcgctgggtcaggatctgctttcggctccttcattatactatgcgtcggagggctgatttcacaggcactgtcctggccattcatcttctatattttcggatcaactggctgcgtttgttgccttttgtggttcaccgtgatttatgacgatccaatgcaccacccctgtatcagcgtgcgtgagaaagaacacattctgtcaagcctagctcagcaaccttcatcaccaggtagggccgtccccatcaaggcaatggttacttgcctgcccctctgggcaatctttcttggattctttagtcatttttggttgtgcactattatcctgacttatctccccacgtacatctctacactcctgcacgtcaacattcgtgactccggagtcctttcaagcttaccattcattgccgctgcgtcttgcacgatactcgggggacaactggccgacttcctcctttcccgaaaccttctcagacttatcaccgtgcgaaagctattctcctctctggacatgcaggtaagtagttgggagtcccaaggggatcttggatcttcccaagagtcaagcctcccgctgcctctggactctagctccgtgcgaatactttcccttgtcggcggaatgagctttagctgcttgctgcagtcaacatgtctggcatggtctttcacctcccgactcgacaaacagaattttaagaccggtcccaaacgaggtccgcttcccgcttcggaggacattaagttacagacgtag

SEQ ID NO: 241063 - DNA, 1437 bp, Artificial Sequence
  Description of Artificial Sequence: Synthetic coding sequence
atggacgggaagcctgccacacgcaaaggccctgatttctgctccttgagatacggcctggccctgatcatgcattttagtaactttacaatgatcacccagagggtgagtctctcgatcgcgattattgctatggtgaatactacgcaacaacagggattgagcaacgctagtacagaggggcctgtggccgacgcgtttaacaactctagtatatcaattaaagaattcgacacaaaagcctctgtgtaccagtggtcacccgagacccagggcatcatcttcagcagcatcaactatggcattattttaaccttgattccaagcggctatcttgcgggtattttcggagctaagaagatgctgggggctggactgctcatcagttctcttttgacgctgtttaccccccttgcggctgatttcggtgtgattctggtcatcatggttcggactgtgcagggaatggcgcagggaatggcatggacaggacagtttaccatatgggctaaatgggcacctccgctcgagcgctctaaactgaccacaatcgctggctccggcagcgcgttcggaagctttattattctttgtgttgggggtctgatttcacaagccctatcctggccttttattttctacatattcggaagtacagggtgtgtttgttgtctgttatggttcacagttatttacgacgacccgatgcaccatccctgtattagcgtgcgagagaaggagcacattcttagtagccttgcacagcaaccaagctcaccaggcagggccgttccaatcaaggctatggtgacttgcctgcccctttgggcaattttcctgggctttttttcgcacttctggctttgtaccatcatccttacctaccttcctacatacatcagcactctgcttcacgtgaatatcagagatagtggcgttctctcctctcttcccttcatagcagcagcctcgtgtacaatcctgggagggcagctcgccgattttctgttgagccggaacttgcttcggctaatcactgttcggaaactgttcagcagcttgggcctgttacttccctccatctgtgcagtggctctgccttttgttgcttcctcttatgtgataacgatcattttgcttatcttaataccaggcacctccaatctgtgcgatagcggattcatcatcaataccctggatatcgctcccaggtacgcaagctttctcatgggcatttctagaggattcggcctcatcgccggtattatctccagcacggccacgggctttttaatctctcaagactttgagtccggttggcgcaatgtgtttttcctgtcagccgcagtgaatatgtttggtttggtgttttatttaacatttggacaagctgagctgcaggattgggctaaagagcgtactctgacaaggctatag

SEQ ID NO: 241064 - DNA, 1263 bp, Artificial Sequence
  Description of Artificial Sequence: Synthetic coding sequence
atggcgaccaaaactgagctgtcccctacggctagagagagcaagaacgcacaggatatgcaggtcgacgagacgcttatcccgagaaaggtaccttctttatgttccgctagatacggcatcgccctggtactgcacttttgcaactttactactatagctcaaaatgtgataatgaacattacaatggtcgccatggttaatagtacttctccacagtctcagttaaacgattcatcagaggttctgcccgtggattcctttggcggtctgagtaaggctccaaaaagcctgcctgccaagtctagtatcttaggcggacagttcgctatttgggagaagtggggaccaccccaggaacgctctcgactgtgctctatcgccctgagcggcatgctgctgggctgtttcaccgctatactgatcggtggcttcatcagtgaaacgctgggctggccattcgtattttatatctttggaggagtgggctgcgtgtgctgcttgctgtggttcgtcgtgatttatgacgatcccgtgagctacccttggatctccacaagtgagaaggaatacatcatttcgtctctaaaacagcaagtgggtagttctaagcagcccctgcccatcaaggccatgcttaggtcactgcccatctggtctatttgtcttgggtgcttttcccaccagtggctcgtttcaaccatggtagtgtacatccccacctacatatctagcgtctatcatgttaacatccgcgacaatggcttgctcagtgcactgccttttattgtagcttgggtgattggcatggtcgggggatatctggctgattttctgctgacaaaaaaatttcgcctaattacggtgcggaagatcgcgaccattctggggagcctgccctcctcagccctgattgtgagtcttccatacttgaatagcggctatatcacagcaacagccctattaaccctttcctgcggtttgagtaccctttgccaatccggaatctatatcaacgtcctggacatcgcccctagatactcgagtttcctgatgggagcttcaagagggttttctagcatcgctcctgttatcgttcctacagtttcaggattcttgcttagccaagacccagagtttggctggagaaacgtttttttcctgctctttgccgttaacctactgggcttactgttttacttaatcttcggcgaggccgatgtgcaagagtgggccaaggaaaggaagctcactagactttag

SEQ ID NO: 241065 - DNA, 1263 bp, Artificial Sequence
  Description of Artificial Sequence: Synthetic coding sequence
atggccaccaagaccgagctcagccctacagctagagagtcaaaaaatgcgcaagacatgcaggttgacgaaacactgattcctaggaaagttcccagtctatgttccgcgaggtatggcattgcactcgtactccacttttgtaatttcacaacaattgctcagaacgtaattatgaacatcaccatggtggcaatggtgaacagcacatccccgcagtcccagcttaatgattcttctgaggtcctaccggtggattcgttcggaggcctctctaaggctccaaagagtctccctgctaaaagtagcatcctagggggacagttcgctatatgggagaagtggggacctccccaggaaagatctcggctttgctccatcgcccttagcggcatgttgctcggctgtttcaccgccatactgatcggcggttttatcagcgaaactctgggttggccttttgtgttctacattttcggtggtgtcgggtgtgtgtgctgcctcctttggttcgtcgtgatttacgacgatcctgtgtcctatccctggatttccacaagtgaaaaggaatacatcattagtagccttaaacagcaggtcgggtctagcaagcaaccactaccaattaaggccatgctgcggtcactgccgatttggtccatttgcctgggctgcttcagtcatcagtggctggtcagcactatggtggtatacatccccacttacatctcttctgtatatcatgtcaatatccgtgacaacggcttactgtccgctctgccttttattgtcgcttgggtgatcggcatggtcgggggttatctggcggattttctgcttacaaaaaaattcagactgatcacggtcagaaagattgccacaattctgggaagtcttccttcctccgctcttatcgtctccctgccctacctcaacagcggctacattactgcaaccgcactgctgacattgtcatgtggcttgagtactctatgccagagtgggatatacatcaatgtgctggacatcgctccaagatactcatctttcctgatgggcgcatcccggggttttagcagcatagcacccgtaattgttcctactgtgagcggattcctgctgtcccaggatcctgagttcggttggcggaatgtgttctttttgctatttgccgtcaacctgctgggcctccttttttacctgatattcggcgaggcagatgtccaggaatgggctaaagagcggaaactaactcggctgtag

SEQ ID NO: 241066 - DNA, 1497 bp, Artificial Sequence
  Description of Artificial Sequence: Synthetic coding sequence
atggccactaagacagagttatcacctacagccagagaatctaagaatgcccaggatatgcaggtagacgagaccttgatacccagaaaggtgccctcactgtgcagcgcccgatacgggatcgcactggtcttgcacttctgtaatttcacaactatcgcccagaacgtcattatgaacattactatggtggcgatggttaatagtacctcacctcagtctcagttaaacgacagctctgaggtactgcctgttgactcctttgggggactgagtaaagcacccaaatccctgcctgccaaggctcctgtgtatgattggtcaccacagattcagggtattatattcggcgctgtcggatacggaggcattctgactatggcccctagcgggtacctcgctggaagggtgggtacgaagagggtggtgggcatatcactgtttgctacatcgtttctgacattgtgcattcccctggctaccgattttggaatcgtcctgctgattgtgacacgcattgttcaaggactttctcagagtagcattctcggcggtcagttcgccatttgggaaaaatggggtccacctcaggaacgatcgaggttatgttccatagccttaagcggaatgctcttgggatgcttcactgcaattttgattggtgggttcatttctgaaacgctgggctggcccttcgtcttctatattttcggaggagttggatgtgtatgctgcctgctttggtttgtggttatctacgacgacccagtgtcatatccgtggatctccacaagcgagaaagagtatattattagctctcttaaacagcaggtagggtcctccaagcaacccctgcctattaaagctatgctgcggtcgctccccatatggtccatctgcctgggatgttttagccaccagtggctggtgagtaccatggttgtgtacatacctacatacatctctagcgtgtaccacgttaatattcgagataacggtcttctcagcgcactgccctttatcgtggcctgggtcattggaatggtgggagggtacttagccgacttcttacttaccaaaaaatttagactgatcacagtaagaaaaattgcgaccatactcggctctcttccatcatccgcccttatcgtaagcttaccatacctcaattcgggctatattaccgcaactgccctactgacccttagctgcgggttatcaaccctgtgccaatccggcatatatataaatgtgttggacatcgccccacggtactcctcctttctgatgggcgcttctaggggtttttcttctatagctcccgtaattgttccaactgtctctggcttcctgctgagccaggacccagaatttgggtggaggaatgtgtttttcctgctattcgcggtcaaccttctgggactgctcttttacctcatctttggtgaagcagatgtgcaagaatgggcgaaagagcgtaaactgaccagactttag

SEQ ID NO: 241067 - DNA, 300 bp, Artificial Sequence
  Description of Artificial Sequence: Synthetic coding sequence
tagactctttcatgtggcctcagcaccttatgccagagcggcatctacattaacgtgttggacattgcccctcggtattcatcattcctgatgggcgcttctagggggttctctagcatcgcccctgtcatagtgccaaccgtgagtgggtttctgctgagtcaggatccggagtttggttggcgcaacgtgttcttccttctattcgctgtcaacctgctcggtctgcttttttacctgattttcggagaagccgacgtacaggagtgggctaaggagagaaaactgacccgattatag

SEQ ID NO: 241068 - DNA, 156 bp, Artificial Sequence
  Description of Artificial Sequence: Synthetic coding sequence
tccggttttctgctgagccaggaccctgagttcgggtggagaaacgtttttttcctcctgttcgctgtcaacttactcgggctgcttttttacctgatcttcggagaggccgatgtccaggaatgggccaaggagcgtaaactcaccaggctctag

SEQ ID NO: 241069 - DNA, 1494 bp, Artificial Sequence
  Description of Artificial Sequence: Synthetic coding sequence
atgtctaccgggccagatgtgaaggctactgtgggggatattagcagcgacgggaacctgaacgtggcccaggaggagtgcagtagaaaggggttttgcagcgttagacatggactagctctgatactccagctgtgcaatttctctatctacacccagcaaatgaacttatccatcgccattccagctatggtcaataacaccgccccaccttctcaaccgaacgccagtaccgagcgtcctagcactgatagccagggttattggaacgaaaccctcaaagaatttaaggctatggcccctgcatacgattggagcccagaaatccaggggattatactgtcctccctgaattacggcagcttcctggctccaattcccagcgggtacgtggccggaatctttggtgccaagtatgtggtgggcgctggattgttcatcagctctttcttgactctcttcatccccttagcagcgaatgccggagtggccttgctgatcgtcctgagaattgtccaaggaatcgcacaagtgatggtgcttacaggccagtattccatttgggtcaaatgggctcccccactggaacgttcccagctgactaccattgctgggagtggctccatgcttggtagcttcatcgttctgttggccggagggcttctgtgccagacaataggctggccttacgttttttacatcttcgggggaatcggttgtgcctgttgtcctctgtggttcccgcttatttatgatgacccagtgaaccacccctttattagcgcgggagagaaacgctatattgtgtgcagcctggctcagcaggactgttcacctggatggagtctgccaatccgggcaatgatcaaaagcctcccattatgggcaatcctggtttcttacttctgcgagtattggctgttttataccataatggcctatacacctacctacataagttcagtcctccaggctaacttgagagatagcgggatcctttctgccctgccttttgtcgtgggatgcatctgtatcattctcggcggattactcgccgatttcctactgtcacggaaaatccttagactaatcacaattcgtaagcttttcaccgcaatcggcgttctatttccatcagtcattctggtctccttgccctgggtgcgatccagccatagcatgaccatgacattcttagtgctgagtagcgcgatcagcagcttttgcgaaagcggtgccctggtgaactttctagatatagctccgagatacacaggatttctgaaaggactgcttcaagtgttcgcacacattgcaggtgctatctctccaaccgctgcaggattttttatttcccaggatagcgagttcggatggagaaacgtcttcttactaagcgcagcggtgaatatctctggcctggtattttacctgattttcggtcgagctgacgtgcaggattgggcgaaagagcagaccttcacccacctgtag

SEQ ID NO: 241070 - DNA, 666 bp, Artificial Sequence
  Description of Artificial Sequence: Synthetic coding sequence
atgaacttatccattgccatcccagctatggtcaataacacagctcctccttcccaaccaaacgccagcactgagcggccaagcacagatagtcaggggtattggaatgagactttgaaggaattcaaagctatggactgcagtccgggatggagcttgcctatcagagctatgatcaagagcctccctctttgggccatccttgtgagctacttctgcgagtactggttgttttatacaataatggcctataccccaacatacatttcttcagtgctgcaggctaatttgcgggattccggcattttaagtgcactgcctttcgtcgtggggtgcatctgtattattctgggaggcctgttagcagacttcctcctaagccgtaagatcttacgactgataaccattaggaaactgtttacagctattggcaaaggcgagacgggccaccgcggagaacgcggtaagttacgtgccgcatttagcctattgtgcgtttgcccacccacacccggagtactgtttcctagcgtaatactggtctcacttccctgggtgagatccagccacagcatgactatgacctttctagtcttgtcatctgccatcagctcattttgtgagtctggggcactagtcaattttctcgacatcgctcctcggtag

SEQ ID NO: 241071 - DNA, 804 bp, Artificial Sequence
  Description of Artificial Sequence: Synthetic coding sequence
atgtccaccggccctgatgttaaggctaccgtgggggacattagctcagatgggaatctgaacgtagcacaggaggaatgttcgcgtaaaggtttttgctccgtcagacatggcctggctctgatcctccagctctgcaatttttctatctatacgcaacagatgaacctcagtatagcaattcccgcaatggtgaataacaccgcccctccatcacagccgaatgcaagcacggagcgcccttctacagattctcagggatattggaatgagacccttaaggaattcaaggccatgtccggcatattatcggcgctgccatttgtagtcgggtgtatctgtattatcctgggtggccttctcgctgactttctcttaagcaggaagattctgagattgatcaccattagaaagctgtttaccgccattggtgtgctgttcccctctgtcattctggttagtctgccctgggtgcgatcatcgcatagcatgacgatgacattcctggtgctaagtagcgcaatatcatccttttgtgagtctggcgctctggtaaactttttagacattgcacccagatacacagggttcttgaaagggctccttcaagtcttcgcccacattgcaggggcaatcagcccaacagccgctgggttttttattagccaggattccgagttcggttggcggaacgtgtttttgttaagcgctgccgtgaacatcagtgggctagttttctacctcatctttgggagagccgacgtgcaagactgggcaaaggagcagactttcacccacctgtag

SEQ ID NO: 241072 - DNA, 1749 bp, Artificial Sequence
  Description of Artificial Sequence: Synthetic coding sequence
atggagagcgtcaagcagcggattctcgcccctggtaaggagggcctcaagaactttgcgggtaaatctctcggtcagatttatcgcgtattggaaaagaagcaagacacgggggagaccatcgaattgaccgaggatggtaaacctcttgaggtaccagaacgtaaagcgcctctgtgcgattgcacctgctttgggctgcctaggcgctacattatcgccatcatgtcaggactcgggttctgcattagctttggcattcgttgcaaccttggagtggccatcgttgacatggtaaacaacagtactatacatcgcggaggcaaggtcattaaggagaaggctaagttcaactgggaccctgaaaccgttggtatgatccacgggtcattcttttggggctatatcatcacccagattcccggtggttatatcgcatcacgactcgccgcaaatagggtatttggtgcggctatcctgctgacttccacgctgaatatgttgataccaagcgccgcaagagtgcattacgggtgcgtaatctttgtgcgaatcctgcaaggccttgttgaaggggtgacataccccgcttgccacgggatttggtcaaaatgggctccccctctggagcgttcaagacttgcaaccacaagtttttgtggctcatacgccggagccgtaatcgcgatgcccctggccggtatcctggtccagtacaccggctggtcttcggttttctacgtttacggctccttcggcatggtctggtacatgttctggctgctcgtgtcatatgagtccccagctaagcaccccacaatcaccgatgaggagcgtcggtatatcgaggaaagcatcggtgagtctgccaacctcctgggagccatggagaaatttaaaaccccttggcgtaagttctttacgtcaatgcccgtctatgccatcatagtggcaaatttttgccggtcttggacattttacttgctcctcattagccagccggcatactttgaggaagtgttcggattcgagatatcgaaggtgggtatgctgtctgcagtcccccacctagtgatgaccataatcgtgccgatcggtggacagattgccgatttcctgcgttcaaagcagatcctttccacaaccacagtgagaaagattatgaactgtggcggttttggaatggaagcaacactgctcctcgtggttggatacagtcacacgaggggcgtggcaatttcatttctggtcctcgccgtaggcttttcaggttttgctatcagcggctttaatgttaaccatttagatattgctcccagatacgcgtccatcctgatggggataagtaacggagtgggcacacttagtggcatggtgtgccccatcatagtgggtgccatgaccaagaataaatcccgagaggagtggcaatacgtcttcctcatcgccgcactcgttcattacggcggagtcatcttttatgcaatcttcgcatccggcgagaagcaaccatgggcagatccggaggaaaccagcgaagaaaaatgcggattcattcacgaagacgagctggatgaagagacgggagatataacccaaaattacatcaattatggcacgacgaagtcgtacggagccacaacccaagccaatggtggctggcccagcggctgggagaagaaagaggagtttgtgcagggtgaggtccaggattcccactcctataaggaccgcgtggactatagttag

SEQ ID NO: 241073 - DNA, 1413 bp, Artificial Sequence
  Description of Artificial Sequence: Synthetic coding sequence
atgaaggctaaatttaactgggatccagaaaccgtcgggatgatccacgggtccttcttttggggctatattattacacagattcctggtggttatatagctagcagattagccgcaaaccgggtctttggcgctgccattctactgacgagtacactgaacatgctgattccttctgccgcaagggtgcattatggatgcgtcattttcgtaaggattctccaaggactggtggagggcgtaacatatcctgcttgtcatgggatttggtccaagtgggccccaccactcgaaagatcccgattggccaccacttctttttgcggctcctatgctggggctgttatagcaatgcccctggcgggaatcctcgtgcagtacacagggtggtcctctgttttctatgtctacggatcatttggcatggtttggtatatgttttggttgttagtatcctacgaatcccctgcgaaacatcccactatcaccgacgaagaaaggagatacatcgaagagtcaattggcgaatccgcgaatctgctcggtgccatggagaagtttaagactccctggcgcaaatttttcacaagcatgcctgtatatgccataattgtggctaatttttgcaggtcctggacattttatctccttcttatttctcagccagcctatttcgaagaggtcttcgggttcgaaatatccaaggttggcatgctcagcgccgtcccccacctggtcatgaccatcattgtacccattgggggacaaattgccgactttttgcgcagtaaacagattcttagcaccaccacagtcaggaagatcatgaactgtggaggttttggtatggaagccacactgctgttagtcgttggatattcgcatacccgcggtgtagccatatccttcttggtacttgcggtgggcttctccggctttgccatttctggattcaacgtgaatcacctggacattgcccctaggtatgcctccattctcatgggaatctcaaatggagttggaacgctatctggcatggtgtgtcccattattgtgggagctatgactaagaacaaaagccgggaagaatggcaatacgtgtttcttattgcggcactggttcattacgggggagtgatcttttatgcgattttcgccagtggcgagaaacagccctgggccgatcccgaggagacttccgaggagaagtgcggattcatccatgaggatgagcttgacgaagagacaggggatattacccagaattatatcaattatggcactacaaaatcttacggcgcaacaacccaagcaaatgggggttggccctcaggatgggagaagaaggaagagttcgtgcagggagaggttcaggactctcatagctacaaggatcgagtcgactactcatag

SEQ ID NO: 241074 - DNA, 5223 bp, Artificial Sequence
  Description of Artificial Sequence: Synthetic coding sequence
atgggggagaaattagaactccgactgaagtcaccagttggagctgagcccgctgtgtatccctggcctcttccggtgtacgacaaacaccacgatgccgctcatgagattatcgaaacaatacggtgggtgtgtgaggagatccctgaccttaaattggcaatggagaattatgtactgatagactatgatactaagtccttcgaaagtatgcagcggctctgtgacaagtacaatagggcgatcgatagcatccatcagctatggaagggcactacccaacccatgaagttgaacacccgaccctccaccggccttctgcggcacattctgcagcaggtttataatcatagtgtgacagaccccgagaaactaaacaactacgagccattcagccctgaggtgtacggagagaccagcttcgatttagttgcacaaatgatcgacgaaatcaagatgaccgatgacgatctgttcgtcgacttgggctctggagttgggcaggtggtgttgcaggttgcagcagcgacgaattgcaagcatcactacggagtggaaaaagcggacatcccagccaagtacgccgagaccatggaccgggagttcaggaaatggatgaagtggtacgggaaaaaacacgcggaatatacactggagcgcggagactttctttccgaagaatggagggaaaggattgccaataccagcgtcatattcgtcaacaactttgcattcggcccagaggtcgaccaccaacttaaagagcgtttcgccaacatgaaggagggagggaggattgtttctagcaaacctttcgcacccctgaatttcagaataaactcgcgtaacctgagcgatattggcactatcatgcgtgtagtggagctaagccccctgaaaggttccgtgtcctggaccggaaagcccgttagctactacttgcacaccattgaccgcacgatactagagaattatttctctagcctaaaaaatcccaaactccgcgaagaacaggaagcagcaaggcggaggcagcaacgtgaaagcaagtctaacgcagctacgcccactaaaggccctgaaggaaaggtggctggcccagccgacgccccaatggatagtggggcagaagaagaaaaagcaggggctgctactgtgaaaaagcccagtcccagtaaggcccgtaagaaaaagctgaataagaaaggtcgtaagatggctgggagaaaaaggggacgaccaaaaaagatgaatactgcaaaccctgaacggaagcccaaaaagaatcaaacagcgctcgatgctctgcacgcccagactgtttcccagaccgccgcatcatcaccacaggatgcctaccggtcgccccatagccccttctaccagctgccaccaagcgttcagagacacagccctaatcctcttctcgtcgctcctactcctcccgcattgcagaaattgctggaatcattcaaaattcagtacctgcagttcctggcctataccaaaaccccacaatataaggcatccctacaggagcttctaggtcaggagaaggaaaagaatgcccaactactgggagccgctcagcagctgctgtctcactgccaggcacaaaaggaggaaattcgcaggctgtttcagcaaaagctcgacgaattaggcgttaaagcactcacatataatgatctgattcaagcccaaaaggagattagtgcccacaatcagcaactccgagaacagtcggagcagcttgagcaggacaacagagccctacgcggtcaatcacttcagctcttgaaagccaggtgtgaggagctacaactggactgggccaccctctcccttgagaagctcctgaaagagaaacaagccctcaagtctcagatttctgaaaagcagcgacattgtttagaacttcagatttctatagtagagcttgagaaaagtcagcggcagcaggaactactgcaactgaaatcctgtgtgccccctgatgatgctcttagtctgcatctccgtggcaagggagctcttggacgggagttggagccagatgctagtaggctgcatttggagctggactgtacaaaattttctctgccgcacctgagcagtatgtcacccgaactttccatgaatggacaagccgctggctacgaactctgtggcgtgctctctcgcccaagtagcaagcagaacacacctcagtacttggccagccctcttgaccaagaggttgtgccatgtacaccttctcacgtagggaggcctcgtctagaaaagctctccgggctggcggctcctgattacactcggctttctcctgcaaaaatcgtacttaggaggcacctgtcacaggaccataccgtgcctggtagaccagcggcatctgagttacactccagagccgagcatacgaaggagaatgggttaccatatcaatccccctcggtgccagggtccatgaagctctcaccacaggatccgagacccctctcaccaggggctctgcagctcgctggcgagaaatcaagcgagaaggggctgagagagagagcctacggtagctctggcgaactgatcacctcattacctatctctattccactgtcaacagttcagccaaacaagctgcccgtgtctatcccactcgccagcgtcgtcctgccgtctagggcagaaagggcgaggtctactccctcccccgtgttgcagcctcgcgatccctcctctaccctagagaagcagatcggcgcaaatgcacatggcgctgggtccagaagcttggcactggcccctgcgggtttttcatatgcgggatccgtcgctattagcggagcgctggctggctcgccggcatctctcaccccaggcgctgaacccgctacattggatgaatcaagttcttctgggtccctgttcgccactgtagggtcacggtcctcaactccccagcacccactgttgctggctcaaccacgcaacagtctccctgcctctccagctcatcagctctctagctcccctcgactggggggtgccgcacagggaccactccccgaggcttcgaagggggacttgcccagcgatagcggattcagtgaccccgagtcagaagctaaaagaaggatcgttttcaccatcaccaccggggctggtagtgccaagcagtccccttctagcaagcattcccccctgacggcctcggctaggggcgattgtgtgccctctcacggccaggatagtcggaggaggggaaggagaaaaagggcgtccgctggcacaccgtccctgagcgccggtgttagcccgaaaagacgggctctcccctccgtcgccggtctcttcacccagccatcgggatctccccttaacctcaactcgatggttagcaacatcaaccagccactcgaaatcaccgctatctccagtcccgagaccagtttgaagtctagccccgtcccttaccaggaccacgatcagccccctgttctgaaaaaggagcgtccattgtcccagacaaatggggcacattatagtccgctgacgagtgacgaggagcctggttccgaggatgagcccagctctgcaagaattgagcggaagattgcgacaatctccctcgagtcgaagtctccccctaaaacattagagaatggcggtggtcttgctgggaggaaacccgctcccgcaggagagcccgttaatagtagcaagtggaaatccacattttcgccgatatctgacatcggccttgcgaaaagcgctgattctcccctgcaggcttcttcggctctgtctcagaatagcctgttcacatttcgcccagcactggaagagcccagtgccgatgcaaagttagctgcacaccctcggaagggctttcccggaagcctgtccggtgctgacggtctttcacccggtacgaaccccgctaacggatgtaccttcggaggtggtctggccgcagatttgtctctacacagctttagtgacggcgcatcactgccccataaaggaccagaagccgcaggactctcttcacccttatccttcccgagccagcgcggtaaggaaggaagcgatgccaatccgtttctgtctaagagacagctcgatggtctcgccggtctcaaaggtgaggggagtcggggaaaggaagcaggggaggggggactgccactgtgtgggcctacagataagactccactgctgtccgggaaggcagccaaggctagggaccgtgaggtcgatttgaaaaacggccacaacctcttcatctcagccgctgccgtccctcctggctccctcctgtccggacccggacttgctccggctgccagctccgccggaggcgctgcttcctcagcgcaaacacatcgtagctttctggggccttttcctccaggcccacagtttgcactggggccaatgtccctgcaggcgaacctgggctccgtcgcgggttccagcgtcctgcaatccctcttctccagcgtgcctgccgcagccggactagtccatgtgtccagtgccgctacccgactgaccaactcacatgcaatgggatccttttccggcgttgccggaggaaccgttggggcaggtggagtattcaaccacgccgtcccatccgctagcgcgcatccatttggtgcacgtgtgggcaggggagccgcttgcggtagtgcaaccctgggcccatccccgcttcaagctgcggcatcggcatcagcctcgtctttccaagcccctgcatccgtggaaacccgcccacccccacccccaccacctcctcctcctcccctcccgccaccagcccatttgggtcgttcaccagctggcccacccgtgttacatgctccgcctcccccaaacgcggcacttccccctccgccaacgctcctagcctcaaatcccgagccagctctgctgcagagcctggcctccctgccaccaaaccaggcattccttcccccaacttctgccgcaagcctgccccctgccaacgctagtttgtcaataaaacttacctcactaccccacaagggagctcgaccttcatttaccgtccatcatcaacccctcccacgactcgccctagcacaggcagctcccggaataccccaagcctccgccaccggaccatcagcagtttgggtaagtctggggatgccccctccatatgccgctcacctctccggcgtcaaaccaaggtag

SEQ ID NO: 241075 - DNA, 1647 bp, Artificial Sequence
  Description of Artificial Sequence: Synthetic coding sequence
atgggaagtcaacttgccttggctggccttctcgaaaaacggcaggaaggagctgaaaccctggagctaagcgctgacggtagaccagtgaccacccaaacgagagacccccctgtggtcgattgtacttgctttggtctccccagacgatatatcattgccattatgagcggcctgggtttctgtatatctttcggtatccgctgtaatctcggcgttgccattgtgagtatggtgaacaacagtactacacacaggggcggtcacgtggtagtgcagaaagcacaatttagttgggatcccgagaccgtggggcttatccatggctcgtttttctgggggtacatcgtaacccagatcccaggcggattcatctgccagaaattcgcagccaatcgggttttcggttttgctatagtggccacatccactttgaatatgttaatcccgtctgccgcaagagttcattacggatgcgtgatatttgtcaggattctgcagggactggtggaaggtgttacttacccggcttgtcacggcatttggagcaagtgggcccctcccctcgagagatctaggcttgcgacgacagccttttgcggctcctacgccggtgccgtagttgctatgccattggcaggtgtgctggtgcaatactcaggctggagctctgttttctacgtgtacggcagcttcgggatcttttggtatttattctggctgttggtgtcctacgagagtccagctcttcacccttcaatctctgaggaggagcgaaaatatattgaagacgcgataggtgaaagtgccaaattgatgaatccgctgactaaattcagcaccccttggcgccgattcttcacctctatgccagtttacgcgatcatcgttgccaacttttgccgttcctggacattttacttactactgatctcccagccagcttacttcgaggaagtgttcggattcgagatcagtaaagtagggctcgtgagcgcactaccccatctggtaatgactattattgtgcctatcggcggacagatcgcggattttctccgcagtcgaaggattatgtcaacaaccaatgtccgaaaactcatgaattgcggcggatttggaatggaggctacgctgttgctggtggtgggttactcccacagcaagggggtcgccattagctttttggtgcttgcggtgggattcagcggatttgccatctccggattcaacgtgaatcacctggacattgcgcctagatacgcttctatactgatgggaatctccaacggagttggcacgttaagcggaatggtgtgtcctataatcgtcggcgcaatgaccaaacacaagaccagggaagagtggcagtacgtgttcctgattgccagcctcgtgcactacggtggtgttattttttatggtgtgtttgcctccggtgagaaacagccctgggctgaaccagaggagatgtcagaagagaaatgtgggttcgtgggacacgaccagctggctgggagcgatgatagcgagatggaggacgaggccgagcccccaggtgcaccacccgcaccacctccttcttatggggctacacattcaactttccagccccctcggcctccccctccggttcgggattactag

SEQ ID NO: 241076 - DNA, 1770 bp, Artificial Sequence
  Description of Artificial Sequence: Synthetic coding sequence
atgcccttcaaggcattcgatacattcaaagaaaagatcctcaaacctggtaaagagggggtcaaaaacgccgtgggggattctcttggaatcctgcagagaaaaattgatgggacaaccgaggaagaagacaacatcgaactcaatgaagagggccgtccggtgcagaccagccgtccatcccctcccctctgtgactgtcactgctgtggcttgccaaaacgctatatcattgccattatgtcaggcctgggattctgtatttcatttggaatcagatgcaacctgggagttgcaattgtggagatggtgaataatagtacagtttacgtagacggaaagccagagatccagacagctcagttcaactgggacccagaaaccgtcggattgattcatggctcttttttttggggatatattatgacgcagattcctggcggttttatcagcaataagtttgcagcaaacagggtgtttggagctgctattttcctgacctccaccctgaacatgttcataccatccgcggctcgcgttcattatggttgtgtgatgtgcgtcagaatcctgcaaggcttggtggaaggggtcacataccctgcatgccacggaatgtggagcaagtgggccccaccactcgaacgctcaagattagctacaactagcttttgcggatcttatgcgggtgccgtggttgccatgcctctggccggagtcttggtgcagtacattgggtggtcttccgtattttacatatacggtatgtttggcattatatggtacatgttctggcttctgcaggcctatgagtgccctgcagcgcatcccacaatctcgaacgaagagaaaacttacatcgaaacttccattggtgaaggagccaatgtggtgagcctctccaagtttagtactccatggaagcgcttttttacaagtttacctgtatacgccatcatcgttgcaaacttctgtagatcttggacgttttacctgcttctcatttctcagccagcctacttcgaggaggtatttggctttgccatctcgaaggtcggcttgctgagtgcagttccacacatggttatgaccattgtggtccctattggaggtcagctagccgactacctccgctctaggcagatactgacaactacagctgtgcgcaagattatgaattgcggaggtttcgggatggaagcgactctgctgctggtcgtgggattctcacatactaagggggtcgccatttccttcttggtcctggccgtgggatttagcggtttcgctatatctggttttaatgtcaaccatttggacatcgcccctagatacgcgtccattctgatgggcattagtaacggtgtcggaaccctgtctggcatggtatgtcccctcattgtgggtgctatgacacgccacaaaacgcgggaggagtggcagaatgtctttctgattgctgccctagttcactattcaggcgtcattttctatggtgtgttcgcttccggggaaaaacaggaatgggccgatcccgagaacttgagcgaggagaaatgcggaattatcgaccaagacgagctggcagaggagatcgaactgaatcatgagtcatttgcctcgccaaaaaagaaaatgtcctacggggctaccagccagaactgtgaggttcagaagaaggaatggaagggccagagaggagctactcttgatgaagaggaactcacatcgtatcagaatgaggaacgcaacttcagcacaatttcttag

SEQ ID NO: 241077 - DNA, 1620 bp, Artificial Sequence
  Description of Artificial Sequence: Synthetic coding sequence
atgccatttaaagcattcgataccttcaaagagaagatcctgaagccaggcaaggagggagtaaagaacgcggtgggagactccctgggaattctccagaggaagattgatggaactaccgaggaagaagataatattgagctgaacgaagaaggtaggcctgtgcagacatcaaggccaagtccccctctctgcgattgccattgttgtggtctccctaaacggtacataatagccataatgtcgggtctgggattttgcattagcttcgggatcagatgtaaccttggggtcgccatagttgagatggtgaacaacagtaccgtgtacgttgatgggaagccagagatacagacagcccaattcaactgggacccagagacagtcgggttaattcacgggtcttttttctggggttatattatgacacagattcccggtggcttcatctccaacaagtttgccgcaaatcgcgtctttggagctgccatcttcctaacctcaactctgaatatgttcatacctagcgctgctagagtgcattacggttgcgtcatgtgcgttcggatcttgcagggtcttgttgagggcgtgacttaccctgcttgtcacggcatgtggtccaagtgggccccaccgctcgaacggtccaggctcgctacaacttccttctgtggaagttatgcaggggctgtcgtggctatgcccctggcgggtgtgctagtgcagtacatcggatggtcttctgtgttttatatctatggtatgttcggcatcatttggtacatgttctggctgctgcaggcttatgagtgccctgcagcacaccctactattagcaacgaagaaaagacatatatcgagaccagtattggagagggcgctaatgtcgtgagcctctcggtgggcctgctgtccgctgtaccacatatggtgatgactatcgtggtccccatcgggggacagctggctgactatttgcggtcacggcaaatcctgaccaccacagccgttcgcaaaatcatgaattgcggtgggtttggaatggaagctactttgctcctggtggttggcttctctcacactaaaggagttgctatctcatttctggtgctggcagtgggcttttcagggtttgccatcagcggtttcaatgtgaatcatttggatattgcaccgagatacgcatccattctgatgggtatctcaaacggcgtggggacattatctggaatggtgtgtcctttaatcgtaggggcaatgacccgacacaagacacgagaggagtggcaaaacgtctttttgatagccgcactggttcactactcaggagttattttctatggggtgttcgcctccggtgagaaacaagagtgggccgatcccgagaacctaagcgaggaaaagtgtggtattatcgatcaggacgagctggcggaggagattgagctgaatcatgagagcttcgctagcccgaaaaaaaaaatgagctatggcgcaacctcacagaattgtgaagtgcagaaaaaggagtggaaaggtcaacgaggagccacccttgacgaagaggagctgacctcctatcagaatgaagaaagaaatttctcaaccatctcttag

SEQ ID NO: 241078 - DNA, 1293 bp, Artificial Sequence
  Description of Artificial Sequence: Synthetic coding sequence
atgaccctcacttcccgacggcaagactctcaggaggctagacctgagtgccaggcttggaccggcaccttgctgctgggaacttgtctgctttactgcgcacgatcttccatgccgatctgcacagtcagtatgtcccaagactttgggtggaataagaaggaggctggaatcgtgttatccagcttcttttggggctattgcctcacccaggtcgtcggaggccacctgggagaccggataggaggcgaaaaggtgatcctattaagtgcttccgcatggggctcaattactgccgtcaccccgttactggcacatttgtccagcgctcacctggccttcatgacattctcaaggatcctgatggggctgctgcagggtgtatatttccccgcactgacaagcttactcagccagaaagttcgggagagcgaacgggcatttacctattctatcgtgggtgctggatcgcagtttgggactttgctgactggcgctgtcggatctctgttgttagagtggtacggttggcagagcatattctacttcagcggcggtttgacccttttgtgggtttggtacgtgtatcggtatcttctctctgagaaggacctaatcttggccctcggcgtcctggcacaaagccgtcccgtctcacgccataatcgagtgccgtggaggcgcctgtttcggaagcccgcagtctgggccgctgttgtttcccagctttccgcggcatgttctttctttattctacttagctggttgcccacgtttttcgaggaaacttttcccgacgcaaaaggttggatcttcaacgtggtgccctggctggtggcaattcctgcgagcctcttcagcggtttcctcagcgatcacttgatcaatcaggggtaccgcgctattaccgtaagaaagctcatgcagggaatgggattgggcttgagcagtgtgtttgcactgtgtctcggccatactagttctttctgcgaatccgtggtctttgcttcggcatcaatcggcctgcagacctttaaccattctggaatttccgtgaacatccaggatcttgcccctagctgcgccggatttctgtttggagtggcaaacaccgcaggggctctggctggtgtggtgggagtatgtctgggtgggtatctcatggagaccacgggcagctggacatgtctgtttaacctggtcgccatcatttctaatctgggtctttgtacctttttggtattcgggcaggcccagagagtcgacctctcatcaactcacgaggacctatag

SEQ ID NO: 241079 - DNA, 1311 bp, Artificial Sequence
  Description of Artificial Sequence: Synthetic coding sequence
atgcagccccctccagatgaagctagaagagatatggcaggcgacacacaatggtccaggccagagtgccaggcctggactggtacccttcttttagggacttgcctgctctactgtgccaggtcaagcatgcctatctgcactgtgagtatgtcacaggacttcgggtggaacaaaaaggaagcgggtatcgtgcttagcagctttttctggggctactgcctgacgcaggttgtgggaggccatctgggagatcgtattggtggcgagaaggtcatcctgttatccgcctctgcctggggaagtatcacagccgttacgcctctgttggcccacctgtcatctgcccacctggcttttatgacttttagtagaattctaatggggctgctgcagggcgtttactttcctgctcttactagtctcttgtcacaaaaggtgcgtgaaagtgagagggcattcacctattcgattgtgggggcaggatctcagttcgggaccttactgacaggcgctgtcggaagtctcctgctagagtggtacggctggcaatctatcttctatttcagtggagggctcactctgttatgggtgtggtacgtctatcggtacctgctatctgagaaggatcttattttggccctgggcgttctggcacagagcagacccgtgtcaagacacaacagggtcccgtggcgtcgcctgtttcgaaagccagccgtctgggcagcagtggtgtcacagctatccgctgcttgcagcttcttcatccttctctcatggctgcctaccttcttcgaggaaacgtttcccgacgccaagggctggatcttcaatgtggtcccctggttagttgccattcccgcatctctgttttcagggttcctcagcgatcatcttatcaatcagggataccgtgccatcaccgtacgtaaacttatgcagggcatggggctggggcttagttcagttttcgccctgtgtctcggacatacaagctcattctgcgagtctgtggtgtttgcaagtgccagcattggcctgcagacctttaatcactccgggatttccgttaatatccaggatctcgcgccatcttgtgctggattcctctttggggtggccaatactgctggggctcttgccggtgttgtcggtgtatgtctggggggatacctaatggagactaccggctcttggacttgcctgtttaatcttgtggccattatctctaatcttggcctctgtactttcttggtgttcggccaggcccagcgggtcgacttaagtagcacgcatgaggatctctag

SEQ ID NO: 241080 - DNA, 459 bp, Artificial Sequence
  Description of Artificial Sequence: Synthetic coding sequence
atgtttccacgccctggggctttgagttggacagtccgcagacacactcctagacaggtggaaccaccatgcgtatgtatgacgctgacatcccgaaggcaagattcccaggaggccaggcccgagtgtcaggcatggactggtacccttcttttaggcacatgtctcctgtactgtgcacggtcttcaatgccgatttgcactgtgagtatgagccaggattttgggtggaacaagaaagaggctggtattgttttaagttccttcttttgggggtattgccttacacaggtcgtcggaggtcacctaggagacaggattggcggagaaaaagtgatactcctgagtgccagtgcttggggcagtatcactgccgtgacccccctgctggctcacctcagtagcgcacacttagcctttatgacattctctaggatactgatgggactcctccagtag

SEQ ID NO: 241081 - DNA, 1599 bp, Artificial Sequence
  Description of Artificial Sequence: Synthetic coding sequence
atggaatccgctgagcctgccggacaggcccgagccgcagccactaagctcagcgaagctgtcggagccgcattgcaagagcctcgcaggcaaagacggctcgtcctggtcatcgtgtgcgtggccctcctactcgataacatgctgtacatggtgatcgtgcctattgtgccagattacatcgcacacatgcggggtggcggtgagggacccacacggactcccgaggtatgggagccaaccttgcccctgcctactccggcaaacgccagtgcctatactgctaatacctccgcaagccccaccgccgcatggcccgcaggctctgccctgcgcccacgataccccacagagagcgaggacgtaaaaatcggggttttgtttgcctctaaggctattctgcagctgttagttaatcccctaagtggaccgttcattgacaggatgtcctatgatgtgccgctgttgatcggacttggagttatgttcgccagcaccgtgttgtttgcattcgcggaggattacgcgacactgttcgctgccagaagcctgcagggcctaggaagcgctttcgcggacaccagtgggatcgcgatgatcgcagataagtatcccgaagaacccgaacgttcgagagctctgggcgtggccctcgcctttatatctttcgggagcctggtggcgccaccttttggagggattctctacgagttcgccggaaaaagagttccattcctggtcctggctgccgtgtcacttttcgatgccctcctgctcttagccgtggccaaaccattttctgccgcagcaagggctcgcgcaaatctcccagtgggaaccccaattcacaggctgatgctggatccatacatcgcagtggtggccggtgccttaactacgtgcaatatccctcttgcctttctggagcctaccatagccacctggatgaaacacaccatggccgcatccgaatgggaaatggggatggcctggctaccggcattcgtgcctcacgtgctcggtgtctatctgacagttcgcttggctgccaggtatcctcatctgcaatggctttacggagcattaggcctggctgtgatcggagccagttcctgtatagtgcccgcatgccgcagctttgcccctttggtggtgtcactatgcggcctctgcttcggaatcgccttggtggatacagctcttctgccaactctggcgtttctggtcgacgttcgtcacgtatccgtgtacggctcggtgtacgccatcgccgatatcagctattcggtggcttatgcccttggcccaattgtcgcaggccacattgttcatagtctcggctttgagcaactgtctctagggatggggctggctaacctgctgtacgcaccagtgctgctgttactgcgtaacgttggcctcctgactcgatcacggtctgaaagagacgtcctacttgatgaacccccacaaggactgtatgatgccgttagactcagagagcgccctgtttccgggcaggatggcgaacccaggtctccccctgggcctttcgacgcttgtgaagatgattacaactactactatacaagatcttag

SEQ ID NO: 241082 - DNA, 1482 bp, Artificial Sequence
  Description of Artificial Sequence: Synthetic coding sequence
atgctcaggaccatccttgacgctccccagcgcctgctaaaggaagggagagcctctagacaactggtcctggtcgtcgtatttgtggccctgctgctggataatatgttatttactgtcgttgtcccgatcgtcccgaccttcctgtacgacatggaattcaaggaggtcaacagttctctgcacctgggacatgctgggtctagtccccacgcactagcctcacccgcattctccactattttctcttttttcaacaacaacaccgttgccgtggaagaaagtgtgccctctggaatcgcttggatgaacgatacagcgtccactatcccccctcctgctactgaggctatctctgcccataagaacaattgcttacaaggcacgggtttcttggaggaggagataacgagggtgggcgtgctgtttgcttcaaaagccgtcatgcaactgctggtaaacccctttgtgggccctctcaccaaccgcattggataccatatcccaatgtttgccggtttcgtgatcatgtttctctctacagtgatgttcgccttttccggaacttatacgttgctgtttgttgcgaggactctgcagggaataggctcttctttttcgtcggtagctggtcttggaatgctcgcttcggtgtacaccgatgaccacgagcgtggaagggccatggggaccgctctggggggactagcgctgggactcctggttggcgcaccattcgggtctgtcatgtatgagtttgttgggaagagcgcaccttttttgatactcgccttcctcgcccttctggacggtgctctgcagctgtgcattttacagccatccaaggtgagccccgagagtgctaaaggcacccccctcttcatgctgctcaaagatccctatatattggtcgctgctggcctggccttcctccctgctagtgtgtcctatttgattgggacgaacctcttcggtgtgctggctaacaaaatgggcagatggttgtgcagccttatcggaatgcttgtggtggggacgtcattactgtgcgtgccacttgctcataacatattcggtctgattggtccgaacgctggactcggactggcaatcggcatggtggatagtagtatgatgcccattatgggccatcttgtagacctgagacacacgtctgtctacggaagcgtttatgccattgccgatgttgccttctgtatggggttcgctatcgggcctagtacaggcggagctatcgtaaaagctataggattcccatggcttatggtgatcactggagtgatcaatatagtgtacgccccactctgctactaccttcgatccccaccagctaaagaggagaagctagctatcctttcgcaggattgcccaatggagacaagaatgtatgcgacacagaaacccacaaaagagtttcccctgggggaggatagcgacgaagaaccagatcacgaggaatag

SEQ ID NO: 241083 - DNA, 1578 bp, Artificial Sequence
  Description of Artificial Sequence: Synthetic coding sequence
atgctgaggaccattctggacgcaccacagcgcctgctgaaggagggacgggcatcaaggcaacttgtgctcgtcgtagtgttcgtcgcccttctccttgacaacatgctctttacagttgtggtgcctatcgttccaactttcctgtatgacatggagtttaaggaggttaactctagtcttcatcttggacacgccggatcctcccctcacgccctcgcttccccggcattttccactatttttagctttttcaataataataccgtcgcagtggaagaaagcgtgccttcaggcatcgcctggatgaatgacacggcctccaccataccccctcctgcgaccgaggctatatcagcccataagaacaattgcttgcagggaacagggttcctggaggaggagatcacccgcgtcggcgtcctgttcgccagcaaagccgtgatgcagctgttggtgaacccctttgtagggcctctgaccaaccggataggttaccacatcccaatgtttgcaggttttgtcataatgttcctgtctacggtgatgtttgcatttagcgggacatacacgctgctctttgttgccagaaccctccagggaatcggctccagcttctctagtgtagctggacttggcatgctcgcttccgtatacaccgacgaccatgaaagggggcgtgctatgggaaccgcgctcggtgggctggctttaggccttttggtgggcgctccatttgggtctgtaatgtatgaattcgtgggaaaatcagccccttttctgatcctggccttcctggccctgctggacggcgcactgcagctctgcatcttgcagcccagcaaagtctctcccgaaagcgcgaaaggaacaccgctctttatgcttctgaaagatccctatattttggtcgctgctgggtccatatgttttgcaaacatgggcgtcgcgatcttggagcccactcttcccatctggatgatgcagacaatgtgcagtcccaagtggcagctgggcctcgcatttttaccggcaagtgtcagttacttgatcggcaccaacctgtttggggtacttgccaataaaatggggcgatggctctgttctcttatcggtatgctggtggtagggacctctttattatgcgtgcctctggcccacaatatttttgggctgatcggacccaatgctggtctaggcctggcaattgggatggtggattcttccatgatgccaataatgggtcatctggtagacctgcgccatacgtcagtttatgggtccgtttatgcgatcgccgacgtggcattttgcatgggttttgctattgggccaagcactggaggcgctattgtcaaagcaattggattcccttggttaatggtgataacaggggttataaatatcgtgtacgcgcctctctgctactacttgagaagcccccctgcgaaagaagaaaagttggctatcttgtctcaggattgccccatggagacaaggatgtacgctactcagaagccaaccaaagaattcccgctcggagaagacagcgacgaagaacccgaccatgaggaatag

SEQ ID NO: 241084 - DNA, 1419 bp, Artificial Sequence
  Description of Artificial Sequence: Synthetic coding sequence
atgttaagaacaatcttggacgcgcctcagaggcttctgaaggaaggacgagcttctcgccagctggtcctagtggtggtgttcgttgcacttctgctcgacaacatgttgttcacggttgtcgttccgatagtgcctacattcctttacgacatggagttcaaagaagtcaattcgagcttgcacttgggccacgccggaagctctccacacgccctcgccagccctgcattctcgaccatcttttcttttttcaataataacacagtcgcagtggaagaatcagtgccctctggcatcgcgtggatgaacgatacagcatctactatacccccacccgctaccgaagccatctccgctcataagaataactgtctccagggaacaggctttcttgaagaagaaattacccgcgtcggagttctctttgcctcaaaggcggtgatgcagttgcttgtgaacccatttgttggtccccttaccaatcgcattggctatcacatcccaatgtttgccggttttgtaattatgtttctgtctactgtcatgtttgccttctccggaacttacacccttctgttcgtggcacgcacactccagggaattggaagctcattttctagtgtcgctggactgggaatgctggcaagcgtgtacacagatgaccatgaacgcggaagagcaatgggaactgcacttggtgggctggccttgggcttactggtcggggcaccctttggaagcgtcatgtacgaatttgtcggcaagtcagctccattcctgattttggcctttctggcgctgctcgatggcgctctgcagctttgtatcctgcagccttcaaaggtgtcccccgagtctgccaagggtacgccgctgttcatgctgcttaaggatccctacatccttgtggccgcaggatccatctgcttcgcaaacatgggcgtggcgatactggaaccaacacttcccatttggatgatgcagaccatgtgctcacctaagtggcagctgggcttagctttcctgcccgcttccgttagctatctgatagggacgaaccttttcggcgttttagctaataaaatgggccgatggctgtgctctctgatcggcatgctggttgtgggcacctcactgctctgcgtccctctcgctcacaacatctttgggttaattggccctaatgctgggctgggcctggccataggcatggtggactcaagcatgatgcccattatgggtcaccttgtggacctacgacacactagtgtgtatggcagcgtctatgccatcgccgatgtcgctttttgtatgggcttcgctattggctacagcgagagcggtctgcctcacggagaccccgacgtctgtaatcccgaggcccacgaggggatcagcagcgggggaggccagtag

SEQ ID NO: 241085 - DNA, 1578 bp, Artificial Sequence
  Description of Artificial Sequence: Synthetic coding sequence
atgctgaggactatactggacgctccacagcgcttgctgaaggagggaagagccagtagacaattggtgctggtggtagtgttcgttgcactcctgctagacaatatgcttttcacagtggtcgtcccaatcgtgcctacatttctttacgatatggagttcaaggaggtgaatagctcattacaccttgggcacgccggtagctcgcctcacgccctcgcaagcccagcattcagcacgatcttctcattttttaacaacaatactgttgcagtcgaagagagcgtcccatccggcatcgcctggatgaatgacaccgccagcactatcccccctccggctacggaagctatctcggctcacaaaaacaattgtcttcagggcactgggttcctcgaggaagaaatcaccagagttggagtgctatttgcctcgaaggccgtgatgcaattgttggtgaacccattcgttggccctcttacaaatcgaatcggttatcacatccctatgttcgctggctttgtgatcatgttcctctcgaccgttatgttcgcgttcagcggaacctacactctgttgtttgtggccaggactctccagggcatcggcagtagctttagttccgtcgccggattgggtatgttggcgtccgtgtacacagacgaccacgagagagggagagccatgggaaccgctctaggcggactggccctgggcctgttggtgggagcacccttcggatcagtgatgtacgaattcgtgggtaagtctgctcccttccttatattggccttcctggcgctccttgatggagcactccaactctgcatacttcagccaagtaaggtaagtcctgaatccgccaagggaactcctctgtttatgctgttaaaagatccttatatcctcgtcgctgctggaagtatttgctttgccaatatgggcgttgctattttggagcccaccctgccaatctggatgatgcagaccatgtgttcccctaaatggcaactgggtctggcgttcttacctgctagcgtctcttatttaatcgggacaaatctgtttggtgttctcgccaataaaatgggacgatggctctgctcactaattggaatgctcgttgtggggacttcgttgctctgcgtacccctggcccacaacattttcggactgataggtcccaacgccggtctcgggttagcaattggtatggtggattcgtctatgatgcctataatggggcacttggtggacttgaggcatacctcagtgtacggcagcgtgtatgcgattgccgatgtggcattctgtatgggctttgcaatcggaccctcaaccggaggcgcaattgtcaaggctatcggttttccctggctcatggtgattaccggggtgataaatatcgtttacgcgccactctgttattacctgcgaagtcctccagcaaaggaggagaagctggccattttgtcccaggattgcccaatggagactaggatgtacgccactcagaagcccaccaaggaatttcccctgggcgaagactcagacgaagagccagatcacgaggaatag

SEQ ID NO: 241086 - DNA, 1158 bp, Artificial Sequence
  Description of Artificial Sequence: Synthetic coding sequence
atgctaaggaccattcttgatgccccacagaggctgctgaaggaggggagagccagccggcaattggtgctagtggtggtcttcgttgcactgctgcttgataatatgctcttcacggtcgtggttcctatcgtgcctacgttcctttatgatatggaattcaaggaggtgaactcctcattgcatctggggcatgctggctcatcaccccatgctttggcttccccagccttctctaccatttttagtttcttcaataacaataccgttgccgtggaagagagtgtcccatcggggattgcctggatgaatgatacagcatccactataccaccacccgctaccgaggccatctcagcccataagaacaattgtctgcaggggactggattcctggaggaggaaatcactcgagtcggcgtcttatttgcttctaaggccgtgatgcagctccttgttaacccctttgtaggccctctgaccaaccgcataggctaccacattcctatgtttgccggattcgttatcatgtttctgtcaaccgtcatgtttgctttttcaggcacatacaccctgctcttcgttgcgagaacactccaaggaattggtagttccttctccagtgtggccggtctgggcatgcttgcctccgtatatacggatgaccacgagcggggacgcgctatgggcacagcgctcggaggactcgccttgggattgctggtgggggctccattcggtagcgtgatgtatgagttcgttggaaaatctgccccttttttgatcctcgcctttctggccctgctggacggtgcacttcagctctgcattttacagccatccaaggtgtcccctgaatcagcgaaaggtacaccactgtttatgctgctgaaggatccatatattctggtggccgcagggagtatttgcttcgctaacatgggagtggcaatactggagcctaccctccccatttggatgatgcagacaatgtgcagccccaagtggcagttgggcttagcatttctccccgctagcgtgagctacttaatagggacaaacttattcggcgtgctcgctaataaaatgggccgatggctgtgctctctcatagggatgctcgtcgtgggcaccagcctattgtgtctgcccagctag

SEQ ID NO: 241087 - DNA, 1482 bp, Artificial Sequence
  Description of Artificial Sequence: Synthetic coding sequence
atgctccgcaccattctggacgctcctcagagactcctgaaggagggaagagcgtcgagacagctggtactcgtagttgtgtttgtagctcttctgctggacaacatgctgtttacagtagtggtgcctatcgtcccaaccttcttatatgacatggaatttaaggaggtcaacagtagcctgcaccttggtcatgccggatcctcccctcacgccctggctagcccagccttctcaacaatcttctctttctttaataataataccgttgccgtcgaggagagcgtgccctcagggattgcatggatgaatgacactgcttcgactatacccccacccgcaacagaagcgatttctgcacataaaaataactgcctccagggcacaggattcctagaggaagagatcacccgagtgggagtgctgttcgcttccaaggcagtcatgcagctacttgtcaaccctttcgtggggcctcttaccaaccgcatagggtatcacatacccatgtttgccggttttgtaatcatgttcctatccacagtaatgtttgcgttttccggtacctacaccctgttgtttgtggccagaacccttcagggcatcggcagttcattcagtagtgtcgcaggactcggaatgcttgccagcgtttacacggatgatcatgagcggggtagggctatgggcacagcgctagggggtctggcccttggactcttagtaggggctcctttcggatccgtgatgtacgagtttgtcgggaaatccgcgccatttctcattctggcatttctagctttacttgacggagctctgcaactctgcatcctacaaccttcgaaggtgtcccctgagtcggccaaaggcacacccctcttcatgctcctgaaggatccctacatcctggttgcggcagggctggcctttttgcctgccagcgtgagctacctgattggcaccaacctgttcggtgtgctggcgaataagatggggagatggctctgtagtctcattggaatgctggttgtggggacctccttgctctgtgttcctctggcccacaacatcttcggattgatcggaccgaacgccggactgggcttggcaatcggtatggtggattcatccatgatgcctatcatgggccacctcgtcgatctgaggcacacttctgtgtacggttccgtgtacgccatcgcggatgtggcattttgcatgggattcgcaattggcccttcaaccggcggagctattgtcaaggctatagggttcccctggcttatggtcataacaggagtcataaatatagtgtatgcaccgctgtgctactatctacggtcccccccagctaaggaagaaaagctggcaatactatcacaagattgcccgatggagaccaggatgtatgccacccaaaagcccaccaaggaatttcctcttggggaggactcagacgaggaacccgaccatgaggagtag

SEQ ID NO: 241088 - DNA, 1545 bp, Artificial Sequence
  Description of Artificial Sequence: Synthetic coding sequence
atggccttatcagaacttgctctggtgagatggctgcaagagagcaggaggtcaagaaagctcatacttttcattgtctttcttgctttactgctagacaacatgctgcttacagtagttgttcctattattccatcctatttgtatagcatcaagcatgagaaaaatgccaccgagattcagactgcgcgtcctgtgcataccgccagcatcagcgattctttccagtccattttctcttattatgacaatagtactatggtcactggcaacgccacccgcgacctgacacttcaccagactgctactcagcacatggtgacaaacgcctcagccgtgccctccgactgccccagtgaggacaaggacctgcttaacgagaatgttcaggtcggcctgctgtttgcttctaaggccaccgtccagctgatcaccaatccctttattggactcctgaccaatcgcattggatatccgattccaatcttcgcaggtttctgcatcatgttcgtttccaccatcatgtttgctttcagcagctcatatgccttcctgctgatagctcgctccctgcaagggatagggtcatcctgctcgagtgtcgcgggaatgggcatgctcgcatccgtgtacacggatgacgaggaaaggggaaacgtgatgggcattgcactgggtgggctggctatgggtgtgctggttgggccacctttcggctctgtcctctatgagttcgttggcaagacggccccttttctggtcctggcggctttggtgctgctcgacggagctattcagttatttgttctccagccatcacgagtacagcccgagagtcagaagggcacccctctgacaacattgcttaaagatccctatatcctgatcgccgctggtagcatatgcttcgcaaacatgggaatcgcgatgcttgagcctgccctaccaatttggatgatggaaacaatgtgttcaaggaagtggcagcttggagtagccttccttccggcatccatctcataccttatcgggacaaacattttcggcatattagctcacaagatggggaggtggctctgtgccctgcttggaatgatcattgtgggggtgtcaatattgtgcattcccttcgctaaaaacatctatggccttattgccccaaatttcggcgttggctttgccattgggatggtggattcctctatgatgccgatcatgggctaccttgtggacttacgccacgtgtccgtgtacggcagtgtttatgctatcgcggacgtggccttttgcatggggtatgccataggtccaagtgccggaggcgctatcgccaaggccattggttttccctggctgatgactatcatcgggattatagatattctgttcgctcccctgtgcttttttctgagatctcctcccgcaaaggaggagaagatggcaattttaatggatcataactgccccatcaagaccaagatgtatacacaaaataatatacagtcgtatcccataggagaggacgaggagtcagagagtgactag

SEQ ID NO: 241089 - DNA, 1494 bp, Artificial Sequence
  Description of Artificial Sequence: Synthetic coding sequence
atggatgtgccagggccagtctctcgccgagcagcagcagcagcagcaacagtgctgctgcgcacagcgagggtcagaagagaatgctggttcctgcccactgccctgctgtgcgcgtatgggttcttcgcttctctgcgtccgagcgagcccttcctgaccccgtatctcttaggtcctgacaagaacctgacagaacgtgaagtttttaatgaaatatacccagtttggacttactcttatttggtactattatttccagttttcctcgctaccgattatctccgttacaaacccgtggtcctgctgcaggggctgtcactcattgttacttggtttatgctactgtacgcacagggactcctggccatccaatttctcgagttcttttatggaatcgccaccgcaactgagatcgcctactattcatatatctactctgtggttgatcttggcatgtaccagaaagttacatcctactgcagaagcgcaacactggttggctttaccgtcgggtcagtgctgggccagatccttgtgtcagttgccggttggtctctcttttcactgaatgtaatctcgctgacatgtgtgtcagtcgctttcgcagtggcatggttcctgcctatgcctcagaagagtctgttctttcaccatattccgagcacgtgccagcgtgtgaacgggatcaaagtacagaacggcggaattgtgacagatacccctgcatcaaaccatctgcctggctgggaagacattgagtccaaaatccctctgaatatggaagagccacccgtggaagagcctgagccaaagcccgatcgtctgcttgttctgaaggtgttgtggaatgactttctgatgtgttacagctctaggcctctcttgtgttggtccgtttggtgggccctatcaacctgcgggtacttccaggtggtgaactacactcagggactgtgggagaaagtgatgccatccagatatgcggctatatataatggcggagttgaagctgtgtcaactctcctcggggcagtggcagtcttcgctgtcggctacatcaagatctcatggagtacttggggagagatgacattgtccttattcagtctgcttattgcggcagcggtgtatattatggacaccgtaggtaacatctgggtttgctacgctagttatgtcgtgtttcgcattatctacatgctgttgatcacaatcgcgaccttccagattgccgctaatctgtccatggagaggtacgcactagtgttcggggtgaatacctttatcgcgttagccctgcagactttgctaacgctgatagtggtcgatgccagcggcctcgggctcgaaatcacaacacagttcctgatctacgcttcttacttcgcccttattgcagtcgtctttctcgcgtccggtgccgtttctgtgatgaagaagtgtcggaaactcgaggaccctcagtcaagcagtcaagtgaccacatcctag

SEQ ID NO: 241090 - DNA, 1380 bp, Artificial Sequence
  Description of Artificial Sequence: Synthetic coding sequence
atggatgtgcccggtcccgtcagtcggagagcagctgccgcagccgctactgtcttactgagaaccgctagagtgcgaagagagtgctggttcctacccactgctctactgtgtgcctacggcttcttcgcatccctcaggccgtccgaacccttcttgactccttacttgttgggtccagacaagaatttaaccgagagagaagtgttcaacgaaatataccctgtgtggacttatagctacctagtgttgctttttccggtttttctcgcaaccgactatctgagatacaaaccagtggtcctattacagggcttaagtctgattgtcacttggtttatgttactgtacgcccagggactcctggctatccagttcctggagttcttttacggaatcgctactgcaaccgaaattgcatactattcctacatttattccgtcgtggacttaggaatgtatcagaaagtcacaagctattgccgctcagcaacgctcgtcggatttactgtgggcagtgtgctcgggcaaatcctggtgtcagtcgcgggttggtccctattctccctgaatgttatatcccttacctgcgtgtcggtcgccttcgcagttgcatggttcctccctatgccccagaagtcccttttcttccaccacataccgtccacctgtcaacgagttaacggcatcaaggagcccaaacctgatcgcttactggtccttaaggtgctgtggaatgatttcctgatgtgctacagctccaggcctctcctctgctggtccgtttggtgggccttgagtacctgtggctacttccaggtagtcaattacacgcagggtctgtgggaaaaggtgatgccctctcggtatgccgctatttataatgggggagtcgaagctgtctccaccttgctaggggctgtggccgtatttgcagtgggatatatcaaaatctcctggtcgacttggggcgagatgaccctttctttgttctcgctactgattgcggcagccgtgtacattatggacaccgtcggaaacatttgggtgtgttacgcatcatatgtggtttttaggattatatacatgcttctgatcactattgccaccttccagattgctgctaatctgtctatggagcgctacgccctcgtattcggggttaacacctttattgcgctggcactccaaactctccttactttaatcgtggtcgacgctagtggccttgggctcgaaatcacaacgcagtttttgatctacgcaagttacttcgcattgatcgccgtcgtcttcctggcttccggggcagtgtctgtaatgaaaaagtgtcgtaagctagaagatccccagagcagctctcaggtcaccacatcctag

SEQ ID NO: 241091 - DNA, 891 bp, Artificial Sequence
  Description of Artificial Sequence: Synthetic coding sequence
atggatgtccccggtcctgtctctaggagagcggctgccgctgccgcaacagtgctgcttcgaacagcccgagtgcggagagaatgctggttcctcccaaccgccttactatgcgcttacggattttttgcctcactgcggccatcagagccattcctcactccatacttgttgggccctgacaagaacttgacggaaagggaggagcccaagccagaccggctgcttgtgctgaaagtgctgtggaatgattttctgatgtgttacagtagccggccactcctgtgctggtccgtgtggtgggcactctccacctgcggctatttccaggtagtcaactacacacaaggcctctgggagaaggtgatgcccagccgatacgcagcaatatataacggaggtgttgaggccgtgtcaactctgttgggtgcagtggcagtatttgccgtgggatacattaagatctcttggtcaacgtggggggaaatgaccttatcccttttttcattgctgatcgctgcagccgtgtacatcatggacaccgtggggaatatttgggtgtgttacgcatcctacgttgtgttcaggatcatatacatgttgttgattactatcgctaccttccagatcgcagccaacctatctatggaacgctacgccctggtgttcggcgtgaatacttttattgccctggcattacagaccctgctaaccctgatcgtggtggacgctagcggtctcggcctcgagattacaactcagtttctcatatacgcgtcctatttcgcactaattgctgttgtgttcctggcttccggagcagtcagtgtgatgaagaaatgcaggaagcttgaggatcctcagagttcttcccaggtgaccacctcctag

SEQ ID NO: 241092 - DNA, 1491 bp, Artificial Sequence
  Description of Artificial Sequence: Synthetic coding sequence
atggattgttatagaacctctctgtccagcagctggatttacccaaccgtgatcctttgcctatttgggttcttttccatgatgagacccagtgagccttttctcatcccttatctcagtggaccggacaagaatctcacatctgcagaaatcactaatgagatatttcctgtgtggacgtacagctacctcgtacttttgctgcctgtgttcgtgctaacagattacgtgagatacaaaccagtgatcatcttacagggcatcagcttcattataacttggctactcctcctgtttggacaaggtgtcaagaccatgcaggtagtggagttcttctatggaatggttaccgctgcagaggtagcttattatgcatacatctattccgtcgtaagccctgaacactatcagcgagtgagtggatactgcaggtccgtgacactcgcggcttacacggccggttctgtactcgctcaactgctcgtatccctcgccaatatgtcatatttttacctgaatgtcatttcgctggcgagcgttagcgtagccttcttattctccctgttcctgccaatgcccaagaagtccatgttttttcacgccaagccgagcagggagattaagaagtcatccagcgtgaacccagttcttgaggagacacatgagggggaggcacccggttgtgaggaacagaagccgacctctgaaattctttctacctccgggaaactaaacaagggacagctaaacagtctgaaacccagtaatgtcaccgtcgatgtgtttgtccaatggtttcaggacctgaaagaatgttactcttctaaacgactcttttactggtcgctctggtgggccttcgctaccgccggattcaaccaggtgctcaattatgtgcaaattctttgggactacaaggccccaagccaggactccagtatctataacggagcagtagaggccatagccacgttcgggggagccgttgccgcattcgccgtggggtatgtaaaagtgaactgggaccttctgggcgagctggcgctggtcgtgttttccgtcgtgaacgcgggttcattatttctgatgcattacacggccaacatttgggcctgctacgcaggctacctgattttcaagagttcctatatgttgttaatcactattgctgtatttcagatcgccgtaaacttgaatgttgaaaggtatgctttagtgttcggcataaacacgttcatcgccctcgttattcagactattatgacagttattgtggtcgaccagcgcggtctcaatcttcccgtgtcaattcagttcctcgtgtacggctcttattttgcagttattgcaggtattttcctgatgcgatccatgtacattacctactcaacaaagtcacagaaggacgtccagtcgcctgctcccagcgaaaacccagacgtgagtcatcccgaggaggagagcaacattattatgtccacgaagctttag

SEQ ID NO: 241093 - DNA, 165 bp, Artificial Sequence
  Description of Artificial Sequence: Synthetic coding sequence
atggactgttaccgcactagtctttcttcctcctggatataccccaccgtaattctgtgcctgttcggctttttctctatgatgcgcccttcagagccatttctgatcccctacctctcaggtccagataaaaatctaacctctgctgagatcacaaatgaatag

SEQ ID NO: 241094 - DNA, 195 bp, Artificial Sequence
  Description of Artificial Sequence: Synthetic coding sequence
atggattgctatcgcacgagcctctcatcttcctggatctacccaaccgtgattctgtgcctattcggattcttctctatgatgagaccaagtgagccattcttaataccatatctgagtgggcctgacaaaaatctgacttctgcggagatcaccaatgagatattcccagtctggacatacagttatctgtag

SEQ ID NO: 241095 - DNA, 1491 bp, Artificial Sequence
  Description of Artificial Sequence: Synthetic coding sequence
atggattgctataggaccagcttaagctcaagctggatttaccctacagtgatcctgtgcctattcggtttctttagcatgatgcggccatctgagccatttctcataccttacctgtcaggacccgataagaatctgacctccgccgaaattaccaatgagatctttcctgtatggacctattcctatctcgtactgctcctccctgtgtttgtgctcactgactatgttcggtacaagcccgttattattctgcagggcatcagctttattattacttggctcctgctgctcttcggtcagggcgtaaagacaatgcaggttgtggagtttttctatgggatggtcacagctgctgaggttgcatactatgcttacatatacagcgttgtttctccagagcattatcaaagggtgagcggttactgccgaagtgtgacattagcagcttacactgcaggctcagttcttgcgcagctgctcgtgtctttagcaaatatgtcttatttttacctgaatgttatatcactggcctcagtgagtgtggcctttcttttttccctgtttctccctatgcctaaaaagtctatgtttttccatgccaagccctctcgcgagatcaaaaagagctcttccgtcaatccagtgctagaagaaactcatgagggcgaggcgcctggctgcgaagaacagaagcccaccagcgagatcctgagtactagcggcaaattgaataaggggcagctgaactctctgaaaccctcgaatgttaccgtcgatgtgtttgtccagtggtttcaggacctcaaggagtgctactccagcaaaaggttgttctattggtccctctggtgggcgttcgcgactgccggtttcaaccaggttctgaattatgtgcaaatcctgtgggattacaaggctcccagtcaagactcttccatttacaacggtgcagtcgaggccatagctacctttggaggtgccgtggccgcatttgcagtaggatacgtgaaggtgaactgggatttgctgggggagctggccctcgttgtgttttcagtcgtcaacgccggtagcctgtttctcatgcactacaccgcaaatatttgggcgtgttatgctggctatttaatcttcaaatccagttacatgttgctgattaccattgcagttttccagattgctgtgaatttaaacgttgaacggtacgcccttgtcttcggcattaacacattcatcgctctagtgatccagaccattatgactgtcatcgtggtcgatcagcggggtctcaaccttccagtgagcatccagtttttagtgtacggttcctattttgctgtaattgctggcatcttcctgatgcgctcgatgtatatcacctacagtactaaatcacagaaagacgtgcagtcaccagcaccttctgagaatcctgacgttagccatcccgaagaggagagcaatattatcatgagcaccaaactctag

SEQ ID NO: 241096 - DNA, 399 bp, Artificial Sequence
  Description of Artificial Sequence: Synthetic coding sequence
atggattgctatcgaaccagtctatccagcagttggatctatcctactgtcattctgtgcctttttggtttctttagcatgatgcgaccttcagagcctttcttgattccctatttgagtggccctgataaaaacctgacctccgccgaaattactaacgaaatcttccctgtctggacgtactcatatctggtgctccttctgcctgtgtttgtgctgactgactacgtgcggtataagcccgtgattattctacagggcatctccttcatcattacctggcttttgttactgttcgggcagggagtgaagaccatgcaggtggtagagttcttctatggaatggtaacagcggctgaggtagcttactacgcttacatctactccgtagttagctag

SEQ ID NO: 241097 - DNA, 1479 bp, Artificial Sequence
  Description of Artificial Sequence: Synthetic coding sequence
atgaatccactggggtcagcgagtcgggcaaccgtggaccagctcacggacttgccaagcaaagaacaactgtcatgcgttgtgtttgccctgtggccacctgcattctctagtaacctgagcgatcccggtgtcaaaatcacaaacgagatctttcctgtgtggacctactcctacctggttctgctgctaccagtgtttgttcttaccgattatgtgagatacaagccagttattattctccagggcatcagttttatcatcacttggctcctgctcctgtttgggcagggtgttaagaccatgcaagttgtggagttcttctacggtatggtgaccgcagctgaggtggcgtactacgcctacatctacagcgtcgtgtctcccgaacattaccagagagtgagcgggtattgtaggtcggtaacacttgccgcatacactgcaggttctgtgctggcccagctgctggtctcactggcaaacatgagctacttctacttgaacgtcatctccttggccagcgtttccgtcgctttcctcttcagtctgtttctgccgatgccaaaaaagtccatgtttttccatgcaaagccttcccgagagatcaagaagtcatcttcagttaatcccgtgcttgaagaaacacatgaaggggaggcccctgggtgcgaggagcaaaaacccacaagcgaaatcctgtccacctccgggaaactgaataaagggcagcttaattcgctgaagccaagtaacgtaacggtcgacgttttcgtgcagtggttccaagatctgaaagagtgttattcctctaaaagactcttttattggtctctgtggtgggcctttgccaccgccggatttaaccaagtgctcaattacgtccagatcctgtgggactacaaggcccctagtcaagattctagcatctacaatggggctgtggaggccatcgctacattcgggggtgccgtggctgcattcgcggtggggtatgtcaaagttaattgggacctgctcggagaactggcgcttgtggttttttctgtcgtgaatgctggatcactttttctgatgcactacaccgctaatatttgggcttgctatgccggatatttgatctttaagagcagttatatgttacttattactattgctgtatttcaaatcgcagtaaacttaaatgtcgagaggtacgctctggtctttggcattaatacattcatagccctggtaattcaaaccataatgaccgtgatcgtggtggatcagagaggtttgaacctcccagtcagcatccagtttctagtctacggtagctactttgcagtgatcgctgggatctttctcatgagaagcatgtatatcacatattccaccaaaagccaaaaagacgtgcaaagtcccgctccctctgagaaccctgatgtcagtcaccctgaggaagagagtaatattatcatgtccaccaagctctag

SEQ ID NO: 241098 - DNA, 1626 bp, Artificial Sequence
  Description of Artificial Sequence: Synthetic coding sequence
atggggcacagccctcctgttctgccattgtgcgcatctgtgagtctgcttggaggactcacatttggctacgagttagccgtaatatctggggcactgctccccctccagctggacttcggccttagctgcctagagcaggaatttctagtgggatctctgctgctcggagccctgctcgccagcctggtagggggatttctgatcgactgctacggcaggaaacaggcgatactgggtagcaatctcgtgctgctagctggcagtctcacgctgggcctggcaggatcccttgcctggttggtactcggcagggcagtggtggggttcgcaatcagtctgagcagtatggcctgttgcatttacgtgtcagaactggtaggacccagacaaagaggcgtactggtctcactgtatgaggcaggtataaccgtaggcatcctgctctcttatgccctaaactacgccctggccggaacgccatggggttggcgccatatgttcggatgggctaccgcacccgcagtattacagagtctgagtttgctgttcttacccgcaggcacggacgagactgcaacacataaagacttgattcctctgcaaggtggtgaggccccaaagctcggccctggaagaccaagatatagcttcctggacttgtttagagccagagacaatatgaggggacgcaccacggtcggcctaggcctcgtactcttccaacagcttactggtcagcctaatgtgctgtgctacgcctctaccattttttcatccgttgggtttcatgggggttcatccgccgtcctggcctccgttggattgggcgcagtgaaagtcgccgctaccttgaccgccatgggattggtcgatagagccggacgaagggcgcttctgctggccggatgtgcactaatggcactgagcgtgtctggaattggtcttgtcagtttcgccgttcccatggacagcgggcctagctgtctggcagtgccaaacgcaacaggtcagacagggttaccgggagacagtggactgctgcaggattcatcccttcctcccataccacggaccaacgaggaccaacgggaacctatcttaagtacagccaagaaaaccaagccacaccctagatcaggcgatccttccgctccccctagactggccttaagctcagcattaccaggaccaccgctccctgcgagaggccatgccttattgcgctggactgctctactgtgcttaatggtctttgtaagcgctttctctttcggatttggacctgtaacttggctggtcctctctgaaatctacccggtcgaaataagaggacgcgcatttgctttctgcaactcgttcaactgggccgcaaatctcttcatctccctctcctttctcgatctcatcggaacaatcggtctgagctggacttttctgttatatggactgaccgccgtcttaggcttgggttttatttacctgttcgtacctgaaaccaaggggcagagcttagcagagatagatcagcaattccagaagcgcagattcacactgtccttcggacacaggcagaacagcacaggcattccctactcgcgcattgagatatctgccgcaagctag

SEQ ID NO: 241099 - DNA, 1947 bp, Artificial Sequence
  Description of Artificial Sequence: Synthetic coding sequence
atgtcacggaaggcgtcagagaatgtggaatatactcttagaagtctctctagcttgatgggagaacgcagaagaaaacagcccgagcccgatgctgcatcagcagctggagaatgctccttgcttgcggctgctgagtcaagcaccagcctccaatctgcaggcgcaggaggcggtggcgtgggtgacttagagcgcgctgccaggagacagtttcagcaggacgagacccccgcattcgtatacgtcgtagcagtctttagcgcactgggtgggttcctgtttgggtacgacacaggcgtggtaagcggggctatgttgctgcttaagcgccagctatctcttgacgccctttggcaggaactcctcgtgtctagtacggtgggagcagctgccgtttctgccttagcaggaggcgctctcaatggagtgttcgggagacgggcagcaattcttcttgcttccgccctctttacagccggatccgctgtgcttgctgctgctaacaataaagagacactgcttgcagggcgtttggtggtgggccttggaattggaatcgcttccatgacagtgcccgtttatatcgccgaggtatcaccgcctaacctgcgcggacgtttagtcactatcaacaccctgttcatcaccggcggacagtttttcgctagcgtggtcgatggggctttttcatatctgcaaaaagacggctggaggtacatgctgggtctggccgctgtgcctgcggttatccaattcttcggttttctgttcctgccagaatctcctcgatggctcatccagaagggccagactcagaaagctagacgcattttaagccagatgcggggaaaccagacaatagacgaggaatacgacagtatcaaaaacaatatcgaggaggaagaaaaagaagtgggatcagctgggcctgtgatttgccgcatgctaagctatccccctacacggagagctctgatagtgggctgtggcctccagatgtttcaacaactgagcgggattaacacaattatgtactactctgcaaccatcttacagatgtcaggcgtagaagacgacaggttggccatatggctggcttctgttacggccttcacgaacttcatttttacgctggtgggcgtatggctggtggaaaaagtcggtagacgtaaactcacatttggcagtctcgcaggcaccaccgtggctttgattatattggccttgggttttgtgctgtccgcccaggtgtctcctcggatcactttcaaacccattgcaccatctgggcaaaatgctacctgcacacggtactcgtattgcaatgaatgcatgttagacccagactgcggcttctgttacaaaatgaataagagtactgtgatagacagctcctgtgtccctgttaacaaggccagcactaacgaagctgcgtgggggaggtgtgagaacgaaacgaagttcaaaacggaggacattttttgggcatacaatttttgccctaccccctactcttggactgcactactcgggctaatattgtacctggtgtttttcgctccgggaatggggcctatgccctggacagttaattccgaaatctaccccctgtgggccagatctacggggaatgcgtgctccagtggtataaactggatcttcaacgtgctcgtttcacttacattccttcacacagctgagtacctgacctattacggcgcattctttctttacgccggattcgcagctgtgggactgctgttcatatacggctgtctccccgagacaaagggaaagaagcttgaagagatcgagagtctttttgacaacagactctgcacttgcggcactagcgacagtgacgaaggacgatacattgagtacatccgagtaaagggctccaattaccatctcagcgacaacgatgcttccgacgtcgaatag

SEQ ID NO: 241100 - DNA, 1074 bp, Artificial Sequence
  Description of Artificial Sequence: Synthetic coding sequence
atgagcagaaaagcctctgagaatgtggagtatacattacgcagcctgagttccctgatgggcgaaagaagacgcaagcaacctgagcctgatgccgcttccgcggcaggcgagtgctccttactcgccgctgctgagtcgagcacctccctgcagtctgctggggctggaggagggggagtgggagatttggaacgggctgcgagacgccagttccagcaagacgaaacacctgcattcgtttatgtggtggccgtattttctgcattgggaggctttttattcgggtatgacactggggtcgtatctggagcgatgcttctcctgaaaaggcagctgagcctggacgccttgtggcaggagctcctggtgagcagcaccgtgggagctgctgcagtgagcgccctggcgggaggtgctctgaatggcgtcttcggtcgcagggcggcaatcctgttggcctccgcattgtttacagcaggaagtgcggtgctagccgctgccaacaacaaggagacgctgctggctgggagactggtcgtgggtctgggcatcgggatagcatccatgaccgtacccgtttacatagctgaggtgagcccccctaatctgcgcggtaggcttgtgaccattaatactctatttataactgggggacagtttttcgcatcagttgtggacggcgctttctcctacttacagaaagacgggtggaggtacatgctgggcctcgcagccgtgcccgcagtcatccagttttttggctttctgttcttaccagaatccccacgttggctaatacagaagggtcagacacaaaaggcgagaagaatcttgtctcaaatgcgcggaaatcagaccattgacgaggagtacgattctatcaagaacaacatagaggaggaggagaaggaggtcggctccgcaggccctgtcatctgccggatgcttagctatcccccaaccagacgggctttgatagtcgggtgcgggctccagatgttccagcagctatccggcataaacaccattatgtacgtgtttctgagcggatttttactgaaacgcctatag

SEQ ID NO: 241101 - DNA, 1494 bp, Artificial Sequence
  Description of Artificial Sequence: Synthetic coding sequence
atggacaatcgacagaacgtaacccctgccctgattttcgctataaccgtcgccaccataggaagcttccagttcgggtacaataccggggtgatcaacgccccagaaacaattattaaggaatttatcaacaaaactctgacagataaggcaaatgcccctccgagcgaggtgctgcttacaaacctgtggtcactctccgtcgcgatttttagcgttggtgggatgatcggttcttttagcgtcggactgtttgtgaacaggtttggtaggaggaattccatgctaattgtgaacctgttagccgctaccggtgggtgtctgatggggctatgtaaaatcgcagaatcagtagagatgcttattctgggtcgcttggtgattggactattctgtggtctgtgtaccgggttcgtgcccatgtatattggggaaattagcccaaccgcattgaggggcgcatttggcacactgaaccagttagggattgtcattggcattttggtggcacagatcttcggccttgaacttattctggggagcgaagaactgtggcccgtccttttgggcttcactatccttcccgcaatcctgcagagtgctgcgttaccgtgctgtcctgagtctcccaggttcctgctgattaatcggaaaaaggaggagaacgctaccaggatcctccagcgcctctgggggacacaagacgtgagccaggatattcaagagatgaaagacgagtccgcccgaatgagccaggagaagcaggtgaccgtcctggaactgttcagagtgtcttcctataggcagccaatcattatttcgattgttctgcaactcagtcagcagttatctgggatcaacgcagtgttctactattccactgggatattcaaagacgcaggagtccagcagcccatttacgctactatctcagctggcgtggtaaatacaatttttaccctgctgtccttattcctggttgaacgagctggccgacgaacattgcatatgatcggcctgggcggaatggctttctgtagcactcttatgactgtttcactgctgctgaaaaaccattacaatggaatgtcctttgtctgcataggagccatcctggtgttcgtggcatgtttcgaaattggcccagggcctatcccctggttcattgttgccgagcttttttctcagggcccacgccctgctgctatggccgtggctgggtgtagtaattggacttccaacttccttgtcggtttactgttcccatccgccgcttattatcttggcgcatacgtctttatcatcttcacaggtttcctcatcacctttctggcctttacgttctttaaagtaccagagacacggggtcgcacctttgaagacatcaccagagcatttgagggccaagcccatggcgcagataggtccgggaaggacggcgtaatgggcatgaactcaatcgagcccgcaaaagagaccactactaacgtctag

SEQ ID NO: 241102 - DNA, 1563 bp, Artificial Sequence
  Description of Artificial Sequence: Synthetic coding sequence
atggaattccataacggcggtcatgtctcagggatcggcggatttctcgtaagtctcacttcccggatgaagccccacactctggccgtgacaccagccctaattttcgccattacagtcgcgactattgggtcctttcaatttggatacaacacaggagtgatcaatgcccctgaaacgataattaaggagttcataaacaagactctgacagacaaggctaatgcacccccaagcgaggtcctactgaccaacctgtggtcgctgagcgtggcaatcttcagtgtggggggaatgatcggcagcttctccgtgggtctatttgttaatcggtttggtcgtagaaacagcatgctcattgttaacctactggccgcaaccgggggatgtctcatgggcctgtgcaaaatcgctgaatccgtagaaatgctgattctcgggaggcttgtcataggtctgttttgcggattatgcacgggcttcgtgcccatgtatattggagaaatctcccccacagcactaagaggagcttttggcacgctcaaccagttggggattgtgatcggaattctcgtggcccagattttcgggctggagctcattcttggctcagaggaattatggccggtactgctgggctttaccatcctaccggcaattcttcagtcagcagccttgccatgctgcccagaaagtccacgctttttgcttattaatagaaagaaagaagaaaacgccacccggattctgcagcgtctttggggaactcaggacgtgtctcaagacattcaagagatgaaagatgaatccgccagaatgtctcaagagaaacaagtgacggttttagagctgtttcgtgtgtccagctaccgccagcccatcatcataagcatcgtcctgcagctctcacaacagctctccggtatcaatgccgtcttctattattcgaccggaatctttaaggacgcgggagttcaacagcctatttatgcgacaatttccgcaggcgttgtcaacaccatctttacgctgttatccctcttcctcgtggagcgcgctggtcggagaactctgcatatgattggattagggggtatggccttctgtagtacgttaatgacagtgagcctgctcctgaagaaccactataacggaatgtcttttgtttgtataggggctatattagtgttcgtggcttgcttcgaaattggcccaggtcctatcccctggtttatcgtggctgagctgttcagtcaaggccctagacctgccgctatggccgtcgctggatgctccaactggactagtaatttcctcgtcggtctgctgttcccaagcgctgcttactatctcggagcctatgtgtttatcatttttacaggattcttgatcacatttctggccttcacattttttaaagtgcccgagacccggggacgcacttttgaggatatcacaagagcttttgaagggcaggcccacggggctgaccgctcaggaaaggatggggtgatgggtatgaacagtatcgaacctgcaaaagaaaccacaaccaacgtgtag

SEQ ID NO: 241103 - DNA, 1494 bp, Artificial Sequence
  Description of Artificial Sequence: Synthetic coding sequence
atggataacaggcagaatgtgacccctgccctcatttttgcgataactgtcgccaccatcggatccttccaattcgggtacaataccggggtgataaacgcccctgagaccatcattaaagaattcatcaacaagacactaaccgacaaagccaatgcaccgccttcagaggtactcttgactaacctgtggagcctcagcgtggccattttctcagtgggtggcatgatcggcagcttttctgtcgggctctttgtcaaccgattcggacggaggaattccatgctgatagtaaacttgctagctgctactgggggatgtcttatgggactgtgtaagatcgcagagtctgtggaaatgcttatccttggacggctggtcattggtttgttttgtggactctgtactgggttcgtcccaatgtacattggagaaattagtcccaccgccctcaggggagccttcggaaccttgaaccagctggggattgtgatcggtatcttggtggcccaaatttttggcctcgagctgatattgggaagtgaggagctctggcctgttctcctcggatttacgatcctcccggctattctgcagagcgccgcattaccctgttgccccgagtctccccgtttcttgctcatcaaccggaaaaaggaggaaaatgctactagaatcttacagcgtctgtggggcactcaggatgtatctcaggatatacaggaaatgaaagatgaatcagctcggatgagccaggaaaagcaggtcacagtgctggagctgtttagggtctctagctatcgtcagcccataattataagtattgtgctccagttaagccagcaattatccgggatcaacgcagtgttttactacagcacgggtatatttaaagacgccggtgtccagcaacctatctacgctactatcagcgcaggcgtcgtcaacaccatctttacccttctcagcctgttcctcgtcgaacgggcagggaggcgcaccctgcacatgataggattgggtggaatggctttttgtagcactctgatgaccgttagccttctccttaaaaatcactataatgggatgagctttgtctgtatcggcgcaatcctggtgttcgtggcttgtttcgaaatcggccctggacctataccttggtttatcgtggctgagctgttctctcaggggcctagaccagctgcgatggctgtcgccggatgctcgaactggacctcaaattttctcgttgggttactgttcccatcggccgcttattatctgggagcatatgtctttattatctttacaggcttcctcattaccttcttggcctttacttttttcaaagtgccagaaacccggggtcggactttcgaagacattacgcgggctttcgaaggacaggcccatggcgctgacagatctggcaaggatggtgtgatgggcatgaattccattgaaccggcaaaggagactaccacaaacgtttag

SEQ ID NO: 241104 - DNA, 363 bp, Artificial Sequence
  Description of Artificial Sequence: Synthetic coding sequence
atggaattccacaacgggggacacgtgtctgggatcggcggatttttggtctccttgacatcacgaatgaagcctcatactttggccgtgactccagctttgatatttgccatcacagtcgcgactattgggtccttccaatttggctacaacactggggtcatcaatgcgccagaaaccattataaaagagtttattaacaagaccctcaccgataaggccaatgcccctcctagcgaggtgctgctgacgaatctgtggtctcttagcgtagctatcttttctgtggggggaatgatcgggtctttctctgtcggtctgttcgtcaatagattcgggcgtcgcaattccatgttgatttag

SEQ ID NO: 241105 - DNA, 1236 bp, Artificial Sequence
  Description of Artificial Sequence: Synthetic coding sequence
atgcttctaaggagaaggaactctatgctgattgtgaacctcctggctgcgactggcggttgcctgatgggactttgcaagattgcggaaagcgtggagatgctgatcctcggaaggctcgttatcggcctgttctgtggactttgtaccgggttcgtcccaatgtatattggcgagatttccccaaccgccctgcggggtgccttcgggaccttgaaccagctcgggattgtaatcgggatactcgtcgcccagatcttcggcctggagctcatactgggaagcgaagaactctggccagttctactgggattcaccattctgcccgcaattctgcagagcgctgccctgccctgctgtccagaatcaccgagatttctcttaattaataggaagaaagaggagaatgccacgagaatactgcaacgcctgtggggaacccaagacgtgtcccaggacatacaagagatgaaagacgagagtgctagaatgagtcaggagaaacaggtcaccgttctcgagctgttccgggtaagttcttatcggcagcccatcatcatcagtattgtcctccagctgagccaacagctgtccggcattaatgccgtgttctattattctacagggattttcaaagacgcaggcgtccagcagcccatctatgccacaatatcggctggcgtagtgaacaccatattcactttattatccctcttcctggtggaaagggcaggtcggaggaccttgcacatgattggactcggcggtatggccttttgctccaccctgatgacggtctccctgctgctcaaaaaccactacaatgggatgagttttgtctgtatcggtgcaatcctagtattcgtcgcctgttttgaaatcggccctggtccgatcccctggttcatcgttgcggaacttttcagtcagggccctaggcctgcagctatggccgtggcgggttgttcaaattggacatctaatttcctggtaggccttctgttcccctcagctgcctattacctcggggcatacgtgttcataatatttacagggttcctaattaccttcctggcgttcacgttctttaaggtgccagagaccagagggagaaccttcgaggacattacaagagcctttgagggccaggctcatggagccgacaggagcgggaaagatggagtaatgggaatgaacagcatcgagccagcgaaagagacaacaacaaatgtttag

SEQ ID NO: 241106 - DNA, 426 bp, Artificial Sequence
  Description of Artificial Sequence: Synthetic coding sequence
atggacaataggcagaacgtaacccctgccctaattttcgccataaccgttgctaccattggctcgttccaatttggctacaacaccggggtgatcaatgcacctgagacgatcatcaaagagttcataaacaaaaccctcacagacaaggcaaatgcccctccctctgaggtgttattgaccaatctctggtcgctgagcgtcgcaatctttagcgttggcggaatgattggttcattttccgtcggcctgttcgtgaatcgctttgggcgtagaaactccatgctgattgtcaacctgctcgccgcaacagggggatgccttatgggcctgtgcaagatcgctgagtccgtggaaatgctgattctgggacggctggtgattggcctgttctgcggattgtgcacagggtttgtgcctatgtag

SEQ ID NO: 241107 - DNA, 144 bp, Artificial Sequence
  Description of Artificial Sequence: Synthetic coding sequence
atggacaaccgccagaacgtgacccccgcactaatattcgctattacggtggctacaatcgggagctttcagtttggctataatactggcgttatcaacgctccggaaactataattaaggagttcattaacaagaccctttag

SEQ ID NO: 241108 - DNA, 69 bp, Artificial Sequence
  Description of Artificial Sequence: Synthetic coding sequence
atggataaccgacaaaatgtcacgcccgctctgatctttgccataactgtcgcgaccataggttcttag

SEQ ID NO: 241109 - DNA, 426 bp, Artificial Sequence
  Description of Artificial Sequence: Synthetic coding sequence
atggaatttcacaacggaggtcacgtcagtgggatcggagggttcctagtgtcacttacctctcgtatgaagcctcatacgctcgctgtcacacccgcactgatttttgccattacagtggcgaccatcggaagtttccaatttggatacaatactggcgtcattaatgcacccgagacaatcatcaaggaatttattaataaaactctaactgacaaagcaaacgcccctccatccgaggtgcttctgacaaacctgtggagcctcagcgtcgcaatcttcagcgttggtggaatgattggctcattttcagtgggcctgtttgtcaatcgcttcggccgaaggaatagcatgctaatcgtgaacttgctcgccgcaaccgggggttgcctaatggggctgtgtaaaatcgcagagtcagtctag

SEQ ID NO: 241110 - DNA, 1608 bp, Artificial Sequence
  Description of Artificial Sequence: Synthetic coding sequence
atgcagcgtctgcaactgctgagggtggaagtgttactaggggtcaaacagggggacgagatgaggcactttttctttagctcccagaccagtaccctggaaaagagccagaacggcggagtgggcgaggaggtcaccccagccctcatctttgccattactgtggccacaattggctctttccagtttggttacaacacaggtgtcatcaacgctccagagaccatcattaaggagttcatcaacaagactctcactgataaagccaatgcaccacctagtgaggtgctgctcaccaacctgtggtctctttccgtcgcaatcttcagcgttggaggcatgattggttcattttccgtggggctctttgtaaaccgatttggacgaaggaattccatgctgatcgtgaatctgctcgccgcaaccggcggttgtctgatgggactctgcaagattgctgagagcgtggaaatgcttatcttaggcaggctggtaataggacttttttgcggcctgtgcaccggctttgtgccaatgtacatcggagagatctctcccaccgccttaagaggtgcctttgggactctgaatcagctcggcatagtcattggcatcctggttgcccaaattttcgggcttgaactcattttgggaagtgaggagctatggcccgtccttcttggtttcactattctgcccgctatcctgcaatcagctgccctgccctgttgccctgagagccctcgttttctattgatcaacagaaaaaaggaggagaatgcaacaagaatcttgcagcgtctctgggggacgcaggatgtgagtcaggatatacaggaaatgaaggacgagagtgccaggatgtcccaggagaagcaggttacggtgctggagctctttcgagtctcatcttacaggcaaccaatcatcatctcgatcgttctccagctgtcccaacagctgagtggcatcaatgctgttttttattactctacgggcatctttaaagacgcaggggtacagcaacccatttacgctacgatttccgcaggcgttgtgaatacaatcttcacccttctctccctgttcctggtagagagggccggtcgtcgaactctccacatgattggcctgggaggcatggctttttgcagcactctcatgactgtgtctcttctcctcaagaaccactacaacggcatgagctttgtgtgcattggggcaatcttggtgttcgttgcatgtttcgaaataggcccagggccaattccttggttcatcgtggccgagctcttcagtcaaggccctcgaccagccgctatggcagtcgcgggatgctcgaattggacgtccaatttcctggtggggttactttttccctcagctgcttactatctgggcgcatacgtgttcataatcttcaccggcttcctgatcacttttctcgccttcacctttttcaaggtgcctgaaactcggggtagaacctttgaggatatcacacgagcatttgagggtcaggcccacggagccgatcgctcgggcaaagacggcgtgatgggcatgaactctatagagcccgcaaaggagactaccacaaacgtttag

SEQ ID NO: 241111 - DNA, 486 bp, Artificial Sequence
  Description of Artificial Sequence: Synthetic coding sequence
atgattgggttagggggtatggccttctgtagtacccttatgaccgtctcactgctgcttaagaatcactacaacggcatgtcctttgtgtgtattggcgctattctggtgttcgttgcttgcttcgaaattggacccggtcctatcccttggttcatcgtcgctgagctcttctcacaggggccacgaccagcagctatggcagtggccggatgtagtaactggactagtaatttcctcgtggggctgctcttccccagtgcagcttactacctgggggcttatgtatttattattttcactggtttcctcatcacgttccttgcctttacctttttcaaggttccagagaccagaggacgaactttcgaggatataacacgggctttcgaagggcaggcgcatggtgccgaccggtccgggaaggacggagtaatgggtatgaactcgatcgagcctgctaaggagaccactactaatgtgtag

SEQ ID NO: 241112 - DNA, 1236 bp, Artificial Sequence
  Description of Artificial Sequence: Synthetic coding sequence
atgctgctgagaaggcgcaattccatgctcatagtgaatctgttggccgcaacaggaggctgtcttatgggcttatgtaagattgccgagtccgtggagatgttgatccttgggaggctcgtcattgggctgttttgcggcttgtgcactggcttcgtacctatgtatattggcgagatctctccaacagcacttagaggcgcattcgggaccttgaatcagctgggcatcgtgatcggcatcctggtggcacagatcttcggattagagctcattctagggtctgaagagttatggccggttctgcttggtttcaccatactgcctgcaatcctccagtccgccgcactaccttgctgtccagaaagtccaaggttccttttgataaaccggaaaaaagaggagaatgcaacgcgtatcttgcagagactttggggcactcaggatgtctcacaggatatccaagaaatgaaggatgagtctgctaggatgtctcaggagaagcaagtgaccgttctggagctgttcagggtgtcatcatatagacagcccatcataatcagcatagtgcttcaattgtctcaacaactgtctggcataaacgccgttttttactatagtaccggaatttttaaagatgccggagtgcaacagcctatctatgccaccatctccgctggtgtggttaataccatatttacactactctcgcttttccttgtggagcgagccggaagaaggacactgcacatgatcgggcttggcggaatggctttttgtagtaccctgatgacagtgtcgctacttttgaaaaatcactacaatggaatgagcttcgtgtgcataggggctatccttgtattcgtggcttgttttgagattggcccaggacccatcccatggttcattgtcgccgagctatttagccaggggcctcggccagcagcaatggcagtggccggttgctccaattggacatctaacttcctggtggggttgctttttccctctgctgcatattacttgggagcctacgtgttcattatctttactggctttctgatcactttccttgctttcaccttttttaaagtgccagagactagaggaagaacgtttgaggatataactagggcctttgagggacaggcgcacggcgctgataggtcaggtaaagacggagttatggggatgaacagtattgagccagccaaagagaccactaccaatgtatag

SEQ ID NO: 241113 - DNA, 459 bp, Artificial Sequence
  Description of Artificial Sequence: Synthetic coding sequence
atggataatcggcaaaatgtgaccccagccctaatctttgcaattactgtcgccactattgggagcttccagtttggatataatactggagttatcaacgcccctgagactattattaaagagttcatcaataagacactgacagacaaagcaaatgcccctccttcagaggtcttgctgactaacctgtggagtctttctgttgcaatctttagcgttggaggaatgatcgggtccttctcagtgggcctgttcgttaacaggttcggcaggaggaatagtatgctgatcgtgaacctccttgcggctactggagggtgcctgatgggattgtgcaaaattgcagaatctgttgaaatgttaatcctgggcaggctggtcatcggtctcttctgcggactctgcacaggttttgtacccatgtatatcggtgaaatttcgccaactgccttgcgctag

SEQ ID NO: 241114 - DNA, 255 bp, Artificial Sequence
  Description of Artificial Sequence: Synthetic coding sequence
atggacaacaggcagaatgttacccctgccctgattttcgcgataacagtggccacaatcgggtccttccaatttggctataacacgggtgtgatcaacgcaccagagactataattaaggaatttatcaataagaccctgacagataaagcaaacgcccctcccagcgaagtgcttctcactaacttgtggagcctgtctgtggccatcttcagcgttggcggaatgattggatcctttagtgtggggctctag

SEQ ID NO: 241115 - DNA, 1563 bp, Artificial Sequence
  Description of Artificial Sequence: Synthetic coding sequence
atggagtttcacaacgggggtcacgtatcgggtattggcggattcctcgtgagcctcacaagtcggatgaaacctcacacccttgcggtgactcctgcactgattttcgccattaccgtggccaccattgggtcatttcaatttgggtacaatactggtgtgatcaatgcgccagaaaccattatcaaagaattcataaacaaaacattgactgataaggccaacgcccctccttcagaggtcctgctgacaaacctgtggtccctttccgtggcgatcttctcagtcgggggtatgattggctccttcagcgttggactctttgttaacagattcggccgtcgaaactctatgctgatcgtgaatctcctcgccgctaccgggggatgcctcatgggtttgtgcaaaatcgccgaatcagtggagatgctcattcttggcagacttgtcatcggcctcttctgcggcctgtgtactggatttgttcctatgtacatcggggagatcagccccacggccctacgtggcgcatttggcaccctaaatcaacttggaatcgtgattggaatcctcgtggcccagatttttggcctagaactaattttaggatccgaagagctgtggcccgtcctgctcgggtttaccattttaccggcaatcttgcagagcgcagctctgccctgttgtcccgagtcacccaggtttctgctaatcaacaggaagaaggaggagaatgccacccgcattctccaaagactttggggaacccaggacgttagccaggatatacaggaaatgaaagatgagtcggcacggatgtctcaggagaaacaagttactgttcttgaactctttagagtgagctcatacagacagccgatcatcatatccattgtattacagttgtcccagcagctgtccggcattaacgcagtgttctactattctacgggcattttcaaggatgccggagtccagcagccaatttacgccacaatctccgcaggggtggtgaacacaatttttactctgctgtccctgtttctcgttgaacgagccggtcgtcgcacgcttcatatgataggccttggcggtatggcgttttgtagcacactcatgacggtgagcttgttgctgaaaaatcattacaatggaatgtcatttgtttgcattggcgctatcctcgtgttcgtggcatgttttgagatcgggcctggcccaattccatggttcatagtggccgagctattttcccagggcccacggcctgccgcaatggctgtggcagggtgctctaactggacctcaaacttcctggttggactcctgttccctagtgctgcttattacctcggggcatacgtgttcatcatttttacaggctttttgattaccttcctggccttcaccttcttcaaagtgcccgagacacgagggagaacattcgaggatataactcgagcgttcgaggggcaggcacacggagctgatcggagcgggaaggacggggtgatgggaatgaacagtattgaacccgctaaggagaccacaaccaatgtctag

SEQ ID NO: 241116 - DNA, 510 bp, Artificial Sequence
  Description of Artificial Sequence: Synthetic coding sequence
atggataaccgacagaacgtaactccagcccttatcttcgcgattacagttgccactatcggaagctttcagttcggctacaacacaggagtgatcaacgctcccgaaactatcattaaggagtttatcaacaagacgctcacagataaggctaatgctccgccaagcgaagtgctcctgacaaacctgtggtccctatcagtggcaatcttttccgttggaggcatgatcgggtccttctcagtgggactttttgtgaacaggttcggacgacggaactcgatgctgattgttaacctgctggccgcaacgggcggatgtttgatgggactctgtaaaatagccgaatccgtggagatgctgattctcggtagattggtcataggcttattttgcggtctgtgtaccggcttcgtgcctatgtacatcggcgaaatcagccctacggctctcaggggcgcatttggcacactaaaccagttggggattgtcatagggattctcgtgtag

SEQ ID NO: 241117 - DNA, 1491 bp, Artificial Sequence
  Description of Artificial Sequence: Synthetic coding sequence
atggggacgcagaaggtgactccggcattgatctttgcaataaccgtcgccacaattggatcctttcagtttggctataacaccggtgtaattaacgcgccagagaaaatcatcaaggaatttattaacaagacgttgaccgataaaggcaacgcaccgccaagcgaagtcctgctgacctcgctgtggtccctttctgtggccatctttagcgtgggcggaatgattgggagcttcagcgttggcctgtttgtcaaccgatttggtcggaggaactcgatgctcattgtgaacctactggctgtgaccggtggatgcttcatgggactgtgcaaagttgcaaaatccgtggaaatgctgattcttgggaggcttgtaattgggctgttctgcggactgtgcaccggattcgtgcctatgtacattggcgagatctcacccactgcattaaggggggcattcggcaccttaaaccagctcggtatcgtggtgggaatactcgttgcacagattttcgggttggagttcattctgggatcagaagaactatggcccctgttgctgggatttacgatcctgccagctatcctgcagtcagcagctctgcctttttgcccagagtcacctaggtttcttctcattaatcggaaggaggaagagaatgctaagcagattctgcagcgattatgggggacacaggacgtctcacaggatatccaagagatgaaagacgaatctgcgaggatgtcacaggaaaaacaagtgacggtgctggagctgtttagagttagcagttaccgacaaccaattattatatccattgtgctgcagctctctcagcagctgtctgggattaacgccgttttttactatagcacagggatattcaaggatgctggcgtccaggaacctatctacgcaaccatcggagctggcgtcgtcaacactatatttactgtcgtgagcctgtttctagtggaacgggcaggcaggagaactctacatatgattgggctgggaggaatggctttctgcagtactcttatgaccgtgtcgctactactgaaggataattataacggcatgtccttcgtgtgtataggcgctatcctagtgtttgtagctttcttcgagattggcccaggccctattccttggtttatcgtggccgaactcttctcccaggggccacggccagcagctatggcagtggccggttgtagcaactggacctctaatttcctggtcggactgctgtttccttctgccgctcattacttaggggcatacgtgttcataatcttcacgggctttctgatcacctttctggcgtttaccttcttcaaggtacccgagactagaggtaggacctttgaggatatcacacgtgcgttcgaggggcaggcccacggagcagacaggtcagggaaagatggggtcatggagatgaacagcatcgaacccgcaaaggagacaactaccaatgtctag

SEQ ID NO: 241118 - DNA, 1269 bp, Artificial Sequence
  Description of Artificial Sequence: Synthetic coding sequence
atgatagggtccttcagcgtggggttattcgtaaatcgctttggacggcgaaattcgatgctgatagttaatctcctcgctgtcacaggtggctgcttcatggggctgtgcaaggtcgctaaatctgtagagatgctcatcctgggccgtctcgtgatcggactgttctgcggactgtgcactgggtttgtgcctatgtatattggcgaaattagcccgactgctctacggggagcatttggaacccttaatcagttgggaattgtggtgggaatcctagtcgctcaaatttttggcctggagtttatcctgggcagtgaagagctctggccacttttactgggatttacaatcctgcctgctattttacagagcgccgctctgccattttgtcccgaatctcctcggttccttttaatcaaccgcaaggaggaagaaaatgccaagcagattcttcagcgcctatggggaacccaagacgtcagtcaggatatacaggaaatgaaggacgagtcagctcgaatgtcacaagagaagcaagttacggtgctagaactgttcagagtgtcttcatatcgacagcctattattatcagcatcgtgctgcagttgtcccaacagctctccggaatcaatgccgttttttactatagcaccggaatctttaaggatgcaggggtgcaggaacccatttatgccactataggggctggcgtggttaatactatttttacagtggtgtcattatttctggttgaaagggccggtcggagaacactccacatgatcggcctcggaggcatggccttttgctccacactgatgactgtgtccctgctgctgaaagataattacaatggcatgtcatttgtctgtattggggcaattctggtctttgttgccttttttgagatcggtccgggaccaatcccctggttcattgtcgctgaattgttttctcagggtccgaggcctgcagctatggcagtagccggatgttctaattggacctccaatttcttggtaggcctgctctttccatccgccgcacattacctcggtgcttatgtatttattatatttaccggctttctgataactttcctggccttcaccttttttaaggtgcccgagaccagggggcgtacgtttgaggatatcactcgggctttcgaaggtcaagcacacggggctgacagaagtggcaaagatggagtgatggagatgaacagcatagagcccgcaaaggaaaccaccaccaacgtctag

SEQ ID NO: 241119 - DNA, 1530 bp, Artificial Sequence
  Description of Artificial Sequence: Synthetic coding sequence
atgccttcaggcttccaacagatcgggtccgaagacggagagccccctcagcaacgagttaccggcacattggtgcttgccgtattctcagccgttctggggtccctccagtttggctataacataggagtcattaacgcccctcagaaggtcatagagcagagttacaatgaaacttggctgggccgacagggaccagaggggcctagttctattccacccggaactctgaccactctgtgggccctctcggtcgctattttcagtgtgggcggtatgatctcctcgtttctgatcggcatcataagccagtggcttgggaggaagcgagccatgctagttaacaacgttctcgcagttctggggggatcattgatggggctggctaatgctgcggctagctacgagatgctgattctgggaaggttcctcatcggtgcctattccggccttacttcaggcctcgttccgatgtatgtgggagaaatcgcgcctacacatcttcggggtgccctgggcaccctcaaccagttggcaatcgtaattggcattcttatcgcccaggtccttggcttggaaagcttgctgggcaccgcatctctgtggccgttacttttaggccttacagtactgccggctcttctgcaacttgtactcctgcctttttgcccagagagtccacggtatctgtacatcattcagaacctcgagggaccagccaggaagtctttaaaaaggctgacaggatgggctgacgttagtggcgtccttgccgagctgaaagacgagaagaggaagctggagcgagaacggcctctatcgctactgcagctactcggctccagaacacatagacagccactcataattgctgttgtgctccaactgtcgcaacagttgtcagggatcaatgccgtgttctattattccacttccatctttgagacagctggcgttggccagccagcctacgctaccatcggcgctggggttgtgaatacagtctttactttggtttccgtgctgttagttgaaagagctggccgacggactctacatcttttaggcctagctggtatgtgcgggtgtgccatcctcatgaccgtcgcattattactgctggagagggtgcctgccatgagctatgtcagtattgtcgccatatttggcttcgtggctttttttgagataggaccaggtccaatcccctggtttatcgtggctgaactgttcagccaagggcctagacccgcagccatggctgtcgccggattctcaaattggacttccaactttatcattggcatggggttccagtacgtggccgaggctatgggtccttatgtttttctgttatttgctgtgctgctcctgggattcttcatctttacattcctgagagttcccgaaacccgtggtcggacctttgatcaaatctctgcggcattccaccgtacaccgagtttgctggaacaggaggtcaagccctccacggaattggaatacctcggtccggacgagaatgactag

SEQ ID NO: 241120 - DNA, 1356 bp, Artificial Sequence
  Description of Artificial Sequence: Synthetic coding sequence
atggacggtgaacctccacaacaacgagtgacaggcaccctggtcctcgcagtattctccgctgtattgggcagtctccagttcggatacaatattggtgttattaacgccccacagaaggtgatagagcagtcatacaacgagacctggctggggaggcagggcccagagggtccctcctccattccccctggaaccctcacgacgctgtgggcacttagcgtagctatcttttccgtaggtggaatgatatcaagttttctgataggaatcatttctcaatggttgggcaggaagcgcgcaatgctggtgaataacgtgctggcagtcctgggcggatctctgatgggtctggcaaacgccgctgctagttatgaaatgcttattctcgggaggtttctcatcggggcttacagcgggctaacaagtggcctggtccccatgtatgtcggcgagattgctcctacgcacctgcgtggcgcattagggaccctgaaccagctggccatagtcattggcatcctgattgcccaggtccttggcctggaatcattgctgggcactgcatcactatggccactgctccttggactaacagtgttaccggctttgttacaactggtgctgttaccattttgccccgaatctcccaggtacctctacattattcagaatctggaagggccagcgagaaagtcgctgaaacgcctgaccggatgggcggacgtgtccggggtgctggcagaattaaaggacgaaaagagaaaactcgagcgggaaaggcctctgtcactgctgcagcttctggggtctagaacccacaggcagccactgattatcgccgtggtgttacagcttagccaacagctatctggcatcaatgcagtattctattacagtacctcaatctttgaaacagccggtgtcggacagccggcatacgccaccatcggcgctggggtggtcaacaccgtgtttactctggtttcagtgctgctggtggaaagggccggacgccgaacattgcatcttctcggcttagcgggtatgtgcggctgtgcaatcctgatgaccgtggcgctcctcctgctggagcgggtgcccgcaatgtcgtacgtctcaatcgtcgccatatttgggttcgtggcgttcttcgaaattggccctggcccaatcccatggtttatcgtagctgagctgttcagtcagggaccccgaccagccgcaatggcagtcgctggcttcagtaactggacctcaaatttcatcatcgggatgggctttcaatatgtagccgtgggccctccagccccagcctctcacacagttggtcagaggtgggcgtcccattcatag

SEQ ID NO: 241121 - DNA, 1338 bp, Artificial Sequence
  Description of Artificial Sequence: Synthetic coding sequence
atgcaggagccattactgggcgctgaaggtcctgactacgacactttcccggagaaaccacccccaagccccggagaccgtgcgcgtgtcggcaccctccagaataaacgtgtcttcttggcaaccttcgcagctgtcctgggcaatttttcattcggttacgcgttggtgtacacgagtccggtgataccagcactggagaggagtctcgacccggatctacacctgacgaaatctcaagcttcctggttcggtagcgtcttcacactgggagctgcagccggaggcttgtccgccatgatcctcaacgacctcctgggtcgtaaattgagcatcatgttcagcgcggtgccatcagcagcaggatacgcactcatggcgggtgcccacggcctatggatgctattgctggggcgtacccttacaggctttgccggaggcttgaccgcagcgtgtatcccggtctacgtaagcgaaattgctccaccaggtgtaagaggcgctcttggagcaaccccccaattgatggccgtgtttgggagcctttctctgtatgctctgggactgctccttccctggaggtggttggccgtggccggagaagcacctgtcctgatcatgattctgctgctatctttcatgcccaattcacccaggttcctgctctcaaggggcagggacgaagaggccctacgcgctttggcttggctgcgtggtacggacgtggacgttcactgggaattcgaacagattcaggacaatgtgcgccgtcagagcagcagggttagctgggccgaagcccgagctcctcacgtctgtcgccctataaccgtggccctgctgatgcggttactgcagcaactcaccggaatcacacctatcctggtatacctacaaagtatattcgactctactgcagtgctcctgcctccaaaggacgacgccgctatagtcggggcagtgagacttttatctgtcctgatcgccgctctgacgatggatctagcaggcaggaaggtgctgctgttcgtgagcggctacgccgtgggctgggggccaatcacctggttgctgatgtccgaagtgctaccactgagagccagaggagtggcgagtggcctatgcgtgctggcaagttggctgacagcttttgtactgacgaagtcctttctgcctgtggtgtccacgttcggccttcaagtccctttttttttcttcgccgctatttgtctggtgagtttggtgtttacaggctgctgcgtgcccgaaaccaaagggcgatcgctggagcagattgaatctttctttaggaccggaaggcggtcatttctcaggtag

SEQ ID NO: 241122 - DNA, 1524 bp, Artificial Sequence
  Description of Artificial Sequence: Synthetic coding sequence
atgcaagaacccctcctcggagcggaaggccctgactatgatacttttcctgagaagccccctcctagccctggcgaccgggctcgtgtagggacgctgcagaataaacgcgtgtttcttgccacttttgctgcagttctcggaaacttctcctttggctacgctctggtgtacaccagccctgtgattcctgcactggaacgctccctggaccctgacctgcacttaactaagtcccaggcgagttggttcggctcggtttttacccttggcgctgctgcgggtggactgtctgcaatgattctaaatgatttgcttggaagaaaattgtcaatcatgttctcggctgtgcctagcgcggctggttacgctctaatggccggagcccatggactgtggatgctcttgctgggaagaactctgactggatttgccggtggactgactgccgcttgcatccccgtgtatgtaagcgaaattgctcctccaggcgtgaggggcgctttgggagctacacctcagctcatggctgtgttcggctccctatctctgtatgccctgggcctcctcctgccctggaggtggctcgcagtggccggagaagcccctgtccttataatgattttattacttagctttatgcccaacagcccacggtttctcctctcaaggggacgcgacgaggaggctctgcgcgcactcgcctggctacgagggaccgatgtggatgtgcattgggagttcgaacagattcaggacaacgtacggaggcagtcttccagagtgtcatgggcggaggctagagcaccgcatgtatgtaggccaattaccgtcgccttgctgatgcgcctgttacagcagctgactgggataacccctatactggtctacttacagagtatcttcgacagtactgcggttctgctccccccaaaagatgacgcggcaatcgtgggcgctgtgcgcctgctttccgtcttgattgctgcactgactatggacctggccggaaggaaagtgttgctttttgtgagcgcagcaatcatgtttgctgccaatctaaccttgggcctgtacatccactttggaccaagacccctgtcccccaattcgaccgcgggactggaaagtgaatcctggggagacctggcccaacctcttgccgcacccgctggctacctgaccctcgtgccgttgctggccacgatgctgtttatcatgggatatgccgtgggatgggggcctatcacctggctactgatgagcgaggtgctgccacttcgcgcaagaggcgtggcatccggcctgtgcgttcttgcgagttggctgacagccttcgtgctgacaaaatcgtttttacctgtcgtaagcacgttcggcctgcaggtgccttttttttttttcgctgctatctgcttggtctcattagtgtttaccggatgttgcgtgcctgagaccaagggccgttccttggaacaaatagaaagcttcttccggaccgggaggcgttcctttcttaggtag

SEQ ID NO: 241123 - DNA, 441 bp, Artificial Sequence
  Description of Artificial Sequence: Synthetic coding sequence
atgatactgaacgacctcctcggtagaaagttgtctatcatgttctcagctgtgccctccgccgcaggatatgctctcatggccggagcgcatgggctgtggatgttgctgctggggagaaccctgaccgggttcgccggagggctgactgctgcctgcatccccggtttgactctcccaagtcgccctggactgggaacgtctatcttcagcaagacttggtgtggcggatgcgtcctccaggtatacgtaagtgagatagcacccccaggggtacgaggcgctctcggggctacccctcaattgatggcagtgttcggctccctgagcttgtatgcattggggaaggacgaggaggccttaagggcacttgcctggctacggggtaccgacgtggacgtacactgggaattcgaacagatccaagacaatgtccgttag

SEQ ID NO: 241124 - DNA, 660 bp, Artificial Sequence
  Description of Artificial Sequence: Synthetic coding sequence
atgcaggaaccccttctaggggctgaagggcctgactatgatactttcccagaaaagccaccaccaagtccgggtgacagagccagagtagggactctgcagaataagcgtgtctttctggccacatttgccgctgtgttggggaacttttctttcggctatgcactcgtttatacctctcctgtgattccagcactggagcggtctttggaccccgatctgcacctgactaagagccaggctagttggttcggctctgtttttacactcggcgctgctgccggtggcctgtccgccatgattctgaacgacctactcggcagaaagttgtccatcatgttctcggctgtgccgtctgccgctggctatgcactgatggccggagcccacggcctatggatgcttctgctcgggcgaacattgacaggatttgcagggggactgaccgccgcttgtatccctgtctatgtaagtgaaatcgcgcctccaggggtgcgtggtgcgttgggtgcaaccccgcagttaatggctgtcttcggtagtctttcactctatgctctcgggacaaagaggccatgcggccgttggcctggctgcgtgggacgtaccagtatgtcgaccggctcctcatcccgtagtcgtacgaccagcggcgattag

SEQ ID NO: 241125 - DNA, 1539 bp, Artificial Sequence
  Description of Artificial Sequence: Synthetic coding sequence
atggagaataaggaggcaggaaccccgccacccatcccttcccgagaaggcagactgcagccgaccctgctactggccactctaagtgctgcctttggcagtgcttttcagtacggctataatctgtccgtggtgaacaccccccataaagtctttaaaagcttctacaacgagacttacttcgaacgccacgcaaccttcatggacgggaaactgatgctactgctatggtcatgcaccgtttcaatgtttcctttgggcggtcttttgggttctctactggtgggcctactggtggactcctgcgggcgaaaagggacactgttgattaataatatctttgcaataattcctgccatcctgatgggcgtctccaaagttgctaaagcattcgagttgatagtgttctcaagagtggtgctcggggtttgcgcaggaataagctactccgctctgccaatgtatcttggagagcttgcacctaagaatttgcggggaatggttggaacgatgactgaagtttttgtcattgttggagtgttccttgcccaaatttttagtctgcaggctattctgggcaatcccgctggctggcccgtgcttttagcgctgacgggggttccggcactcttacagttattaaccctgcccttcttccctgaatccccacgctatagtctcattcagaagggcgacgaggccactgcacggcaggcgctgcgtcgcctgcgtggccacaccgacatggaagcagaattggaggatatgcgcgctgaggcgagggcggaacgggctgaggggcatctgtctgttcttcatctctgcgccctgaggagcctccggtggcagctgcttagtatcattgtcctgatggctgggcagcagctttctggaattaatgctattaattactatgcggacaccatctatacctccgctggagtggaggcggctcatagccaatatgtcacagtgggaagcggtgtcgtgaatatcgtgatgacaatcacctccgccgtcctggttgaacgattaggcagacgccacttgctgttggccggatatggcatttgtggaagcgcgtgccttgtccttaccgttgttctgttgtttcagaatcgcgtccccgaactatcttacctcgggattatttgtgtgtttgcctacatagccggacactcgataggcccttccccagtaccctcagtcgtgcgcacagagatttttctccagagctctaggcgcgcagcatttatggtggacggggctgttcattggttgaccaactttattatcggcttcctcttcccaagtattcaggaggccatcggcgcatactccttcatcattttcgccggaatctgtttgctgacggccatatacatctacgtcgttattcccgaaaccaagggcaagacctttgtggaaataaacagaatattcgcaaaaagaaatagggtgaaactgcccgaagaaaaggaggaaacaatcgacgcaggcccacctacggcctctcctgcaaaagagacttcattctag

SEQ ID NO: 241126 - DNA, 804 bp, Artificial Sequence
  Description of Artificial Sequence: Synthetic coding sequence
atgacgtgctccctgggaaaggtgtatatctctgagatcgcctatcccgctgtgcgtggcttattggggtcctgtgtccaactgatggttgtggttggcattcttctggcgtatctggctggatgggtgctcgaatggcggtggctagccgttctggggtgcgttcccccttctctgatgttgcttttgatgtgtttcatgcctgaaacccctcgcttcctgctcacacagcataggaggcaagaagcaatggccgcattaaggttcctatggggtagtgagcaaggttgggaagaccctcccattggagccgagcaatctttccacctggccttacttcgtcaacctggaatttacaagcccttcataatcggagtttcactgatggccttccaacagctgagtggagtgaacgccgtaatgttttacgcggagactatttttgaggaagcaaaattcaaggactccagcctggcttcggtagttgtaggggtgatccaggtcctgttcacagccgtcgccgctcttatcatggaccgagctgggagacggcttttactcgtgttgtctggagtggtaatggttttcagtacaagcgccttcggggcatacttcaagctgacacagggagggcctggcaactcctcgcacgtggcaatctcagccccagtgtccgctcagccagtggacgctagtgtggggctggcctggctggcagtcggttccatgtgtcttttcatcgcgggtttcgcagtcggctgggggcctatcccatggctgttaatgagtgagatatttccatag

SEQ ID NO: 241127 - DNA, 645 bp, Artificial Sequence
  Description of Artificial Sequence: Synthetic coding sequence
atggccttccagcagttatccggcgtgaatgccgtcatgttttacgctgaaaccattttcgaggaggctaagttcaaggattcatcattggcctcggttgttgtcggcgtcatccaggtgctgttcaccgccgttgccgcactgatcatggacagagccggtcgacgactgctgctggttctaagcggggtcgtgatggtgttcagtacctctgcgtttggggcatactttaaactcacccaaggaggtccgggaaattccagccacgtagccatttccgccccagtgtccgctcagccggttgacgctagcgttggtcttgcctggttggccgtcggatccatgtgtctgttcattgccggatttgcagtcggttgggggccaattccatggctcctgatgtccgagatttttcccctccacgtgaagggggtggctacggggatctgtgtgttgaccaactggttgatggcctttttagtgaccaaagagttcagctcccttatggaagtgcttcggccatacggtgccttttggctggccagtgccttttgcattttctccgtcctgtttaccctcttctgcgtgccagagacaaagggaaagacactggaacagattaccgcccacttcgaagggcgatag

SEQ ID NO: 241128 - DNA, 1236 bp, Artificial Sequence
  Description of Artificial Sequence: Synthetic coding sequence
atgactcccgaagatcctgaagagacccaaccactcctgggcccacccggagggagtgcccctcgaggcaggagggtatttctcgccgctttcgcagcagcactgggtcccttgtctttcggttttgcattgggctatagctctcccgcaattccatctttacaaagagcagcgcctcctgctcccagactcgatgatgctgcagctagctggtttggcgcagtggtcacgctcggcgctgccgctggtggcgtcctggggggatggctggtggaccgagctgggaggaaattgtctctcctgttgtgctcggtcccgttcgtggccggttttgccgtgattacagcagcccaggatgtatggatgctgctgggaggcaggctgcttacaggcctcgcgtgcggtgtcgctagtctggtggccccagtgtacattagtgaaattgcctaccccgcagttagaggtctcctcggatcttgcgtacagctgatggtggttgtcggcatccttctcgcgtatttagcaggttgggtgctggaatggcgctggctggcggttcttggttgcgtgcctccatctcttatgcttctcctgatgtgctttatgcccgagacccctaggttcctgttgacacagcatcgcaggcaggaggctatggctgcgctccggttcttgtggggaagcgagcaggggtgggaggatcctccaatcggcgcagagcagtcattccacctcgcgttgctgaggcagcctgggatatataagccttttatcattggcgtgtcacttatggccttccagcagctgagcggagttaacgctgtgatgttctacgcagaaaccatttttgaggaagctaagtttaaagatagctctctggcttcggtggttgttggcgttatacaggttctgttcaccgccgttgccgctctgatcatggatagagccggtcgccgtctgctgcttgtcttatctggtgtggtgatggtgttctccacaagcgcctttggcgcttatttcaaattgacccagggcggtcccggaaactcaagccacgtggctatctccgccccagtttctgcccagccagtggatgcttcggtgggcttggcttggttagccgtcgggtctatgtgcctgtttatcgcgggaggtcctcaggctttatggagcctgttggcatgtctgcggttcctacacctgcagtgccccttccattttgtgctttgcccctag

SEQ ID NO: 241129 - DNA, 1434 bp, Artificial Sequence
  Description of Artificial Sequence: Synthetic coding sequence
atgaccccggaggacccagaggaaacacagcctctcctcggtccacctggcggatctgctcctagggggaggcgggtattcctcgccgcttttgctgcggcattggggccattgtcttttggatttgcccttggctatagctcaccggctatccctagcctccagcgggctgctccaccggctcctcggttggatgacgctgcagcctcgtggtttggcgctgtggttactcttggggctgccgctggtggcgtgctgggaggatggctggtcgaccgcgctgggaggaaacttagcctgctactgtgctcagtgccctttgtggctggattcgccgtcataaccgctgctcaggacgtgtggatgctgcttggaggcaggttactgaccggactcgcttgcggcgtggcttctctcgtcgcaccagtgtatattagcgaaatcgcctacccggcagtacgaggactgttgggttcgtgcgtgcagttgatggtagttgtgggaattcttctggcctacctagctggatgggttctggagtggagatggctggctgtactgggctgtgttcctccgtccctaatgcttctcctcatgtgcttcatgccagagacaccacggttcctgctcacacagcataggaggcaggaagccatggccgctctgaggtttctctgggggtccgagcagggctgggaggatccccctattggagccgaacagtctttccacttggccctgctgcgacaacctggcatttacaaaccttttatcataggggtgtccctcatggccttccagcaattgtctggtgtcaacgccgttatgttttatgctgaaactatctttgaggaggcaaaatttaaggatagtagtctcgctagcgttgttgtgggagtgatccaggtgctctttacggcagtggcggcattaatcatggatcgggctgggcgaagacttcttctggtgctatcgggggtcgtcatggtcttttccacctcagcgtttggagcctatttcaagttaacacagggcggacccggaaattcctcccatgttgcaatttctgcacccgtgagcgctcagcctgtcgatgcatcagtaggactggcctggctagctgtaggcagtatgtgtctctttatagcaggctttgccgtgggctggggacccatcccatggctgttaatgagcgaaatctttcccctccatgtcaaaggagtggccacgggaatttgtgtgctcacaaattggctgatggcgtttctggtgactaaggagtttagctccctgatggaggtcctacggccatatggtgcattttggctcgcctccgcattctgcatctttagcgtcctgtttaccctgttctgtgtgcccgaaacgaagggcaaaacacttgagcaaattaccgcccactttgagggccgttag

SEQ ID NO: 241130 - DNA, 510 bp, Artificial Sequence
  Description of Artificial Sequence: Synthetic coding sequence
tagggcagacgggtttttctggccgcttttgctgcagccttgggtcccctgtcttttggattcgctttaggatattcgtcgcctgcgattccatcccttcagagggcagcccctcctgcccctcggctcgacgatgctgcagcctcgtggttcggtgtgtacatcagtgagatcgcgtacccggcagtgcgaggacttttaggcagttgtgtccagctgatggtggtcgtcggcatattactggcatatttggccggttgggtgctggagtggcgctggcttgctgtgctcgggtgtgtaccgccttctctgatgcttctactgatgtgcttcatgcctgagaccccaagatttcttttaacacaacacagaagacaggaggccatggccgctctgcggtttctatggggcagtgagcagggctgggaggaccccccaattggggctgaacagcagctgagcggagtgaatgccgttatgttttacgccgaaactatcttcgaagaatag

SEQ ID NO: 241131 - DNA, 771 bp, Artificial Sequence
  Description of Artificial Sequence: Synthetic coding sequence
atgaccccagaagatccagaggaaacacaacccctgttaggcccacccggtggttccgctcccaggggcaggcgagtcttcctggcggcattcgccgctgctctgggacctctgtcttttggatttgcactgggctattcctcccccgcaattccttctctccaacgggcagcacccccagcgccaagattggacgacgccgctgcctcctggttcggggtgtacattagcgaaatagcttacccagccgttagagggctactgggctcatgcgtccaattaatggtcgtggttggaatattactggcctacctcgcgggatgggtcttagagtggagatggctggctgtactcggatgcgtgcccccatcactgatgctgctcctgatgtgctttatgccagaaacaccacgttttctactgacgcaacaccgacggcaggaagccatggccgctcttcgctttctttggggcagcgagcaggggtgggaggatcctcctatcggcgcagaacagtccttccatctggccctgctgagacagcctggcatttataagccctttatcatcggtgtctccctcatggccttccagcagctgtccggagttaacgctgttatgttctatgctgagactatattcgaggaggcaaaattcaaagactcttccctggcgtcagtggtcgtaggtgtgatccaggtgctcttcactgcagtagctgcactaatcatggaccgagcaggtcggagactgctgctcgttctgtcttag

SEQ ID NO: 241132 - DNA, 804 bp, Artificial Sequence
  Description of Artificial Sequence: Synthetic coding sequence
atgacctgttcactggggaaggtctatatctcagagattgcatacccagctgtgagagggttgctggggtcatgcgtccagttgatggtcgttgttggcatactgcttgcttatctggccggatgggtactggaatggcggtggctggcagtcttaggttgcgtgcctccctctctcatgctcctgcttatgtgctttatgcctgagaccccaaggttcctgctcacccagcatcgtaggcaggaggcaatggctgcactccggtttctatggggatctgagcaggggtgggaagacccccctattggcgcagagcagagcttccacctggcactcctcaggcagcctggcatttacaaaccctttataatcggggtttctctgatggcttttcaacaactgtccggagtaaacgcggttatgttttacgctgagacaatttttgaagaggccaaatttaaagactccagcttggctagcgtggtagtcggggtcatccaggttctgttcacagcagtggctgccctgataatggacagggccggacggaggttgctgctggtgctctcgggtgtggttatggtcttttctactagtgctttcggtgcatactttaaattgacgcaaggtgggccaggcaattcctcacatgtggctatctcggcccctgttagtgcacagcccgttgacgccagcgtgggtctggcgtggctggccgtagggagcatgtgtctctttattgccggttttgctgtgggctggggccctattccatggctgctcatgagcgaaatattcccctag

SEQ ID NO: 241133 - DNA, 831 bp, Artificial Sequence
  Description of Artificial Sequence: Synthetic coding sequence
cagctgatggtggtggttgggatcctgttggcttacctagcgggatgggtgctcgaatggcgctggctcgctgtacttggatgcgtccctccgtctctgatgcttctcctgatgtgcttcatgccagaaacaccaagattcctcctgacgcagcatcgccgtcaagaggcaatggccgcactgagattcctctggggtagcgagcaggggtgggaggaccccccaatcggggctgagcagtcttttcacctcgcattgctgagacagcccggtatctacaagcctttcataattggggtgtctttgatggcttttcagcagctgtcgggcgttaatgcagtgatgttttatgccgaaactatcttcgaggaggctaagtttaaggattcctctctcgctagcgtggttgtgggggtgatccaggtcctgttcacagcggtcgctgcactgatcatggaccgagctggcaggcgcctgctactggtcctgtctggggtcgtaatggtgttttccactagcgccttcggcgcttattttaaactgactcaggggggacccggtaactctagccacgttgccattagtgcccctgtcagcgcccaacctgtcgacgccagtgtgggcctggcatggctcgctgtgggctctatgtgtctgtttattgctggctttgcagtcggctgggggcctatcccttggctgctcatgtcggaaatctttcctttacacgtaaagggagttgctactgggatttgcgttctgaccaactggctgatggcgtttctggtgactaaggaattcagtagtctaatgctgctacttctcttatag

SEQ ID NO: 241134 - DNA, 726 bp, Artificial Sequence
  Description of Artificial Sequence: Synthetic coding sequence
atgacttgcagcctgggtaaagtctacatatctgaaatcgcgtaccctgcagtgcgcggactgctgggatcctgcgtgcagttaatggtcgtggtcggcatcctgctcgcatatctggccggttgggtgctggagtggcggtggctggccgtcctcggttgcgtcccacccagccttatgctgttgttaatgtgcttcatgccagagacacctagatttctgcttacccagcaccgacgacaggaagccatggcagccctgcggttcctttggggctctgagcaggggtgggaagatcctcccattggcgcagagcagcagctcagcggcgtcaatgcagtgatgttctatgccgaaacaattttcgaggaggccaagtttaaagactcatcattggcatccgtcgtggtcggggtaattcaggtcctgttcaccgccgttgccgctctgattatggatagggctggcaggagattactattggtattatccggagtcgtgatggtcttttccacctctgccttcggtgcctatttcaaattgacccagggcggacctggtaatagcagccacgttgccatctcagcccctgtgagcgctcagcccgtggacgcttctgtgggcctcgcatggctcgcggtgggcagtatgtgtctgttcattgccggatttgccgtcggatgggggcctattccatggctgctgatgagtgaaatcttcccttag

SEQ ID NO: 241135 - DNA, 798 bp, Artificial Sequence
  Description of Artificial Sequence: Synthetic coding sequence
atggtcgtcgtcggcatcctgttggcatacttggccggttgggtgctggagtggagatggctggccgtcctcggatgtgtgccccctagcttaatgctgctcttgatgtgctttatgcctgaaacaccaaggtttctgttaacccaacacaggaggcaggaagctatggccgcactgcgctttctgtggggatcagagcagggatgggaggaccccccaatcggagccgagcaatcttttcatctggccctccttcgtcagccagggatttataagccattcatcattggagtcagcctcatggctttccaacaactgtccggagtgaacgcagtgatgttctacgcagagacaatcttcgaggaggctaagttcaaggactccagcttagcctcagtggtggtgggcgtgatccaggtcttgttcactgccgtggcagccctgattatggaccgcgcaggaaggaggctcttgctggtgctgagtggagtggtgatggtctttagtacgtccgcctttggcgcatactttaaactgactcaggggggtccgggaaattcctctcatgtggctatcagtgccccagtcagcgcacagccagtcgatgccagtgtgggattggcttggctcgcagtaggcagtatgtgcctatttatcgctggcttcgccgttggctggggaccgatcccctggctgcttatgagtgaaatttttcccctgcacgtcaagggggtggccactggaatctgtgtcctgacaaattggctcatggctttcctcgtcacgaaggagttctag

SEQ ID NO: 241136 - DNA, 1623 bp, Artificial Sequence
  Description of Artificial Sequence: Synthetic coding sequence
atggctaggaaacagaacagaaatagcaaagagctgggtctcgtccctctcacggacgacacatcccacgcgggtcctcctggccctggcagggcattgctggaatgtgatcatcttcgctctggcgtaccagggggacgtagacgcaaagattggagttgttcactgcttgtggcgagtctggccggagccttcgggtctagctttttatacggctacaacctctcagtggtgaacgcacctactccttacattaaggctttttacaatgagagctgggagcgccgacatgggcgtccgattgatccagatacattgacactcctttggagcgtcaccgtgagcatattcgcaatcggaggcctggttgggactctgatagtgaagatgattgggaaagtcctaggccgaaagcatacactcctggccaataatggcttcgccatctcagcagcgctcctgatggcctgttccctgcaagcaggggcatttgagatgcttatcgtcgggcgattcattatgggaatcgacggcggagtggccctgtctgtgctcccaatgtacctgtctgaaatcagtcccaaggagatccgaggctccctaggacaggtgactgctatatttatctgcattggagtgtttacaggacagctgctcggcctccctgaactcctaggaaaggaaagtacctggccctacttatttggggtcatcgtcgtgcctgcagtggttcagctgctctcactgccatttctccccgattctccccgttacctgcttttagaaaaacacaatgaggccagagccgtcaaggcatttcagactttcctggggaaggccgacgtatcccaggaagtggaagaggtcctggcggagtccagagtgcagaggagcatccgcctggtcagcgtgcttgaactcttgcgagcaccgtatgtgcgttggcaggtggtcacagttatcgtgacaatggcgtgctaccaattatgcgggctgaatgccatctggttctatactaactccattttcgggaaagctggaatacccccagccaaaatcccatacgttaccctctccactggtggcattgaaacactagccgcagttttttcaggcctcgtcattgagcacctcggtagaagacctctactaattggcggattcggcctgatgggactcttttttggtaccctcaccattacactcaccctgcaggatcacgctccctgggtgccatacttatcaattgtgggaatcctagcaataattgcaagtttttgcagtggacccggaggtatcccatttatcctcactggagaattcttccagcaaagccaacgtcctgcagcttttatcatcgcagggactgtcaactggctgtccaattttgcagttggcttgctcttccctttcatccagaaatctctggacacttattgcttcctggttttcgcaactatctgcataacgggcgcaatttatctgtatttcgtgcttccagagaccaaaaatcgtacctatgccgagatttcccaagcattcagcaagcgcaacaaggcgtaccctcctgaagaaaagattgattccgcagtaaccgacggaaaaatcaatgggagaccctag

SEQ ID NO: 241137 - DNA, 1536 bp, Artificial Sequence
  Description of Artificial Sequence: Synthetic coding sequence
atgaaattgtccaagaaagatcgcggtgaggatgaggaaagtgattcagccaagaagaagctggactggagctgcagtctgctggtcgcgagtttggcaggagctttcggttccagcttcctttacggttacaatctgagtgtggttaacgcaccgaccccttatattaaagcattctataatgaatcatgggaaaggcgtcatggtcgaccgatcgacccagacacactgacactgctgtggagcgttacggtttccatctttgccatcgggggattagtgggaactttgatcgtgaaaatgattggcaaagtgttgggcaggaaacacacactgctggccaacaatggctttgcaatatctgctgcgctgctcatggcttgtagtttgcaggccggtgcgttcgagatgttgattgtcggccgtttcatcatgggtatcgatgggggagtggccctgagcgtgctccccatgtatctgagcgaaatttcgcctaaggaaattcggggttccctcggtcaggtcacagccatatttatttgtatcggagtgtttaccggacagttgctgggcctgcccgaactgctgggcaaagagagcacttggccttacctgtttggcgtgatcgtggtgcccgctgtcgtgcagctgctgtccctcccattcctccccgacagtcctcgctacctgctcctcgagaagcataatgaggcacgcgctgtgaaggcctttcagactttcctaggcaaggccgatgtaagccaggaagtggaagaagtgttagcggagtcgagggtccagaggtctattcgactggtctccgtccttgagctgctgcgagctccttatgttaggtggcaagtggtaacggtgatcgtcactatggcctgctatcagctgtgcgggctgaatgccatctggttttacaccaattccatctttggaaaggctgggatcccccctgccaagattccttacgtaaccctctctaccggcggaatcgaaaccctggcggctgtgttctccggcctagttattgaacacctgggcaggagacctttgctcatcggcggttttggcctgatgggcctattttttggtactctcacaattactctcacactccaagaccatgccccatgggtaccatacctctcgattgtggggattttggccatcatcgcctccttttgcagcggtcccggtggaatcccatttattctcacaggcgagtttttccagcagtcccaacggccagccgcttttattattgccggtaccgtgaactggctgtcaaatttcgccgtaggtctcctcttccccttcatacagaaatcccttgacacatactgttttctggtattcgccacaatttgtattaccggcgcaatatatctttatttcgtgctacctgaaaccaagaaccggacgtatgcagaaatttcccaggcttttagcaagcgaaataaagcttatcctccggaggagaaaattgactcagctgtgactgatggaaagatcaacggcaggccgtag

SEQ ID NO: 241138 - DNA, 1536 bp, Artificial Sequence
  Description of Artificial Sequence: Synthetic coding sequence
atgaagttaagtaaaaaggaccgcggtgaagacgaagaatctgactctgctaagaagaagctagactggtcttgcagtttactcgtggcgagtctggcaggggcatttggctccagctttctgtacgggtacaatttgtccgtcgttaacgctcccacaccttacatcaaagctttctataacgagtcttgggagagaagacacgggcgaccgatagaccccgatacactcactctcctttggtccgtgacagtttcaatctttgccattggaggtctcgtcggcacactgatcgtaaagatgatcgggaaggtcctaggcaggaagcacacattgctggcgaataacgggttcgcaatctccgcagctttacttatggcctgctccctgcaagctggagcattcgagatgcttattgtcggaagattcataatggggattgacggaggcgtagcattgagtgtgttacccatgtatctttctgagatcagtccgaaggaaatacggggatctttgggccaggtgactgccatcttcatctgtattggtgtttttacagggcagctgctcggcctgcccgaactcctgggaaaagagtccacctggccctatctctttggcgtcatagtggtgcctgctgtggtccagctcctgagtctgccattcttacctgattcaccaaggtatctccttttggaaaaacacaacgaggccagagcagtgaaagcgttccagacctttctgggaaaggccgatgtctcccaggaggttgaagaagtgctggccgaaagtagagtgcaacgctccatccgcctggtttccgtcctcgagctgctgagagccccttacgttcgctggcaggtggtgacagtcattgtcaccatggcctgttatcagctgtgcggactaaacgccatttggttctatacgaattcaattttcggcaaagccggaatcccaccggctaagataccttacgtgactctgtccacgggaggcatcgagaccctcgcggctgtgttctccggtctggtgatcgaacatttaggaaggagaccactgttgatcggcggattcggtctgatgggcctgttctttggaacattgacaatcaccctgaccctccaggaccatgccccttgggtgccatacctgtccattgttggaattctcgccataattgcatcattttgcagtggtccgggaggcatccctttcatacttactggcgagttcttccagcaaagccagagacctgctgcttttattattgctggcacagttaattggctcagcaactttgcggtggggctcttgttcccattcattcagaaatccctcgacacgtactgctttctggtgttcgcaacgatatgtataactggcgctatatatctgtatttcgtgcttcctgagacaaagaatcgtacctacgcagaaattagtcaggcgttctccaagcggaacaaagcatatcctccagaggagaagattgattccgccgtgaccgatggcaagatcaatggccgtccatag

SEQ ID NO: 241139 - DNA, 597 bp, Artificial Sequence
  Description of Artificial Sequence: Synthetic coding sequence
atgaaactttcaaaaaaggacaggggtgaggatgaggaatctgattccgctaagaaaaaactggactggtcatgctctctgcttgtcgccagcttggcgggagcttttggtagctcctttctgtacggctataacttaagcgtggttaacgcgccaacaccatacattaaggccttctacaatgaatcatgggagcggaggcatggtcgacccatagacccggatacactgacgctcctgtggtctgtgactgtaagtatatttgcaattggcggactggtgggcacactaattgtgaagatgatcggaaaggtccttggaagaaagcacacccttctcgcgaacaacggatttgccattagtgctgctctactgatggcttgtagtcttcaggccggagcgtttgagatgctaattgtggggagattcataatgggcatcgacggaggggtggctctgtctgtgctgcccatgtacctgtcagaaataagcccaaaggagatccgcggttcgctcgggcaggtcaccgctattttcatctgtattggcgtgtttacaggacaattgctgggtttacccgaactgctgggcaagtag

SEQ ID NO: 241140 - DNA, 735 bp, Artificial Sequence
  Description of Artificial Sequence: Synthetic coding sequence
atggaacagcaggatcagtcaatgaaagaaggtcggcttaccctcgtgctggcgttggcaaccctgattgctgcgttcggctcctccttccaatatggatacaacgttgctgccgtcaacagtcctgctctgcttatgcagcagttctataacgagacctactatggtagaacaggcgaattcatggaagacttccccttgaccctgttatggagcgtgaccgtgagcatgttcccattcgggggttttataggcagtctgttggttggccctttggtcaacaagttcggcaggaaaggtgccctgctgttcaataacatattttctattgtgccagctattctcatgggctgctctagagtggcaacctcttttgagttaataatcattagcaggctgctggtcgggatttgtgctggcgtatccagtaacgtcgtgccaatgtacctgggcgagctcgccccaaagaacttaagaggggctctgggcgttgtccctcagctctttattacagtggggatcctagttgcacagatcttcgggcttaggaatctcctagccaatgtggatggcgagtttcggacttctcgcgagcacccccatcccttcacaaccaccctcggcccactcctggtcttccaaagtcatcaccaccggacaggtttgtccgctgactggagtctgctgaccgggtggatgtcactcggaggtccgtcttgtcccgagcccacctag

SEQ ID NO: 241141 - DNA, 1506 bp, Artificial Sequence
  Description of Artificial Sequence: Synthetic coding sequence
atggagcagcaggatcaaagcatgaaagaagggcgtttgactctggtgctggcgctcgcgaccctaattgccgctttcggctctagtttccagtacggttataacgttgctgccgtcaattcgccagccctcctaatgcaacaattctacaacgagacctactacggcaggacaggggagttcatggaggatttccccctaacactattgtggtcagtgactgtgtccatgttcccgtttggcggattcatcgggtccctcctggtgggtcccttggtcaacaagttcggaagaaagggtgccctcctgttcaacaacatcttttcaatcgtgccagccatactgatgggatgcagtagagtggctacctccttcgaacttataataattagcaggcttcttgtgggcatctgtgccggagtttctagtaatgtggtccccatgtatctgggcgagctagccccaaagaacttgcgaggagccctgggagtggttccgcagctgttcataaccgtgggcattcttgtggcccagatctttggcctgcgaaacctgcttgcaaatgtggatggatggcctatattgttagggctgacaggggtccctgccgctcttcagctcttgctcctgccatttttccctgaaagccctcggtacctgcttatacagaagaaggatgaagctgcagccaaaaaggcacttcagacattacgaggttgggatagcgttgaccgggaggtagcagagatacgacaggaggatgaagccgagaaagcggctggctttatctcggttttgaaactcttccgcatgaggtcgcttcgctggcagctgttgtctattatcgttctgatgggaggtcagcaactgtctggtgtaaacgcaatttactactatgccgaccagatctacctatctgccggagttcctgaggaacacgtccagtacgtgacagccggaaccggagccgtgaacgttgtgatgacattttgcgcagtgtttgtcgttgaattgctcgggagaagactgctgcttttactgggcttcagtatctgcctgatcgcatgttgtgtcctcacggcggctttggcgcttcaggatacagtatcatggatgccatacatttcaatcgtatgcgtcatctcttacgtaataggccacgctcttggtcctagtcccattcccgctctgctgattaccgagatctttctgcagagctcccgcccaagcgcgttcatggtggggggaagcgtgcattggcttagcaattttaccgtcggtctgatctttccatttattcaggaaggactggggccatattcattcatcgtgtttgctgtgatatgcctgctgaccaccatatacatcttcctgattgtgcctgagaccaaagccaagacctttattgagatcaatcagatctttaccaagatgaataaggtttccgaggtttatcctgaaaaggaggagctgaaggaacttccccctgtgacctcggagcagtag

SEQ ID NO: 241142 - DNA, 1455 bp, Artificial Sequence
  Description of Artificial Sequence: Synthetic coding sequence
atggagcagcaagatcagtcaatgaaagaggggaggctcaccttggtgttggctctggccgcagtgaattcacccgctctgctgatgcaacagttctacaatgagacgtattacggacgcactggagaatttatggaagactttccacttactctgctgtggtcagtgacagtatctatgttccctttcggcggttttataggaagtctcttagtcggtcctctggtcaataaattcggaagaaagggcgctctcttgttcaacaacatctttagtatcgttccagccattctgatggggtgctcaagagtcgcaacatctttcgagctgataatcattagcaggctgctggtcggcatttgtgccggtgtgtcatctaacgtcgtgccaatgtacctgggggaactagccccaaagaatctgaggggcgcattaggcgttgtccctcagttgttcattacagtgggaattctagtcgcccagatctttggcctgagaaacctcctggcaaacgttgacgggtggccaatactgctgggattgactggcgtgccggctgctcttcagcttctcctcttgccattcttccccgaatcccctagatatctgctaatccaaaagaaggatgaggccgcagcaaaaaaggccctgcaaactttgcggggatgggactctgttgatcgcgaagttgccgagatacgccaggaggacgaggcagagaaagctgccggattcatctcagtcttaaaattattccgaatgcgctctctgcgttggcagctgctgagcattatcgtactgatgggaggacagcagctctccggggtgaatgcgatctactattacgcggaccagatctacctctcagccggtgtgccagaggagcacgtgcaatatgttaccgcgggtacgggagctgttaacgttgtgatgacattttgtgccgtgttcgtcgttgaattgctgggcagaaggctgttgctgctactgggtttttccatttgtcttattgcctgttgcgtactaacagccgctttggccttacaagacaccgttagttggatgccctacatttctattgtatgtgtaataagctatgtcattggtcacgccctgggcccttcacccatccctgccctcctgattaccgagattttcctacaatcctcccggcctagtgcctttatggtggggggatcagtccactggctaagcaactttaccgtgggtctaatttttccttttatccaggaagggctaggaccgtatagcttcattgttttcgccgtcatttgtctgcttaccaccatttatatttttcttatcgtgccagagacaaaagccaagacttttatcgaaattaaccaaattttcactaaaatgaataaagtgtccgaggtgtatcccgagaaggaagagctcaaagagttaccccctgtgacaagcgaacagtag

SEQ ID NO: 241143 - DNA, 1161 bp, Artificial Sequence
  Description of Artificial Sequence: Synthetic coding sequence
atgggatgtagcagggtggccacgtcattcgaactaatcataatatctcggcttctggtggggatctgtgccggagtgagctctaatgtggtgcctatgtatctgggggagctggccccaaagaatctcaggggcgctctgggcgtggtcccacagctgtttatcacagtgggtatcctggtagctcagattttcggtctgcggaatctgctagctaacgtcgatggttggcctatcctcctggggcttacaggcgttccagcagccctgcagctgctgctacttccgtttttccccgagtcaccacggtacctcttgattcaaaaaaaagatgaggcggctgccaagaaagctctacaaacccttaggggctgggattccgtggatagagaggtggcagaaattaggcaggaggatgaggcagaaaaggctgcaggcttcatttctgtgcttaaactgttccgcatgcgcagccttcgttggcagttgctgtccattatcgtgctgatggggggacaacagctgtctggcgtgaacgccatttactattacgcggatcagatttatctatcagcaggtgtccctgaagagcacgtccagtacgtgacagccggaacaggggctgttaacgttgtgatgacgttctgtgcggtatttgtagtggagctcctcggaaggcggctgttgctcttattagggttctccatttgcttaatagcctgctgcgtcctgacagctgctctcgctttacaggatactgtgtcatggatgccttacattagcattgtgtgcgtcatctcctacgtgattggccacgcactcgggccatctcctattcctgcccttctcattactgagatcttcttgcaaagcagcagaccatccgcattcatggtcggcggaagtgtacactggctctccaattttacagtaggcctaatcttcccctttattcaggagggcttaggtccttacagcttcatcgtctttgctgtcatttgtttgctcacaactatctacatatttctaatagttcccgagacaaaagcaaaaactttcatcgaaatcaaccaaatctttaccaaaatgaacaaagtgtctgaagtgtaccccgaaaaagaggagctgaaggaactccccccagtaacctcagaacagtag

SEQ ID NO: 241144 - DNA, 1329 bp, Artificial Sequence
  Description of Artificial Sequence: Synthetic coding sequence
atgctggaactgcacagtcttactgccagtagtatcatgcgcgtactgatcatgcgcgcacctctgagagaggctccaccagagaaattcgccctgctgctgtcagggtcccccggaaaaggcgcactgctattcaataatatattctcgattgtaccagctatcctcatgggatgtagccgggttgcaacgagcttcgaattaattattatatctcgcttgttggtgggcatttgtgcaggtgtgtcctccaatgtcgttccaatgtatctgggcgagctggcacctaagaatctcagaggtgcattaggagtagtcccgcagctgtttattaccgtgggcattcttgtcgcacagattttcggcctccgaaacctactggcgaacgtggatggatggccaatcttactcggacttaccggtgtgcccgctgctttgcagcttttgctgttgccttttttcccagagtcaccacggtacctgctaatccaaaaaaaggatgaggccgcagctaagaaagccttgcagactcttcgcggttgggacagcgtcgatcgcgaggtagcagagatccggcaagaggacgaggcagaaaaagctgcgggatttatttcagttctgaagctgtttcggatgaggtctctccggtggcagctgctctctatcatagtgcttatgggcggtcagcaactgtctggagttaacgccatctattattacgctgaccagatttacttgagcgcaggagtgccagaagagcacgtgcaatacgtcaccgcaggcactggtgccgtaaatgtcgtgatgacattttgcgctgtcttcgtggtcgaattgctgggacggcgtttgctcctcctcctgggattctctatctgcttaattgcttgttgtgtccttacagctgcgttagctttacaggacactgtgagctggatgccgtacatttccatcgtttgcgtgattagctacgtcatcggtcatgctctaggcccatctcccatacctgccctgcttatcactgagatcttcctgcagagcagtaggcccagcgccttcatggttggcggtagtgtgcactggctctcgaacttcaccgtgggcttgatcttccccttcatacaagaaggtctgggaccctattcctttattgtctttgctgtgatatgcctgttgactaccatttacattttcctcattgttcccgagactaaggcgaaaacttttatcgagattaatcaaatcttcacaaagatgaacaaagtgagcgaggtgtatcctgaaaaagaggagctcaaagaactgccccctgttactagtgagcaatag

SEQ ID NO: 241145 - DNA, 2040 bp, Artificial Sequence
  Description of Artificial Sequence: Synthetic coding sequence
atggcaactctcattactagcacaacagctgccaccgcagcatctggaccactggtggattacttgtggatgctcattttggggttcattatcgccttcgtattggccttctctgttggagctaacgacgttgccaacagctttggcacggctgtaggcagcggagtcgtgacgctgaaacaggcttgcattctggcctccatcttcgagaccgttgggtcagtccttctaggggctaaagttagtgagaccattagaaagggactcatcgatgttgagatgtataattctacacagggtttgctgatggcgggatccgtgtctgccatgttcggatctgctgtgtggcagctcgtggcctcgttcctcaaactgcctatcagcgggacacactgcatcgtgggggctaccattggattttcacttgtcgcgaaaggccaagaaggcgttaagtggagtgaactcatcaaaatcgtaatgtcctggtttgtaagcccacttctgagcggcataatgtccggcatactctttttcctggtgagagcatttatattgcacaaagccgaccccgtgccaaacggcctcagagcactacccgtcttttatgcatgtacagtgggtataaatctttttagtatcatgtacactggcgctcccctactgggtttcgataagctacctctgtgggggacgattctcatttcagtcggatgtgcagtgttttgcgctcttatcgtgtggttcttcgtttgccctcggatgaaacgcaagatcgaaagggaaatcaaatgctcaccgagcgaatctcctttaatggaaaaaaaaaactcgttgaaggaggatcatgaggaaaccaagttgtctgtgggagacatagagaataagcatcctgtgtctgaggtgggcccagccaccgtaccgttgcaggcagtggtcgaagagaggacagtgtcatttaagttgggggatctggaggaagcacccgagcgagagagactgcccagcgtcgacctcaaggaggaaacatccattgattccaccgtgaatggagccgtgcaattaccaaatggtaacctcgttcagttttcccaggccgtttcaaatcagataaattcttcggggcactatcagtaccacaccgttcacaaggattccggcctctacaaagagctcctgcataaactccatttggcaaaggtgggcgactgcatgggagactcgggcgacaaaccattgcgtagaaacaacagttacacgtcttacactatggcaatctgcggaatgccgctggactcctttcgggcaaaagagggtgagcagaagggagaagaaatggagaagctaacgtggccgaacgccgactcgaagaagcggattcggatggattcatacacgtcatactgcaatgctgtgagtgacctgcactccgcgagtgagatcgacatgtcagtgaaagccgaaatgggcttgggcgaccggaaaggaagcaatgggtctctcgaagaatggtatgatcaggacaagcccgaggtgtcccttctctttcagtttctacaaattttgacagcctgctttggttcattcgctcatggcggaaatgacgtgagtaatgccataggcccattagttgcactctatctagtttacgacacaggggatgtgtcgagcaaagtcgccacccccatttggctcctgctgtatggaggggtggggatttgtgtgggcttgtgggtgtggggtcggagagtgatccagacaatgggtaaggatctcaccccaattaccccctccagcggcttctccatcgagctggccagtgccctgacagttgtaatcgccagtaatataggactcccaattagtaccacgcactgtaaagtggggtcagtggtctcagtaggctggctgcgcagcaagaaggccgtggattggcgtctgttcaggaacatcttcatggcttggttcgtgacagtccctatttccggggtgatttctgctgccatcatggctatttttcggtacgttattctcaggatgtag

SEQ ID NO: 241146 - DNA, 1137 bp, Artificial Sequence
  Description of Artificial Sequence: Synthetic coding sequence
atggggaacccatctgtgcctagaggaggttttacccaatactgtcggggactccttccttggggctttcaggatgccccattttatctcctggtcctcggattcgacaagttgcctctgtggggcaccatattgatctcggtcggatgcgccgtcttctgtgcactgattgtgtggttctttgtgtgtcctcgaatgaagcgtaaaattgaacgtgaaattaagtgtagcccatcagaatccccgctcatggagaagaaaaattccctcaaggaggatcatgaagagaccaaactgagcgtaggggatatagaaaataaacatccggtaagcgaagtgggccctgctaccgtcccccttcaggctgttgtggaggagcgcacagtctcattcaaattgggggacttggaggaagcgccagaacgtgagagactgccctccgtggatctgaaggaggagacttccatcgattctactgttaacggggctgtgcagctccctaatggaaacttagtgcagttctcccaggctgtgtctaatcagataaatagtagtgggcattaccagtaccatactgtccacaaagactctggcctttataaggagctcttgcacaaattacatcttgcaaaagtcggtgactgcatgggtgatagtggagataagccactgcgtagaaacaattcctatactagttacacgatggccatctgcggcatgccccttgacagtttccgagccaaggaaggcgaacaaaagggcgaggagatggagaagttgacatggcccaacgcagactccaagaagcgtatccgcatggacagttacacttcctattgcaatgccgtgtcagaccttcacagcgcgtctgaaatcgatatgtccgtcaaggccgagatggggctcggggatagaaaaggctcaaacggttcgttagaagagtggtacgatcaggacaagccagaagtaagtctcctgtttcaatttctccagattctgaccgcctgtttcggctcttttgcgcacggcggaaatgacgtaagcaatgcaataggcccactcgtcgcattgtacctggtgtacgatacaggcgacgtaagcagcaaggtagccacgcctatctggctgttatgttag

SEQ ID NO: 241147 - DNA, 1959 bp, Artificial Sequence
  Description of Artificial Sequence: Synthetic coding sequence
atggccatggacgagtatctgtggatggtcattctgggttttattattgccttcattcttgcattttcggttggcgcaaatgatgtggcaaattcttttgggacagctgtgggttcaggtgtggtcacgcttcggcaggcttgcatcctggcatctatttttgagactacaggcagtgtcctccttggcgcaaaggtgggtgaaacaatccgcaaggggataatcgatgttaacctgtataatgagactgtagagactctgatggctggggaagttagtgcgatggtgggcagcgccgtttggcagctgatagccagtttcctgcgactgccaatatctgggacccactgcattgtaggaagtaccattgggttcagcctggtggccatcggcacaaaaggtgttcagtggatggagctggtcaaaattgtggccagctggttcatttccccacttctgtcaggtttcatgagcggactccttttcgtactcattcgcatctttatcttgaagaaagaggacccagtgccaaacggtctgcgagccctgccagtgttctatgccgctaccattgctataaacgtcttctccatcatgtacaccggggcacctgtgctgggcctggttctgcccatgtgggctatcgctctcattagttttggcgtggccctgctgtttgcctttttcgtgtggttgtttgtctgtccatggatgcgaaggaaaattaccgggaaactacagaaggaaggggctctgagcagggtcagtgatgagtctctttctaaagtgcaagaagccgaatcccccgtgtttaaagagctgccaggtgccaaggcgaatgacgacagcaccatcccactcacaggcgctgctggggaaactcttggcacgagcgagggcacaagcgctggaagtcacccaagggccgcatacgggagggcactgtctatgactcatggttctgtcaagagtcccatctcgaacggcacctttgggttcgatggtcatacccgtagcgacggccatgtgtaccacactgtgcacaaagatagcggcttgtacaaggacctgctgcataaaatccacatagaccgcggacctgaggaaaaacccgctcaggaatccaactacaggctgctgcggaggaataattcttacacttgttacacagctgctatttgcgggctgcccgtccatgcgacctttagggctgcggactcatccgccccagaggatagcgagaagcttgtaggtgatacagtctcatactcaaaaaaacgtctgcggtatgatagctacagtagttactgcaacgcagtcgcagaggctgagattgaggctgaggagggaggagtggagatgaagctggccagcgaactggcggacccagaccagcctcgggaagaccctgcagaagaggagaaagaggaaaaagatgcgccagaggtgcacctcctgttccattttctccaggtactaacagcttgtttcggctcatttgctcatggcggaaacgacgtgtctaacgctataggacctctcgtcgccctgtggctgatttataagcagggaggggttactcaagaagccgctacccccgtgtggctccttttttatgggggagtgggcatctgcacaggcctctgggtgtgggggagaagagtgattcagacaatgggtaaggatttaacccctattacgccatcctcaggctttaccatcgaacttgcatccgccttcacggtggtcatcgctagcaacataggactacccgtttctactacccactgcaaagtgggttccgtcgtggcagtgggctggattcggagccgaaaagcagtcgactggagactcttcagaaatatctttgtggcttggtttgttacggtgcctgttgccggtttgttttccgctgcagtgatggctctgttaatgtatggaatcttgccttacgtgtag

SEQ ID NO: 241148 - DNA, 216 bp, Artificial Sequence
  Description of Artificial Sequence: Synthetic coding sequence
atggcgatggacgaatatctttggatggtgatcctggggtttattatcgccttcattctggccttcagcgttggggctaacgatgttgcaaatagcttcggaactgcagtaggctctggggttgtgactcttcggcaggcgtgcatactggccagtatctttgaaacaaccggctccgtgctgttgggcgctaaagtaggggagacaattaggtag

SEQ ID NO: 241149 - DNA, 87 bp, Artificial Sequence
  Description of Artificial Sequence: Synthetic coding sequence
atggcgatggacgaatatttatggatggtcatccttggctttatcatcgcttttattctggcattctcagtaggggcaaatgattag

SEQ ID NO: 241150 - DNA, 237 bp, Artificial Sequence
  Description of Artificial Sequence: Synthetic coding sequence
atggcgatggacgagtacttatggatggtgatcttaggcttcatcattgcctttatcctggcttttagcgttggggcaaatgacgtggccaatagtttcggaaccgctgtggggtcaggtgtggtgaccctgaggcaggcctgcatcctggccagcattttcgagacaactggaagcgtgttgctgggtgccaaagtcggcgagacaatccggaaaggcattattgatgttaactag

SEQ ID NO: 241151 - DNA, 1959 bp, Artificial Sequence
  Description of Artificial Sequence: Synthetic coding sequence
atggccatggatgagtacctgtggatggttattctgggcttcatcatcgcttttatcctggccttctccgttggagccaatgacgtagccaattccttcggaacagccgtcggctccggcgtggttactctgcgccaggcctgtatcttagcgtccatttttgagacaacaggatcggtgctgctgggcgctaaggtgggcgagaccattagaaagggtatcatcgatgtaaacctctacaacgagacagtggaaactttaatggctggagaagtctctgcaatggtgggctccgccgtgtggcaactgattgcttccttcctccgactccccatctcagggactcattgtattgtgggatccaccatcggattctccctcgtggccattggcactaagggtgtgcagtggatggaactggtgaaaattgtggcttcctggtttatctcccccctgctctcaggtttcatgtctgggcttctgttcgttctcatcagaatttttatactcaagaaagaggacccagtccccaacggcctccgcgctctgcccgtattttacgccgctaccatcgccatcaacgtgttctctattatgtacactggggctcccgttttaggcctcgtcctcccgatgtgggctatcgccctgatctcattcggcgtggctctcctctttgccttcttcgtgtggttgttcgtgtgtccttggatgaggaggaaaattactgggaagcttcagaaagaaggcgcactcagtagggtgtctgacgagtctttgtctaaggtgcaagaggccgagtctcctgtgtttaaagagctccccggagcaaaggccaacgatgattctaccatacccctgacaggcgcagccggagaaacactgggcacatcagaaggcacgtcagcagggtctcacccgagggccgcttatggacgggcactgtccatgacgcacgggtctgtcaagtctccgatttccaacggtacctttggatttgatgggcatacgcgcagtgacggccacgtttatcatacagtccacaaggatagcgggctgtacaaggatctccttcataagatccacatcgaccgcggaccagaggagaaacccgcacaggaaagcaactacagactcctgagacggaataatagctatacgtgttacactgccgcaatttgtggacttccagtgcacgcaacatttcgcgctgcggattcgtccgcacctgaggattcggagaaattggtgggcgacacagtcagttatagcaaaaaaagactccgatatgatagttactcttcttactgcaatgccgtggcagaagccgagatcgaggcggaggaaggcggtgtcgagatgaagctggccagcgagctggccgatccggaccagcccagagaggatccagccgaggaagagaaagaggagaaagacgccccagaggtccacctcctgtttcattttctccaggtgctgacagcatgcttcggaagcttcgcgcacggtggaaatgacgtgtctaatgcaatcggtcccctcgtggctttgtggttaatatacaaacaagggggtgtgacacaagaagccgctacacccgtgtggctattgttttacgggggtgtgggcatctgcaccggcctgtgggtgtggggcaggagggtgatccagactatggggaaagacttgactcccataactccctccagcggttttacgatcgagctcgcttctgcattcaccgtagtcatcgcctcgaatattggcctccccgtgtcaaccactcattgcaaagtcgggtctgtcgtggccgtagggtggatacgcagtcgtaaagctgtagactggcgcttgtttcgaaatatctttgtggcctggttcgtgaccgtccccgtcgctggcctcttcagcgcggcagttatggccctgctgatgtacggcattctcccttacgtctag

SEQ ID NO: 241152 - DNA, 1959 bp, Artificial Sequence
  Description of Artificial Sequence: Synthetic coding sequence
atggcgatggatgagtacctgtggatggtgatcctcggtttcataattgccttcattctggcttttagcgtcggggctaatgacgtggccaatagtttcggcaccgccgttggctccggcgtggtcaccctgcgccaggcttgcatactggcctctatttttgagacgacaggctcagtgttgctgggcgctaaggtaggggagactattcggaaggggataatcgacgttaacttgtacaacgagaccgtggagactctcatggcaggggaggtgtccgcgatggttggaagcgcagtgtggcagctgatcgcttcttttctgaggctacccattagcggaactcattgcatcgtgggtagcactattgggttctcgctggtggccattggcaccaagggcgtgcagtggatggagctcgtcaaaattgtggcatcttggttcatttctccactgctttccggctttatgagtggcctgttgtttgttcttataaggatctttatcctcaagaaggaagatccagtacccaacggcctgagggccttgcctgttttctacgcagcgactattgctatcaacgtgttttcaatcatgtacaccggggctcccgttttgggcctggtactgcctatgtgggcgatcgctctgattagctttggcgttgcactactcttcgccttcttcgtttggctgttcgtttgtccttggatgcgcaggaaaattacagggaagctgcagaaagagggtgcattgagtcgcgtgtccgacgagagtttatcgaaagtacaggaggccgagagtccggtgtttaaagagctccctggggcaaaagctaacgacgacagcaccattcccctaaccggtgcggcaggagaaaccttgggaactagcgaggggacctcagccggaagccaccctagagctgcctacggccgtgcgttgtctatgacacacggtagcgtgaaaagccctatcagtaacggcacattcggattcgacgggcacacccgatcggacgggcatgtttaccacaccgttcataaggatagcggtctatataaagatctgctgcacaagatccacattgaccggggtcccgaggagaagccagcacaagaaagcaactatcggctgctgcgacgcaataactcatatacgtgctacacagcagccatttgcgggcttcccgtccacgctacgtttagagctgccgatagctcagccccagaggatagcgaaaagctggtcggagataccgttagttacagcaagaagcgccttagatatgacagttactcctcatattgtaatgcggtagccgaggcagagatcgaagcagaggaaggtggcgttgaaatgaaactggctagtgaactcgctgatcccgaccaacctcgggaagaccccgctgaggaagagaaggaggagaaggatgccccagaggtccacctcttgttccacttcctccaagttctaacagcgtgttttggcagcttcgctcacggcggaaacgatgtttctaatgcgatcggacctctggtggcactgtggctgatttataagcaggggggagtcacacaagaagctgcaaccccagtgtggctgttgttttatggcggagtggggatttgcaccggcttatgggtttggggacgtcgggtcatccaaacaatggggaaggatctgactcccattaccccctctagcggattcaccatcgagctggcctctgccttcaccgttgtgattgcatccaatattggtctgcctgtgtcaaccactcactgcaaagtcgggagtgtcgtggcagtagggtggattcgttccaggaaggccgtcgactggaggctgttcaggaacatttttgttgcatggttcgtcactgtgccggtggccggactgttctccgctgctgtaatggccctccttatgtacggcatcctaccttatgtgtag

SEQ ID NO: 241153 - DNA, 144 bp, Artificial Sequence
  Description of Artificial Sequence: Synthetic coding sequence
atggccatggatgaatatctctggatggtgatcctgggctttatcatagcattcatccttgccttttctgtgggagccaacgatgtcgctaactcttttggaaccgcagttgggagtggcgtcgtgactctcagacaggcatag

SEQ ID NO: 241154 - DNA, 1260 bp, Artificial Sequence
  Description of Artificial Sequence: Synthetic coding sequence
atggcccagtctatctttatggccggtatactgatcggcggtctggtgttgggcgacctaagtgaccgattcggacggaggccaatactgacttgttcatacctcttactagccgcttccgggtcaggcgctgcgttctcccctacattcccgatatacatggtctttaggtttctttgcggcttcggcatctctgggattaccctttccaccgtcattctaaatgtagagtgggtacctacgcgtatgcgggctattatgtctaccgcgctcggatactgctacacttttggtcagttcattctgcccggtctagcttacgcaatccctcaatggcgttggttgcagctcaccgtctccatccccttctttgttttctttctgtcttcctggtggaccccagaaagcattagatggcttgttctgtctggcaaaagcagtaaggctcttaaaatacttcgtcgcgtggccgtcttcaatgggaagaaggaggagggcgagcgcctgtctttggaagagctaaagttgaatctccaaaaggagatctctctggccaaggcaaagtacaccgcctctgacctgtttcggatccctatgctgaggaggatgacattttgtctttcactggcttggttcgccaccggcttcgcatattattcactggctatgggggtggaggagtttggtgtgaacctgtacatactgcaaatcatcttcggcggtgtggatgtgcctgcgaaattcatcacaattctatccttgtcctacctaggccgtcatactacacaggctgctgccctattgcttgcagggggagccattttggctcttactttcgtgcctctggatctccaaacggtgaggacagtcttggccgttttcggtaagggatgtctgtcctcctctttttcctgcctgtttctgtatacatctgagctttaccctacagtcatccgtcagacgggcatgggcgtatccaacctgtggacgcgagtgggtagcatggtctccccattggtgaaaatcactggagaggtacagccttttattccgaacattatttacggaatcacagcccttttgggagggtccgccgcactgttcctgcctgagacccttaaccaacccttaccggagactatcgaggatctcgaaaattggagcttgcgggcaaagaagcctaaacaagagccagaagtggaaaaagccagccaaagaattcccctccagccccacggtcccggactggggtcttcttag

SEQ ID NO: 241155 - DNA, 1356 bp, Artificial Sequence
  Description of Artificial Sequence: Synthetic coding sequence
atggaaccttgtttagacggttgggtttataacagtacgaaagatagtatagttactgaatgggacctagtgtgtaacagcaataaactgaaagaaatggctcagagcatttttatggcaggcatcctaattggtggcctcgtgctgggcgatctcagcgaccggtttggacgcagacccatacttacctgcagttaccttctgctggcggcttccggatctggcgctgcgtttagccccacgttcccgatttatatggtgttccgattcctgtgcggattcggaatctcggggattaccctctcaaccgttatcctgaacgtggagtgggtccccactcgcatgcgtgcaattatgagcacagccttaggatactgttacactttcgggcagttcattctgcctggcttagcatacgccattccccagtggaggtggctgcagctgactgtcagcatccctttcttcgtgttcttcttgtccagttggtggacgcccgagagtatcaggtggctggttctctcaggaaaatcttcaaaggccttgaagattcttaggcgtgtggcggtgttcaacggcaagaaggaggaaggcgagcggctgagcttggaagaattaaaacttaacctacagaaggaaattagtctggcaaaggctaagtacactgctagcgatttgtttaggataccaatgctacggcgaatgaccttctgcctaagcctggcctggttcgctaccgggtttgcgtactactctctggctatgggagtcgaggagttcggcgtgaacctgtacatcttgcagatcatttttggtggcgttgatgtgcctgcaaaattcataaccatcctgtcactgagctatctgggtcgccacactactcaagcagccgctctcctgttagccggtggtgcgattctggctctgacctttgttccactggatctccagacagtgcgcactgtcctggccgtgttcggcaagggctgcttgagcagctcattcagctgtctgtttctgtacaccagtgagctgtatcccaccgtcatccgccaaactggtatgggtgtgagtaacctttggactagggtcgggagtatggtctccccgcttgttaagattactggagaagttcaacccttcataccaaacattatttacgggattaccgctctgctgggcggttcggctgcactctttcttccagagaccttaaaccagccattacccgagacaattgaagatctggagaattggtctctgcgggcaaagaagccaaaacaggagcccgaggttgagaaagcgagtcaacggattccgctgcagccacacggcccagggctgggatccagctag

SEQ ID NO: 241156 - DNA, 1653 bp, Artificial Sequence
  Description of Artificial Sequence: Synthetic coding sequence
atggctttcaacgacctcctgcagcaggtgggaggggtgggaaggttccagcaaatccaggtaaccctcgtcgtattaccccttctgctgatggccagccacaatacattacagaattttaccgccgcaataccaacccatcactgccgacctcccgcagacgccaatctgagcaagaacggcggactcgaagtgtggctgcctcgggacaggcaggggcaaccggaatcttgtttgcgcttcacttccccacagtgggggctcccgttcttaaatggcacagaggcgaacggcacaggagcgaccgaaccttgcaccgacggctggatctatgacaacagtacgtttccgagcaccattgtaacagaatgggatctcgtgtgcagccacagggccttacgccaattggcgcagagcctctatatggtcggggtcctgctgggggctatggtgtttggatatctggccgacaggctaggtcgtagaaaggttctgatcctcaactatttacaaactgctgtgagtggcacctgtgccgcattcgcaccaaacttccccatctactgcgcatttaggctgctcagcgggatggcgctggcgggaatctcccttaactgcatgacattgaatgtggaatggatgcctatccacacgagagcttgcgtggggaccctcatagggtacgtgtattccctcggtcagttcctacttgccggtgtggcctacgcggtgccccactggcgacacctccagctgctggtgagtgctccatttttcgcatttttcatatattcctggttcttcatcgaatcagcaaggtggcactcatcctcagggcgacttgatttgaccctgagggctctacaaagggttgctaggatcaacggaaaaagagaagaaggggctaagctttctatggaagtcttgcgggcttccctgcaaaaggagcttacaatgggaaagggacaggcttccgctatggagctattgaggtgtcctaccttgagacacctgtttctgtgcctgtctatgttatggtttgccaccagcttcgcatattatgggctggttatggacttgcagggattcggtgtgtccatttaccttattcaagtgatttttggcgctgtggatctcccggcaaagcttgtgggtttcctggtgatcaattctctaggcagaagaccggctcagatggccgctttgctactcgcagggatatgtattctcctgaacggcgtcattccacaggatcagtccattgtgaggacttcacttgcagtcctaggcaagggctgtttggccgcaagctttaattgtatatttttatatacaggggagttgtaccccaccatgatccgccagaccggcatgggcatgggcagtaccatggcccgtgtggggagtatagtgagccctctggtctcaatgaccgccgagctgtatcctagcatgccactatttatatacggagcagtgccagtggcagccagcgccgtgactgtgctcctaccggaaacactggggcaacccctccctgacacagtgcaggacctggagtccagaaaggggaagcagactagacaacagcaagaacatcagaaatatatggtgcccttgcaggcatcggcgcaagagaagaacggtctgtag

SEQ ID NO: 241157 - DNA, 1692 bp, Artificial Sequence
  Description of Artificial Sequence: Synthetic coding sequence
atggcgtttaacgacctactgcagcaggtggggggagtgggcagatttcagcaaatccaggtgacactagtggtgctgcctctcctgcttatggcttcccataatacactccagaatttcaccgccgcaattcccactcaccactgtagacccccagcggacgcgaatctcagcaagaacggaggactggaagtgtggttgccacgcgacagacaggggcagcctgagagttgcttgcgcttcacctcacctcagtggggcttgcccttcctgaacggtactgaggctaacgggaccggggcaacagaaccctgtactgacggatggatttatgataattctacattccccagtaccatcgtcacggagtgggatctggtgtgtagccatcgagccttgcgacagttagctcagagtctttatatggtaggcgtcctactcggggctatggtcttcggttacctggccgatcggctgggcaggcgcaaggtgctcattctgaattacctccagacagctgtgagcgggacctgcgccgcatttgcaccaaatttcccaatctactgtgcctttcggttgctgagcggaatggctctagcgggaatctccctaaattgtatgactttgaatgtggagtggatgcctatacatactcgcgcatgtgtaggaaccctcatcgggtacgtgtactccctggggcaatttttgttagcgggagtggcttatgcagtacctcactggcggcacctgcaactgctggtatcggctcccttctttgcatttttcatatattcctggtttttcattgagtccgcccgatggcatagcagctcaggaaggctagacctcactctgcgcgcactgcagagggtcgcgagaataaacgggaagagagaggagggcgctaaactgtctatggaagtcctgcgcgcatcacttcagaaagagctgaccatgggcaagggccaagcgagcgctatggaactgttgaggtgcccaacactgaggcacctgttcctttgtctgagtatgctatggttcgccacaagttttgcctattacgggctggtgatggatcttcagggctttggcgtgtcgatctatctcatccaggtgattttcggagcagtcgacctgcccgctaagctggtggggttcctggttatcaactccctgggaaggcgcccagcccagatggctgcattgttactggccggtatttgtatcctgttgaatggcgtgataccccaggatcaaagcatcgtaaggacgtctctggctgtgctcgggaagggatgcctggccgcatcttttaattgcatctttctctatacaggggagttgtatcctaccatgatcaggcaaacaggaatggggatgggatccactatggccagagtgggctccatagtctcacctttggtctcgatgactgctgagttgtatccaagtatgcccctttttatttacggtgccgtcccagtggcagcgagcgcagtgactgtccttttaccggaaaccctaggccagcctcttcccgacactgtgcaggacttggagagcaggtgggcgcctacccagaaagaggccggtatatacccaagaaaaggcaagcagactaggcagcagcaagagcaccaaaaatacatggtgcccctgcaggcgagtgctcaggagaagaacgggctgtag

SEQ ID NO: 241158 - DNA, 1590 bp, Artificial Sequence
  Description of Artificial Sequence: Synthetic coding sequence
atggcctttaacgacctactgttgctgatggcctctcataacacactgcagaatttcactgcagctatccccacacatcattgtaggcctcctgccgatgccaatctcagcaaaaatggtgggctcgaagtttggctgcctcgggatcggcaaggccagcctgaatcttgtctgagatttactagtccccagtggggactcccctttctgaacggcacagaagctaatggcaccggtgccactgagccgtgcacagacggatggatctacgataatagtacattcccttccaccattgtcactgaatgggaccttgtctgttcacatcgggcactccgccagttggctcaatctttatacatggtgggcgtgctcctcggcgctatggtctttgggtatctcgctgacagactcggccgtagaaaggtcttaatccttaattatcttcagaccgccgtctcaggtacatgtgcggctttcgcgccaaattttcctatctactgcgcctttagactcctctctggaatggcactggccggtattagcctgaactgtatgacactcaacgtcgagtggatgccaattcatacacgtgcttgcgtaggcaccttgatcgggtatgtgtatagtctaggccagtttctgctggcaggcgtagcttacgctgtgccacactggaggcaccttcagctcttagtctcagctccattctttgcattctttatttactcttggttcttcattgaaagtgccagatggcattccagttctggcaggctggacctaacgctgcgcgctctccagcgggtcgctcgtatcaatggcaagcgtgaggaaggggctaaactgtcgatggaggttctacgggcttccctgcagaaagaactgaccatggggaaaggacaggcatccgccatggaactgctgcgctgtcccacactgcggcacctgttcttgtgcttgtccatgctctggtttgctaccagcttcgcttattatggcctcgtgatggacttgcagggctttggggtaagcatctacctgatacaggtgatctttggagcagtggatctgccggctaaacttgtgggattcctggttattaactccctcggaaggagaccagcccagatggctgcactgttacttgctggcatttgcatactgctgaacggtgtgataccgcaagatcaatcaatcgtgcgaacgtctctggcggtgctggggaagggttgcctcgctgctagcttcaactgcatctttctttacacaggcgagctctacccaacgatgatcagacagaccgggatgggaatgggctcaaccatggccagagtcgggtctatcgtgtccccactggtgagtatgacggctgaactgtaccctagcatgcccttattcatatacggcgcagtcccggttgcggcaagcgcagtgactgttttgctgccagagacactcggacaacctctgcccgacaccgtgcaagatttagagtcaaggaaggggaagcagactcgacaacagcaggagcaccaaaaatacatggtacccttgcaggcctctgcgcaggagaagaacggtttgtag

SEQ ID NO: 241159 - DNA, 1560 bp, Artificial Sequence
  Description of Artificial Sequence: Synthetic coding sequence
atggcatttaacgacctcctgcaacaagtcggaggagtgggtcggtttcagcagatacaggtgacactggtcgttctgcctctcctgctgatggcttctcacaacactctgcaaaacttcactgcggcaatccccacccaccattgtcgaccccctgccgatgcgaatttaagcaagaatggcggtttagaagtgtggcttccacgcgaccgccagggccagcctgaaagttgcttgcgctttacttcaccacaatggggtctgccctttctgaatggtactgaggcaaatggaactggcgctaccgagccatgcactgatggctggatttacgataatagcacattcccttcgactattgttaccgagtgggatcttgtgtgtagtcatcgggctctgaggcagttggcccagtcactttacatggtcggcgtcttattaggagctatggtgtttggctaccttgccgacagactgggcagaagaaaagtgcttatcttgaattatcttcaaacggccgtgagcggcacatgcgctgcatttgccccaaattttcctatttattgcgcttttcgcctgctgtccggaatggcactggctggtatctcactgaactgcatgactctgaatgtggagtggatgcccattcacacaagggcctgcgtgggtactctgataggatacgtgtatagcttggggcagttcttactggctggtgtcgcatatgccgtgcctcactggcgtcacctgcaactgttagtgtcagccccttttttcgcattctttatctactcatggtttttcattgaatccgcgagatggcactcctcctccggtagactagacttgactctgcgtgccttgcaacgggttgctcgaatcaacggcaagcgagaggagggcgcaaaactttctatggaggtgttgcgggcttccttgcagaaggagctgacgatggggaaagggcaggcgtccgcaatggagctgctgagatgcccaacactgcgtcatctgtttctctgcctgtcaatgctgtggtttgcaacatccttcgcctactacggcttggttatggacctgcagggattcggagtgtccatctacttaatccaggtaatattcggggctgtcgacctgccagcaaagcttgttgggttcctcgtgattaactcccttggacgtagacccgcacaaatggccgctctgctgttggctggcatttgtattctgctcaatggcgtcattcctcaggaccagtccattgtcagaacatcgcttgcagttttgggtaaaggatgtcttgcagcctcctttaattgcattttcctctacaccggggagctgtatccaacaatgattcgagcagtgaccgtgttactcccagagactctcgggcaaccactgcctgacacagtgcaggacctagagtcgcgctgggcccctacccagaaggaagcaggtatttaccctaggaaagggaagcagaccaggcaacagcaggagcatcaaaagtatatggtccccctccaggcctccgcacaggaaaagaatggcctttag

SEQ ID NO: 241160 - DNA, 1521 bp, Artificial Sequence
  Description of Artificial Sequence: Synthetic coding sequence
atggctttcaatgatctgcttcagcaggtgggaggcgtaggcaggttccagcagattcaagtgactttagttgtcctccccttactgctgatggcatctcacaataccctgcagaatttcacagctgcaattcccacacatcactgcaggcccccagctgacgctaacctctctaagaatgggggacttgaagtgtggttaccaagggatagacagggacaacccgagtcttgccttcggttcaccagtccccagtggggactgcccttcctcaacggcacagaggcaaatggcactggcgctacggagccatgtaccgatggatggatttacgataatagtacattcccttccacaattgtgacagaatgggacctggtgtgtagccaccgggctttgagacagctcgctcaaagcctctacatggtgggggttctccttggggcaatggtgttcggatatctggccgaccggcttggaagaaggaaggtactgattctcaattaccttcagactgccgtgtccggcacctgtgccgcattcgcccctaacttcccaatctactgcgcgtttcggcttttatctgggatggctcttgccggtattagtcttaattgtatgactctgaatgtcgagtggatgcccatccatacgagagcatgtgtcggcacactgattggctacgtgtatagcctcggtcagttcctgctagctggcgtggcctatgctgtgccacattggcgccacctgcagctgcttgtgtccgcacccttttttgcatttttcatctattcctggttttttattgagtctgctagatggcacagctccagcggcaggctggacctcactctccgcgcactgcagcgggtggcccgaataaatgggaaaagagaagagggcgctaaactcagtatggaggtgctgcgggcatccctgcagaaagagttaactatggggaaagggcaagcaagcgctatggagctgctgcggtgccctaccctgcgacatctgttcctttgcctgagcatgctttggtttgccacatcgtttgcatattacgggttagtcatggacctacagggcttcggcgtctccatatatttgatccaggtgattttcggggctgtcgatctgcctgcaaagcttgttggattcctggttattaattcgctgggcagacgccctgcccagatggctgccttactactcgctggcatctgcatcctcttgaacggcgttatcccacaggaccagagcattgtgaggacttcattggcagtgttgggcaaaggatgcctggcggctagcttcaactgtatttttctctacactggcgagctctacccaacaatgattcgcgctgtgaccgtgctgctgcccgagactctcggccagccgctccctgataccgtccaggacctcgagtcaagaaaagggaagcagacaagacaacagcaggagcaccagaaatatatggtacctttgcaagcaagcgcccaggagaaaaacggcctttag

SEQ ID NO: 241161 - DNA, 1620 bp, Artificial Sequence
  Description of Artificial Sequence: Synthetic coding sequence
atgggattcgaggagcttcttgaacaggtggggggttttggtcctttccagctgcgaaatgtggctctcctcgctctccccagagttctacttcccctgcattttctgctgcctatattcctggccgctgttcccgctcaccgatgtgcactccctggggctccagccaattttagtcaccaggacgtttggcttgaggcccacctgcctcgggagcctgatggaacgctctcttcttgcctccgatttgcgtacccccaggctctgccaaacacaacactgggcgaagagcggcagtcccggggtgagttagaggatgagcccgctaccgtgccgtgttcacaaggctgggagtacgaccattcagaatttagcagcaccatcgctaccgagtgggacttagtgtgtgaacagaaaggtctaaaccgagccgcaagcacattcttcttcgccggagtgctggttggcgcagttgcctttggatatcttagcgaccgtttcggccgaagacgactcctcctggtggcatatgtatctactctcgtgctaggtctggcatcagccgcttccgtcagttatgtgatgtttgcaataaccagaactcttacaggatccgcacttgccggattcacgatcatcgttatgcctcttgagcttgaatggctcgacgtcgagcaccgcactgtggcgggagtgctgtcttctaccttctggactggcggtgttatgttgcttgcactggtgggttacctgattcgggactggcgatggcttctcctcgctgtgaccctgccctgcgctcccggtatactcagcttgtggtgggtccccgaaagcgcaaggtggctgctgactcaaggccatgtgaaggaagcgcataggtatctgctgcactgcgcgaggttaaacggcagacccgtgtgcgaagacagcttcagccaagaggcagtctcgaaggtggctgcgggtgagcgtgtggtgcgaaggccatcctatctcgatctgtttaggaccccacggctgcgtcacatttctctgtgctgcgttgtggtttggttcggcgtaaactttagttactatggccttagtctggatgtctcaggcctcggcctgaacgtttatcagacccagttactatttggagccgttgagttgccctctaagctgctcgtctatctgagcgtcagatacgctgggaggcgtctgacccaggcaggcacactgctaggcactgcactggcatttgggactaggctgttagtatcctctgatatgaaatcgtggtcaacagtactggcagtgatggggaaagccttctccgaagctgcatttaccacggcatacctgtttacatcagaactgtacccgacagttctacgtcagaccggtatgggattaaccgccctggtgggccgactcgggggaagcctggcccctctggcagcacttctcgacggcgtatggttgagcctccctaaacttacctacggagggatcgctctactggctgcgggaaccgctctgctgctgccggagaccagacaagcacagcttcctgagaccatccaagacgtcgagcgcaagcggtgtgtccatcggactgtgagcgtctatgtgtag

SEQ ID NO: 241162 - DNA, 1647 bp, Artificial Sequence
  Description of Artificial Sequence: Synthetic coding sequence
atgggctttgaagaactcctggagcaggtcggagggtttggcccattccagctgcgcaacgtcgcactcctcgccctgcctcgggtgctgctccccctgcatttccttctgccgatttttcttgccgctgtgcccgctcatcgatgcgcccttccaggcgcaccagcgaatttttcccaccaggacgtatggctggaggctcatcttccacgcgagcctgatggcacactgagtagttgcttgcgctttgcctacccacaggcactgccaaacacgacactcggcgaggaacggcagtcgcggggtgagctggaggatgaaccagcaaccgtgccctgtagtcagggctgggaatatgaccattctgaattctcaagtactatagctacagaatcacagtgggaccttgtctgcgagcaaaagggactgaaccgtgcagccagcaccttcttttttgcgggagtgctggtaggcgcagtggcctttgggtatctttccgacagattcgggaggcgtagactgctgctggtggcatacgtaagtacactggtgctcggattagcgagtgctgccagcgtaagctacgtgatgtttgccataacaagaactcttactggaagcgcactcgccggtttcacaatcattgttatgcccttagaactggaatggttggacgtggagcaccggacggtggccggtgttctctcctctacattctggactggaggggtcatgctcctggctttagtagggtatcttattagggattggcggtggctgcttttggctgttacgctcccatgcgcaccagggatcttaagcttgtggtgggtaccggaatccgccagatggctgttgacacaagggcacgtgaaggaggcgcacagatacctactccactgtgcgaggctgaacggtaggcccgtgtgcgaggatagcttttctcaggaggctgtaagtaaggtcgctgctggcgaaagagtcgttcggagaccttcctacctcgacctgtttagaacgcctcgccttcggcacatctctctttgctgcgtggtggtgtggtttggggtgaacttctcctactatggactgagcctcgacgtatctgggctgggattgaacgtgtatcagacgcaattattgtttggagctgtcgagctgccttccaagctattagtgtacctttccgtccgctacgctggcagaagattgacacaagccggaacgttgctgggcactgcattggcctttggaactagactcttggtctcctcagacatgaaaagctggtcaaccgtgctcgctgtgatgggtaaggcattttcagaggccgctttcaccacagcttatctatttacctccgagctttaccccacagtgctgaggcagaccggcatggggctgaccgccctggtgggtcgcctgggtgggagtctggcgcctctagcagctttgctcgatggggtctggctgtcattgcccaaactgacctatggaggcatagccctgcttgcagccggtaccgcacttctgctgcccgagaccagacaggctcagctccctgagaccatccaggatgtggagcgtaaatccgcacccaccagcttacaggaggaggagatgcctatgaaacaagttcagaactag

SEQ ID NO: 241163 - DNA, 1641 bp, Artificial Sequence
  Description of Artificial Sequence: Synthetic coding sequence
atgggctttgaagagctgctggaacaagtgggcggatttgggcctttccaactgcgcaatgttgcccttctggcgctgcccagggtactgcttcctctgcattttttattaccaatctttttggcggctgtgcccgctcaccgatgcgccctgcctggcgctccggcaaatttttcacaccaggacgtctggctggaagcgcacctcccacgggagccagatgggacactctcaagctgtcttagatttgcctaccctcaggcattgcccaatactactctgggcgaggaaagacaatcaagaggggaattggaggatgagcctgcgaccgtgccatgttcgcaaggctgggagtatgaccattccgaattcagctcaactattgctactgaatgggatttagtgtgtgaacagaaaggcctgaaccgggctgcttcgacattctttttcgcgggagtcctagtcggtgccgtagccttcggctacttgagcgaccgcttcggtaggcgcagacttctgctggtagcctatgtctcaacacttgtgctgggcttagccagcgccgcttctgtcagttatgtcatgtttgcaataacccgcacacttaccgggtctgccttggcaggttttactattattgtgatgccccttgaactcgagtggctagatgtcgaacaccggaccgttgcaggcgtgctgtctagcaccttttggaccggcggagtaatgttgctggcactggtgggttatttgattcgcgattggcggtggctgctgctggcagtgacattgccctgtgccccagggatccttagcttatggtgggtgcccgaatctgcacgttggctgcttacgcaaggacatgttaaggaagctcacagatatctcctccactgcgccagactgaatggcagaccagtctgcgaggactcattttcacaggaggccgtgtctaaggtcgctgccggtgagcgggttgtgcggagaccatcttatctagacctgttccgaactcctaggctccgccatatcagcctttgttgcgtggtggtgtggttcggagttaatttcagctattatgggttgtcgttggatgttagtggcctgggtctgaacgtctatcaaactcagttactgttcggggctgtggagttgcccagcaagttgctcgtctacctgtcagttcgatatgccggacggaggcttacccaggctggcaccttgttagggactgcacttgccttcggtacgcgcctcttggtgagtagtgatatgaagtcctggtcaacagtactcgctgttatgggaaaggcattcagcgaagctgcattcacaacagcctatcttttcacatctgagctgtaccctacagtactccggcaaacaggcatgggactgacggctctggttgggcgactcggtggcagcttggctcctctggctgccctgctggacggagtctggctgtcgctccctaaacttacctatggtgggatcgcgctgctagcagcgggaacagctctgttattacccgaaacccggcaggcccagttgccagagactatacaggacgtggaacgaaaaagcgcccctacctcgctccaggaagaagagatgcctatgaagcaggttcagaactag

SEQ ID NO: 241164 - DNA, 636 bp, Artificial Sequence
  Description of Artificial Sequence: Synthetic coding sequence
atgctgcagcctcacctcttaccataccaagccgtcagcaaagttgcagccggagaacgcgtggtccgtagacctagttaccttgatcttttccgtactccccgtctgcgccacatctctctgtgttgtgtggtcgtgtggttcggagtcaatttctcttactatggtctctctctggacgttagcggtctagggctgaatgtgtaccagacgcagctgttgttcggagctgtagagctgcctagcaaacttctcgtctacctgtccgtgagatatgcgggacggaggttgacccaggcgggaaccctgctgggaaccgctcttgccttcggcactaggttgctcgtcagttccgacatgaaatcttggagtacagtgttggccgtgatggggaaggccttcagcgaagccgcttttacaacagcgtacctcttcactagtgagctctacccaactgtgctccggcagacaggcatgggactgaccgctctcgttggaaggttaggaggctcccttgccccactcgcggctctcctcgatggagtgtggctgtccctgccgaagctgacctatgggggaattgctctgttggcagccggaaccgcattgctgctccccgagacccgtcaggcttag

SEQ ID NO: 241165 - DNA, 837 bp, Artificial Sequence
  Description of Artificial Sequence: Synthetic coding sequence
atgggcttcgaggagcttctcgagcaggtcggtggcttcggccctttccaattgagaaacgtagccctcttagcgctacctcgagtcctcctgccccttcactttctcctgccaatcttcctggccgctgtacccgctcacaggtgtgcgctgcccggtgcaccggctaatttctcacatcaggatgtgtggcttgaggctcacctgcctcgcgagcccgatggaacactgagttcatgccttaggtttgcataccctcaagctcttcctaataccacactgggagaggaaagacagagtaggggagagctggaagacgaacccgctacagttccttgttctcaggggtgggaatatgaccatagcgagttttcatctactatcgccactgaatcccaggtgggcatctacataatccatctggaggtggagtgtaggtggagacagagtccctgggaggccgctggacgaggtctcccctgggaggaggctgaggccgcaggactcggaagagataaagtaagctactcaccttcttggcgagagtcacttggcggtctgctgtccggaatggagtgggacctcgtatgcgagcagaagggtctaaaccgcgctgctagtaccttcttcttcgctggggtgcttgtgggcgctgtggccttcggctatttatctgatcggtttggcagaagacgcctactcctcgtggcttacgtgagtaccctcgtactgggcctcgccagcgccgcatcggtttcctatgtgatgttcgctattacccgaacacttactgggtctgctctggctgggttcaccattattgttatgccgctgtag

SEQ ID NO: 241166 - DNA, 444 bp, Artificial Sequence
  Description of Artificial Sequence: Synthetic coding sequence
atggaatgggaccttgtgtgtgagcagaaagggctcaaccgggctgctagtacttttttcttcgctggggttctggtcggggcagtcgcctttgggtacttgtcagatagattcgggcgaagacgcctcctgctggtggcgtatgtttccacattggttctgggcctggccagcgccgcaagtgtgagctacgtaatgtttgccataaccagaacattgaccggtagtgccttggcaggatttactatcattgtaatgcccctcggggaagctgaacttgaatggctggacgtggaacacagaactgttgcaggagttctctcgtctacgttttggactgggggtgtcatgctgctagctcttgtgggttatcttatacgggactggcgatggctgttgcttgccgtgacgttgccctgcgcaccgggaatcttgtcactgtag

SEQ ID NO: 241167 - DNA, 1629 bp, Artificial Sequence
  Description of Artificial Sequence: Synthetic coding sequence
atgaccttcagcgaaatactggatcgggtggggtcaatggggcattttcagttcttgcacgtagccattcttggtttgcctatcctcaatatggctaatcacaatctgctgcagatttttacggcagcaacccctgtgcaccattgtagacccccacataacgcaagcacaggaccttgggtgctacccatggggcctaatgggaagcccgagcggtgtctcaggttcgttcatcccccaaatgcatccctgcctaatgatacccaaagagctatggagccttgcctcgacggctgggtatacaatagcactaaggatagcatagtgacagagtgggaccttgtatgtaactccaataaactgaaggagatggcacagtctatattcatggcaggaatcctgattggcggtctggtgctcggggacttatcagaccgctttggacggcgacctattctcacgtgtagctacttactactcgctgcgtctggctcaggcgcagccttttctccaactttccccatatatatggtcttccgatttttatgtggcttcggaatctccggcattaccttatctaccgtgattctaaatgtggagtgggtcccaacacgcatgcgcgcaattatgtctaccgcattgggctactgttacacattcggccagtttatcctccccggtctggcctacgcaatccctcaatggaggtggttgcagctcacggtgagcataccgttttttgtgtttttcctgagctcttggtggacccctgagtccatcaggtggttggtgctctccggcaaaagttccaaagccttaaaaatcctccgtcgcgtcgccgtgttcaacgggaagaaagaagagggggagcgactcagcttggaggaactgaagcttaacctgcagaaagaaatatcgctggcgaaagcaaagtacaccgcttcagacctcttccgtatccctatgctgaggcgtatgaccttttgtctatccttggcctggtttgcaactgggtttgcatactatagtcttgccatgggcgtagaagaatttggcgtgaacctatacatcttgcagataatctttggcggagtggacgtgcctgcaaagttcataaccatcctcagcttgagttatttgggacgacacactactcaggcagcggctcttctcctggccggaggagctatcctcgccctcacattcgtgcccctggatctccagaccgtgcgtacagtcctggccgttttcgggaagggatgcctttctagctcatttagctgtttatttctgtatacctcagagctgtaccctaccgtcattcgacaaaccggaatgggggtctctaatctctggacccgagtcggtagcatggtgtcaccgctcgtaaaaattactggtgaggtacagccgtttatacccaacataatttatggcataactgccctgctcgggggatcagccgctctttttctgcccgagaccctcaatcaacccctgccggaaacgatcgaagacctggaaaattggagtctgcgcgctaagaagccaaagcaggagcctgaggtggaaaaggctagtcagcgaattccactgcaaccccacggcccaggcctgggctcatcctag

SEQ ID NO: 241168 - DNA, 1629 bp, Artificial Sequence
  Description of Artificial Sequence: Synthetic coding sequence
atgacattttctgaaatcctggaccgggtgggctcaatgggccattttcagttcctgcacgttgccattttagggctgccgattcttaatatggctaaccataacctgcttcagatcttcaccgctgctacccccgtccatcactgccgacccccacataacgcatccaccggcccatgggtactacctatgggtcccaacggaaaacctgagcggtgtctaagatttgtgcatcctccaaatgcttcattgcccaatgatacccaacgggcaatggaaccatgtctcgacgggtgggtgtacaatagcactaaagactcaatcgtgacagagtgggaccttgtctgtaatagcaacaagctaaaggagatggcccagtcaattttcatggccggaatccttattgggggtctggttcttggggatctatcggatagatttggaagacgcccaatcttaacatgctcataccttctgctcgcggcttcgggctcaggagcagccttctcacctacctttcccatctacatggtcttccgattcttatgtggatttggcatctcagggatcaccctcagcaccgtgatcttaaatgtggaatgggtgcccactcggatgcgtgcgatcatgtctacagcccttggctattgctacacgtttggacaattcattttgccgggactggcgtacgcaatcccacaatggcgctggttgcagctgacggtttctatccccttctttgtatttttcctgagtagctggtggacgccagagtctatccggtggttggtcctttctggtaaatcctccaaggctttgaaaatcctccgacgcgtcgctgtatttaacggaaagaaagaggagggcgagaggctgagccttgaagagctcaagctgaaccttcaaaaagaaatttcccttgcaaaggcaaaatacactgcctcagacctctttcggattcctatgctgaggcggatgacattttgcttgtctctggcatggtttgctaccggctttgcatactactcgctggctatgggtgtggaggaatttggggtcaacctgtatatattgcagataatttttgggggagttgatgtcccagccaaatttattaccatactctcactctcctatctgggcagacacacaacacaagccgctgctcttctccttgcgggaggcgcaattctagctctgacattcgtaccacttgacttgcagacagtacgcacggttttggccgtgttcggcaaaggttgccttagctcctccttctcatgcttgtttttgtacacctccgaactttacccgaccgtgattcgccagacgggcatgggagttagcaacctgtggacgcgggtgggttcaatggtttcccctcttgtgaaaattactggcgaggtccaaccctttatcccaaacatcatttatgggatcaccgcgctcctgggagggtcagctgccttgttcctcccagagaccctcaaccagcctcttcctgagacgattgaagatcttgaaaattggtcgttacgggcaaagaagcctaagcaggagccagaagtggagaaggctagccagaggattcccctgcagcctcacggcccaggcctcgggagtagctag

SEQ ID NO: 241169 - DNA, 1587 bp, Artificial Sequence
  Description of Artificial Sequence: Synthetic coding sequence
atgaccttctccgagatcctggatagggtgggtagtatggggcacttccaatttctgcatgtggccatcttagggctccctatattgaacatggctaatcactgccgtccccctcataacgcctccacaggcccatgggtgctacccatggggccaaacgggaagccagagaggtgcctccgattcgtccatcctcctaatgcctcccttccaaacgacactcagcgcgcaatggaaccttgcctagacggctgggtatacaatagtacaaaagactctatcgtcaccgaatgggacctggtgtgcaactccaacaaactgaaggagatggcacaaagcatttttatggcgggaattcttattggaggcttggtcctcggcgacctgtctgacaggtttggcaggcgtccaatcctgacctgcagctatcttctgctcgcagcgagcggctcaggcgcagcttttagcccgaccttccctatttatatggtatttaggtttctgtgcggcttcggaattagcggcataactctgagtaccgttatcctcaatgttgaatgggtgcccacaaggatgagagcaattatgagcacagccttggggtattgctacactttcgggcaattcatactccccggtctagcctacgctattccccagtggcggtggctgcagttgactgtctctattcctttctttgtattcttcctgagcagttggtggacacccgagtcaatcaggtggcttgtgttgtccggcaagtcgtcaaaagcgctaaagatcctaaggagggtagccgtgttcaacggaaaaaaggaagaaggcgagagactgtccctggaggagcttaagctgaacctccaaaaagagattagcctcgctaaagctaaatataccgcatctgatctctttagaatacccatgttaagaaggatgacattctgcttgagtctcgcctggttcgcgactggctttgcctactactcactggctatgggcgtggaggagttcggcgtgaatctctatatcttacagattatctttggcggagtggacgtgccggctaaattcatcaccatcctttccctgtcatatctgggcaggcatactacccaagctgccgctttgctgctggccggaggtgcaatcctcgcgttgaccttcgtgcctctggatctgcaaaccgtgagaactgtcttggctgtgtttgggaaggggtgcctgagctccagtttctcttgtctgttcctttatacaagtgagctgtacccaaccgtgatccgccagactgggatgggtgtctctaacctttggaccagggtaggcagcatggtgagcccactggttaagattaccggcgaggtccagccctttatcccaaatattatctatggtatcacagctctgctgggcggtagtgctgccctcttcctgccggagaccctgaatcaacctttgccagagacgatcgaggacctggagaactggtcactccgcgctaagaagccaaagcaggaacctgaagtcgaaaaggcctcccagaggatacccttgcagcctcacggaccagggctgggatcttcctag

SEQ ID NO: 241170 - DNA, 1653 bp, Artificial Sequence
  Description of Artificial Sequence: Synthetic coding sequence
atggctttttcaaagctcctggagcaggccggaggtgtagggttgttccagacactgcaggtgcttacctttattctaccgtgcctgatgatccctagtcaaatgctgctcgaaaatttctccgctgctatacccggtcacagatgttggactcacatgctggacaacggatcagccgtgagcacaaatatgacgccgaaagcattgttgactatctccattccccctggacctaaccaaggcccacaccaatgtagacggtttagacagccccagtggcaactcttagaccccaacgcaacggccaccagctggtctgaggctgatacagaaccatgcgtcgacggatgggtttacgaccgctctgtgttcacaagcacaatagtggctaagtgggacctggtgtgcagctctcagggtctcaagccgctctcccagtctatatttatgtctggaatcttggtgggctcatttatctggggtttgctctcatatagatttgggcgtaaacctatgctttcatggtgctgcctgcaattagctgtggcgggaacctcaactatatttgccccaactttcgtgatttactgcggattacgcttcgttgctgcatttggtatggcagggatctttcttagtagtctaacattgatggtggaatggacaacaacgagccgcagagccgtgaccatgaccgtggtgggatgcgccttcagcgccggtcaggcggcactgggtggattggcatttgccctcagggattggaggacactgcagctcgccgctagcgtgccattcttcgccatcagtctgatcagttggtggctgccggaaagcgctcggtggctgattatcaagggcaaacccgatcaggcccttcaggagctgcgcaaagtggctagaatcaacgggcataaggaagctaagaacttgacgatcgaggtactgatgtccagcgtgaaagaagaggtagcttcagccaaggaacctcgtagcgtgttagatcttttctgcgtgcccgtgttgcgttggcgctcttgtgccatgctagtggttaatttctctctcttaatttcctactatgggctggtctttgacctgcagtctctgggcagggatatttttttgttacaggccctattcggtgccgtggattttttgggcagggccacaaccgcactgctgcttagctttctgggtcgtagaacgatccaggcaggttcccaggctatggctggactcgccatcctcgccaatatgttagtgccccaggatctgcagactttaagggtagtttttgccgttttgggaaagggctgcttcggtatttccctcacctgcctgaccatttacaaggcggagctgttcccgactcctgttagaatgacagcggatggtattctccatacagtcggccgtctcggagcaatgatgggacccctgatcctcatgagcaggcaggcactgcccctcctgcctcctctcctgtatggggtgatcagtattgcctcctccctagtcgtactgtttttcctgccggaaactcagggattacctttaccggatacaatacaggatctggagagccagaagagcacagccgctcagggcaatcgacaagaagcagttacggtagagtcgacttcgttatag

SEQ ID NO: 241171 - DNA, 1338 bp, Artificial Sequence
  Description of Artificial Sequence: Synthetic coding sequence
atggcttttagcgaactgctggatcttgtaggaggtctgggacgcttccaagttctacagacaatggcccttatggtcagtatcatgtggttgtgtacacagtccatgctcgaaaatttctccgccgctgtgccttctcacagatgctgggcacctctcttagacaattccaccgcccaggcctcgatccttgggtctctgtcccctgaggccctccttgccatcagcatcccaccgggaccaaatcagcgccctcaccagtgtaggcgctttaggcagccgcagtggcagttgctggacccgaatgcaacagctacttcttggagcgaagcagatacagagccctgcgttgacggctgggtgtacgataggtccatttttacttcaacaatcgtggctaaatggaacctcgtctgtgacagccacgcgctgaagccaatggcacagtccatctatttggccggtatactcgttggagctgccgcttgcggccctgcaagcgaccgctggctcgccgagtccgctcgctggcttctaaccaccgggagactggattggggactgcaagagctctggagggtagccgctattaatggcaagggagcggtgcaggatacccttaccccggaagtccttctcagcgcaatgagggaagagttaagcatgggccagcctcctgctagtctgggcacactattgagaatgccaggcctgagatttcgcacctgcatcagtacgctctgctggtttgccttcggattcacattttttggcctggctctggatctgcaggctttagggtctaatatctttctgctgcaaatgtttatcggcgtggtcgacattcccgcaaagatgggggctttgctcttacttagtcacttgggtcggcgaccgacgttggctgcctccttgctattggccggactgtgtattcttgctaatacgttggtcccacacgagatgggtgccttacgaagcgctctggctgttctcggcctggggggtgtgggtgcagccttcacctgtataactatttactcctctgagctcttccccaccgtactccgaatgacagccgtcggattgggtcagatggcggctaggggcggagctattctggggccactcgtgagactcctgggcgttcacggcccatggctcccactgctcgtttatggtaccgtccctgtgctgagcggtctagctgccctattgcttcctgaaacccagagtctgcctttaccggatacaattcaggatgtccagaaccaagccgtcaagaaggcgacccacggcaccctgggtaacagcgtcctgaagtcaactcagttttag

SEQ ID NO: 241172 - DNA, 1662 bp, Artificial Sequence
  Description of Artificial Sequence: Synthetic coding sequence
atggcattcagcgaactgctcgatctcgtgggcggtctgggaagattccaggtcctccaaaccatggctctcatggtttctattatgtggttgtgtactcagagtatgctcgagaatttctccgccgcagttccctctcataggtgttgggcccctcttctggataattcaaccgcacaggcatccattttgggctccctgtcacctgaggccctccttgccatttcaatccccccaggtcctaatcagcgcccacatcagtgtcgccgattccggcagccccagtggcagctcttagacccaaatgctacagccacatcatggagtgaggctgacaccgagccttgtgtcgacggctgggtgtatgaccgatcaatctttacttcgaccatagtcgccaagtggaacctagtgtgcgacagccatgcactcaagcctatggcgcagtctatttacctcgctggaatcctcgttggtgctgcagcatgtgggcctgcctcagacaggttcggcaggcgcttggtgctaacctggtcttacctgcagatggccgtaatgggcactgccgcagccttcgcacctgcgtttcctgtgtactgtctgtttcgatttctgctggcctttgctgttgccggagtcatgatgaacacagggactctcctcatggagtggaccgccgcacgggctcgccctctggtaatgaccttgaacagtctgggctttagctttgggcatgggctgaccgccgcagtagcttatggtgtgagagactggacactacttcagcttgtggtgagcgtgcccttctttctctgcttcttatattcttggtggctggctgagtcagccagatggctgctgaccaccggccgactcgactgggggctccaggaactgtggagagtggcagccataaacggaaagggcgcagtccaggacactctcactcccgaggtactgctttcagcaatgcgggaggaattgagtatgggacagcctcctgctagccttgggacgctgctgcgcatgccgggactcaggttccggacatgtatttccacactttgttggttcgcatttggctttacgttcttcggccttgccctcgacctccaggcgctcggaagcaatatcttcctattgcagatgtttataggtgttgtagatattccagccaaaatgggcgctcttttattactgtcacatctcggacgtcgcccaacattagcagccagtctgcttttagcaggcctatgtattctggctaacactctagtgccgcacgagatgggtgccctccggagcgccttggctgtgttaggccttggaggcgttggagctgccttcacttgcattacaatttattccagcgagctgttccccaccgtactgcggatgacagctgtcgggttgggccagatggccgctagaggcggagccatattggggcctctggtgcgccttttgggcgtgcacgggccttggctgcccctcttggtgtacggcacagtgccggtgctttcaggcctggcagccctgctgttgcccgaaacacagtcactccctctgcccgacactattcaggacgtgcagaatcaggcggtcaaaaaggcgactcacggaaccctgggaaactctgtgttgaaaagcacacaattttag

SEQ ID NO: 241173 - DNA, 999 bp, Artificial Sequence
  Description of Artificial Sequence: Synthetic coding sequence
atggaatggaccgcggctagagcgaggccccttgtcatgacgctcaactctctcggtttctcatttggacacggcctgaccgctgcagtggcctacggggtgagggactggactctgctgcagctggtagtgtctgtgccctttttcttgtgttttctgtattcctggtggctggcagagagcgcgagatggcttctcaccaccggacgactggattggggtcttcaggagctgtggcgggtggctgcgataaatgggaagggagctgtacaggatacattaactcccgaggtccttcttagcgcaatgcgcgaagaactcagcatgggccagccacccgcatccctcggtacacttctgcgtatgcctgggcttcgctttaggacatgtatatctacgctgtgctggttcgcatttggctttactttttttgggcttgccctggatctgcaagctcttggtagtaatatatttctccttcaaatgttcataggagtggttgacattccagccaaaatgggggcactgctgctgctgtcccacctcgggagacggccaaccttagctgcttccctgctgctggcaggactgtgcattctcgcaaatacactcgtgccgcatgaaatgggagctctgcgaagcgctctggctgtgctaggtttgggaggggtgggcgctgccttcacttgtattacaatctattccagcgagctctttccaaccgtgctccgtatgactgcggtgggactcgggcaaatggcggcaaggggcggagccatactggggccactggttcggctactgggagtgcacgggccatggctgcccttgctcgtgtacggcactgtacctgtgctttctggattggcagccctactcctgcctgagacccagtctctaccattaccagatacgattcaggacgtacagaaccaggccgtgaaaaaagcgacacacgggaccctgggcaattctgtgcttaaatccacgcagttctag

SEQ ID NO: 241174 - DNA, 1665 bp, Artificial Sequence
  Description of Artificial Sequence: Synthetic coding sequence
atgccaaccgttgacgacattctggagcaggtaggcgaatccggctggtttcagaagcaggccttcctcatactatgcctcttatctgccgctttcgctccaatttgcgtcggtatcgttttcctcggatttactccagatcatcattgccagtccccaggcgtcgcggaactgtcccagagatgcggatggtctcccgcagaagaacttaactacactgtacctggcctcggacctgccggtgaggcattcttaggtcagtgccgtagatatgaggtagattggaatcagtcagccttatcctgtgtggatccgctcgccagcttggccactaacagaagtcatctccctctgggtccctgtcaggacggttgggtgtatgataccccaggatcatccatcgtgactgagtttaacctagtttgtgctgattcctggaaattagatctgttccaaagctgcctgaacgccggttttctatttgggagcctgggcgttggttatttcgccgatcgttttggccgaaagttgtgcctgcttgggacagtgttggtcaacgccgtatctggcgtgttaatggctttttcacccaattacatgagcatgttgctatttcgcctgctgcagggactagtatccaagggcaactggatggccggatatactcttatcacggaatttgtgggttctggcagccgtaggaccgtggccattatgtaccaaatggcttttactgttggcctggttgctctgacagggcttgcttacgcgctaccgcactggaggtggctccagctggccgttagcctacctacctttctgtttctgctctattactggtgcgtccctgagtcccctcggtggctgctctcccagaagaggaacacggaggcaatcaaaataatggaccacattgcccaaaagaacggcaagctcccaccggctgatctgaagatgctgagcctagaggaagacgtcactgagaagctgtccccctcttttgccgacttgtttcgcactccccgactgaggaaaaggacgttcatcctgatgtatttatggttcactgactctgtgttgtatcagggtttgatactccatatgggggctacctccggaaacctatatctggattttctttactcagccctcgtggaaatcccaggggcttttatcgcgttaatcactatagaccgcgttggtaggatctaccccatggccatgagcaatctgctcgctggggctgcatgtctggttatgatcttcatatcaccggacctgcattggctgaatattatcatcatgtgcgtgggcagaatgggtatcactatcgctatccaaatgatctgcttagtgaacgcagagttgtatcccaccttcgtgcgtaatctcggagtgatggtgtgctcctcattgtgtgacatcggagggattataactcccttcatagtattcagattgagggaagtgtggcaggcgctcccacttatattgtttgccgtgctgggcctcctggccgcaggtgtaactctattgctgccagagacaaagggggtagcactgcctgagacgatgaaagacgctgagaacctggggcgtaaagctaaacccaaggagaacacaatttacctgaaagtacagacaagcgagccgtccggtacatag

SEQ ID NO: 241175 - DNA, 1005 bp, Artificial Sequence
  Description of Artificial Sequence: Synthetic coding sequence
atgttcttcctgctggcattgctttcagcaactttcgcacccatttacgtgggcatcgtgttcctcggctttacgccagaccatcgctgtaggagcccaggcgtggcagagctctctttgaggtgcggttggtccccagctgaggagctcaactacactgtgccgggtccgggacctgctggggaagctagcccgagacagtgcagacgatacgaggtggattggaaccagagcaccttcgattgtgtggacccactggcctcgttggacaccaatcggagccggctacccctcggtccttgccgcgacggatgggtttacgagacacccggatcatccattgttacagaattcaacctcgtctgcgcgaactcctggatgcttgacctgttccagtctagtgtgaatgtggggttcttcattgggtcaatgtcgattggctatattgccgaccgcttcggtcgaaagctgtgtctgttaacaactgtgctaatcaatgctgccgctggtgtgctgatggccattagtcccacctatacgtggatgttaatctttcgtctcatccagggactggtatctaaggccggttggctaataggttatatactcattaccgaatttgtcggaaggagatacaggagaactgtggggattttttaccaagtagcgtacactgtaggcctgcttgtgctggccggtgtggcatacgccctgccccattggcggtggctgcagtttaccgtctcgctgcccaatttttttttcctgctgtattactggtgtatacctgagagccctcgctggttaatctcccagaacaaaaatgcagaagccatgcgcataataaagcacattgccaaaaagaacggtaagtctctgccagcatccctgcagcggctgcggttggaggaggagaccggcaagaagctgaatccaagttttctggacctggtcaggacgccccaaattcgcaaacataccatgattcttatgtacaactggtag

SEQ ID NO: 241176 - DNA, 1668 bp, Artificial Sequence
  Description of Artificial Sequence: Synthetic coding sequence
atgccgactaccgtggacgacgttctggagcatgggggtgagtttcacttttttcagaagcagatgttctttctactggcgctgctgtctgccacatttgcacccatatatgtggggatcgtgtttttgggattcacaccagaccacagatgccgaagcccaggtgttgctgaattaagcttgagatgcgggtggtcccccgcagaagaacttaactacaccgtcccaggtcctggtcccgctggcgaagcaagccccagacaatgccggcgatacgaagttgactggaaccaaagtacgttcgactgtgtagatcccctcgcctccctggatacgaatagatcgcggctgcctctaggaccatgccgcgatgggtgggtgtatgaaactcccggatcaagcatcgtgacagaattcaatttggtttgcgcaaatagttggatgctggacctgtttcaaagttccgtaaatgtgggatttttcattggatccatgtctataggttacatcgcagatagattcggcaggaaattgtgcctcctgaccactgtgttaataaatgcggcagctggagtactcatggcaattagccctacctacacatggatgctgatatttcgtcttatccagggcttggtgtccaaggccggttggctgatcggttatattctcatcactgagtttgtgggcaggaggtatcgcagaacggttggcattttctaccaggtcgcctatacagtgggtctgcttgtattagctggcgtggcgtacgccctcccacattggagatggttacagtttacagtgtcattaccgaactttttttttctactgtactactggtgtatcccagaatcaccaagatggcttatcagccagaataaaaatgccgaggccatgagaatcatcaagcacatcgcaaaaaagaatggaaaatcgcttcccgcaagtctccagaggcttagactcgaagaagagactgggaagaaactgaatcctagctttctcgatctggtacggactccgcagatacgcaaacataccatgatcctgatgtacaattggtttacctcaagtgtgttgtatcaggggctcatcatgcatatgggtctggctggggacaatatttacctcgattttttttattcagcactagtcgagttcccagccgcatttatgatcattctgactatagatcgtataggcaggcggtacccatgggctgctagcaatatggtcgccggtgctgcatgcctggcttcggtatttataccaggcgacctgcagtggctaaagattattattagctgtctaggcagaatggggatcactatggcctacgagattgtctgtctggtgaacgctgagttatatcccactttcatcagaaacctcggcgtgcatatctgctcaagcatgtgtgatattggaggtatcatcaccccctttctggtgtatcgcctgactaacatatggctggagctgcccctcatggtctttggtgtactggggttggtcgccggaggactggtcctgctcctccccgagaccaaggggaaggccctgcctgaaacaattgaagaggccgaaaatatgcagaggcctcgaaaaaacaaggagaagatgatttatctgcaggtccagaagcttgacattccgctcaattag

SEQ ID NO: 241177 - DNA, 1632 bp, Artificial Sequence
  Description of Artificial Sequence: Synthetic coding sequence
atgcgtaccttgcacgccgtgtcacatccttatagcaacagcatgcgctttcaacgcgtgctttactttatctgtgctttccaaaatatcagctgcggcatccactatctagcaagtgtgttcatgggagtgacgcctcaccacgtgtgtcgccctccgggaaacttgcagaatggcgagatctgggagttatcacggtgcagccgaaacaaaagagagaatacgtcctccctggggtatgagtatactggttctaaaaaagaatttccatgtgtagatgggtatatctatgaccagaacacatggaaaagcactgccgtcacccagtggaaccttgtttgcgataggaaatggttagccatgctgattcagccattgttcatgttcggagtgctcttggggtctgtaacatttgggtacttctccgatcgtcttggtcgcagagtcgttttatgggccactagcagcagcatgttcctgttcggaatagcagccgcatttgctgtggattattatacatttatggccgcacgttttttcctcgctatggtggcgtccgggtaccttgtcgtgggttttgtctatgtaatggagttcatcggcatgaaatctcggacatgggcgtctgtacacctgcactcattttttgccgtgggaacactgcttgtcgcactcactggctacttggtgagaacttggtggttataccagatgattctcagtaccgtaacggtgccttttatcttatgttgttgggtgctaccggaaactccattctggctgctgtctgaggggcgatacgaagaagcccagaaaatcgtggacatcatggccaaatggaatagggcaagtagttgcaagctgagcgagctgctgtcactggatcttcaaggtccagtttcaaatagccccaccgaggtccagaagcataatcttagctatctcttctataattggtccatcacaaagaggacattgactgtgtggctaatctggttcacaggttctctgggtttttactcatttagcttgaattctgtcaacttaggcggaaacgagtatcttaacttatttctgcttggggtggtggagatacctgcttatacattcgtctgtattgccatggataaagtgggccgtcgaacggtgctggcctattctctgttctgttcagctctagcctgcggcgttgtgatggtaattccccagaagcactacatattgggtgtcgtgaccgccatggtcggtaaatttgctatcggagcagcttttggcttgatttatctttacaccgcagaactctatcccaccatagtgagatctctcgccgtgggatcgggctctatggtgtgccgcctcgcatcaatcttggctccgttctctgtggatctgagtagcatctggatttttattccccagctattcgtgggaaccatggctctcctgagcggcgtgctgaccctgaagttgcctgagacactaggaaaaagactcgccacgacgtgggaggaagcagccaaactggagagcgaaaatgaaagcaaatctagtaagctgctcctcactactaacaacagtggcctcgagaaaacagaagcgattacccctagagattctggattaggagagtag

SEQ ID NO: 241178 - DNA, 1734 bp, Artificial Sequence
  Description of Artificial Sequence: Synthetic coding sequence
atgggctcacggcactttgaagggatatacgatcatgtgggacactttggacgattccagcgggtcctgtacttcatttgtgctttccagaatatatcctgtggcatacactatcttgcttcagtattcatgggagtcacacctcatcacgtgtgccggcctccgggtaacgtctcacaggtggtgtttcataaccatagcaattggtcactggaagacaccggagcccttctcagcagtgggcaaaaagactacgtcacggtgcagctgcagaacggagagatctgggagctctcgaggtgctcaagaaataaaagagaaaatactagcagcctgggatatgagtacaccgggagcaaaaaggagttcccatgcgtcgatggatatatttacgaccagaatacctggaagtctaccgccgtgacccaatggaatctcgtctgcgacaggaagtggcttgccatgttgatccagcccctgtttatgttcggcgtgctgctcggttctgtcacgtttggctatttttccgacaggttggggagacgagttgtgttgtgggctacttcctctagcatgtttctatttggaattgctgcagcattcgccgtcgattactatacctttatggccgctcgattttttctggctatggttgcttctggttatctggtagtgggcttcgtgtacgtgatggaattcataggcatgaaatcccgcacatgggcatctgtgcacctccactcttttttcgcagtgggaacattgttggtcgcactcacaggatatctagttagaacctggtggctctatcagatgattctcagtaccgtcacggtgcctttcatcttgtgctgctgggtgctgcccgagacccccttttggttactgtccgagggccgatacgaggaagctcagaaaatcgtggacataatggccaagtggaatagagcctctagttgtaaacttagtgaattgctcagtctcgatctgcaggggccagtgagcaatagtcctaccgaagttcaaaaacacaacctatcatacctgttttataactggagcataaccaagaggacgctgaccgtctggcttatctggttcacaggatctctggggttctactccttcagcctgaactccgtcaatctgggagggaacgagtatctgaatctttttcttctgggcgtggttgagattcctgcttacacattcgtatgcattgccatggacaaagttgggaggagaaccgtcttggcatattccttgttctgcagtgcgttggcctgtggagtggtgatggtgattccacagaagcactatattctcggtgttgttacagctatggtcggcaaattcgccatcggagccgctttcggtcttatctatttgtataccgccgagctatatcccaccattgtccggtctctggcggtgggaagcgggagcatggtttgcagactggcaagtatactagcgcctttttcagtggatctatcaagcatctggatatttattccacagctgtttgtgggaactatggcgctcctcagtggcgtactgactctgaagctaccggaaactctgggaaagaggctagccaccacctgggaagaggccgctaagttagagtccgaaaacgagtcgaaatcgtctaaattactgctgaccacaaacaattcaggcttggagaagaccgaggcaatcactcccagagacagcgggttgggtgagtag

SEQ ID NO: 241179 - DNA, 525 bp, Artificial Sequence
  Description of Artificial Sequence: Synthetic coding sequence
atgggagtcacgccccaccatgtgtgtcgcccacctggtaacgtcagccaagtggtgtttcataatcattccaattggtcacttgaagatactggcgctctgctcagctccggacagaaggattatgtgacagtgcagttacagaatggggaaatttgggaattgtccaggtgctcgaggaataagagggagaacaccagctccctagggtatgagtatactggcagcaagaaggagtttccttgcgttgacgggtacatttatgaccaaaacacatggaaatctaccgccgtgacccaatggaatctcgtctgcgatcgaaagtggcttgcaatgttaattcagcccctattcatgtttggggtcttgctgggctctgtcacattcggatacttctccgataggctggggcgacgagtggtgctctgggctactagctcaagcatgtttctgttcggcatcgctgcagcatttgccgtggactattatacatttatggctgctagattcttcctagctatgtag

SEQ ID NO: 241180 - DNA, 804 bp, Artificial Sequence
  Description of Artificial Sequence: Synthetic coding sequence
atgtctgctggccctcaggctatgttgggtaggcgggttgtactgtgggctacgtcttctagcatgttcctgtttggtattgccgcagcctttgccgtcgattattacactttcatggccgctaggttcttcctggccatggtggcaagtggttacctcgtcgtgggatttgtctacgtgatggagttcatcggcatgaagagccgtacatgggcctcagttcacttgcactctttcttcgctgtgggaacactactggtggcactcaccggttaccttgtccggacctggtggttatatcagatgatactatcaaccgttaccgtgccctttatactttgttgctgggtgctgccagagacacctttctggctcctttctgaagggcgttatgaggaggcccaaaaaatagtggacattatggctaagtggaatagggcctcatcatgcaaactgtccgagctgttgtctctggatctccagggcccagtgagcaattccccaaccgaggtccagaagcacaacctcagctatctgttctacaactggtccatcaccaagcgtactctgaccgtgtggttgatttggttcactggttccctgggcttctattcattctccctcaattccgttaacctgggcggaaacgaatatctgaacctatttcttttaggcgtagtagaaattcctgcctatactttcgtatgtatcgccatggacaaggtgggcagacggaccgtgctggcatacagcttgttttgctcagccctggcatgcggggtagttatggtcataccgcagtag

SEQ ID NO: 241181 - DNA, 1056 bp, Artificial Sequence
  Description of Artificial Sequence: Synthetic coding sequence
atgggtgtgactccccaccacgtctgcagacctcccggaaacgtgagccaagtcgtattccacaatcattccaactggagcttggaagacacaggagctctgctatccagtggccagaaagactatgtgacagtgcaactccaaaatggagagatctgggagctgtccagatgtagtcgtaataagagagaaaacacgagctcgctcggttacgagtatacgggcagcaagaaagagttcccgtgtgtggacggatacatatacgaccagaacacgtggaagagtacggcagtgacccaatggaatttggtatgcgacaggaaatggctggccatgctgatacagcctctgttcatgttcggggttctcctggggtcagtaaccttcggctattttagcgatcgcttagggagacgagtagtcctctgggccacttcaagcagcatgtttttgttcggcattgccgctgcgtttgccgtagactactacacctttatggccgcacgattcttcttagcgatggtggcatctggttacctggtggtgggattcgtgtatgtcatggagtttataggcatgaaatcccggacctgggccagtgtacatctgcattctttctttgcagtgggcactcttctggtggctctgacgggttacctggtgagaacatggtggttataccagatgatactgtccacggtaacagtgcccttcatcttatgctgctgggtcttgcctgagactcccttctggctactgtcagaaggtagatacgaggaagcgcagaagatcgtggacattatggccaagtggaatcgtgccagttcatgcaagctcagtgaacttctaagtctcgacctccagggcccagtaagcaattcccctaccgaggtacagaagcataatttatcctacctattctataattggtcaattaccaaacggacactcacagtgtggctgatatggttcacaggatccctcggattctacagtttctccctgaatagcgtgaacttggggggaaacgagtacttaaacctgttcttgctttag

SEQ ID NO: 241182 - DNA, 1548 bp, Artificial Sequence
  Description of Artificial Sequence: Synthetic coding sequence
atgggctccagacatttcgaaggcatttatgaccatgttggtcattttgggaggtttcagagagtcttgtactttatttgtgcattccagaacattagttgtgggatacattatctggccagcgtgttcatgggagtgacaccacaccacgtttgtcgcccacccggtaatgtgtcacaggtggtgttccacaatcattccaattggtccctggaagataccggtgccctgctctccagcggacagaaagattacgtaactgtccaactgcagaacggcgagatatgggagctctctaggtgttctaggaacaagcgagaaaataccagttctcttggttatgagtacactggtagcaaaaaggaattcccctgcgtggacgggtatatttacgatcaaaacacctggaagagtaccgctgttacccagtggaacctcgtgtgtgacaggaagtggctggcaatgctgattcagccacttttcatgttcggtgtactgctcgggtcagtcacttttgggtactttagtgatcgcttggggcgtcgtgtcgttctgtgggctacatccagttccatgttcctgtttgggatagctgcggcttttgcagtggactactacacgttcatggcggctaggttttttctggccatggtggcttccgggtatttggtggtaggattcgtgtacgtgatggagtttattggcatgaagtcccgtacctgggcctctgtacacctgcactcattttttgccgtcggaacactgctagtagctctgacgggatacctggtgcgcacttggtggctgtatcagatgatcctgagtactgtcactgtccctttcatcctgtgctgctgggttttgcctgagactcccttctggcttttgtcggagggtcgttacgaagaggcccagaagattgtagatataatggctaagtggaaccgtgcctcatcatgcaaattgagtgaattgttgtcacttgaccttcaaggaccagtgtctaattccccaactgaagtacagaagcataacctttcttatcttttttacaattggagcattacaaaacgcacgctgacagtgtggctgatttggttcactgggtcactggggttctacagcttctcattgaactccgttaacctcggcggtaatgagtacctcaacttatttctgctgggcgtagttgaaatccccgcttatacttttgtttgcatagctatggacaaagtcggtcggaggacagtcctcgcttacagtcttttttgttctgctttggcctgtggagttgtgatggtcatccctcagaaacattacatcctgggggtcgtcactgcaatggtaggcaaatttgctataggcgctgccttcggactcatctacctctacaccgccgagctctatcccacgattgtcagaagcttagcagtggggagtggttccatggtctgccgcttggcatccattctcgcccctttttctgtggatttgagcagcatatggatattcatccctcagctgctcgggcagcatctacaggaatag

SEQ ID NO: 241183 - DNA, 1299 bp, Artificial Sequence
  Description of Artificial Sequence: Synthetic coding sequence
gactatgtgacggtgcaacttcaaaacggggagatttgggaactgtcaagatgttcccgaaataagagagagaatacatcatcgcttggctacgagtatacagggagtaagaaggagttcccttgcgtggacgggtacatatacgaccagaatacgtggaaaagtacagcagtgacccagtggaacctggtatgtgataggaagtggctggccatgctgattcagcccttatttatgttcggggtgctattaggcagcgtaacctttggttatttctctgatcggctgggccgaagagtggttttatgggcaacctcttcttcaatgttccttttcggtattgctgcagcttttgccgtggactactatacgttcatggcagctagattcttcctcgcaatggtggccagtggctatctcgtggtcgggttcgtgtacgtgatggaatttatcgggatgaagtctcggacgtgggcaagtgtgcacctgcactcttttttcgctgtcggcacactccttgtggccttgaccggctacttggtgcggacctggtggctgtaccaaatgatattgtccacggtgactgtcccctttatcctctgctgctgggtcctcccagaaacaccattctggttgctctccgaagggagatacgaggaggcccagaaaattgtagacatcatggccaaatggaacagggcgagttcctgcaaactgagcgagttgctatctctcgatctgcaaggccctgtgtctaactcccccactgaggtgcagaaacataatctcagctacctgttttacaattggtcaattacgaagcgaactctgacggtttggctcatctggttcactggctcattgggattctactctttctctcttaatagcgtgaatttggggggtaatgagtacctcaacctctttcttctgggggtggtggagataccggcatacaccttcgtgtgcatcgcgatggataaggtgggcaggaggactgtgctcgcatactccctgttctgttcagcactggcttgcggagtggtgatggtgatccctcagaaacattatattttgggagtcgtgacagcaatggtggggaagtttgcaataggggcagccttcggcctgatatacctgtatacagcggaactgtatcctacaattgttaggtcactggccgttggcagcggatcaatggtttgccggctggctagcattctagccccattcagcgttgatctgtcttcgatatggatcttcatccctcagttacttgggcagcaccttcaggaatag

SEQ ID NO: 241184 - DNA, 600 bp, Artificial Sequence
  Description of Artificial Sequence: Synthetic coding sequence
atggggagccgccacttcgagggaatctacgaccacgtgggccacttcggtcggttccaacgtgtattatattttatctgcgcatttcagaatatcagttgtggcatccactatctggcgtcagtgttcatgggcgtgacaccgcaccacgtgtgccgtccccctggcaatgtctcccaggtggttttccataaccatagcaactggtctctggaggacacaggcgctcttctatcatccggccagaaagattacgtgacagtccagctccagaacggagagatttgggaattgagcagatgttcccgaaacaaaagggagaacacaagctccttgggttatgagtacaccgggtccaagaaggagttcccctgtgttgatgggtacatttatgatcagaatacatggaaaagcacagccgtcacccaatggaacctcgtatgtgatcgcaaatggctggccatgttaatccaacctctgtttatgttcggcgtgctgctggggtctgttaccttcggatacttttccgacagagtgggttttctgacagcctggtataaaaccagtggtttccccacatcaagcgcccctcccctttag

SEQ ID NO: 241185 - DNA, 1674 bp, Artificial Sequence
  Description of Artificial Sequence: Synthetic coding sequence
atgcgagactatgacgaagtgaccgccttccttggtgagtggggaccttttcagaggctgatttttttcctactatctgcatctataatccctaacgggtttacaggcctgtcgtccgtcttcttgatcgccaccccagaacaccgctgccgagtccccgacgctgccaatctgtccagtgcatggcggaatcatactgtgcctctgaggctgcgcgacggcagagaggtgccgcacagctgtcgcaggtataggcttgcaactatcgctaacttctctgctttaggtctggaacctggtagagatgtggatctaggacagctagaacaagagtcatgtctggacggctgggagttttcacaagatgtgtacctgtcaaccatcgttaccgagtggaatttggtttgtgaagacgattggaaagcgccactgaccattagtctgttctttgtcggggtactgctgggaagttttattagtggccagcttagcgaccgtttcgggagaaagaacgtgttgttcgtgaccatggggatgcagactggcttttctttcctccagattttctcgaaaaatttcgagatgttcgtggtgctgttcgtgcttgtcggaatgggccagatctccaattatgtggctgcctttgttcttggcaccgagatcctcggcaagtctgtgaggattatattttctactctcggtgtatgcattttttacgctttcggatatatggtcttgcccctctttgcctattttatcagagactggcggatgctgttggtcgccttgactatgcctggggtgctgtgtgtggctctttggtggttcataccggaatcaccccgatggctgattagccagggcagatttgaagaggctgaagtaattattaggaaggctgccaaagccaacggaattgtcgtcccttctactatattcgacccttccgaactacaggacctgtcctcaaagaaacagcagtcacacaatattctcgatctgttgcgtacctggaatatccgaatggtgaccatcatgtccatcatgttgtggatgactatcagcgtgggatattttgggttgagcttagatactcccaacttgcacggcgatatcttcgtgaattgtttcctatcagcgatggttgaggtgcccgcatatgttttagcctggttactcctgcagtacttgccgcgaaggtatagtatggccactgccctctttctggggggttctgtgctgttatttatgcagctagtcccgcctgatctttattatctcgcaacggttctcgtaatggtgggcaagtttggagtcaccgctgccttctccatggtgtacgtttacacggccgaattataccccacagtagtgcgcaatatgggcgtgggtgtatcttcgacagcttctcggttagggtctattctgtctccatacttcgtctacctgggtgcttatgatcgatttttgccttacattctgatggggtcactgaccatcctcactgcaattctgactctgttcctgccagagtcctttggtacccctttacccgatacaatcgatcaaatgcttcgcgtgaaggggatgaaacacagaaagacccccagtcacacgcgcatgcttaaggacggtcaggaaagaccaactatcctcaagagcacagcattctag

SEQ ID NO: 241186 - DNA, 1746 bp, Artificial Sequence
  Description of Artificial Sequence: Synthetic coding sequence
atgcgcgactacgacgaggttactgctttcctaggcgagtggggcccattccagagactgatcttctttctgctgtcagcatctataattcccaatggatttacgggtctctctagtgtctttctgatcgccacacccgaacaccgttgccgggtgcccgatgctgcaaacctgagcagcgcttggagaaatcatactgtccctctgaggctcagggacgggcgagaagtgccccattcttgtcgaaggtatcgactcgccacgattgccaacttctcagccctaggcttggagcctggcagagatgtggacctggggcagcttgaacaggaaagctgtctggatggctgggagtttagccaggatgtatatttgtccacgattgtaactgagcaggattcaggcgcatataacgcaatgaagaacagaatgggtaagaagcccgctctgtgtcttcctgcgcagtggaacctggtgtgcgaagacgattggaaggctccccttacaatttctcttttcttcgtgggggtcttgcttggtagtttcatatctggccagctgtctgatcggttcggaagaaaaaatgtgctttttgttaccatgggaatgcagaccggcttcagttttctgcagatatttagcaaaaactttgaaatgtttgtggtgcttttcgtgttagttggtatggggcaaatctctaactacgtggccgcattcgtgcttggcacagagatccttgggaaatcggtgcgaataattttctctactctcggggtatgcatcttctatgctttcggatacatggtgctgcccttatttgcatatttcattcgggattggcgcatgctcctggtcgctctcactatgcctggtgtgctctgtgttgctctgtggtggtttattcctgaaagccctcgctggctgattagtcagggacgattcgaagaggccgaagtaataataagaaaagctgcaaaggctaacgggatagttgtgcccagcactatattcgatcctagtgaactgcaagacctgagctccaaaaagcagcagtcccataatatcctggatctgctgcggacatggaacatcaggatggtgacaatcatgtctatcatgctgtggatgacaatctctgtgggctactttggtctgagcttggacacccctaacctgcacggggacatattcgtcaattgtttcctctctgcaatggtggaagtgccggcttacgtgctggcatggctgcttctgcagtacctgccaaggagatactctatggcaacagccctgttccttggcggaagcgttttgctgtttatgcaattagtaccacctgatctgtactatctggccaccgtgttggttatggtggggaaattcggggttaccgccgcattctccatggtctacgtgtatacagctgagctttaccctacagtggtccgaaatatgggcgtgggagtcagctccactgccagccggcttgggagtatcctctcgccatactttgtgtatctgggtgcatacgaccgcttcctgccgtatatacttatgggttccctaactatcctgacggccatcttaaccctctttttacctgagtcctttggaacaccactgccagacaccatcgaccagatgctgcgggtgaaggggatgaagcacaggaagacacctagccatactcggatgttaaaggacggacaggagcggccaactatcttaaaatccacagctttctag

SEQ ID NO: 241187 - DNA, 1656 bp, Artificial Sequence
  Description of Artificial Sequence: Synthetic coding sequence
atgcgcgactacgacgaagtgattgcgttcctgggagagtgggggccattccagagactgatcttttttttgctcagcgccagcatcatcccaaatggctttaacgggatgtctgtggtgtttctcgccggaacaccggaacataggtgtcgcgtacctgacgccgctaacctgagtagtgcttggaggaacaatagcgtcccactgagactgagagacggcagggaggtccctcactcctgcagcaggtatcgcctggctaccattgcaaatttctcagcactcgggctcgaacccggaagagacgttgacctcggccagctagagcaggagagctgcctggacggctgggaattctcgcaggacgtatatttgagcactgtggttactgaatggaatcttgtatgcgaagacaactggaaggttccattgacaacatcactgttttttgtgggagtcctgttgggcagcttcgtgtctgggcagctgagtgatcgatttgggcgtaagaatgtgttattcgccaccatggcagtccagactggctttagctttttacagatcttttccatcagttgggaaatgtttactgtgctatttgtcattgtgggcatgggacagatcagtaactatgtggtggccttcatcctgggtaccgagattctgggaaagtctgtcagaatcatattttctacacttggtgtgtgtacgttcttcgccgtggggtatatgctgttaccgctgtttgcctacttcattcgggattggaggatgctgctacttgcgctgacagtgcccggtgtgctgtgtgtccccctgtggtggttcattccagaatcccccaggtggctgatctcccagagaaggtttcgcgaggcggaggatattattcagaaggcagctaagatgaacaacattgcagttcccgcagtgattttcgatagtgtggaggagctgaaccccttgaagcagcagaaggcgtttatcctcgacctcttccgcacgcgtaacattgctatcatgaccataatgagtctgcttctgtggatgctcacctccgttggctatttcgctcttagcctcgacgctcctaacctgcacggggacgcttacctaaattgtttcctcagcgcattaattgaaattccagcctacatcacagcttggctgctgctgaggacattacctaggagatacattattgcagccgttctgttctggggcggaggcgtgctgctgtttatacaattagttccggtcgattactacttcctctccatcggcctggttatgctgggcaagtttggtattacgtcagctttcagtatgctctatgtgtttaccgcagaactctaccctaccctagtgcgtaacatggcagtcggggtcacctctactgcatccagggttggtagcataatagccccttatttcgtatacctgggggcttataatcggatgcttccctatatcgtcatgggctcattgaccgtcctcataggtattctcacccttttctttccggaatcgcttggaatgacccttccagagaccttggagcaaatgcagaaagtgaaatggttccgatctggaaagaaaacacgcgacagcatggaaaccgaggaaaatcctaaagtgcttatcactgctttttag

SEQ ID NO: 241188 - DNA, 1656 bp, Artificial Sequence
  Description of Artificial Sequence: Synthetic coding sequence
atgggctttgacgtgctgctggatcaggttgggggaatggggagattccagatttgcttaattgccttcttctgtatcactaatattctcctgttcccaaatattgttcttgagaactttaccgccttcacaccgagtcaccgctgctgggttcctctgttggacaatgataccgtctctgacaatgacactggaacactgagcaaggacgacctgctaagaataagtattcccttggacagcaatctaagaccacagaagtgccaaagatttattcatcctcagtggcagctgctccatctcaatggcacatttcctaataccaacgagcctgacaccgagccgtgcgttgacggttgggtctacgaccgatcttcttttttgtcaaccatcgtcactgagtgggatttagtgtgtgagtcccagtctctgaaaagcatggtccagtccttgtttatggccggtagcctacttggaggactgatttacggccatctatccgacagagtcggacgcaagatcatctgtaagttgtgttttctccagctggccattagtaacacatgcgccgcttttgcaccaacatttctggtatattgtatcctacggttcctggccggttttagcactatgaccatactcgggaacacatttattctaagtctggaatggaccttgccacgttccaggtccatgaccattatggtgttgctatgctcatactccgtcggccaaatgctgctaggcggtcttgccttcgccattcaggattggcatatcctgcaactgacagtttctacacccatcatcgtgttattcctgtcttcctggaaaatggtcgaatctgcacggtggctcatcatcaacaaccaactagatgaagggttgaaagagctccgcagggtcgctcatattaatggcaagaagaacacggaagaaacgctgaccacggaattggtgcggtctactatgaagaaagagcttgacgccgtcagaatcaagacttctatcttctccctctttagagctccaaaactcagaatgcgcgttttcggcctgtgtttcgtgaggtttgccatcacagtccccttctacggcctgatcctgaatctccagcatctaggctctaacgtaagcctgttccaaattctgtgcggggctgtgacattcactgcccgatgtgtttctcttctaactctgaatcatatgggtcgcaggatttcccagatcctgttcacattccccgtcggcctttttatcctggttaatacatttttaccccaggagatgcagatcctaagagtggtgctggctactcttgggataggctccgtaagcgcagcctcgaattccgcctctgtgcaccataatgaattggtccccaccatcctgaggtccaccgtcgccggtattaacgctgttagtggtaggaccggggctgccttggcacccttgctaatgactctcatggcctactcgccgcatcttccgtggatatcctatggagttttccctattctcgcggtgcccgtgatactcttgttgccagaaacgcgcgatctgcccctacccaacacgatccaagacgttgagaacgagaaggactctaggaatataaagcaggaggatacatgtatgaaagttacgcagttttag

SEQ ID NO: 241189 - DNA, 738 bp, Artificial Sequence
  Description of Artificial Sequence: Synthetic coding sequence
atggaggttgaagaagcattccaggcagtgggcgagatggggatataccagatgtatctctgttttctcctggcagtcctgctgcagttgtatgtggctactgaagcaattttgatcgcattagtgggggctacccctagttatcactgggacctggccgagctcctacccaaccagtcccatggcaatcagtccgctggggaagatcaggcttttggagattggctgttgacagctaacgggtcagagatccacaagcatgttcattttagctctagttttacatctatcgccagcgaatggttcctcattgctaatcgcagttataaggtgagtgcagcatctagtttttttttttccggagtattcgtgggagtgatttcatttggccagctctctgaccggtttgggaggaagaaagtgtatttgacaggattcgcgttggatattctgttcgctatcgcgaacgggttctccccatcctacgagttttttgccgtaacacggttcctggtcggcatgatgaacggcggaatgtcattagtcgcgtttgtgctgctgaacgaatgcgttggtaccgcatattgggcccttgccggtagcataggcggtctgttcttcgccgttggcattgctcagtacgcccttctgggatatttcatccggtcctggcgtacgttggctatactcgtcaacttgcaaggcactgtagtattcctcctctcccttgttgactag

SEQ ID NO: 241190 - DNA, 1644 bp, Artificial Sequence
  Description of Artificial Sequence: Synthetic coding sequence
atggaggttgaagaggcattccaggcggtaggggaaatgggaatctatcagatgtacctgtgcttccttctcgcggtgctcctccaactgtacgtggctactgaggcaattttgatcgccctggtcggggctacccccagctatcactgggacctggcagagcttttacccaatcagagccacggaaatcagtcagcaggcgaggaccaggcctttggtgactggctattaaccgcaaacggaagcgaaattcacaaacacgtgcatttttcatcctcatttactagtatagcctctgaatggtttttaatcgcaaacaggtcatataaagtttcggctgcttcatcctttttcttttccggggtgtttgtgggcgtaatctcctttggtcaattgtctgatcgttttggtcgcaagaaggtctatctgacgggtttcgctttggatatcctgtttgctatcgcaaacggcttttcaccatcatacgagttctttgccgttacaagatttctggtcggaatgatgaacggcggtatgagtctggtggctttcgtcctcctaaatgaatgtgtgggaaccgcatactgggcattagcaggatctataggaggcttattctttgcagtcggaatagcacagtacgccctgctggggtactttatcagaagctggcgcaccctggctatcctcgttaatcttcaagggaccgtggtgttcctgctatcactgttcatacccgagtccccaaggtggttgtattctcagggcagactgagcgaggccgaagaggcactgtatctgattgcgaagagaaatcgcaaactgaagtgtacattcagcctaactcatccagcaaataggagttgcagggaaacaggctcatttctggatttgttcagataccgtgtgctgctgggtcacacactgattctaatgtttatatggttcgtgtgttcactagtgtactacggcctgacattgtccgctggggacttaggtggaagcatctatgccaatctggctctgagtggcctgatcgaaatacccagttatccactgtgtatctacctgataaatcagaagtggttcggcagaaagaggaccttgtccgccttcctctgcctcgggggattggcctgtttgatcgtgatgtttctgccagagaagaaagacacaggcgtgtttgcggtcgttaacagccacagcttgagtctgcttgggaagctgactatctccgcggctttcaacatcgtgtacatttacacatcagagttgtacccgacagtgatccgaaacgtaggcctgggtacctgtagcatgttctctagggtgggtgggatcatcgccccattcatcccctccctcaaatatgtgcagtggagcctgcccttcatcgtgtttggggctactggcttgacatctggactgcttagcctattattacctgaaactctgaacagtccactattggagaccttcagcgacctacaagtctatagttatcgaagactcggggaagaggccctgtccctgcaggccctggaccctcagcaatgtgtcgacaaagaatcctcactggggtcagaatccgaagaagaagaggagttctacgatgccgatgaggaaacacaaatgatcaaatag

SEQ ID NO: 241191 - DNA, 1008 bp, Artificial Sequence
  Description of Artificial Sequence: Synthetic coding sequence
atgcccgctgtgctgggatttgaaggctcagctaataagatcggtgtgggcgtggtgagagacgggaaagttctcgccaaccccaggaggacgtacgtgacgccccctggcacaggcttcctgcctggagatacagcccgtcaccaccgcgctgtgattttggatctgctgcaagaggcactgaccgagtctggactgactagccaggatattgattgtatcgcatatacaaagggcccagggatgggcgcaccactggtctctgtggccgtcgttgctagaactgtggcccaactatggaacaagccgctcgtcggcgtaaatcactgcatcggacacatcgaaatggggaggctgatcacaggggctacatccccgaccgtattgtatgtgagtgggggaaacactcaggtcatagcttatagcgagcacagataccgaattttcggggagactattgacatcgctgtcggtaattgcctcgatcggttcgcacgcgttttgaaaatttccaatgatccttcccccggatacaacatcgagcagatggccaaacgagggaagaaactggtcgagcttccctacactgtgaaaggtatggacgtgagcttctccggcattttgagttttatagaagacgttgcacatcgcatgctagccacaggtgaatgcaccccggaagatttatgtttctcactgcaggagactgtgttcgctatgcttgtggagatcactgaacgagccatggcccactgtggcagtcaggaggcccttatcgttggcggtgtgggatgcaatgtgcgtttacaagaaatgatggccactatgtgtcaggagagaggcgctaggctttttgctactgacgagagattctgcattgacaatggggctatgatcgcccaggccggatgggaaatgtttagagccggtcaccggacaccactgagtgacagtggagtgacacagcgctatcgaaccgacgaggtggaggtgacctggagggactag

SEQ ID NO: 241192 - DNA, 1563 bp, Artificial Sequence
  Description of Artificial Sequence: Synthetic coding sequence
atggccagcgatcccatattcactcttgccccacctctccattgtcattacggggcttttccccctaatgctagtggatgggagcagccacctaatgcttcgggtgtcagcgtcgccagtgctgcactcgctgcgtccgcggcatcccgcgtagcgacttctacggatccctcttgctctggattcgccccaccagattttaaccattgcctgaaggattgggattacaatggcctcccggtgctcaccaccaacgccatcgggcagtgggatctggtatgtgatcttggctggcaggtgatcctggaacagattctgtttattcttgggttcgcaagtggatatctgtttctgggttatccagctgaccggttcgggagaaggggaattgtgctgctgaccctgggacttgttgggccatgcggcgtggggggagccgcagccggttcgtctaccggagtcatggccctgcgttttctgctgggcttcctactggctggggtcgacctgggcgtctaccttatgcggctggaactgtgtgaccctactcagcgactgcgggtggcactagccggtgagttggttggagttggcggtcattttctgttccttggcttagccctcgtttctaaggattggaggtttctgcagagaatgatcacggccccttgtatcctgttcctgttttacgggtggccaggactgtttttagaatcagcccgttggctaatcgtgaaaaggcagatcgaggaagctcaatctgtcctcagaattctggcagaacgcaacaggcctcatggtcagatgctaggtgaggaggcacaagaggcactccaggatctggagaacacttgccctctgccggcaaccagttctttcagcttcgcaagcttgctgaactataggaacatctggaaaaatctgttgatcctgggtttcaccaatttcatagcacacgccatcaggcattgttatcagcccgtcgggggaggaggcagcccgagtgatttttacctgtgcagcctcctcgcaagcggaactgccgcactggcatgtgtcttcctgggggtaacagtggacagatttgggcgtcgtggcatcctcctgctgtccatgaccctgactgggatcgcctccctggtgctgcttgggctttgggactatctgaacgaagccgcaatcacaaccttttcagtgttaggtttatttagtagtcaggccgctgcaatcctatcaactctcctcgcagctgaggttatcccaactacggtgcgcggtagaggactcgggctgatcatggcgcttggcgcactcggcggtctctcgggccctgcccagcgcctgcatatgggacacggcgcatttctccagcacgtcgtgctggcagcttgcgcccttttgtgcatcctttccatcatgctgctgcccgaaaccaagagaaaactacttcccgaggtcctgcgagatggggaactttgtcgcagaccttccctgttgcgtcagccacctcctactcgctgtgaccacgtgcctctactggcgactcccaatcccgcactatag

SEQ ID NO: 241193 - DNA, 1617 bp, Artificial Sequence
  Description of Artificial Sequence: Synthetic coding sequence
atggcatcagatcctatatttacgctggcccctcctctgcactgtcattatggcgcattccctccgaatgctagcggttgggagcagccaccaaacgccagtggcgtgagcgtggcatccgcagccctggccgcttccgctgcctccagagtggcaactagcacggacccaagctgttccgggttcgccccaccggactttaaccactgtttgaaagactgggactacaacggccttccagttctaaccacaaatgccatcggccagtgggatttggtgtgcgacctgggctggcaggtcattctggagcaaatcttattcattttggggttcgctagtggctatttgttcctgggctaccccgctgaccggttcggtagacggggtatagttctgttgacattaggcctggttggcccttgtggcgtcggaggtgctgcagctggttcttcgacaggagtgatggccctgcgctttttgcttggctttcttctggctggggtcgacctcggggtgtatctgatgaggctagagctctgcgaccctacacagcggttgcgggtagcactagccggagaattggttggcgttggaggccattttctctttcttggactcgcactggtgagcaaagactggcgctttttacagcgcatgatcactgcaccttgcattctatttctgttctacggttggcctgggctgttcctggaaagtgcacggtggctcattgtgaagcgccagattgaagaggcacagtccgttctgagaattctggccgaaagaaataggccccacgggcagatgctgggggaagaagcccaggaagcactccaggacctcgagaatacttgccccctgcccgctacatctagtttctccttcgctagtctgttgaattataggaatatctggaaaaatctcctcatcctgggttttacaaactttattgctcacgccatcaggcactgttaccaaccagtaggtggcggaggtagtccgtccgatttttacctctgctctctcctcgcaagtggaactgcagcattggcatgcgtgtttcttggtgtcacagtggacagatttgggaggcggggtattctcctgctgtccatgaccctgactggcatcgcttctctcgtgctcttaggcctttgggattgcgagcacccgatctttcctacagtgtgggctcaacagggaaatccaaatagggatctgaatgaagctgctatcaccacctttagtgtgctaggattattcagctcgcaggcagccgcaattttatcaacactcctggcagcagaggtcattcccacaactgtgaggggccgaggactgggcctaattatggccctgggcgcactcggcggactcagcggccctgcccagagattgcacatgggtcacggagctttcctacaacacgtcgtgctcgccgcatgtgccctgctgtgcatcctctctatcatgctcttacctgagaccaagcggaagctgttgcccgaagtcttacgcgatggagaactgtgtagaagaccctctctgctcagacagcccccaccaaccaggtgcgaccacgttcccctgctggccacgcctaatcctgccctctag

SEQ ID NO: 241194 - DNA, 1086 bp, Artificial Sequence
  Description of Artificial Sequence: Synthetic coding sequence
atggccatcgatagaaggcgcgaggccgcaggaggcggacccggacgccagcctgcacccgctgaggaaaacggcagtctgccaccaggcgacgcagcagccagtgcacccctgggaggtagagccggacctggaggcggagcagaaatccagccactgcctccattgcatcctgggggtgggccacatcccagctgttgctccgcggctgctgctccatccctcctgctcctggactacgacggctccgtactgccgttcctgggtggcctgggagggggttaccaaaaaacactggtgctcctgacgtggatacccgctttgtttattggcttctcccagtttagtgattctttcttgctcgatcagcctaatttctggtgtagaggagcagggaagggcacagaactggccggagtcacaaccactggtcgaggcggagacatgggaaattggacttcactgccaactacaccatttgcgacagctccttgggaagctgcagggaatcgttcaaactctagcggcgctgatggcggtgacacaccacctctgccctctccaccggacaagggcgataatgccagtaactgtgattgtcgggcttgggattacggcattagagccggactggttcaaaacgtggtgtcaaagtgggaccttgtgtgcgataacgcatggaaggttcacattgctaagtttagcctgctggtaggtcttatctttgggtatctgattaccggatgcatcgcagactgggtgggtagaaggcctgttctgctttttagcatcatctttatactcatttttgggctgactgtagccctgtctgtgaacgtaacaatgttttctacactgcgtttctttgagggcttttgcctggcaggcattatcttgaccctctatgcgctccgcattgaactgtgccctccaggcaaacgtttcatgatcactatggtggcctcttttgtggcaatggcaggtcagttcctgatgccgggtctcgctgccctgtgtagagattggcaggtgctccaggcattgattatctgcccctttctcctaatgttgctgtattggtcatag

SEQ ID NO: 241195 - DNA, 1218 bp, Artificial Sequence
  Description of Artificial Sequence: Synthetic coding sequence
atgttttctaccctccgcttcttcgaaggcttttgccttgcgggaatcatcctgaccttatatgccctcagaattgagctgtgcccccctggcaaacgctttatgatcacaatggtggccagttttgtcgctatggccggtcagttcctgatgcccggactggccgcactgtgtcgcgactggcaggtgctgcaggccctgattatttgcccgttcctgttgatgctgctctattggagtatttttccagaaagtctcaggtggctgatggctacgcagcagtttgaatccgctaagcgtctgatattgcattttacacagaagaatcgcatgaatccggagggcgatatcaagggcgtcatcccagagctggagaaagagctgagccggcgacccaaaaaggtttgtatcgtgaaggtcgtgggcactaggaatctgtggaaaaatatcgttgtcctgtgtgtgaatagcctgaccggatacgggatacaccattgctttgcacggtccatgatgggacacgaggtgaaggtaccccttctggaaaatttttatgccgattactacaccactgcaagcattgccttggtgtcctgcctggctatgtgtgtcgtggttcgctttctggggcgtaggggtggactgcttctctttatgatattaacagcgttagctagccttctgcagttgggcttacttaacctgatcggaaagtatagtcaacaccccgatagcgggatgtcggacagcgtgaaggacaaattttccattgcgttctctatagtgggaatgttcgcctcccatgccgtaggtagtttatctgtttttttctgcgctgagattacccctaccgtgattaggtgtggaggcctgggactggtcctcgcctcagctggctttggaatgctcaccgcccctattatcgaactccacaatcagaagggctacttccttcaccatatcatatttgcctgctgtaccctgatttgtatcatctgtatcttgctgttgcctgagtctagggatcagaacttgcctgagaatatttccaacggcgagcattatacaaggcagcctttgctgccccacaaaaaaggagagcagccgctgctgctcactaacgccgaactcaaggattatagcggtctccatgatgccgcagcagctggcgataccctacccgagggagctaccgccaacggcatgaaggcaatgtag

SEQ ID NO: 241196 - DNA, 2061 bp, Artificial Sequence
  Description of Artificial Sequence: Synthetic coding sequence
atggccatcgaccggagacgggaggctgccggtggaggaccaggaaggcagccggctcctgcggaagagaatggttcccttcctccaggggatgccgcagcctctgccccactaggaggcagagctggtcctggtggtggggctgagattcaaccactgccccctctgcatcctggtgggggtccccacccttcttgctgttccgcagccgcagctccttccctgcttttactcgattacgacggatctgtgctgccgtttctgggtgggctgggcggagggtaccagaagactctcgtcctgctgacctggattccggctttgtttattggttttagtcagttcagcgactcctttttgctggatcaacccaatttctggtgtcgtggagccggaaagggaaccgagctcgccggagtgaccaccaccggacgcggaggggacatgggcaactggacctcactgcccaccactccgttcgccactgccccatgggaagccgctgggaaccgtagtaactcatcaggagcagatggcggagacactccacccctgccctcccccccagacaaaggagataacgcaagcaattgtgactgtcgggcatgggactatggtattcgcgctgggttggttcagaacgtcgtttctaaatgggatctcgtctgtgacaacgcgtggaaagtgcatatcgctaagttctctctgctggtggggctgattttcggttacctgatcacagggtgcattgccgactgggtcgggaggcggcctgtgctgctgttctctattatctttatcctgatttttggcctgacagtggctcttagcgttaacgtgactatgttcagcaccctccggttctttgagggtttttgcctagctggtatcatcttgactctgtatgccctgcggatagaactatgccctccgggaaagagattcatgattacgatggtggcaagcttcgtggctatggctggccaatttttgatgccaggacttgctgcactttgccgagactggcaggtattacaggccctcattatttgccctttcctcctgatgcttctgtactggtccatctttccagagtcgctgcgttggttaatggccactcagcagttcgagtccgctaagcgactgattctacactttactcaaaaaaacagaatgaaccccgaaggggatattaagggtgtcattcccgagttggaaaaggaactttctaggagacctaagaaagtctgtattgtaaaggtggtggggaccagaaacctctggaaaaacattgtagtgctgtgtgtgaactcgctgaccggatacggcattcaccattgttttgcgcgttctatgatgggacacgaggtgaaagtgccactactggaaaacttctacgcagattattacaccactgcttccattgccctcgttagttgcctcgccatgtgcgtagtggtgagattcttggggagaagaggcggactgcttcttttcatgatactgaccgctttggctagcctcctccagctgggcctcttgaacctgattggtaagtattcacagcaccccgattctggcatgagcgattctgtcaaagacaaattttccattgctttcagcatcgttggtatgtttgcttcccatgctgtgggttcgttgagtgtgttcttctgtgccgagatcaccccaaccgtcatccgctgtgggggattagggctggtgctggcttccgctggtttcggaatgctgaccgccccaatcatagaactccataatcagaaaggatatttcctgcaccacataatttttgcctgttgcactctgatatgcataatttgcatcctgctgctccccgagtctcgcgatcagaacctccctgaaaatatctcaaacggagagcactatacgcggcaacctctgttacctcacaaaaagggcgaacaacctctcctgctgaccaatgccgagctcaaagactattctggactgcatgatgccgctgcagccggtgacacactgcccgagggagccacggccaacggtatgaaggcaatgtag

SEQ ID NO: 241197 - DNA, 1218 bp, Artificial Sequence
  Description of Artificial Sequence: Synthetic coding sequence
atgtttagcacacttcgcttctttgagggtttttgtctggccggaattattttgacactctacgccttgcggatcgaactctgtccccctggaaagagattcatgatcaccatggtggcctcatttgtggccatggcaggccaattcctcatgcccggtctcgctgcactctgtagggattggcaagtcttgcaggcgttaattatctgcccattcctccttatgctcctttactggtcgatattcccagaatcacttcgatggctcatggctacgcagcaattcgaatcagccaagaggctcattcttcacttcacccaaaagaaccggatgaaccctgagggtgatataaagggcgttatccccgaattagaaaaagagttgagtcgacgccctaagaaagtgtgtatcgtcaaagttgtgggaactcggaacctgtggaagaacattgttgttttatgtgtgaactctttaacggggtacgggattcaccattgctttgctcgatccatgatgggccacgaagtgaaggttccccttcttgagaatttttacgcagactattacacaacagcttcaatcgctctggtaagttgtcttgcaatgtgtgtggtggtgcggttcttgggccgtcgcggaggactgctgttatttatgatactgacagctctcgcttccctgctacagctgggtctgctgaacctaattgggaaatattcgcagcatcccgatagtgggatgagtgacagcgttaaggacaaattctctatcgccttctcgattgttgggatgttcgctagtcacgccgtgggctctctctccgtgtttttctgcgccgagataacaccaaccgtcatcagatgtggcggactggggctagttctcgcgtctgccggtttcgggatgctcacagcacccattattgaactacacaatcaaaaaggttatttcctgcatcatatcattttcgcatgctgtacccttatctgcattatctgcattctgctgctgcctgagtccagagatcagaaccttccagagaatatatcaaatggtgaacactacacgaggcaacccctgctgcctcataagaagggagagcaaccgttgctcctaaccaacgccgaactcaaggactactctgggttacatgacgccgcagccgcaggcgacaccctgcctgagggggcaaccgcgaacggaatgaaggccatgtag

SEQ ID NO: 241198 - DNA, 969 bp, Artificial Sequence
  Description of Artificial Sequence: Synthetic coding sequence
atgggctttgacgtgttgctcgaccaagtggggggaatgggtaggttccagatttgtctgattgctttcttttgtattaccaatattttgctgtttccaaatatagttctagaaaatttcaccgcttttacaccaagtcaccggtgttgggtccccttgctcgataatgataccgtctccgataacgacacaggcaccttatcaaaggatgatctcctgaggatctcaatccctttggatagtaacctgaggcctcagaagtgccagagattcatacaccctcagtggcagctactccatctgaatggcacatttccaaacaccaatgagcccgacactgagccctgtgtcgacggctgggtgtacgatcgaagtagctttttgagcactatcgtgacagagtgggacctggtgtgtgaatctcagtcgctcaaatctatggtgcaaagcctgttcatggccggaagccttctgggaggcctcatctacggtcatctgtccgacagggtcggcagaaaaattatatgtaaactgtgcttcctacagctggccatctccaacacttgcgcggctttcgctccgacattcctggtttactgtatcttgcggtttcttgcagggttctccacaatgactatcctgggcaatacatttatcctatctcttgagtggaccctccctagaagtaggagtatgaccattatggtcctcttatgcagctactcggtagggcagatgctgctaggcggactggcttttgccatccaggactggcatatcttgcagttgacagtgtctactcccattatcgtgcttttcctcagttcttggtacgaacagtcgccacactccctcccggtctcagaagccatggtggacatcgagcgtaagattctgacccctggcatttgctccgtgtccgggctcgtgctgtcacatgatgtccactctacgtattgtgtgacatag

SEQ ID NO: 241199 - DNA, 780 bp, Artificial Sequence
  Description of Artificial Sequence: Synthetic coding sequence
atgcgggcacaggaggacctggaggggcgaacacagcacgagacaactagagacccctcaacacctctaccaacagaacccaagtttgacatgctatacaaaatagaggatgtgcccccatggtatctttgcattttacttggctttcaacattacctgacctgcttctccgggaccatcgccgtgccttttctactcgctgaggccctttgcgtgggacacgatcagcatatggtaagtcagttgatcggtactatttttacatgcgtaggcatgttctgtactcttttcgggatgatcactgcagtcggtctgtccaatttgcagtttgtcgacatgaactctagtcggaatctgtttgttctcggcttctctatgttcttcggattgactctgccaaattaccttgagtcaaaccctggggctatcaatactggcatcctggaggtagaccaaattctgattgttttgctcactacagaaatgtttgtggggggttgcctggccttcatcctggacaacaccgttccagggtctccagaggagaggggactgatccagtggaaagctggggcacatgccaactctgacatgtcgtcctccctcaagtcatacgactttcccattgggatgggtatagttaagagaattactttcttgaagtacattcctatttgccctgtgtttaaaggatttagctccagtagcaaggaccagattgccatacctgaagacaccccagaaaatacagagacagcatcagtttgtactaaggtttag

SEQ ID NO: 241200 - DNA, 1797 bp, Artificial Sequence
  Description of Artificial Sequence: Synthetic coding sequence
atgagggcgcaggaggatctggagggtcgcacgcagcacgagacaactagagatcccagcacacccttgcctacggagccaaagtttgacatgctttacaagatcgaggatgtcccgccatggtacctctgcattctgctgggattccagcactatctgacatgcttctcaggtactattgccgtcccattcctgttagcggaagccctttgcgttgggcacgaccagcatatggtgtcacagcttatcggaacaatatttacttgcgttggaatcacaacactgattcagaccacagttggcattaggctccccttattccaggctagcgcattcgcgtttcttgtgccagcaaaggctattctggccctggagcggtggaagtgccccccagaggaggaaatctatggcaattggtccctgcctctgaatacctctcacatctggcaccctcgcatccgggaagtgcaaggggcaattatggtttcttcggtcgtggaagtcgtcatcggtctcctcggattaccgggagctctgcttaactatattggtcccctcactgtcacccctaccgtctctctgataggattaagtgtattccaggcggctggcgatagagcaggttcccactgggggattagcgcctgctccatcctgctcataatcttattttcccaatatctcagaaatctgacattcctgctgcctgtctaccgctgggggaaagggctgacattgcttcggattcagatcttcaaaatgttccctattatgcttgccattatgacagtgtggctcttatgctatgtcctgactctgaccgacgtgcttcccactgaccctaaagcatacgggttccaggcacgcacggatgccaggggtgacataatggctatagccccatggattcgcataccgtatccatgccagtgggggcttcccacggtcacagccgctgcagtgcttggaatgttttctgccacattggcaggtattatcgaatccatcggcgattattacgcatgcgccaggctggcgggagctcctcctcctcctgtccacgccatcaacagggggatattcaccgaaggtatctgctgtattatcgctgggctcctgggaactgggaatgggagcacttctagctctcctaacattggagtgctggggattacgaaagtgggaagtcgcagggtggtgcagtacggggctgctatcatgctagttctaggcaccattggcaagtttacagccttattctcttctcttccagaccccattttggggggaatgttctgtaccctgttcggaatgatcacagccgtagggctctctaaccttcagttcgtggacatgaactcaagtcggaatttattcgtgttgggattttccatgttctttggtctgacgctgccaaactacctggaatcaaatccgggagccatcaatacgggaatattggaggtggatcagatcttaatcgtgctgttaacaactgaaatgttcgtgggagggtgtctggctttcatcctggacaacacggtcccaggctctccagaagagagaggcctgatacaatggaaggccggagctcacgctaactccgatatgtcctccagcctgaagagttatgacttcccaattggaatgggaatcgtgaaaagaatcacatttctgaaatacatccccatctgtcctgtgttcaagggattctcttctagctccaaggatcaaatcgcgattcctgaggacactcccgaaaatacagaaactgcaagtgtatgcactaaggtttag

SEQ ID NO: 241201 - DNA, 1809 bp, Artificial Sequence
  Description of Artificial Sequence: Synthetic coding sequence
atgcgggcacaggaagatttagaagggaggactcagcacgaaaccacgagagaccccagcaccccactcccaacagagccgaagtttgacatgctgtataagatagaagacgtgcccccatggtacctctgtattctgctcgggttccagcattacctaacctgcttctccggtactatcgcagtcccctttttactggccgaagctctgtgtgtgggccacgaccagcatatggtaagccaattgatcggtaccatcttcacctgcgtgggcatcactactctcatccagactactgtcggcatccgccttcctctcttccaagcttccgctttcgctttcctcgtgcctgcaaaagctatcttggcactggagcgttggaagtgtcccccagaagaggaaatttacggcaattggtctttacctctgaacaccagccacatctggcatcccagaatacgcgaggtggggctgcatgtccagggcgctattatggtatcctccgtcgtggaggtggtgattggactgctcggactcccaggcgctctccttaattacatcggccctctcactgtgacaccgacggtttctttgatcggtctatcagtttttcaggcagccggtgacagggctggctcacactggggcatctctgcctgcagtatcttgttgatcattctgttttctcagtatctgcggaatctgacgtttttactacctgtctacaggtggggaaagggacttacacttctgcgcatccagatatttaaaatgtttcctattatgctggcgataatgacagtgtggttgctttgttatgttttaaccctaaccgacgtgctgcccaccgaccctaaagcgtatggctttcaggctcgaactgacgcccgaggcgacatcatggctattgctccctggattcgtataccctatccctgccagtggggtctcccaacagtgactgctgctgccgtgctgggcatgttctccgctaccctggcagggattattgagtccattggggattactacgcttgcgccagattggcaggcgctccaccccctcccgtgcacgccatcaaccggggaatctttaccgagggtatatgctgcatcatcgccggtctgctcggaaccggaaacgggagcacaagcagctctccaaatatcggcgtgctgggcattactaaagtaggttccagacgagttgtccagtacggtgctgcaataatgctggtgctgggaactattgggaagtttaccgctctgttctcttcccttccagaccccattctcggtggcatgttctgtactttgttcggaatgataacagccgtgggattaagcaacttacagttcgtagacatgaacagctcaagaaacctttttgtgctgggatttagcatgtttttcggattaaccctgcccaactatctggaatccaatcctggcgctatcaacaccggcatacttgaagttgatcagatcttgatagtgttgttgacaactgaaatgtttgtagggggatgtcttgcctttatcctcgataacaccgtgcccggatcaccagaagagagggggttaattcagtggaaggctggcgcacacgctaacagcgacatgagcagcagcttgaaatcatacgacttcccgattggtatgggaatcgtgaagagaattactttcttgaaatatatcccaatttgtcccgtgtttaaggggttcagcagttcatccaaagaccagatcgcaatccccgaagacacaccagagaacaccgaaactgcctctgtttgtacgaaagtgtag

SEQ ID NO: 241202 - DNA, 1179 bp, Artificial Sequence
  Description of Artificial Sequence: Synthetic coding sequence
atgagggcacaggaggacttggaggggcgaacacagcacgaaacaaccagagaccccagcacacctttgccgacagaacctaagttcgatatgctttataagatagaggacgtcccaccttggtatctctgcattttactgggcttccagcattatcttacgtgtttctccgggacaatagcagtgccttttctcctggcagaagccctttgcgtcgggcacgatcaacatatggtgtctcagctgattgggactattttcacttgtgtcgggatcacgacactgatccagaccacggttgggatacgactgccactttttcaagccagtgcatttgcgtttcttgtgccagccaaagccatactggcactcgagagatggaagtgtccccctgaagaggaaatttacggaaactggtcactgcctctcaatactagtcatatttggcacccgagaattagggaagttggtttgcacgtgagcatagaagaagccggtggctacatgggtgtgagggtggcggctgagtttggcgacctcagaagatggtcaagaagcttcgttcccgcaagttcgagccaggtgcagggagcaattatggtgagcagcgtggtggaagtcgtcatcgggctactagggctgccaggagctttgctgaactatataggaccactgacagtgacgcccaccgtgagtctcattggtctgtcagtgtttcaggctgccggtgaccgggctggcagtcactggggcatatcagcctgcagtattctgctgataattcttttcagtcaatatctgcgcaatttgaccttccttctgccgtgtgctcaacaaagcgctccactgtggcaggcctcgctctcaccttccgagatcactacacccgtacctgcttggctggttcaccacccactccagtacatgttatccaccggagcgtcgagcccgaaagcgtttgccgctagctctcgcggttattgggcacgggctaccgggcctcctcggcctgtccctacattggccagttgggagctaccaaggtgggctgcaggggcatggtgcagcatggttaggctttcctgttggtcatgggctccctccgcttctagcaggccgtctagccccagatcacttacaccttcatggggtgcttgtagtgcccttagcttggcatag

SEQ ID NO: 241203 - DNA, 1953 bp, Artificial Sequence
  Description of Artificial Sequence: Synthetic coding sequence
atgatggggattgggaaaaatacaacgtcaaagtcaatggaggcaggaagttcaactgagggtaaatatgaggatgaggccaagcaccctgccttcttcaccctgcccgtcgtgatcaacggtggtgcaacaagcagcggcgaacaggacaatgaggataccgaactgatggcaatatatactactgaaaacggcattgcggagaagtcatcccttgctgaaacactagattcaactggaagtttggatcctcagcggtccgatatgatttacacaattgaggacgtgccgccatggtatctgtgtatattccttggcctgcagcattacctcacgtgcttctcaggcactatagcggtccctttcctgttggctgatgccatgtgcgtgggctacgaccagtgggcaacaagccagctgatcggcactatcttcttctgtgtggggattactacgcttctgcaaactaccttcgggtgtcgtctaccactgttccaggcaagcgccttcgcattcttggccccagctcgggctattttgagcttggacaagtggaagtgtaatacaacggacgtcagtgttgcgaatgggactgctgaactcctgcacacagagcatatttggtacccacgaatccgcgaaattcagggcgctatcatcatgagcagtctgatcgaggtggtcattgggctcttaggattgcctggcgcactactgaagtatatcggaccattaacaatcacacctaccgttgccctcattggactctctgggttccaggccgctggggagcgcgctggcaagcactggggaatcgctatgttaaccatttttcttgtgctactgttttcgcaatatgccaggaacgtgaagtttcctctcccaatttacaaatcgaagaagggctggactgcatataaactgcaactgtttaagatgtttcccattatcttggctatcctcgtctcctggttgctgtgcttcattttcaccgtcaccgacgtgtttcccccagactcgaccaagtatggattctacgctcgcacagatgctcgccagggcgtgcttctggtggccccttggttcaaggtgccttacccgttccagtgggggttaccaacagtttccgcagccggagtgattggcatgcttagcgctgtcgtggcctctattattgagtccatcggcgattactatgcatgtgcaaggctgtcctgtgcaccccctccgcctattcacgcaataaatcgaggtattttcgtggaaggtctcagttgcgttttggacgggatttttggaaccggcaacggcagtaccagtagctctcctaacatcggcgtcctaggtatcaccaaggtaggctcaagacgagttatccagtgcggggctgcactgatgcttgccctggggatgattggaaagttctctgccctgttcgcgtctttgcccgacccagtgctgggagcattattctgtacactgttcggaatgatcacagccgtggggctctctaatttgcagtttatcgaccttaacagttctaggaacctcttcgtgctggggttctctattttctttggactcgtgctaccaagttatcttcgacagaaccccctcgtaaccggtataacgggcatcgaccaggttctcaatgtgctgctcaccacagctatgttcgtgggcggatgcgtggcatttattctagacaataccattcctggtaccccggaggaacggggtatcagaaagtggaagaagggggtggggaagggaaacaagagtctcgatggaatggagtcctacaatctgccttttgggatgaacattatcaaaaagtaccggtgtttttcttatctgccgatcagccctacctttgtagggtatacttggaaggggctcagaaagagtgacaacagccggagcagcgacgaagatagccaggctactgggtag

SEQ ID NO: 241204 - DNA, 1953 bp, Artificial Sequence
  Description of Artificial Sequence: Synthetic coding sequence
atgatgggaattggtaagaatacaactagcaaatcaatggaggcagggtcgtcgaccgagggaaaatatgaggatgaggccaagcaccctgccttcttcaccctgccagtcgtgattaatggcggtgcaacaagctccggtgagcaggacaacgaggacactgagctgatggcaatttataccactgagaacggaatcgctgagaaaagctccttagcggagacactggatagtacaggatctctggatccccaacggagcgatatgatatacaccatcgaggatgtgcctccatggtacctctgtattttcctgggcttacagcactacctgacctgtttttccgggaccattgccgtgcccttcttgctcgcagacgctatgtgcgtgggctatgatcagtgggccacatcacagttaattgggaccatctttttctgtgtaggtatcaccactttactccagactacattcggttgccgtctccccctgtttcaagcttctgccttcgccttcctggccccagcgagagccattctgtccctggacaagtggaagtgcaatacaacggatgtgtctgtcgctaatggaacggctgagttgctgcataccgagcacatctggtacccccgaatcagagagatccaaggggctatcatcatgtcctctctgattgaggtcgttatcgggctgttagggctgccgggagccctcctgaagtacatcggccctctgacgataacacctaccgtagctctcataggtctgagtgggttccaggcagcaggggagcgcgcaggtaagcactgggggattgcaatgttaacgattttcctggtcttgctcttctcacagtacgctagaaatgtcaagtttcccctgccaatctataaaagcaagaagggatggacagcttacaagttgcaactatttaaaatgtttccgattatactcgcaatcctggtttcgtggttgctgtgttttatcttcaccgtcaccgacgtgttcccccctgactccactaagtatgggttctatgccagaaccgacgcacggcagggtgtgttgctagtagcaccgtggttcaaggtcccgtatccatttcagtggggcttaccaactgtcagtgccgcaggcgtgatcggtatgctgagcgccgtcgtggcaagcattattgagtcgatcggtgattactacgcttgcgccaggctgagctgtgccccacctccccctatccatgcaattaaccggggaatctttgtagaaggtttaagttgcgttctggacgggatctttggaacaggcaacggatcaacatccagcagtcctaacatcggggtgcttggcattactaaggtggggtctagacgggtgattcaatgtggtgccgcactcatgctggccctaggaatgatcggcaagttcagcgccttatttgcaagtctgcctgatccagtcttgggggctctattctgtaccctgttcggaatgatcacagctgttgggctgagcaacttacagttcatagatctgaactcctcaaggaacctatttgtgctgggattcagtatatttttcgggctggttctgccgtcctaccttagacaaaaccctctagttacaggcatcacagggattgaccaggtgctcaatgtgctcctgactaccgccatgtttgttggcggatgcgtggcattcattttggacaatactattccagggacgccggaggagaggggaataaggaaatggaagaagggcgtaggaaagggaaacaagagccttgacgggatggaaagctacaacttgccctttggcatgaatatcatcaagaaataccgctgtttttcatacctgccaatctcacccacctttgtaggttacacttggaagggcctgcgaaaatcggacaattcccgttcctcagacgaagatagccaggctaccgggtag

SEQ ID NO: 241205 - DNA, 915 bp, Artificial Sequence
  Description of Artificial Sequence: Synthetic coding sequence
taaggctacgaccaatgggccacctcccagctgattgggacaatctttttttgcgtgggaatcacaacactgctgcagactacttttggatgtcgcacgatatttttggttctcctgttctcccagtatgcaagaaatgttaagttccctcttccaatctataagagtaaaaaaggctggactgcgtacaagttacagctgttcaagatgtttcccataattctcgccattctggttagttggctgctctgttttattttcactgtaactgatgtcttccctcctgactccacaaagtacggcttctacgcacggacggacgctagacagggcgtgcttctggtggccccttggtttaaggtgccttaccccttccagtggggtctgcctaccgtgagcgccgctggagtgattggaatgctgagtgcagttgtggcatccattatcgaatccattggcgactactacgcatgcgcgcgtctgagctgcgccccacctcccccaattcacgctatcaaccggggaatcttcgtcgagggacttagctgcgtgctcgatggcatattcgggacgggaaatggcagcacctccagcagtcctaacatcggcgtgctgggaatcactaaggtgggctcccggagagtgatccaatgcggagctgcgttgatgttggctctgggtatgattgggaagttttccgccctattcgcttctctgccagatcctgtgctaggcgctctgttctgcacgctgttcggaatgatcaccgccgtcggcctgagtaacctccagtttatagatctgaactccagcagaaatttgtttgttttgggctttagcatatttttcgggctggtgctcccctcatatctaaggcagaatccactagtgactggaattacaggtatcgactag

SEQ ID NO: 241206 - DNA, 1611 bp, Artificial Sequence
  Description of Artificial Sequence: Synthetic coding sequence
atgatggggatcggaaagaataccacctcaaagtctatggaggctgggagctctacagaaggaaaatatgaggacgaagcaaagcacccggcttttttcactcttccggtggtgattaacggaggggcaacatctagcggagagcaggacaatgaggacacagagctaatggccatctacacaactgaaaatggaattgccgagaagtcatctctggctgagaccctcgattcaacaggaagcctggatccccagcgcagtgatatgatttatacaatcgaagacgtcccaccctggtatctctgcatctttctgggcctgcagcactacctgacctgctttagtggcaccattgctgtaccttttctcctggctgatgccatgtgtgtgggatatgaccagtgggccacctcgcagctgattggaactattttcttctgtgtcggcatcactacactcttgcagaccactttcggctgccgcacgattttcctggttctgctctttagtcagtatgctaggaatgtgaagttccctctccccatatacaaaagcaagaaaggatggactgcttacaaactgcagctgtttaaaatgttccccattatcctggcaatattggttagctggctgttgtgcttcatatttaccgttaccgatgttttcccccctgacagcaccaaatatggattttacgcaaggactgacgcacgccagggggtcctgcttgtggccccatggtttaaggttccctatccatttcaatggggactcccgacagtgagcgccgctggtgtaattggtatgcttagtgcagtggtagcctcaatcattgaaagcatcggcgattattacgcttgcgcccgactttcatgtgctcctcctccacctattcacgccatcaacaggggtatatttgtcgaggggctgagctgcgttctggacgggatatttggcactggaaacggatctacaagttcgagccccaatatcggtgtgctgggtattacaaaggtagggagccgccgtgtgatacaatgtggggctgcgcttatgctcgctctaggcatgattggaaaattctcggctctgttcgcatctctgcctgatcctgtgctgggcgcactgttttgcacgctgttcgggatgattactgctgtaggcctgagtaacctgcagtttattgacctcaatagctcacggaacctgtttgtcctaggttttagcatcttcttcggactggtactcccctcatatttgaggcagaacccactcgtcacgggtatcaccggcattgaccaggtgctgaacgttcttctaactaccgccatgttcgttggtggctgcgtggcctttattctggataacaccatacccggtactcccgaggagagagggataaggaaatggaaaaagggtgtcggtaaggggaacaaatctctggatggcatggagagttacaatctgcctttcgggatgaacatcatcaagaagtatcgttgcttctcctatttgcctatcagtcccacattcgtaggctatacctggaaggggctgcggaagagcgataattcccggagctctgacgaagacagccaagccacaggctag

SEQ ID NO: 241207 - DNA, 3300 bp, Artificial Sequence
  Description of Artificial Sequence: Synthetic coding sequence
atgggcaaactgataagaatgggcccacaggagcggtggttattgcgtacaaaaaggctccactggtcacgcttgttgtttctccttggtatgttgatcatagggagcacgtaccagcatctgcgccgtccccgaggcctatcctcactgtgggccgcagtgagcagccaccagccgatcaagttggcatccagagatctgtcaagtgaagagatgatgatgatgtctagctctccttccaagccttccagcgagatgggcggaaagatgctagtccctcaggcatcggtcggctccgatgaggctacgttgtccatgacagtggagaacatcccaagcatgcccaagaggaccgcgaagatgattccgactaccaccaagaataactattccccaacagccgctggaactgaacgcagaaaagaggacacgcccacctcatctcgcaccctgacctactatacctccacatccagcaggcagatagtcaagaagtatactccgacaccacgcggtgagatgaagagctatagcccaactcaagtgcgggagaaggttaaatatactccctcaccacgcggacggagagtcggtacatatgtccctagtacgtttatgactatggagacatcacatgcgatcaccccgagaacaaccgtgaaggatagcgacatcacagcaacatataaaatcctcgaaacgaacagcttaaagcgtatcatggaagaaacaaccccaaccacgttaaaaggtatgtttgattcaacccccacgttcttgacccacgaagtggaagcgaacgttctgactagtcctcgtagtgtaatggaaaagaataatctgtttcccccacgtcgagtggaatctaactcatctgcccatccttggggactcgtggggaagagcaacccgaaaactcctcagggcacggttctgctgcacacccctgcgactagcgagggccaagtaacaatctccaccatgaccggttcctctcccgcagagaccaaggctttcaccgccgcatggagcctccgaaatccgtcccccagaacatccgtgtccgcaattaaaactgcccctgctatcgtgtggagactagctaagaaaccaagtacggcgccttcaaccagcaccactcctacagtgagggccaaactaacaatgcaggtgcaccactgcgtcgtggtcaagcccacaccagctatgctcaccacgcctagcccctcactgacaactgcactgctgccagaggagctgagcccatcaccttctgtgctgccaccttctcttccagacttacatccaaaaggagagtaccctccagacctgttctccgttgaggagaggaggcagggatgggtggtgctgcatgtctttggaatgatgtatgtgttcgtggccttggcaatcgtctgtgacgagtacttcgtgcccgcactgggcgttatcacggataagttgcaaatctccgaagatgtcgccggagcaacctttatggcagctggcggttccgcacccgaactgttcaccagcttaataggtgtcttcatatcacattccaacgttggaattgggactattgttggctccgcagtttttaacatcctgtttgttataggcacctgcagtctgttctcgcgggaaattctaaatcttacatggtggccattgtttagagacgtgagtttttatattctggacctgattatgctgattctatttttcctcgatagcttgatagcttggtgggagtctctgcttcttttgttggcatatgccttctatgtgttcaccatgaagtggaacaagcatattgaggtctgggtcaaggagcagctcagtcgacggccagttgctaaagtgatggctctcgaagatctgagcaagcccggagacggggctattgctgttgatgaactgcaggacaacaaaaaactaaaactgcccagtcttctaacacgcggatccagctccaccagccttcacaattccacaattcgcagtacgatctaccaactcatgctgcattcattggaccccctgcgcgaggtgcgattagctaaggagaaagaggaggagtcattaaatcagggagcgagggcccagccacaggctaaagcagaatcgaagccggaggaggaggaaccagccaagctgcctgccgtgactgtgactcccgcaccagttccagacattaagggggatcagaaggaaaaccctggcggtcaggaggatgttgccgaggccgagtccacaggggaaatgcccggagaagaaggcgaaactgctggcgaaggcgagacagaagagaaatcaggaggcgagactcagcctgaaggagaaggtgaaacagagacacaaggcaagggagaggaatgtgaggacgaaaacgaggccgagggaaagggcgataacgaaggcgaagacgaaggtgagatccatgctgaggatggtgaaatgaaagggaacgagggcgagacagagtcacaagagctgtccgccgagaaccatggggaggccaagaacgatgagaagggggtggaagacggtggcggttccgacggcggagattccgaagaagaggaggaggaggaagaagaacaggaggaggaagaagaagaggaagaacaagaggaagaggaggaggaggaggaagaggaggaagagaagggcaatgaagagcccttgtccctagactggccagagaccaggcagaagcaggcaatttacctatttttgttgcccatagtgtttcctttatggttaaccgtacccgacgtgcgaagacaggagagtcggaaattcttcgtgtttacattcctgggatcaatcatgtggattgctatgttcagttaccttatggtttggtgggcacatcaggtgggtgaaactattggcatttcggaggagattatgggcttaaccattctagccgcaggcacgtctatccccgatttgataacatcagtgattgtggctcgaaagggattgggggacatggcagtcagctcctctgtgggctccaatatattcgatatcacggttggactgcctgttccatggcttctcttctcactaatcaacggactgcagccagtccccgtgtcttccaacgggctcttctgtgctattgtgctcctgtttctcatgctcctgtttgtgatcagtagcatcgctagctgtaaatggcgcatgaacaagatcctaggcttcacaatgttcctgctttatttcgtgttcctgatcatctctgtgatgctggaagatcgcattatatcttgccctgtctcagtgtag

SEQ ID NO: 241208 - DNA, 3246 bp, Artificial Sequence
  Description of Artificial Sequence: Synthetic coding sequence
atgggcaagttgatccgaatggggcctcaggagaggtggctactgcgcaccaagaggctgcactggagcagactgctgttcctactcggtatgctgattatcgggtcaacttaccagcacctgcggagacctcgaggcctttcgtctctttgggctgccgtgtcttcccatcagccaattaaattagcatctagagacctcagcagcgaagagatgatgatgatgagctcaagcccttccaagccaagctccgaaatggggggaaaaatgttggtaccacaagctagtgttggaagtgatgaagccactctgtccatgaccgtggagaacattccctccatgccgaaacgcaccgctaaaatgatccctactactacgaaaaacaactatagcccaaccgccgcagggactgagcgacgcaaggaggacacgcctacttcatcacggactctcacatattacaccagcacctcctctaggcagattgtgaagaaatatacaccaactcccaggggagaaatgaagagttattcacccacccaagtgagggagaaagtgaagtatacgccaagccccagaggccgacgcgtggggacatatgttccaagcacatttatgacaatggagactagccatgccatcaccccaaggaccaccgtgaaagactcagacatcacggctacctacaagattctggagactaatagtttgaagcggatcatggaggagacaacacccacaacgcttaaggggatgtttgactctacacccacatttctgacacatgaggtggaagctaacgtgctgacctcacctcgaagtgttatggagaagaataatctctttccccctagacgcgtcgagtcaaactcgagcgcccatccatggggactggtgggaaagtctaacccaaaaactccacagggcacagtgctcttgcacaccccagccactagcgaggggcaggtgaccatcagcacgatgacaggatcgagtcctgctgaaacaaaggcctttacagcagcatggtccctcaggaaccccagcccacgcacctctgtcagcgctatcaaaactgctcctgccattgtatggaggctggccaaaaaaccttctacagctccttccacatctacgacacccactgttcgtgccaagctgaccatgcaagttcaccactgcgtagttgtcaagcctacgcccgcaatgttgactacaccatcaccctctctcactacggctctgctccctgaggagctctctccttctcccagtgttctccccccaagcctgccagatctccaccccaaaggagagtatcctccggatctgtttagcgttgaggagcgtagacaaggctgggtcgtgctccatgtatttgggatgatgtacgtgttcgtggctctggcaattgtgtgtgacgagtacttcgtccccgcactaggagtgattacagacaaattacagatcagcgaagatgttgcgggagccacctttatggctgccggtgggagcgccccagagctctttacttcactcattggagtttttatctctcactcaaatgtcggtattggcaccatcgtggggtccgcagtgttcaacatcctcttcgtcatcggaacttgcagcctgttttcgcgcgaaattctgaacctaacatggtggccactgttccgagacgtgagcttttacatcctcgacttgatcatgttgattctgttcttcctcgattcactgatcgcctggtgggagagcttgctgctattactcgcttatgctttctatgtcttcaccatgaaatggaataaacatatcgaggtgtgggtgaaagaacagctgagcagacggccagtagccaaagttatggcactagaagatctatctaagttgccctcacttctgacacgagggtcttccagcacatcgcttcacaacagtacaattcggtccacaatctatcagctgatgctccatagcctggacccgcttcgcgaagtcagactggccaaggaaaaagaagaagagagcctgaatcaaggagcccgtgcccaacctcaagccaaagcggaaagtaagccggaagaggaggaacccgcaaagctaccggcagtcaccgtgacgcctgctcctgtccctgatattaagggggaccagaaggagaaccctggtggccaggaagacgttgctgaggcagaaagcaccggcgaaatgccgggtgaggagggggaaacagccggtgagggagagactgaggaaaaaagcggaggcgaaacccagccagaaggcgagggggaaaccgagactcaagggaagggtgaggagtgcgaagacgagaacgaagctgaaggtaaaggcgataatgaaggcgaagacgaaggcgaaatacatgccgaggacggcgagatgaagggaaatgagggggagacagagtcacaggagctcagcgccgagaatcacggcgaagctaaaaatgacgagaagggcgtggaggacggcggtggttcagatggcggagactctgaagaagaggaggaagaggaagaagagcaggaagaagaggaagaagaggaggaacaagaggaggaggaggaggaggaggaggaggaagaggagaaaggtaatgaggagccactcagcttagactggccagagacccgccagaaacaggcaatctacctgtttctcctgcctatcgtgtttcctttgtggctgacggtaccagacgtccggagacaggagtccaggaagttcttcgtgtttacttttttaggcagcataatgtggattgccatgttctcttacctgatggtatggtgggcccaccaggtgggagaaactatagggatttccgaggagattatgggcctgaccatcctagcagctggaaccagcatcccggatttaatcacatctgtgatagtggccaggaagggtttaggtgatatggccgtcagctcaagcgtcggcagtaacatttttgatataaccgtgggcctacccgtgccttggctgttattctctctgatcaatgggctacagccggtacctgtttccagcaatgggctcttttgcgcaatcgttctcctgtttctgatgctgctgttcgtcatatcctccatcgcctcttgcaagtggcgtatgaacaaaattcttggctttacgatgtttctgctctattttgtgttcctcatcatttcagtaatgcttgaggacagaattatttcgtgtccagtctctgtgtag

SEQ ID NO: 241209 - DNA, 3210 bp, Artificial Sequence
  Description of Artificial Sequence: Synthetic coding sequence
atgggaaagttgatccgaatgggcccacaggagagatggctcttgcgtactaaaagactgcattggtcaagactgctgttcctcttggggatgctgattataggttccacttatcagcatttaaggcggccaaggggattatcatctctgtgggccgctgtgtcctctcaccagcccataaagctggcctccagggacctgagctccgaggagatgatgatgatgtcttcctcccccagcaaaccatcaagtgaaatgggagggaaaatgctggtgcctcaggcaagtgtcggatccgacgaagccacactgagtatgaccgtggaaaacatccctagcatgcctaaacggaccgctaagatgatccccactactactaaaaacaactatagtccgacagctgccggaacggagcgaagaaaagaggatacaccaacaagttctcgcaccctgacctactacaccagtacatccagcagacaaatcgtgaaaaagtacaccccaacacctagaggggagatgaagtcttattcccctacgcaggtccgcgaaaaggtgaaatataccccttctccgcgtgggagacgagttggcacctacgtcccttctacctttatgaccatggagacatcccacgcgataacccctaggaccacggtaaaagatagtgatatcacagctacatacaaaattctggagacaaactcactcaagaggattatggaagaaaccacgcccaccacactgaagggcatgttcgacagtacgccaacttttctgacccacgaggtggaagccaatgtgttgacatccccacgctcagttatggaaaagaataacctgttcccaccacggagagtagaaagtaactctagcgctcacccctggggtctggtggggaagtccaaccctaagactccacaaggcaccgtcttgctccacaccccagccaccagcgagggccaggtgactatcagcacaatgacaggctccagccccgctgagaccaaggctttcactgcggcatggagtttgaggaatccctcccctagaacgtccgtgtccgcaatcaagacggcgcctgctatcgtgtggagactcgctaagaagccctcgactgctccatcaacaagcacaactccaaccgttagagctaagctaacaatgcaggttcatcattgtgtggtggtgaagcctacgcctgccatgctgactacccctagccctagcttaacaactgccctgctccccgaagagttatcccctagtccatcagtgttgcccccatctttaccagatctacatcctaagggagagtatccccctgacctatttagcgtcgaggaacgacggcagggttgggtcgtattgcacgttttcggtatgatgtacgtcttcgtggcattggccatcgtgtgcgatgagtatttcgtacccgcactgggcgtaatcactgacaaactgcagatcagtgaagacgtggctggtgccacctttatggccgctggcggttccgcgccagaactgttcacatcactgattggcgttttcataagccactctaatgtggggatcggaactatagttggctccgccgttttcaatatcctgtttgttatcggtacatgcagcctcttttctcgggagattttaaatcttacatggtggcccctgtttcgggacgtatctttttatatcctagatctcatcatgctcattctgttcttcttagatagcctcatcgcatggtgggagagcttactactactgctggcttacgccttctatgtgttcactatgaaatggaacaagcacatcgaggtttgggttaaagaacagctgtcccgcaggccagtcgctaaggtgatggcgttagaggaccttagtaagcccggagatggcgctatcgcggtcgacgaactgcaggacaataaaaaactgaaactaccctcactattaaccaggggttcaagctcgacgtctttacacaacagcacaatccgctccacaatataccagctgatgttgcactcccttgatccacttagggaagtccgcttagccaaggagaaggaggaggagtctctgaaccagggagcccgagcccagcctcaggcaaaggcagaaagtaagccagaagaggaagagcctgccaagctcccagcagtcactgtgacccctgcacctgtcccggacatcaaaggagaccagaaggagaatccaggaggccaggaagatgttgctgaggcagagtcaacaggagaaatgccaggggaggagggcgagaccgcgggtgagggcgagaccgaggagaagtctggcggtgagacccaaccagaaggcgagggagagaccgagacacagggaaaaggagaggaatgtgaagacgagaatgaggctgagggaaaaggggacaacgagggcgaggacgaaggtgaaatccacgccgaagacggcgagatgaagggtaatgagggcgaaacagagagccaggagttaagcgccgagaaccacggcgaagcgaaaaacgatgagaagggcgtggaggatgggggaggttctgacgggggagactcggaagaggaagaagaagaggaggaagaacaagaggaagaagaagaggaggaggagcaagaggaggaggaggaggaagaagaggaagaggaagagaaaggaaacgaagaaccactttccctggactggccagagacaagacagaagcaagctatatacctgttcctgctgcccatagtgttccctctgtggctaaccgtccctgacgttcgaagacaggtcggcgagactataggtatctcagaggagatcatgggtctgactattctggccgctggcaccagcattcccgatctgattaccagcgtgatcgtggcaagaaaaggtctcggggacatggcggtaagcagttcggtggggtctaacattttcgatataactgtgggcttgccagtgccctggctcctcttctcactcatcaacgggcttcagcccgtgcccgtgtcctcaaacggtttattttgtgctatagtgctgctcttcctcatgctgctttttgtgatctcctcgatcgcttcctgcaaatggcgcatgaacaaaatcctgggtttcaccatgttcttactatattttgttttcctgatcatcagcgtgatgctcgaagatcgtatcatctcatgcccagtctcagtgtag

SEQ ID NO: 241210 - DNA, 3246 bp, Artificial Sequence
  Description of Artificial Sequence: Synthetic coding sequence
atgggaaaattaatccgtatggggccacaggaacgctggctgctaaggaccaagaggctccattggtcccgtctgttatttctccttggcatgttaatcatcggcagtacatatcaacatttgaggagacctcgaggacttagctctctgtgggccgctgtgagtagccatcaacctataaagttggcgagtcgagatctaagttcggaagagatgatgatgatgtcaagcagcccatcgaaaccaagttccgagatgggtggcaagatgttggtgcctcaggcaagcgtcggctcagacgaggccaccctaagtatgacggtggaaaacatcccgtccatgcctaagagaactgccaaaatgatccccaccaccaccaaaaacaactattcacctaccgcggcaggaaccgagagaagaaaagaggacaccccgacatcgagccggacccttacctactacactagtacatcatccagacagattgtgaagaaatacacacccacgcccaggggcgaaatgaagagctattctcccacccaggtgagggaaaaggttaagtacactccctcccccagaggacggcgtgttggaacctacgtgccttcgacatttatgaccatggaaacctcacatgctattaccccccgaacaacagtcaaggatagcgacattactgcaacatataagatactggagacaaatagtcttaagcgtatcatggaggagacgacgcctaccacgttgaaaggtatgtttgactctactcctacctttctaacccacgaggtggaggcgaacgtgttaacctccccaagatctgttatggaaaagaataaccttttcccaccccgtagagtggagtctaatagctccgcccacccttggggcctggtggggaagtcaaatccaaaaacgccccagggaacagtgctgctgcacacaccggcaacatctgaaggacaagtcacaatttctactatgactgggagcagtcccgctgaaaccaaggcctttaccgcagcatggtcacttcggaatccaagtcctagaacaagcgtgtccgcgattaaaacagcgcctgctattgtgtggaggctggcgaaaaaaccttctactgcaccttcaacctctaccacccccaccgtgagggccaaactcaccatgcaggttcaccattgcgtcgtagtcaaacctactcccgctatgctgaccactccctctcctagccttactacagcattgctgcctgaagagctgagccctagcccttcagtgctgccacctagcctcccagatctgcatccaaagggcgaatatcctcccgacctcttctcagtggaagagagaagacagggctgggttgtgctccatgtatttgggatgatgtacgtgttcgtggccttggcaattgtgtgcgacgagtatttcgtgcccgcacttggagtgattaccgacaagttgcagatatctgaggatgtggcaggagccactttcatggcagccggaggttcagctcccgagttattcacatctctaataggggtgttcatctcccattcaaacgtcggcatcggaacaattgtaggaagcgccgtctttaatatcctgtttgttattggcacctgttccctcttcagcagagaaatcctgaatctgacatggtggccactctttagagacgtgtcgttctacattctggacctcatcatgctgatccttttcttcctcgactccctgatcgcctggtgggaaagcttattgctgttacttgcctatgccttctacgtttttactatgaagtggaataagcatatagaagtctgggtaaaggagcaactgagcaggagaccagttgctaaggtgatggcgctggaagacttgtctaagttaccatcattgctgacgagggggtcatcctctacttccttacacaactcaacaattagaagtactatttaccaattgatgctgcacagcttagacccgctgcgggaggtccggctggctaaggagaaagaggaggagtctttgaatcagggggctcgggctcaacctcaggcgaaagcggaatccaagcctgaagaggaagaacctgccaagctgccagcagttaccgtaaccccggcaccagtaccggacattaaaggcgaccagaaggaaaaccccggtggccaggaggatgtggcagaagccgagagcaccggagaaatgccaggagaggaaggcgaaaccgcaggggagggcgaaacggaggaaaagtcaggcggagaaacccaacccgagggcgaaggtgagaccgagacccagggtaaaggagaggagtgcgaagacgagaacgaggcagagggaaagggcgacaatgagggcgaagatgagggggaaattcatgccgaggatggggaaatgaagggaaatgagggcgagacagagagtcaggaactgtccgctgagaatcacggagaagctaaaaatgacgagaaaggtgttgaagacggaggcggtagtgacggtggagacagcgaagaggaggaggaagaggaggaagaacaggaggaggaagaggaagaagaggaacaggaagaggaggaagaggaagaggaagaggaggaggaaaaaggaaatgaagagcctctgagtcttgactggccagagactcgacagaagcaggcaatttacttatttcttttgccaatcgtgttcccattgtggctcacagttccggacgtgaggaggcaggaatctcggaaatttttcgtgttcactttcctcgggagtattatgtggattgcaatgttctcctaccttatggtctggtgggcacaccaggtgggtgaaacaattggaatctccgaagaaattatggggctcaccattctcgccgctggaacgtctattcccgatctgattactagtgtgatcgtggcgagaaaaggtctgggcgacatggctgtgtctagtagcgtcggctcgaatatcttcgatattactgtgggtcttccagtgccttggctgctgtttagtttgatcaatggcttacaaccagttcctgtgagcagtaatggactgttttgcgccattgtcctactatttctcatgctcctgtttgtgatatcaagcatcgcatcgtgtaagtggcgaatgaacaaaattctcggctttaccatgtttctgctctactttgtctttttgatcatttccgtgatgctggaagatcggattatctcttgccccgtgagcgtctag

SEQ ID NO: 241211 - DNA, 1935 bp, Artificial Sequence
  Description of Artificial Sequence: Synthetic coding sequence
atggatctgcagcagagcactactattacatctcttgagaagtggtgtttggacgaatctctctccggctgtcggagacattattctgtgaagaaaaaactgaaactcatccgagtgttggggctgttcatgggactggtggccatcagtaccgtatccttttctattagcgcattctcagaaactgacactcaatctactggggaagcctccgtggtgtccggcccacgcgtggcccaggggtaccaccagcggaccctcctggatctgaacgataagatcctagactacacacctcagcctcctttgtccaaggagggggagtcggagaactccacagatcatgcccagggcgactaccccaaggacatctttagcttggaggaaagaagaaagggggcaatcattctgcacgtcattggcatgatatacatgttcatcgccctagcgattgtctgcgacgagttcttcgtgccaagtctgacagttattactgagaaactggggatctctgacgatgtggccggagccacttttatggccgctggcggatccgctcccgagctgtttacatctctgatcggagttttcatcgcccactctaatgtggggattggaactatagttgggtcagctgttttcaacattctattcgtgattggaatgtgcgctttgttttcacgggaaatcttgaacctgacctggtggcctctctttagagatgtgtctttctacattgtcgacctaattatgcttattatcttcttccttgacaacgttatcatgtggtgggagtccctgctgttgcttactgcatacttctgttatgtagtgttcatgaaatttaatgtccaagtggagaaatgggtcaagcagatgatcaaccgcaataaggttgtgaaggtgacggctcctgaggcgcaggccaagccttctgcagcccgagacaaagatgagcctaccctgcctgcaaagccgaggttgcagaggggaggctcctccgctagcctccacaattcacttatgaggaactccatattccaactaatgatccacaccctagacccactcgcagaaggccgattccgggagaaagcctctattctccataagatcgcaaagaagaagtgccacgtggacgaaaacgaacgtcagaatggagctgccaaccatgtggagaaaatcgagttgccaaattcaacctccaccgacgtggagatgaccccctcctcagacgcctcagaacctgtgcagaacggtaatctaagtcacaacattgagggcgcagaggcccagactgcagatgaggaggaggatcaacccctgagtctggcatggccctccgaaacacggaaacaagtgacgtttctgattgtgtttcccattgtgttcccactatggatcactctgccagacgtgaggaaaccttcgtcgagaaagtttttccctatcacctttttcggctcaatcacttggattgctgtgttcagttaccttatggtatggtgggcccaccaggtcggggaaacaattggaatttcagaagaaataatgggacttaccatactagccgcaggcactagcatacccgatctcatcacatcagtgatcgtggcgagaaaagggctgggagacatggctgtttcatcaagtgtcgggtccaatatctttgacattacagtggggctgccactgccctggctgctctacaccgtcatccatcgctttcagccggtggcggtgagttccaatggtctgttctgtgcaatcgtcctgttatttataatgctgctgtttgttattttgagcattgccctctgcaagtggcgtatgaataagattctgggatttattatgttcggcctctactttgtctttttggttgtgtccgttctgctggaggatcgtattctgacctgtccggtgtcaatctag

SEQ ID NO: 241212 - DNA, 1986 bp, Artificial Sequence
  Description of Artificial Sequence: Synthetic coding sequence
atggacttgcagcagtccacaactataacaagcctcgagaagtggtgcctggatgagagcctgagcggctgtagacgacactatagcgtgaagaagaagcttaagctaattagagtgttggggctgtttatgggacttgtcgcaataagcacagtgagctttagcatatcagctttcagcgagaccgacactcagagtaccggcgaagccagtgtggtgagtggtccgagggtcgcgcaaggctatcatcagagaacactcctggacctgaacgataaaatcctagactacaccccacagcctcccctgagtaaagaaggggagtcagagaacagcactgaccatgcccagggggactacccaaaggatatttttagtcttgaggaaaggcgaaagggtgcaattatcttacacgtaatcggtatgatttacatgtttatcgcccttgcaattgtttgtgacgagttcttcgtacccagcctgacagtgatcaccgaaaaactgggcatatctgatgatgtggcaggtgccacattcatggccgctggcggatcagcccctgaactgtttacaagtctgattggagtttttatcgcccactctaatgtaggcattgggacgatcgttggatcagccgtgttcaatatcctgttcgtcatcggcatgtgtgcgctgttctctcgcgagattcttaacctgacatggtggccactgtttcgagatgtgagcttctacattgttgacctcatcatgcttatcattttcttcctagataatgtcattatgtggtgggagagcctccttcttttaaccgcctatttctgttatgtggtatttatgaagtttaatgttcaggtcgagaaatgggttaagcagatgataaatagaaataaggtggtgaaggtaacagcgccagaggcccaggcaaaacctagcgccgcaagggacaaggacgagccaacacttcccgcaaagccaaggctgcagcgaggtggttctagcgcttcccttcataactcacttatgaggaacagcatatttcaactgatgattcataccctcgaccccttagccgaggagctgggatcttacggcaaacttaagtactacgacacgatgaccgaggagggcagattccgagaaaaagccagcatcttgcacaagatcgctaaaaagaaatgtcacgtggacgaaaatgagcggcagaatggcgcagccaaccacgtcgagaagattgagttaccgaactctactagcaccgacgttgagatgactccaagctcagatgcctcagaacctgtgcaaaacggtaacttgtcccataatatcgagggtgcggaggcgcagaccgccgacgaagaggaggatcagccactttcattggcctggcccagtgaaaccaggaagcaggttactttccttatcgtcttccccatcgtgttcccattgtggatcacacttcctgatgtcaggaagccatcttcacgcaaattctttcccatcactttcttcggatctatcacttggatcgctgtgttctcttatttgatggtgtggtgggctcatcaagttggagaaacgataggtatcagtgaagagattatgggtctcacaattctcgccgcaggcacatccatccctgacctcattacatccgtgattgtcgcgcgtaaaggccttggcgatatggctgtgagctctagcgttggctctaacatatttgatatcaccgttggcctccctctgccttggctgttatacaccgttattcaccgattccagccggtagccgtcagttctaatgggttgttttgtgccatcgttttgctcttcataatgctgctatttgtcatattatccattgcactctgtaaatggcgcatgaacaagatcttaggcttcatcatgtttggactctattttgtcttcctggtagtgtcagtactgctcgaggatagaattctgacatgcccagtaagtatctag

SEQ ID NO: 241213 - DNA, 1935 bp, Artificial Sequence
  Description of Artificial Sequence: Synthetic coding sequence
atgcggccaagcggggatgaagacagagccaggcggcgacggaggcgaagaaggaggcgcgaccttttgctcagtcagctttgctttctggccagtgtggctcttctgctgtggtccctgtccagtctgcgcgagcagaaagaacttgacctgatggatctagtcggggaagaccgcaagtggatgatggcacgcaaacttatgcaggtgaatgacacccttacctctgaagatgccggtctgcgcaacagcaaaaactgcacagagcccgcactgcacgaattccccaatgatatttttaccaacgaagaccgcaggcagggggcagtcgtcctgcatgtgctgtgtgcgatttacatgttctatgctctagcgatcgtgtgtgacgatttcttcgtgcccagtttggagaaaatctgcgagaggttgcacctatcggaggatgtagcaggcgctactttcatggccgctggaagctccgcccctgaactctttacatctgtaatcggtgtgttcatcacaaaaggcgacgtgggagtgggtaccatcgtcggctctgctgtcttcaacatactgtgtatcattggcgtctgcggtttgttcgcgggacaggtcgtagcgctgtcatcgtggtgccttcttagagatagcatctattacaccctgtcggtaatcgccttgatcgtgttcatttacgacgagaaagtgtcctggtgggagtctttggttttggtgctgatgtacttgatctatattgtgattatgaagtataacgcatgtatacatcagtgcttcgagaggcgtaccaaaggagccggtaacatggtgaatggcctggcaaataacgccgagatcgacgatagcagcaattgtgatgccactgtcgttctactcaaaaaagcaaactttcataggaaagcctccgtcatcatggtggatgaactcttaagcgcatatcctcaccaattatcattctccgaagcagggctaaggatcatgattacctcccacttcccaccaaaaacaaggctgtcgatggcctcacgcatgctgatcaatgagagacagcgcctgatcaattcacgggcatacacaaatggtgagtccgaggtcgccatcaagattcccatcaagcatacagtcgagaatggaacaggaccgtctagtgccccagaccggggagtgaatgggaccaggcgggacgatgtagtcgcagaagccggtaacgaaaccgagaatgaaaacgaagacaacgaaaatgacgaggaggaggaggaggacgaggacgatgacgaggggccttacaccccgtttgacacgcctagtggcaagctggagaccgtcaaatgggcttttacatggcccctaagtttcgtcctatactttaccgtgccaaactgcaacaaacctcgctgggaaaagtggttcatggtcacttttgcctccagtaccctatggattgccgcattctcatacatgatggtatggatggttaccatcatcggatataccttaggaattcccgatgtgatcatgggaatcacatttttggctgcaggcacaagcgtgccagattgtatggccagtcttattgtggctcgacaagggatgggcgacatggccgtgagcaattccatagggtcgaacgtcttcgatatactgatcggccttggattgccttgggcgctccaaacactggccgtggattacggttcatacattcgactcaatagtcgtggcctgatttatagtgtgggactgttacttgccagcgtcttcgtcaccgtctttggggtgcacctcaacaagtggcagctcgataaaaaactggggtgtggctgcctcttactatacggggttttcctttgtttcagcatcatgacggagttcaacgttttcacatttgttaacttgcccatgtgcggcgaccattag

SEQ ID NO: 241214 - DNA, 1755 bp, Artificial Sequence
  Description of Artificial Sequence: Synthetic coding sequence
atggccggaaggagattaaacctgaggtgggcactgtccgtgttgtgtgtactgctgatggccgagactgtatcagggacccgcggaagctccactggagcccacataagtccacagtttcctgcttcaggagttaaccagacaccggttgtggactgccgaaaagtgtgcggacttaacgttagcgataggtgtgattttattcggactaacccggactgccacagcgatggtggatacctggactacctggaaggcattttttgccactttccaccatccctccttcccctggccgtgactctctatgtgtcttggcttctttacctctttctcattctcggggtgaccgccgctaagtttttttgtccaaatctctccgctatcagcacaacgctgaaactgagtcataatgtggcgggagtaacgttccttgcttttggaaacggggcaccagacatattcagcgccctggtcgcattttccgatccacacaccgcaggcctggctctcggagcattgttcggggctggcgtgctggtgacaaccgtggttgctggaggcataacaatcctgcatccatttatggctgcaagtagacctttcttcagagacattgttttttacatggtggccgtgtttctcacatttctcatgttgtttcggggaagggtaaccctcgcctgggccctcggttacctcgggctatacgtcttctacgtggtaacagtgatcctctgcacgtggatctaccaacggcaacggaggggctcactcttctgccctatgcccgtgacacccgagatcttgagtgactccgaggaggatcgcgtcagtagcaacaccaacagctatgattatggtgatgagtacagaccgcttttcttctaccaggagactaccgcgcaaatccttgtgagggctctgaatcccctagactacatgaagtggcgtcgcaagagtgcttattggaaagcactgaaagtgttcaaactcccagttgaatttctccttctcctgaccgtcccagtagtcgatccagacaaggacgaccagaattggaaaagacctctgaactgcctacatctggtgattagccctctcgttgtggtgctcacactgcaaagtggtacctacggggtatacgagatcgggggactggtgccagtgtgggtcgtggtggtcatcgccggaacggccctcgctagcgtgacgttcttcgctaccagtgattcccagcctcccaggctgcactggctgttcgcttttctcggctttctgaccagtgccttgtggattaatgcagctgctacggaggtggtcaacatcctgcggagtctgggcgttgtatttcggttatctaataccgtgctaggactcactctactggcatggggcaacagcattggcgatgctttcagtgatttcactctggctcgccagggatatccacggatggccttctctgcctgctttggtgggatcatctttaatatcctggtgggcgttgggttaggctgcctgctccagatcagccgcagtcacactgaagttaaactagagcccgatggcctgctggtgtgggttctcgctggggctctgggcctgagcctggttttctccctggttagcgtgccactgcagtgcttccagctctctcgcgtctatggtttctgcctgctgctcttttatctcaattttctggttgtggcattgctgaccgagtttggggttatacacctgaaatcaatgtag

SEQ ID NO: 241215 - DNA, 1587 bp, Artificial Sequence
  Description of Artificial Sequence: Synthetic coding sequence
atggcgggacgcaggctgaacctgagatgggctctgtccgtcttgtgcgttctactgatggcagagactgtcagcggaacacgtgggtctagtacaggcgctcacatcagcccccaatttcccgcaagcggggtaaatcaaaccccagtggtagactgcagaaaagtgtgcggcctgaacgtgtctgacagatgcgacttcataaggacgaatcctgattgccactcagacggtggctatctggactatttggagggcatattttgtcactttcccccttcactcctccccttggcggtcaccctgtacgtgtcctggctgctctacctgttcctgattctgggcgtaaccgctgccaaattcttttgtcccaacttaagcgccatcagcactaccctgaagctgtcccacaacgtcgcaggagttactttcctggcatttgggaatggtgctcccgatatattcagtgcacttgtcgccttttcagatccccacaccgcaggcttggcactcggcgctctgttcggctatctcgggctatacgtcttctacgtggtgaccgtcatcttgtgcacgtggatatatcaacgacagcggagaggcagcctgttttgccctatgccggtgaccccagagattctctccgatagtgaggaggacagggtgtcttccaatactaactcatacgactatggggacgaatacagacccctttttttttaccaggaaacaacagcccagatcttggtgcgagcacttaaccccctcgactacatgaagtggaggcgtaaaagcgcatactggaaggccctgaaagttttcaagctccctgtggagttccttttacttctgaccgtccctgtggtcgaccccgacaaagatgatcaaaattggaagcgacctctgaactgcctgcacctggtgatctctcctctggtcgtcgtgctgacccttcagtctggtacctacggtgtatacgagatagggggtcttgtgcctgtttgggtggtcgtggtcatcgcaggcactgctctcgcatcagtcaccttcttcgccacatctgatagtcaaccaccccgacttcattggctttttgccttcctgggctttctgacaagcgccttatggattaacgcagccgctactgaggtagtgaatattcttcggtcactcggcgttgtctttcggctctccaatacagtactgggactcaccctcttggcttggggtaacagcattggagacgctttttctgactttactctggctcggcaaggttatcccaggatggcctttagcgcctgcttcggtggcattatattcaatatactcgtgggcgttgggttaggttgcctccttcagatctccaggagtcatacggaagtgaaactggaaccagacggcctgctggtgtgggtgttggcaggcgctctggggctgtctttggtcttttcattggtctcagttcctttgcaatgtttccaacttagcagagtatatggcttttgtctcttgctcttttatctgaactttctggttgttgccctgcttaccgagttcggcgtcattcacctcaaatccatgtag

SEQ ID NO: 241216 - DNA, 1587 bp, Artificial Sequence
  Description of Artificial Sequence: Synthetic coding sequence
atggctggacgcagactgaatcttagatgggctctctcggtactgtgtgtgttattgatggcggaaaccgtgagtgggactcggggttcaagcacaggggctcatatatctccccaattccctgccagtggagtgaaccaaacccccgttgtggactgccgcaaggtgtgcggcctgaacgtgtccgatagatgtgacttcattagaacgaaccctgactgccattcagacggcggatatctggactatcttgagggtatcttttgccatttccctccaagcctcttaccgctggccgtcacgctctacgtgtcctggctcctatacttgtttctgattttgggcgtgacagctgcgaaattcttctgtcccaacttgagcgccattagcacaactttaaagctgagtcataacgtagccggagttacatttctcgcctttgggaacggcgctcctgacattttttcagctctcgttgcctttagtgatccgcatacagccggtctagccctgggagcattgtttggatatctgggactgtacgttttttacgtcgtcaccgtcatcctgtgtacatggatctaccagcgccagaggagggggtcactcttctgcccaatgcctgtcacacctgaaatactgtctgactccgaggaagaccgcgtgagttccaacactaactcatacgactacggagatgagtaccgaccgctgttcttttatcaggaaactacagctcaaatcctggtgcgtgccctcaaccccctcgattatatgaagtggagacggaagtcagcctactggaaagcacttaaagtgtttaagctccctgtggaattcctcctgttactcaccgtgccagtggttgacccagacaaggatgaccagaattggaaacggcctcttaactgtctgcacctggtgatctcacctttggtggtcgtcctgacccttcagtctggtacgtatggcgtttacgagatcggaggcctggtgccagtgtgggtagtcgtggtaatagccggaacggcattggcctccgtgacattctttgccacgtcagattcacaaccaccgaggttacattggctgttcgccttcctcggttttttgacctctgccctgtggattaatgctgccgctacggaggtggtgaacattctccgctctttaggcgtagtctttagactgagcaatacagttcttggtctcactcttctcgcatggggcaactctattggtgacgcattttcagatttcacccttgcacggcagggctaccctcggatggctttctcagcatgttttggcggtatcatatttaatatcctggtgggagtaggactgggatgtctgctacagatatccagatcccataccgaagtgaagttggagccggacgggctactggtgtgggtcctcgccggtgcgctcgggctctccctcgtgtttagtctagtgtcggttcctttacaatgttttcagctcagcagagtttacggattttgcctgctcctcttttacctcaattttctggtcgtggccctgctcacagaattcggggttatccacctgaaatccatgtag

SEQ ID NO: 241217 - DNA, 396 bp, Artificial Sequence
  Description of Artificial Sequence: Synthetic coding sequence
atggccggtagacgcctgaacctgcgctgggctcttagcgtactgtgcgtgctgctaatggcggaaacggtgtccggaaccaggggctcatcaacaggcgctcacatctcgccccaattccccgcttccggtgttaaccaaacaccagtggtcgactgcagaaaggtgtgtgggctgaatgtcagtgacaggtgcgactttatacgaaccaaccctgactgccactcagatggagggtacctcgactatttggagggcattttctgtcactttcccccttctctcttaccattggccgtcactctgtacgtcagctggctattgtacctctttctaatccttggtgtgactgccgctaagttcttttgccccaacctttcagccatttccacttag

SEQ ID NO: 241218 - DNA, 696 bp, Artificial Sequence
  Description of Artificial Sequence: Synthetic coding sequence
atggcaggcaggcggctgaacctaagatgggctctttccgtcctgtgtgtcctgcttatggccgaaacagtctccggcactaggggaagcagcactggagcacacatttccccacagtttccagcctctggcgtcaaccagacccctgtggtcgactgccggaaggtgtgcggcttaaacgttagtgatcggtgtgattttatacgaacaaaccccgactgccattccgacggaggctacctcgattatttggaaggcattttttgtcattttcctccttcactgctgccccttgccgtcaccttgtacgtgtcttggcttctttacctattcttaatccttggggtgactgccgctaagtttttttgtccaaacctcagtgctatcagtaccaccctgaagctgtcgcacaacgtcgcaggagttacctttcttgcatttggaaacggagcaccggacatattctccgctttagtagctttttccgatccacataccgctggcctcgccctgggggctctgtttggggcaggtgtgctggtaactactgtagtcgcaggtgggataactattttgcatcccttcatggccgcttctcgcccattttttcgagacatcgtgttttacatggtggcagtcttcttgactttcttaatgctgttcagagggagggtgacattggcgtgggcactgtag

SEQ ID NO: 241219 - DNA, 312 bp, Artificial Sequence
  Description of Artificial Sequence: Synthetic coding sequence
atggcaggccgtcggttgaatttgagatgggcgctctcagtgctctgcgtgttgctgatggctgaaacagtttccggaacaaggggctccagcacgggggctcatatctctcctcagtttcccgctagcggcgtaaaccagactccagtggtggattgcagaaaggtctgtgggttaaacgtgagcgatcgatgtgatttcatacgaacaaaccctgattgccattcagacgggggttaccttgattacttggagggcattttctgccacttccccccaagcctgctgccgctcgcagtgacgctgtattag

SEQ ID NO: 241220 - DNA, 1755 bp, Artificial Sequence
  Description of Artificial Sequence: Synthetic coding sequence
atggccggaaggcgccttaacctgaggtgggccctcagtgtcttgtgcgtgctcctgatggccgagacggtgagtggaacccgcggaagttccacaggggcacatatttccccccaattcccggcatctggagttaatcagactcctgtggtggattgccgaaaagtgtgtggcctgaatgtcagcgacaggtgtgactttatccggaccaaccccgactgccactccgatgggggatatctcgactatttggaggggatcttctgtcacttccccccttccctcctgcccctggccgtcactctttacgtgtcctggttactgtatctgtttcttattttgggcgtgaccgcagcaaaattcttctgcccaaacctgtccgccatctctaccacgctcaaattgtcccacaacgtggccggagttacgttcctcgcgtttgggaatggcgctcccgatatcttcagcgcactggtggcatttagcgacccccatactgcaggactggcactcggcgctttgtttggagcaggcgtgctggtaacaacagtcgtggcaggtggaattactatcctccacccgttcatggcagcttcaagacccttcttccgcgacatcgtgttttatatggttgccgtattcttaacctttctgatgttatttagggggcgagtgacacttgcctgggctctcggttatctcggcctgtatgtgttttatgttgttaccgtcatcctgtgtacctggatctaccagcggcagcggaggggctcattgttctgtccaatgcctgtgactcctgagatcctctctgacagcgaggaggatcgagtctcaagtaacaccaacagctatgattacggcgacgaataccgaccactgtttttctaccaagaaacgacagcccagattttagtccgtgcactgaatcccctggattacatgaagtggagacgcaaaagcgcatattggaaggctctgaaggtcttcaaattgccagttgaattcctgctccttctgacagttcccgttgtggatccagacaaggatgaccaaaattggaagagaccgctgaattgcttgcacctggttatctcaccgctcgtagtggtgctgactctgcagtctggcacatacggggtctatgagattggcggattggtgccagtctgggtcgtggtagtcatcgcagggaccgccctcgcgtctgttacatttttcgctaccagtgattcccaaccccctaggctccactggctcttcgctttcctggggtttcttacctcagctttatggattaatgctgccgctaccgaagtcgttaatatccttcgctcacttggcgtggtgtttcggctttccaataccgttctgggattaacactcctcgcttggggtaattcaattggagacgctttctccgactttacccttgcacgccagggctatccacgcatggctttttcagcttgcttcggcggaatcatctttaacatactcgtcggagtgggattaggctgtttgctgcagatttctcgatcccacacagaggtgaaactggaaccagacgggctgctggtgtgggtgctcgccggtgccctgggattgagccttgtcttttctctcgtgtcagttccgcttcagtgcttccagctcagccgcgtgtacggcttctgtctactgctgttttatctgaacttcctggtcgtagcactgctcaccgaatttggggtcatccacctaaaatccatgtag

SEQ ID NO: 241221 - DNA, 906 bp, Artificial Sequence
  Description of Artificial Sequence: Synthetic coding sequence
atggcagaccagcccaaaccaatatccccactaaagaatctgctggcaggtggatttggaggtgtctgcttggtgttcgtcggccaccctctcgacacagtgaaagtacgactgcagacgcaacccccatctctgccgggacagccgccaatgtactccgggactttcgactgctttcggaagaccctgttccgagagggtatcacaggtctttacagaggaatggctgccccaattattggagtgacacccatgttcgctgtctgcttcttcggctttggattgggcaaaaagttgcagcagaaacatcctgaagacgttcttagctaccctcagctgttcgccgcaggcatgctgtccggcgtatttactaccggcatcatgacccctggggaaaggattaaatgtttgcttcagattcaggccagcagcggagaatctaaatacacagggaccctcgactgcgcgaaaaaactctatcaggagtttggaatcagggggatttacaagggtactgtgttgaccctgatgagagatgtcccggctagcggcatgtactttatgacatatgaatggctcaagaacattttcacaccagagggcaagcgagtgtctgaactgtccgccccaagaatcctggtcgcagggggaatagccggaatttttaactgggccgtggctatccctcctgacgtgctaaagtcaagatttcagactgctcccccaggaaagtaccccaacgggtttagggacgtcttgagggaacttattcgcgacgagggcgtcaccagcctttacaagggatttaacgctgtgatgatcagggctttcccagctaacgctgcgtgttttctgggctttgaagtcgccatgaaattcctgaactgggccacacccaacctatag

SEQ ID NO: 241222 - DNA, 756 bp, Artificial Sequence
  Description of Artificial Sequence: Synthetic coding sequence
atgtatagcgggacttttgactgctttcgtaaaaccctgtttagggaaggcattacggggctttataggggcatggcagctccgattattggcgtcaccccaatgttcgccgtgtgctttttcggatttggtctgggaaagaaacttcagcagaagcaccccgaggacgtgctctcctacccccagctgtttgcagcaggaatgctgagtggggttttcacgactggtataatgactcctggagagcgtattaaatgcctcctgcaaatccaggcttcctccggcgagagcaaatacacaggcactctggattgcgctaagaaactttaccaagagttcggaatccgtgggatttataaggggactgttttaacactcatgcgagacgtaccagcctccggcatgtacttcatgacctatgagtggctaaaaaacatctttacgcctgagggaaagcgcgtgagtgagctcagcgcacctcgcattctggtggccggaggcatcgccggtatcttcaattgggcagtggctatacctcccgacgtcctcaaatcccgtttccaaacggctcctccaggcaagtatcctaatggatttagggatgtcctacgggagttgattagagacgagggagttacctccctgtacaaagggtttaatgcagtcatgatcagggctttccctgccaacgcggcatgtttcctgggattcgaagtcgctatgaaatttctgaactgggcaactccgaacctctag

SEQ ID NO: 241223 - DNA, 948 bp, Artificial Sequence
  Description of Artificial Sequence: Synthetic coding sequence
atgacccaccaggacctgagtatcacagctaaactgatcaatggaggggtcgctgggctcgtcggcgtaacttgtgtgtttcccattgacctggccaaaactcgcttacagaaccagcacggtaaggccatgtacaaggggatgattgattgcctgatgaaaactgctagggccgagggatttttcggcatgtatcgcggagccgcagtcaatcttacactggtgactcccgagaaagccatcaaactcgccgctaacgatttctttcggcgtcttctcatggaggatggcatgcaacggaatctgaaaatggagatgctcgcgggttgcggtgcgggaatgtgccaggtggtagtgacttgtcctatggaaatgcttaagattcagctacaagatgcaggcagacttgccgtgcatcatcaggggtcagctagtgccccaagtacttcacggtcttatactaccggatcagcttctacgcaccgcagaccgtccgctactttgattgcatgggaactccttcgcacgcaggggctcgcaggtctgtataggggactgggcgctaccctgctccgggacattccattctccataatctattttccactgttcgccaacctgaacaacctgggatttaatgaattggccggaaaagcttccttcgcccatagctttgtgtcaggttgtgtggccggaagcatcgccgcagtcgcagttacgcctctggacgtgctgaagactcgaatccagacactgaaaaagggtcttggcgaggatatgtactctggcattaccgactgcgcccgaaagctgtggatacaggaggggccatcggcgttcatgaagggggctgggtgccgagccctggtgatagctccattgtttggaatcgctcagggcgtttacttcatcggcatcggggaacgaatattgaaatgtttcgattag

SEQ ID NO: 241224 - DNA, 948 bp, Artificial Sequence
  Description of Artificial Sequence: Synthetic coding sequence
atgactcaccaagacctttctatcaccgccaaactgatcaacggcggtgtggctgggcttgtgggagttacttgcgtctttcctattgaccttgccaaaacacgtctgcaaaaccaacacggtaaagcaatgtacaagggcatgatcgattgtctcatgaaaacagctagggctgaaggattttttggaatgtacaggggtgccgcagtgaatctgaccctcgtcacccccgagaaagcaattaagcttgcagcaaatgacttctttaggcgtttgcttatggaagacgggatgcagcggaatctgaaaatggagatgctggcaggatgtggtgctggaatgtgtcaggtggtggttacatgcccgatggagatgctcaagatccagctgcaggacgctgggagactggcggtgcaccatcagggttccgcctcggccccttccacaagcaggagttacactaccggctcagccagcacacaccggagaccatccgccacccttatagcgtgggagctgctccggacccaaggcctggcaggcttgtaccggggtctgggtgccaccctgctccgtgatattcctttttccatcatctatttccccctgttcgccaacctgaataatctgggctttaatgagctcgccggaaaggcgtctttcgcacacagttttgtatccggttgtgtggccggaagcatcgccgctgtcgcggtcacgccccttgacgtgctcaagactagaattcaaaccctgaagaaagggctgggcgaggacatgtatagcggtattactgattgcgcacggaagctctggatccaggaagggccaagtgcatttatgaagggggcaggctgtcgagcattagttatcgcaccactgttcggaattgcccagggggtttatttcattggcatcggcgaacgcatattgaagtgcttcgattag

SEQ ID NO: 241225 - DNA, 1716 bp, Artificial Sequence
  Description of Artificial Sequence: Synthetic coding sequence
atggaaaacgttaaggaaatctttggccagaccattattcatcatcatatcccattcaattgggactgtgagtttataaggcttcacttcggtcacaataggaagaaacacctaaactacacagagttcacacaattcctgcaagagctgcagctggaacacgctcgtcaggcattcgctctcaaggataaatccaaatcagggatgatttcgggactggattttagcgacattatggtcaccataaggagccacatgctcaccccatttgtcgaggagaacctggttagcgctgccggaggcagtatttcacatcaggtcagcttcagctacttcaacgcctttaattccctgctgaacaatatggagctggttaggaaaatttacagtactctcgccggtacacggaaggatgtggaagtgaccaaagaagaatttgcccagtctgccataaggtacgggcaggtgacccctctagaaatcgacatcctctaccaactggcggatctatacaacgccagtggtagacttactctggccgatatcgagagaatcgcccctttagcggaaggagcgctcccatacaatctagcagaacttcagcggcagcagagccctggcctgggcagacctatttggctccagattgctgagtccgcttacagatttactctgggaagtgtagctggagccgtgggcgcaacagcagtctacccgatagacctggtcaaaacaagaatgcaaaaccaaaggggtagcggttcagtggtcggagaattgatgtacaaaaatagttttgactgctttaagaaggtgctccgctacgagggattttttggcctctatagggggttaatcccccagctcatcggtgtggctccagagaaagccataaagcttacagttaacgactttgtgcgagacaagttcacccggagggacggttccgttccactccccgcagaagtgctcgcaggcggttgtgccggagggtcccaggtgatcttcaccaaccccctggaaatcgtaaagatccggcttcaagttgcaggagagattaccacaggaccacgcgtttctgcactaaacgtcctgagggatttaggaatcttcggtctgtacaaaggtgcaaaagcctgctttcttcgcgacatcccgttctccgccatctactttcctgtctatgcccattgtaagctgctgctcgcagacgaaaatggccacgtggggggtctcaatttgctggccgctggagctatggctggagtaccagccgctagtctcgttacccctgccgacgtgatcaaaacccgcctgcaggttgctgcacgcgcaggccagacgacatatagcggcgtcattgactgctttagaaaaatcctccgggaagaagggccatccgcattttggaaaggcacagccgctcgggtgttcaggtctagtcctcagttcggggtgacactggttacttacgagttgttgcagcgctggttctatattgacttcggtggactgaagcccgcaggctctgaaccaaccccaaaatcccggatcgccgatctccccccagcgaatcccgaccacatcgggggttaccgtttagctactgctacgtttgcaggcatcgagaataagtttggactgtacctgcccaagttcaagtcgccaagcgttgccgtggtgcaaccgaaggccgctgtggccgcaactcagtag

SEQ ID NO: 241226 - DNA, 2037 bp, Artificial Sequence
  Description of Artificial Sequence: Synthetic coding sequence
atggccgtcaaggtgcagactacgaaacgcggagacccccatgaattgagaaacatcttcctccaatacgccagcaccgaagtcgacggtgagcgatatatgaccccagaagacttcgtgcagagatacctgggactctataacgaccccaactccaaccccaaaatcgtgcagctgttggcaggggtggcagatcagacaaaggatggtctgattagctatcaggagttcttagctttcgagtctgtgctatgcgccccagactcaatgttcatcgtcgcgttccagctgttcgataagagtggcaacggggaagtcactttcgagaacgtgaaagaaatcttcgggcaaaccattattcaccatcacatcccattcaactgggactgtgagttcatccgcctccattttggtcataacagaaaaaagcacctgaattatacagaattcacacagtttctgcaggaattgcagctggagcacgccaggcaagcctttgctcttaaagataagtccaagtcagggatgatctccggcctggacttcagcgatatcatggtgacaatccgcagtcacatgttgaccccttttgttgaggagaacctggtcagtgctgctggcggatctatcagtcaccaggtatcgttttcatactttaacgctttcaacagccttctcaacaacatggagctggtcagaaagatctactccacactcgccggaacacgcaaggatgtggaagttaccaaggaggagttcgctcagtccgcaatccgctatggacaggtgacccctctcgagattgacatattgtatcagctggcagatctgtacaatgcaagcggaagactgaccttagctgatatagagcgaattgccccactagctgagggagccctcccatataatctggccgaactccagaggcagcagtcgccgggtctcggccgtcccatctggctccagatcgccgagtccgcttatcgctttacgctcgggtccgtcgcaggcgctgtgggggctaccgccgtatatcccattgacctggtaaagacccgcatgcagaaccagaggggaagtggctccgtcgtcggggagctgatgtataagaacagtttcgactgctttaagaaggtgctaagatatgaggggttttttggcctatatcgagggttgatacctcaactgatcggcgtggctccagaaaaagccattaaactcaccgtcaacgattttgttagagacaaatttactcggcgagatggtagcgtccctcttcccgcagaagtgctcgctggaggatgcgcagggggaagccaagtcatttttacaaatcccctggagatcgtgaagattcgactgcaggtagcaggagagattactactgggcctcgcgtgagtgctctgaatgtgctgcgtgacctcgggatcttcggcctgtacaaaggagcaaaggcttgctttctgcgagatatccctttttcagccatatacttccccgtgtatgcacactgcaaactacttttggctgatgagaatgggcatgttggtggcttgaatcttctagcagccggtgcgatggcaggcgtaccagctgcaagcctcgtcactccagccgatgttatcaaaacacgtctgcaggtggccgcacgtgccggacagactacctattcgggtgtgatagattgctttcgaaaaatccttagagaagaaggaccctccgctttttggaaaggaacagccgctcgagttttccgctcatcaccccagttcggggtaactctcgtgacctatgaactgctgcagcgatggttctacattgatttcgggggactgaagccagcaggcagcgaacccacccccaaaagccgtatagcggatcttccacccgcaaacccagaccacatcggaggctatcgcctggcaaccgctacatttgccggaattgagaacaaatttggcttatacctgcctaaattcaaatcaccatcagttgctgtggtgcagccaaaagcggctgttgctgctacccagtag

SEQ ID NO: 241227 - DNA, 1944 bp, Artificial Sequence
  Description of Artificial Sequence: Synthetic coding sequence
atggctgccggactggccacatggctgccattcgccagggccgcagcagtgggatggcttcctctggcccagcagcccctgccaccagccccaggcgtgaaggcatcgcgaggcgacgaggtcctagtggtgaacgtgagtggacgcagattcgagacatggaaaaatactctggataggtaccccgatacactcttagggtccagtgagaaagaatttttctacgacgctgatagcggcgaatatttctttgatagggatcctgacatgttccggcacgtcctgaacttttaccggactggaagactgcactgtccaaggcaggaatgtatccaggcctttgacgaggagctggccttttacggcctggtcccggagctggtcggcgattgctgtctggaagagtacagggatcgaaagaaggagaatgctgagcgcttggcggaagatgaagaggcggagcaggctggggatggacctgcactgccagccggatcctctttgagacaacgattgtggcgggcatttgaaaacccacacacctctactgcagccctggtgttttattatgtaaccggatttttcattgccgtctccgtgatcgccaacgtggtggaaacaattccatgccgcggatctgctaggcgatctagccgggaacagccatgtggcgagcgtttcccacaggcattcttttgcatggacactgcttgtgtgttaatattcaccggagaatatctactgaggctctttgcggcaccctcccggtgtcgctttctccgctctgtaatgtcactcattgacgtcgtggctattctgccctattacatcggcttgctagtacctaagaacgatgacgtgtctggtgccttcgtcacactcagggtgttccgggtgtttagaattttcaagttttcccgtcactcgcagggccttagaatcctagggtacaccttaaaatcctgtgcctcagagctaggctttctgctgttcagcctcactatggctattataattttcgccacagttatgttttatgccgagaagggaacaaacaagaccaacttcacttcaattccggctgccttttggtacaccattgtcaccatgacaaccctgggatacggcgacatggtgccgtccactattgccggaaagatattcggatcaatttgctcattgtctggagtcctcgtcatcgccttgccagtgccggttatagtgtctaattttagtagaatctaccaccagaaccagagggccgataaaaggagagcacagcagaaggtgcgattagccaggatccgcctcgctaagagcggtacaaccaacgctttcctgcagtacaagcagaacgggggactggaggacagtgggtccggtgaagagcaagcattgtgcgtccgcaatcgcagcgcattcgagcagcagcatcatcacctgctgcactgtctggagaagactacctgccatgagtttacggacgagttgacgttcagcgaagccctcggtgccgtgtcacctggaggccgaacttcgagatccacgagtgtgagttctcagccagtgggccctggatcgctgctttcgagttgctgtcccagaagggccaagcgcagagcgatcagacttgccaacagcaccgcatctgtgtcccgtggaagtatgcaggaattggacatgttagccggacttaggcgctcccatgcccctcagagccgcagctctctcaacgctaagcctcacgattctcttgacctcaattgtgactcccgcgatttcgtggcggctatcatatcgatccctacaccacctgcaaatactcccgacgaatctcagccgtcatctcccggaggaggaggacgggctggtagcaccctacgtaattcgagcttaggcaccccatgcttatttcctgagaccgtgaaaatcagttcactctag

SEQ ID NO: 241228 - DNA, 1062 bp, Artificial Sequence
  Description of Artificial Sequence: Synthetic coding sequence
atgggcatcttccctggtattatacttatcttccttcgcgttaaatttgcaacggcagcagttattcaccagaagagcaccacagtgtcccacgaaatgtctggcctaaactggaaacctttcgtatacggcggactggcgtcaatcgttgcagagtttgggacatttcctgtggacctgacaaaaacacggcttcaggtgcaagggcaaagcattgatgcccgattcaaggaaatcaagtatcggggaatgtttcatgcgctcttcaggatctgtaaagaggaaggagttctcgctttgtactcaggaatagctcccgctctgctccgccaggccagctatgggacgatcaagatcggaatataccaatcgctgaaaaggctgtttgtcgagaggctagaagatgagaccctgttaattaacatgatctgcggagtggtgtctggggtaatttcttcaaccattgccaaccctacagatgttctgaagatccgcatgcaggcccaggggtccctctttcagggctctatgataggaagcttcattgatatctaccagcaagagggcacacgcggtctatggagatgcctgtgtagcaaagctgtaaccggttgcgtgctttggctgatgccagttattcccgcattatgggaagctaatgccggtggaagcctcgaaggggtcgtgcccacggcccagagagccgctattgtcgtcggggtggagctgcctgtgtacgatattactaagaaacacttaatcctgtcaggcatgatgggggacactatcctgactcacttcgtgtcctccttcacctgcggactcgcgggagcactcgcctcaaacccagtcgacgtggtgagaacccgcatgatgaaccagcgagctatcgtcgggcacgtggatttatacaaaggaactgtcgatggaatcctcaaaatgtggaagcatgagggattctttgctctttacaagggattctggccaaactggcttagattggggccatggaacattattttcttcatcacctacgagcagctgaagagactgcagatatag

SEQ ID NO: 241229 - DNA, 969 bp, Artificial Sequence
  Description of Artificial Sequence: Synthetic coding sequence
atgggaattttcccagggattatcctcatattcttgcgggtaaagtttgccacggccgcagtgattcatcagaagtcaaccacggtctcacatgagatgtcagggctcaactggaaaccctttgtatatggcggactggccagcattgttgcggagtttggcacatttccagtggacctgacgaaaacacgcctgcaggtgcagggccagagcatcgacgcccgttttaaggaaattaaatatcggggtatgtttcacgctctctttcgtatttgcaaagaagaaggagtgttagcgctctactcaggtatcgctccggcactcttgaggcaggccagctacggaactataaaaatcggcatttatcagtcacttaaacggctgttcgtggagcgcctggaggatgagacattactcatcaatatgatttgtggagtagtctcaggggtgatttcaagtactattgctaatcccacagacgtgctgaagatcaggatgcaagcccaaggttcattatttcagggctctatgattggcagcttcattgacatttaccagcaggagggaactagggggctctggagaggcgtggtgccaaccgcccagcgggctgcaatcgtagttggcgtcgagttgcctgtctacgacatcaccaagaaacacctgatcctttccggaatgatgggcgatacgatacttacacactttgtcagtagcttcacctgcgggttggccggtgcgttggcatccaaccctgtcgacgtcgtgcggaccagaatgatgaatcagcgtgccatcgtggggcacgttgatctgtacaagggcaccgtcgacggtatactcaagatgtggaaacatgaaggcttcttcgcactatacaaagggttttggccaaactggctccgcctgggaccatggaatataatattcttcattacgtacgaacagctgaagcggctccagatatag

SEQ ID NO: 241230 - DNA, 597 bp, Artificial Sequence
  Description of Artificial Sequence: Synthetic coding sequence
atgggcattttcccagggattatcctgatttttctcagggtgaagttcgccaccgccgcagtgattgtgtcaggacaccagaaatctacgacagtgtcgcacgagatgtcagggttgaattggaaaccatttgtttatggaggcttagcttcaattgtggcagaatttggcacgtttcctgttgatctgacaaagactaggctccaggtgcaaggacagtctattgacgcacggttcaaggaaatcaagtatcgtggcatgttccatgcattatttaggatttgcaaagaggagggcgttctagccttgtactctggcatcgcacctgcgctgctgaggcaggcttcctatggtactatcaagatcggaatttatcagtctctgaaaagactgtttgtggagagactggaagatgagacactcttgatcaacatgatctgtggagttgtaagcggggtgattagttccacaatagctaaccctactgatgtcctgaagataaggatgcaggcccaaggcagtcttttccaggggtcgatgatcggaagttttatagatatctaccagcaggagggaacccggggactgtggaggtag

SEQ ID NO: 241231 - DNA, 618 bp, Artificial Sequence
  Description of Artificial Sequence: Synthetic coding sequence
atgagtggactgaactggaaaccattcgtgtatggaggtctggccagcattgtcgcggagtttggtacctttccggtggatctgaccaagacacgactccaagtccaaggacagtcgatagacgcccgattcaaagagattaagtatcgagggatgttccatgccctgttccgcatttgtaaagaagaaggcgtcctggcattatattcggggattgcccctgccctcttaaggcaagccagttacggtaccattaaaatcggcatctaccagtcactgaaacgactgttcgtggagcgcctggaagacgagactctcctgatcaacatgatctgcggcgtggtgtccggggtgattagtagcacaatcgctaaccccaccgatgttctgaagattaggatgcaggctcaggggtccctctttcagggaagcatgataggatcattcatcgacatctaccagcaagagggaacaagaggactttggaggggcgtggtcccaacggcacagagagctgcaatcgtcgtgggggttgagcttccagtttatgacattacaaagaagcacctgattctgtctggtatgatgggagacaccatcctgacgcactttgtttag

SEQ ID NO: 241232 - DNA, 723 bp, Artificial Sequence
  Description of Artificial Sequence: Synthetic coding sequence
atgggaattttccctggcattatcctaatcttcctgcgagttaaatttgccacagccgcagtgattgtctcgggccatcagaagagcacgactgtgagtcatgagatgagcggtttaaactggaaaccattcgtatacggaggcttggcgagcatcgtggcggagttcgggacctttccagtagatcttacaaaaacaaggctgcaggtgcagggccagtcaattgacgctagattcaaagagatcaagtatcgcggtatgtttcatgctttgtttcgaatttgcaaagaagaaggcgttttggcactgtacagtggtattgcgcctgccctccttcggcaggctagttatgggactataaaaataggcatttaccaaagtctaaagcgcctgttcgttgagagacttgaggacgagaccttattgataaacatgatttgcggggtggttagcggcgttattagcagcactattgccaatcccaccgatgtcctgaagatccgaatgcaagcgcaggggtccctttttcaagggagcatgatcggctcatttattgatatctaccaacaggagggcactcgagggctgtggagaggcgtggtgcctacagcacagagggcagcaatcgttgtcggcgtggaactgcctgtgtatgacatcacaaagaaacatctgatcttgagcggtatgatgggtgacaccatcctgacccactttgtttag

SEQ ID NO: 241233 - DNA, 972 bp, Artificial Sequence
  Description of Artificial Sequence: Synthetic coding sequence
atggcggacaaacaaatttcactgcccgcaaagctcatcaacgggggaatcgccggacttatcggagttacctgtgtctttccgatagacctggccaagactcgtctgcagaaccaacaaaacggtcaacgagtgtatacgagtatgtctgattgtctgatcaagaccgtccgctctgagggctactttggaatgtatcgcggagcagctgtgaacctgaccctggtgacgcctgagaaggctatcaagctcgccgcaaacgacttcttccgacaccagctttccaaagatgggcaaaagctgaccttgcttaaagaaatgctagccggatgtggagcgggaacctgccaggttatcgtgactactccgatggagatgctgaagatccaactgcaggacgcaggaaggatcgccgctcaaagaaagatcctggcagcccagggccagcttagcgcccagggaggagctcagcccagtgtggaggcacctgcagctccaaggccaacggctactcagttgacccgggatcttctgcggtcacggggtattgccggtttgtacaaggggcttggtgccaccctcctcagagatgtgccattttcagtagtgtacttccccctgttcgccaatctaaaccagctcggaagacccgctagcgaggaaaagagtcctttctatgtgtcttttctagctggctgtgttgcaggaagcgctgcagctgtggcagtgaacccctgtgacgttgtgaaaaccaggctgcaaagcctgcagagaggcgtcaacgaggacacctatagcggaatactggactgtgctcgaaaaatcttgcgacatgaaggtcccagtgcattcttgaagggagcatattgtagggccttagtcatcgcaccgctgtttggaatcgcacaggtcgtctatttcctcgggatagccgagagcctgctcggacttcttcaggacccccaggcttag

SEQ ID NO: 241234 - DNA, 333 bp, Artificial Sequence
  Description of Artificial Sequence: Synthetic coding sequence
atggccgacaagcagatctcccttcctgctaagctgatcaacggagggattgccggattgataggtgtcacttgtgtttttccaatcgatctcgccaaaactaggctccagaatcagcagaacggccaaagagtgtacacaagtatgtcagattgcctgattaaaactgtccgatcagaggggtactttggtatgtatcgtggcgcagccgtgaacctgacactagttacccctgagaaggccattaaactagccgcaaatgattttttcagacaccagctgtcaaaggatgggcagaagcttactttgctgaaagagatgttggctggatag

SEQ ID NO: 241235 - DNA, 384 bp, Artificial Sequence
  Description of Artificial Sequence: Synthetic coding sequence
atggccgataaacagatctcccttcccgcaaaacttatcaatggtggaattgccggactgatcggcgtgacatgcgtttttcccattgatctggctaagaccagactgcaaaaccagcagaacggtcaaagagtgtacacaagcatgagcgactgcttgatcaagaccgtcagaagtgaagggtattttgggatgtataggggcgcagcagtcaaccttaccctggtgactccggaaaaggccatcaagctggccgctaacgattttttcaggcaccagttgagtaaggacggtcagaaattgactctgcttaaggagatgttggcgggatgtggagccggtacctgtcaggttatcgtgactacccctatggaaatgctgtag

SEQ ID NO: 241236 - DNA, 360 bp, Artificial Sequence
  Description of Artificial Sequence: Synthetic coding sequence
atggcagacaaacagatcagcctgcctgcaaagttgataaacggtggcattgcaggcctgataggggtgacttgtgtctttccaatcgacttggccaaaacaagattacagaatcagcaaaacggacaaagggtatatacaagcatgtcagattgtctaataaagacagtgcgctccgagggatactttggcatgtatcgcggagccgcagttaacctgacactcgttacaccagaaaaagccattaagctggcagccaatgattttttcaggcaccagctgtctaaggatggccagaagctaacgctgcttaaagagatgctcgctggctgcggagcagggacttgccaggtgatctag

SEQ ID NO: 241237 - DNA, 372 bp, Artificial Sequence
  Description of Artificial Sequence: Synthetic coding sequence
atggccgacaagcagatttctttgccagcgaaattgattaatggcggtatcgcaggtttgataggagtcacctgcgtgttcccaatagaccttgcaaagaccaggctgcagaaccagcagaacggacagcgtgtttatacttctatgtccgactgtttgatcaaaactgtgcggagcgagggatatttcggcatgtataggggggcagccgtaaatcttactttggtcactcctgagaaggcaatcaaactggctgctaacgacttctttaggcaccaactgagcaaggacggccaaaaacttaccttactgaaggaaatgctcgctggctgcggagccggaacctgtcaggtgattgtcaccactccctag

SEQ ID NO: 241238 - DNA, 342 bp, Artificial Sequence
  Description of Artificial Sequence: Synthetic coding sequence
atggcggacaagcaaatatccctgcctgctaagctgattaatgggggtatcgcgggtctgattggagtcacctgcgtgtttccaatagaccttgcaaagacacgcctacagaaccagcagaatggacagcgggtgtacaccagcatgtctgactgtttaattaaaaccgtgcgctccgaaggatactttgggatgtataggggagctgcagtgaatctaacgcttgtgacgccagagaaagcaataaagcttgcggctaatgatttcttccggcatcagttatctaaggacggacagaaactgaccctgctgaaggaaatgttggcagggtgcggcgcttag

SEQ ID NO: 241239 - DNA, 237 bp, Artificial Sequence
  Description of Artificial Sequence: Synthetic coding sequence
atggctgataagcagatcagcctgccagctaaactcatcaatgggggaatcgcagggctgatcggagtgacatgtgttttcccaatcgatctcgcaaaaaccaggcttcagaaccagcagaatggacaaagagtatacacgagtatgagtgattgtctgattaaaactgtgcgatccgaaggatattttgggatgtacaggggcgcagccgtaaatcttacccttgtgacaccttag

SEQ ID NO: 241240 - DNA, 180 bp, Artificial Sequence
  Description of Artificial Sequence: Synthetic coding sequence
atggccgacaagcagatttctctcccagcaaaactgattaacggaggcattgcaggcctgatcggggtgacctgcgtctttcccatcgatctggccaaaacacggctgcagaatcagcagaatggtcagcgcgtctataccagcatgagcgattgtctcattaaaacagtgcggagctag

SEQ ID NO: 241241 - DNA, 972 bp, Artificial Sequence
  Description of Artificial Sequence: Synthetic coding sequence
atggccgataaacagatcagcttaccggcaaagctgatcaatggaggcatagccggtctgatcggcgtgacctgtgtatttccaatagacctcgcgaagactcggctgcagaaccagcagaacggtcagagggtgtatacgtctatgtcagattgcttgatcaaaactgtcaggtccgaggggtacttcggcatgtaccgcggtgcagctgtgaacctgaccctagtgacacctgagaaggcaatcaaactcgccgcaaacgatttctttcgtcaccagttgagcaaggatggccaaaagctgacattactgaaagagatgctggcgggttgcggagccggaacttgccaggtgattgttacgacacctatggagatgcttaaaatccagcttcaggatgccggaaggatcgcagcacaacgaaaaatcctcgccgcacaaggccagctgagcgcccagggtggcgctcagccatccgtggaagctcccgcagctcctcgtcccacagccactcagttgacacgcgatctgctgaggagcagaggaatcgctggactgtataagggtctaggcgcaacgctcctgcgggacgtgcccttctcggtggtatactttcccctgttcgctaatctgaatcagctcggcagaccagcatccgaggagaaaagcccattttatgtgtccttcttagcaggatgtgtcgcagggtccgccgctgcagtggcggtcaacccgtgtgacgtggttaagacgcggctgcaaagcctccagcgcggagtgaatgaggacacttactctgggatcctagactgtgctcgtaaaatcttgcgtcatgaaggacccagcgcctttttgaaaggtgcttattgccgggctctcgtgatcgcacccttatttgggattgcccaggttgtgtacttcctgggcatcgcagagtcgcttctcggcctcctccaggatccacaggcatag

SEQ ID NO: 241242 - DNA, 345 bp, Artificial Sequence
  Description of Artificial Sequence: Synthetic coding sequence
atggccgacaagcagattagtctacctgcaaagctgattaacggtggcattgcaggcctcatcggcgtcacttgtgtctttcccattgacctggccaaaactaggctgcagaaccagcaaaatggtcaaagggtgtacacttccatgtccgattgtctcattaagacagtccggagtgaagggtacttcgggatgtatcgcggagccgctgtcaacctcaccctcgtgaccccagagaaggctattaagcttgctgccaacgatttctttagacatcagctgtccaaggacggacaaaagctgacactgttgaaagagatgctggctggttgcggagctgggtag

SEQ ID NO: 241243 - DNA, 237 bp, Artificial Sequence
  Description of Artificial Sequence: Synthetic coding sequence
atggctgacaaacagatcagcctgcccgcaaagctgataaatggcggtatcgccggtctaattggcgttacctgtgtattcccaatcgatctcgccaaaacccgtctgcagaatcaacagaacggacagcgggtttacacatcaatgtcggactgtctcatcaagaccgtgaggtctgagggatatttcggaatgtaccgcggagcagccgtcaacctcactctagtcactccttag

SEQ ID NO: 241244 - DNA, 321 bp, Artificial Sequence
  Description of Artificial Sequence: Synthetic coding sequence
atggctgacaaacaaatctctctccctgcaaagctgattaatggcggaatagctggcttaatcggcgtgacttgcgtctttcccatcgacttagcaaagacaaggcttcagaaccagcagaacggccagcgagtatatacctctatgagcgactgcctgatcaaaaccgtcaggagtgaaggatattttggcatgtatcgcggagctgccgttaatttaaccctagtgaccccagaaaaagccatcaaattggccgcaaatgattttttcaggcaccagctgtctaaggacgggcagaaacttaccttgcttaaggagtag

SEQ ID NO: 241245 - DNA, 408 bp, Artificial Sequence
  Description of Artificial Sequence: Synthetic coding sequence
atggccgacaaacagatctccctcccagccaagctgatcaatggaggtattgctgggcttatcggcgtgacgtgcgtgtttcctatagacctagctaagactcggttacagaatcagcagaacgggcagagggtctacacctccatgtcagactgcctgatcaaaactgtgaggagtgaggggtattttggaatgtacagaggcgcagctgtaaacctcacgcttgtgacgccggagaaggccattaagttggccgcaaacgatttctttcggcaccagttatctaaagatggacagaaactgactctgttgaaggagatgttggccggatgcggcgctgggacttgtcaggtcatcgtcaccactccaatggaaatgctaaagatccaactccaggatgccggatag

SEQ ID NO: 241246 - DNA, 948 bp, Artificial Sequence
  Description of Artificial Sequence: Synthetic coding sequence
atgcaccgagagcctgctaaaaagaaggccgagaagcgcctctttgatgccagctcatttgggaaggaccttctggccggaggagtggctgctgccgtcagcaagactgctgttgcccctattgaacgggtcaaattgctgctgcaggtgcaggccagcagcaagcagatcagcccagaggcaagatataagggtatggttgactgcctggtgcggataccgagggaacagggcttcttcagcttctggcgcggaaacttggctaatgttataagatactttccgacacaggccctcaattttgctttcaaggataagtacaagcagctattcatgtctggagttaacaaggagaagcaattctggagatggtttctggcgaatttggccagcggtggtgccgcaggagccacaagtctctgcgtggtttacccgctggattttgcccgaacacgcctaggagtcgacatagggaaaggccctgaggagcgacagtttaagggcctgggcgactgcatcatgaaaattgcaaaaagcgatgggatcgccggtctgtatcaaggcttcggcgtgtcggtacagggcattatagtgtaccgagcctcctattttggggcttatgatacggtgaagggcctgctacccaaacccaaaaagacaccgtttctggtgtcctttttcattgcacaggttgtgaccacatgcagcggtatactcagttacccctttgataccgttaggcgcagaatgatgatgcagtccggtgaagctaagaggcagtataaggggaccttggattgcttcgtaaagatatatcaacatgagggtatttctagcttttttcgaggcgcttttagtaatgtgctgcgtggaacgggaggcgcattagttctcgtgctctacgacaagatcaaggaatttttccacatcgacatcggaggcaggtag

SEQ ID NO: 241247 - DNA, 897 bp, Artificial Sequence
  Description of Artificial Sequence: Synthetic coding sequence
atgggggaccacgcatggtccttcctgaaggacttccttgccggtggagtggcagccgcagtgtctaaaacagccgtcgcccctatcgaaagagtgaagttattgctccaggtccagcacgcttcaaaacagatatccgccgaaaagcagtataagggaatcatcgattgcgtggtgaggatacctaaggagcaaggctttctgagcttttggcgcggaaacctggccaatgtaattagatacttccctacgcaggcgctaaattttgcatttaaagacaaatataaacagctgtttcttggtggcgtggataggcataagcagttttggcgctactttgcgggaaaccttgccagcggcggagcagccggtgccaccagcttgtgcttcgtgtaccccctcgacttcgcaagaactcggctggccgctgacgtcgggaagggagcggctcagagggagtttcacgggttaggtgactgcataatcaaaatcttcaaatcggacggccttcgaggactctaccagggcttcaacgtctctgtacagggcatcatcatataccgtgcggcttactttggggtgtatgacaccgccaagggaatgctccctgaccccaaaaatgtccatattttcgtgtcctggatgattgcacagtcagtaacagctgtcgccggtctggtgtcctaccccttcgacactgtcaggcgaagaatgatgatgcagtctggccgtaagggagctgacatcatgtacacaggaacggtggactgttggcggaagatagccaaagatgagggcgctaaggccttttttaagggtgcctggtctaacgtccttagaggtatgggcggtgcgtttgttttagtcttgtatgatgagattaagaaatatgtgtag

SEQ ID NO: 241248 - DNA, 897 bp, Artificial Sequence
  Description of Artificial Sequence: Synthetic coding sequence
atgacagatgcggctgttagtttcgccaaggatttcttagccggaggagtggcagcagctatctcaaagactgcagttgcccctatcgaaagggtgaagttgctgcttcaggttcaacatgcgagtaagcaaattaccgcagacaagcagtacaaaggaataatagactgtgtggtgcggattccaaaagagcagggggtcctctcattctggagaggcaacctggccaacgttattcgctattttcctactcaggccctcaacttcgcgtttaaagacaagtataaacaaatttttttgggaggggtcgataagcgaacccaattctggttatacttcgccggaaacctggcttcaggcggagctgctggcgcaacttccctatgttttgtctatccccttgactttgcacggaccagactggctgcggatgttggtaaagccggagccgaacgcgaatttcggggacttggcgactgtctggtaaagatttacaaatccgacggcatcaagggattataccagggattcaacgtctccgtccaaggcatcatcatatacagagccgcttacttcgggatatatgacaccgccaaaggaatgttgcccgatcctaagaatacccacatagtgatctcctggatgatcgcccaaactgtaactgccgttgccggactaacctcatatccttttgacactgtgcggaggcgtatgatgatgcagtccgggcgtaaaggcacagacataatgtacacaggaacactcgattgctggcggaaaatagccagggacgaggggggtaaggccttctttaaaggcgcttggagtaatgtcttgcgtggaatggggggagcttttgtgctggtgctgtacgacgaaatcaaaaaatacacatag

SEQ ID NO: 241249 - DNA, 897 bp, Artificial Sequence
  Description of Artificial Sequence: Synthetic coding sequence
atgaccgaacaggctatcagctttgccaaagactttctcgcgggaggaatagccgcagctatcagcaagaccgccgtggcacctatcgagcgcgttaagctcctcttacaggttcagcacgcatccaagcaaattgccgctgataagcaatacaaaggcatcgtggactgcatcgttcgaatccctaaggaacaaggcgtactgtctttttggcgcggtaacctggctaacgtcatcagatattttcctacccaggcccttaacttcgcattcaaagacaagtacaaacagatctttctggggggtgtagataagcatactcagttttggaggtactttgctgggaacttggcctctggaggggctgccggagcaacttccctgtgtttcgtttatcctctggatttcgctcggacccgtttggctgccgacgttggtaaaagtggaactgagcgcgagttcaggggactaggggactgtctggttaaaataacaaagtctgatggaatccgcggtctgtaccagggtttttccgtaagcgttcaaggaataatcatctacagagcagcatattttggggtgtatgataccgccaaggggatgttgcccgatccaaagaatactcatattgttgtcagttggatgatcgcacagacggttaccgctgtggcaggcgtagtctcgtacccctttgacaccgtgagaagacgaatgatgatgcagtcaggacggaagggcgctgacatcatgtacaccgggaccgtggattgctggagaaaaatctttcgagacgaaggtgggaaggcgtttttcaaaggcgcatggagtaatgtcctgagggggatgggaggtgctttcgttctggtactgtatgatgagctgaaaaaggtgatttag

SEQ ID NO: 241250 - DNA, 477 bp, Artificial Sequence
  Description of Artificial Sequence: Synthetic coding sequence
atgaccgagcaggctatcagcttcgccaaagactttctggcgggagggatcgccgcagctatatcgaaaacagcagtcgcacctatcgagcgggttaaactgctcctgcaagtgcaacacgcaagcaagcagatcgctgccgacaaacagtacaaaggcatcgttgactgtattgtccggattccaaaagaacagggcgtgttaagcttctggcgcggtaacctggctaacgttatacgctactttcctacacaagctctgaacttcgctttcaaagacaagtacaagcagatttttctgggtggtgttgacaaacatacgcaattctggcgttatttcgctggcaatctggcgtctggtggggctgctggcgcaacaagcttgtgcttcgtctaccccctggattttgcgcgaactagactcgcggctgacgtggggaagagtggtactgagcgcgaattccgaggattgggatag

SEQ ID NO: 241251 - DNA, 2913 bp, Artificial Sequence
  Description of Artificial Sequence: Synthetic coding sequence
atgctgtgtttcctggatgatggcgctggcatggatccctcagacgcagcctcggttattcagttcggcaaatccgccaagcggacacccgaaagcactcagatcggtcaatacggtaatggactgaagtccggatctatgaggattgggaaggactttattctattcacaaaaaaggaagacaccatgacgtgtctgttcctcagtcggaccttccacgaagaggaggggatcgacgaggttattgtgccgctgcctacctggaatgcccgaacgcgagaacctgtaaccgataatgttgagaaattcgctattgagaccgagttgatctataagtacagtcccttccggaccgaggaagaagtgatgacccagttcatgaaaatcccaggtgacagcggcactctggtcatcatctttaacctgaagctgatggacaacggggaacccgagctagacatcatttcaaacccaagggatattcagatggctgaaacaagccctgaaggcactaaacccgagagacggtcttttagggcctatgcagccgtgctatacattgaccctcgtatgcggattttcattcacggccacaaggtgcagaccaagcgcctgtcctgttgcttgtataagccaagaatgtacaagtacacaagcagtcgcttcaaaacgagggctgagcaggaggtgaagaaagccgagcacgtcgccagaattgccgaggagaaggcgcgtgaggcagaatctaaagcccgtacactggaagtgagacttggtggagatttgacacgggattctcgagttatgttgcgacaggtgcagaatcgagccatcactctcagaagggaggccgacgtcaaaaagaggattaaagaggccaagcaaagggcactgaaggaaccaaaggagctgaatttcgtcttcggcgtcaacatagaacaccgtgaccttgacggcatgtttatttacaactgttcacgattgatcaagatgtacgaaaaggttgggccacaactagagggcggaatggcttgcgggggagttgtcggtgtggtggatgtgccatatctggtgctggagccaacacacaacaaacaggactttgccgatgccaaagagtaccggcacctcctccgggctatgggcgagcatttggcccagtactggaaggatatcgccatcgctcagcggggaatcatcaaattttgggacgagttcggttatctgtccgccaactggaaccaacctcctagcagcgagctacggtataagagacggagagctatggagattccgactactattcagtgtgacctgtgtttaaaatggaggacactgcccttccaacttagctcggtggagaaggactatccagatacctgggtttgttctatgaatcctgatcccgagcaggatcggtgtgaggccagtgagcagaagcagaaggtgccgctgggcacatttcggaaggatatgaagacccaggaagaaaaacagaaacagctcacggagaagattaggcagcagcaggagaaactagaagccttacagaaaaccactccaatccggtcccaggccgacctgaagaagctccccctcgaggtgacaaccagacccagtacagaggagccagtgaggcgaccccaaagaccccgttcgccaccgctcccggcagtgatacggaatgccccatcacgccctccatccctgccgactcctcggcctgccagtcagcccagaaaggcacctgtgattagtagcacaccaaagctgcctgccttggctgctcgcgaggaggcttctacttcccggcttttgcagcccccagaggcgcctaggaagccggctaacacgctggttaagactgcgagtcgacctgcacctttagtgcagcagctgtccccttcattgctgcccaactcaaaaagtcccagagaggtgccatctcctaaggtgataaagacccctgtggtgaaaaagaccgaatcacccatcaagttgagccccgctacaccttcgaggaaacggagcgtcgcagtttccgacgaggaggaagtggaggaggaggctgagcggagaaaggaacgttgtaagcggggtagatttgttgttaaggaagagaaaaaagatagcaacgagctgtctgattccgccggagaggaggattctgccgatctgaagagggctcagaaggacaagggcttacatgtggaagtccgagtcaatagagagtggtacaccggcagagtaaccgccgtcgaagtgggaaaacacgtagtccgatggaaggtaaagttcgattatgtgccgacagacactacaccgagagaccgatgggtcgagaagggatccgaagatgtgcgcctgatgaagccgcctagcccagaacaccagtcgctagacacgcaacaggaagggggagaagaggaggttggtcctgttgctcagcaggccatcgccgtggccgagccctctacctccgaatgtctacggatcgaaccggacacaactgcattgagcacaaatcacgagactatcgatctcctggtgcaaattctcaggaactgtttgcgctatttcttgcccccatccttccccatttccaagaaacagctttccgccatgaactcagatgaactgatctctttcccacttaaagagtactttaaacagtacgaggtaggcctccaaaatctgtgcaactcctaccagagtcgcgctgacagtagagcgaaagcctcagaagaatcccttaggacctcagagcggaagctgcgggaaacagaggaaaagcttcagaagctgcgaaccaatattgtggcccttttgcaaaaagttcaggaggatatcgacattaatactgacgacgagttggatgcatatatcgaggatctgataactaagggggactag

SEQ ID NO: 241252 - DNA, 627 bp, Artificial Sequence
  Description of Artificial Sequence: Synthetic coding sequence
atgtttgaatttttaagtaatcacatgcgggacgctcaagggagactcgactctacccgcggactgctctgtggattgggggctggcgtcgccgaggcagttgttgttgtatgccctatggagactattaaagtgaaattcattcacgaccagacatcacccaatcctaaataccgcggattcttccatggagtgagggaaattgtacgggagcagggcttgaagggaacctatcagggactgaccgcgacagttctgaaacaggggagcaaccaggctatcaggttcttcgtcatgacctcattaagaaattggtacaggggcgataacccgaataaaccgatgaaccccttgattactggcgtcttcggtgcaattgctggagcagcttccgttttcgggaatactccactggatgtgatcaaaacgcgaatgcagggtctggaagcccacaagtatcggaacacatgggattgtggactacagattctgaaaaaagagggcctcaaagccttttacaaggggacagttccacggctgggtcgggtatgtcttgacgtggccatcgtgtttgtgatttatgatgaagttgttaagctgcttaacaaagtatggaagacggattag

SEQ ID NO: 241253 - DNA, 999 bp, Artificial Sequence
  Description of Artificial Sequence: Synthetic coding sequence
atggccgcagctaccgcagctgccgcactggccgcagcggatcctccgccagccatgccgcaggcggctggagctgggggacctacaacccggagggatttttattggttacgatcttttctggccggtggcatcgcgggttgttgtgccaagacaacggttgccccactggacagagtgaaggtactgctccaggcccataaccaccattataagcacctcggggtgttttccgctctcagggccgtccctcaaaaggaaggtttcctcggcctttacaagggtaacggtgccatgatgatcagaatatttccatacggcgctattcagttcatggcatttgagcactacaagacactgatcacgacgaagctcgggatcagtggtcatgtgcaccgcttgatggctggcagcatggccggaatgacagccgtgatttgcacataccctctagacatggtgcgcgtgaggctggcatttcaggtcaaaggcgagcactcttacacggggattatccatgccttcaagacaatctatgctaaagagggaggattctttggcttctacagaggtttaatgcctactatattggggatggccccatatgctggcgtctctttttttacctttgggactctgaagtctgtgggtttaagccacgccccaacgctactcggaagaccttcctctgacaaccccaatgtgctcgtgctgaaaacccacgtgaatctcctgtgtggcggtgtggcaggcgctatcgcgcaaaccatctcctaccccttcgacgtgacgcgccgacgaatgcagctggggacagttcttccggagtttgagaaatgtctgacaatgcgggacaccatgaagtatgtgtacggacatcacggtatcagaaaaggattgtacagaggcttgtcactcaactacatcaggtgtattcctagccaggcagtcgcctttaccacctacgagctcatgaagcagttcttccacctcaattag

SEQ ID NO: 241254 - DNA, 705 bp, Artificial Sequence
  Description of Artificial Sequence: Synthetic coding sequence
atgatgattagaatctttccctacggtgccatacagttcatggcttttgagcattacaagactctcattacaaccaagctgggaattagcggccacgtccacagacttatggcaggctcaatggccggaatgactgccgtcatctgcacctatccactcgacatggtgcgggtgcgactcgctttccaggtgaagggggagcacagctatactgggatcatccatgccttcaagacaatttacgcaaaggaagggggattctttggcttctacagggggctgatgcctacgatcttagggatggcaccgtacgcaggcgtcagtttctttaccttcgggacactcaagagtgttggtctctcccacgctcccaccctcttggggagaccgagttcagacaatccgaacgtgcttgtgctaaagacccacgtgaatctgctgtgcggcggagtagcaggcgcaatagcccagacaatcagttatccattcgacgtcaccagacgacggatgcagctggggacagttctcccagaattcgaaaagtgcctgaccatgcgtgatactatgaagtatgtgtatgggcatcatggcatacgtaagggactctacagaggactgagcctcaattacatccgatgcatcccttcacaggccgtggctttcacaacatatgaactgatgaaacagttttttcatctgaactag

SEQ ID NO: 241255 - DNA, 906 bp, Artificial Sequence
  Description of Artificial Sequence: Synthetic coding sequence
atgaagagtaaccccgcaatccaagccgctatagatcttacagccggagcagcaggaggtaccgcatgcgtgctgaccggccagcccttcgatacaatgaaagtcaagatgcagacttttcctgacttatatcggggtttgacggactgctgcctcaagacatacagccaggtaggattcaggggcttctacaaaggtacctctcccgcattaatagctaacatcgccgagaatagtgtcctgttcatgtgctatggtttttgccaacaggtggtccgcaaagtggctgggctggacaagcaagctaaactgtctgacctgcaaaacgcagctgcgggatcctttgcttccgcatttgccgcactagttctatgtcccactgaacttgttaagtgccgcctccagacaatgtacgagatggagactagcggaaagatagccaaaagtcaaaacaccgtgtggagtgtaatcaaatcaatcctccggaaggatggcccactaggtttctaccatgggttgagtagtacgctgctgagggaggtcccaggatactttttcttctttgggggttatgaactctcacgatccttttttgctagcggtaggagtaaagacgaactggggccagttccactcatgctgtctggaggagttggaggtatctgcctctggctcgccgtctatccagtggattgtatcaaaagccggatccaggtgctgtccatgagcgggaagcaagccggattcatcagaaccttcattaatgtggttaagaacgagggtatcacggccctctattcaggactcaaaccaacaatgatccgtgcttttcccgctaacggagcactatttctggcctacgagtattcaagaaaactcatgatgaaccaactggaagcttactag

SEQ ID NO: 241256 - DNA, 402 bp, Artificial Sequence
  Description of Artificial Sequence: Synthetic coding sequence
atgaagagtaatcccgcaatccaggccgctatcgacctcaccgctggtgcagcaggaggcactgcgtgcgttctcacaggccagcctttcgacaccatgaaggttaagatgcagaccttccccgacctgtacagaggcttaacggattgttgcctgaaaacttatagtcaagttggcttcagagggttctataaagggactagcccagctctaatcgcaaacatagctgaaaactccgtcctgttcatgtgctacggattctgccagcaggttgtgcggaaggttgctggcctggataagcaagccaaactgtcaactgtgtggtctgtgatcaagtcaatcttgaggaaagacggtcctctcggtttttatcacggtctgtccagcactttactgaggtag

SEQ ID NO: 241257 - DNA, 402 bp, Artificial Sequence
  Description of Artificial Sequence: Synthetic coding sequence
atgaagtcaaatcctgccatccaagctgccatcgatcttacggccggtgccgcaggcggaactgcatgtgtgctcactggacagccgtttgacacaatgaaggtgaagatgcagacgtttcccgacctgtatagaggccttacagactgttgcctgaaaacatactctcaagttggcttcagggggttctataagggcacttcccctgctctcatcgcgaacattgcagagaacagcgtgctgtttatgtgctacggcttctgtcagcaggttgtcagaaaggttgcaggtctcgacaagcaagctaagctgtcaactgtatggagcgtaataaaatcgatcctccgtaaggatggccctctgggcttctaccatggcttatcctccaccctcctgagatag

SEQ ID NO: 241258 - DNA, 906 bp, Artificial Sequence
  Description of Artificial Sequence: Synthetic coding sequence
atgaaatctaatccagctatacaagccgctatagacttgactgccggagcagccggtgggacggcctgcgtcctcactggtcaacctttcgatacgatgaaagtgaaaatgcagacatttcccgatctgtacaggggactgaccgattgctgtttgaagacctatagtcaagtgggcttccgcggattctataaaggcacctctcctgctctcatagccaacatcgccgaaaattccgttctttttatgtgctatggcttctgtcagcaagtggtccggaaggtggccggtttggataaacaggccaaactgtccgacttgcagaacgcagccgcagggagcttcgcgagcgcattcgcggctctggttctgtgtcccaccgaactggtgaaatgcagactccaaactatgtatgaaatggagacttccggcaaaatagccaaaagccagaatacagtctggtccgtgattaaatccattttgagaaaggacggcccacttggtttttaccacggtctttcatctaccctgttgcgagaggtgcctggctattttttctttttcggcggatacgagctgtcgaggagcttttttgcgagcggaagaagcaaagacgagctcggccctgtgccgctcatgttgtccggtggggtcgggggaatctgtttgtggctggccgtgtacccagtggattgcatcaagagcaggatccaggtgttatccatgagcggaaaacaagcagggtttattcggacattcatcaacgtggttaagaatgaaggcatcacagcactctatagtggattgaagcccacaatgatcagagcatttccagcaaatggagccctattcctagcatatgaatacagcaggaagcttatgatgaaccagctagaagcctactag

SEQ ID NO: 241259 - DNA, 726 bp, Artificial Sequence
  Description of Artificial Sequence: Synthetic coding sequence
atgaagagcaatcccgctattcaggctgccatagacctcacagctggggctgctgggggaaccgcgtgtgtgctcacagggcagcctttcgatacaatgaaggtcgccggactggacaaacaggctaagctgtcggacctgcagaatgcagccgcaggctccttcgcctctgctttcgcagctctcgtgctgtgccctaccgaactggttaaatgtagacttcagactatgtacgaaatggagaccagcggcaagattgccaagtcacaaaacactgtatggagcgtgatcaagagcattctgcggaaagatggccctctgggattctaccatggcctgtctagcacgctgctgcgggaggtgcccggttacttttttttctttggaggttatgaattatcccgttctttttttgcctctggcaggagtaaagatgagttgggccctgtgcccttgatgttgagcggaggcgtcggaggcatatgcctttggctcgcagtgtacccggtggattgcatcaagtcgcgtatacaggttctctctatgtcggggaaacaggctggattcattcgtacctttattaacgtagtcaaaaacgagggcattacagctctatatagcgggctgaagccaaccatgatacgggcatttcctgcgaacggcgctctgtttctggcatacgagtatagccgaaaactgatgatgaatcaactggaggcgtactag

SEQ ID NO: 241260 - DNA, 906 bp, Artificial Sequence
  Description of Artificial Sequence: Synthetic coding sequence
atgaagtccgggcctggaatccaggccgcaattgatctgactgccggagctgccggtggcaccgcctgcgtgttgacagggcagccatttgatactattaaggtcaaaatgcaaacattccctgatttgtacaagggactcacggactgtttcctcaagacttacgctcaggtgggcctacggggtttctacaagggtacaggcccagcgctaatggcttatgtggccgagaatagtgtactgttcatgtgctatggcttttgccagcagttcgtaaggaaagtggctggcatggacaaacaggcgaaactgagtgatctccagacggcggcagccggtagcttcgcttccgcttttgccgcactcgcattgtgccccaccgaacttgtcaagtgccgactacagaccatgtatgaaatggaaatgtccggcaagatcgccaaaagccataacacaatttggagcgttgtgaagggcattctcaaaaaagacggtccattgggcttctatcatggcttgagctctacactgctgcaggaagtgcctggttactttttcttctttgggggatatgagcttagtcgctccttctttgcctcggggcgaagcaaggacgaactcggcccagtccacctgatgctgtccggtggagtagcgggtatttgcctttggcttgtggtgtttcccgtcgactgtattaaaagtaggatccaggtactgtccatgtatggcaagcaggctgggtttattggcaccttactgtcagtagtccgtaatgaaggaatcgtggccttgtacagtgggttaaaagcaacaatgattcgggcaatacccgcaaatggcgctttgttcgtggcctatgaatacagtcgaaaaatgatgatgaagcagcttgaagcctactag

SEQ ID NO: 241261 - DNA, 423 bp, Artificial Sequence
  Description of Artificial Sequence: Synthetic coding sequence
atggcaggatggaacgcgtatatcgacaacctcatggctgacggaacgtgtcaagatgcagcaatcgtcgggtacaaagattccccatcagtctgggcggcagtacccggtaaaacgttcgtgaatatcacccccgcagaagttggagtcctggttggcaaagatcggagctcgttctacgtgaacggcttaactctagggggacaaaagtgctccgtcattcgtgacagtctcttgcaggatggggaatttagcatggatctgcgcaccaagagcactggcggtgcacctaccttcaatgtcaccgtgactaagaccgataagaccctcgttcttctgatgggtaaagagggtgtgcacggcggactcatcaacaagaagtgttacgaaatggctagtcacttaaggcgcagccagtactag

SEQ ID NO: 241262 - DNA, 792 bp, Artificial Sequence
  Description of Artificial Sequence: Synthetic coding sequence
atggcagcaaccgcaagtgctggagccggaggaatcgacggtaaaccaaggaccagccccaagagcgtgaaattcttgttcggtggtctggctggtctcagcgccggtttgcttcgccaggccacatatactaccacccggctcggaatttacacagtcctcttcgagcgacttaccggagctgacggtacgcctccgggattcctgttaaaagccgtgatcgggatgactgctggcgctaccggagcttttgtggggacaccagccgaagtggcgctaatacggatgacggccgatgggcgactgcctgccgatcagagacgaggttacaaaaacgtgtttaacgcgttgatcagaattacccgggaggaaggcgttctcacactttggcgcggatgcattccaaccatggctagagccgtggtcgtgaatgctgcccagctggcttcatactctcaatccaagcagttcctgctcgatagcggttattttagcgataacatattgtgtcacttctgcgcgtctatgatatctggcctggtgacaactgccgcaagcatgccagtggatattgccaagacccgcattcagaatatgagaatgatcgacggaaagccagaatacaagaacggccttgacgtgcttttcaaggtcgtgcgctacgaaggcttcttcagtttgtggaagggcttcaccccatattatgctagacttggcccacacacagtcttgacctttatttttctcgagcagatgaacaaggcctataaacgcctcttccttagtggatag

SEQ ID NO: 241263 - DNA, 678 bp, Artificial Sequence
  Description of Artificial Sequence: Synthetic coding sequence
atggaatactggtacgtggcactgaagcagcagtcactgaaggcagacattctgccctccctgttccttagtatcttcctggtaaaaggggtcgtgaacgtgttactgactaccccgttgtgggttgtaaatacaagattgaaattgcaaggtgcaaagttcaggaacgaggacattgtgccaaccaattacaaaggaatcattgacgcgttccaccaaatcatccgtgacgagggcatctctgcactgtggaacggcacatttccctccttgctcttggtgtttaatcccgctatccagttcatgttctacgagggactgaaacgccagctgctgaaaaagaggatgaagctgagcagtcttgacgtcttcattatcggggctgtggccaaggcaattgctacaactgtgacgtacccactgcaaacagtgcagagcattctgagatttgggaggcatcgactgaaccccgagaacagaaccctcggaagcctaaggaacattctgtatctactgcatcagagagtccgcaggttcggcatcatggggctctacaaaggcctggaagctaaacttctccagacagttctgacagccgcactcatgttcctagtgtatgagaagttgaccgcagcaacattcacagtgatgggcttgaagcgcgctcatcagcattag

SEQ ID NO: 241264 - DNA, 279 bp, Artificial Sequence
  Description of Artificial Sequence: Synthetic coding sequence
atggggtccgtgacagccatgacagtatttttcccattagacaccgcgagactgcgcctccaggtggatgagaaaagaaagtccaaaacaacacacatggtgctgctggaaattatcaaggaggagggccttctggcgccttaccgcggatggttccctgtgatctcatccctgtgctgttctaactttgtgtacttctataccttcaactcactcaaggcactgtgggtgaaaggccagcattcgaccacaggaaaggatctggttgtaggcttttag

SEQ ID NO: 241265 - DNA, 924 bp, Artificial Sequence
  Description of Artificial Sequence: Synthetic coding sequence
atggcctcagtgctgtcctacgagtcgctggtgcatgcagttgccggagctgtggggagcgtgacagcaatgactgtgttttttcccctcgatacagccagacttcgcttgcaagtggatgagaaaagaaagtccaagaccacccatatggtccttctagagatcatcaaggaggaaggtctgcttgcaccttatagagggtggttcccagttatttcatctctgtgctgctcaaattttgtctatttctatacttttaacagccttaaggcattatgggtcaagggacaacactccaccacaggcaaggatctcgtcgtgggattcgtggccggagtggtgaacgtgctcttgacaacaccattatgggtggtgaatacccgtctcaaactgcagggggctaaattccgcaatgaggatatcgtgccaaccaattacaagggcataatcgacgccttccatcagatcattagggatgagggtatttcagccctatggaacggcactttcccctcacttctgttagttttcaaccccgcaatccagttcatgttttatgagggactaaagcgacagctgttaaaaaaacggatgaagctgagctcgctcgacgtctttataataggagccgttgcaaaggcaatcgctaccaccgtgacttatcccctgcagaccgtgcagtctatactaagattcggtcgacatcgactgaatccagaaaatagaactctgggctctctgagaaacattctgtatcttctccaccagcgcgtgaggaggttcggcattatgggcctgtataaaggcctggaagctaagctgcttcagactgtgttaacagcagccctgatgtttctcgtgtacgaaaaactcaccgcagccactttcacggtgatgggacttaagcgagcgcaccagcactag

SEQ ID NO: 241266 - DNA, 705 bp, Artificial Sequence
  Description of Artificial Sequence: Synthetic coding sequence
atggcgtccgtcttgagttacgaatcgcttgtgcacgcggtggcaggcgcagtcggctctgtaactgccatgacggtctttttccctctggacactgcaagactgcgcttgcagggcgtcgttaacgtgttattaacgacgcctctctgggttgtgaatactcggttaaagctacagggagccaagtttagaaacgaggacatcgtgccaaccaactacaagggtatcatcgacgccttccatcagattattcgagatgagggcattagcgctctgtggaacggtacgttccccagcctcctgctcgtctttaatccagcgatacaattcatgttctacgaaggcctgaagcggcagctgctgaaaaagcgcatgaaactctcctctctagacgtctttattattggcgcagtggcgaaggcaattgctactactgtgacttatccactgcagaccgttcagagcatactgcggttcggcagacataggctgaacccggagaacaggactttgggttccttgcggaatatcctctatctgttacatcagcgcgtgcggaggtttggtattatggggctgtataaaggactagaggcaaagctattacagacagttttaacggcagctctcatgttccttgtttacgaaaagctgactgccgctactttcactgtcatggggctgaaaagggctcatcagcactag

SEQ ID NO: 241267 - DNA, 813 bp, Artificial Sequence
  Description of Artificial Sequence: Synthetic coding sequence
atgattgacgaaaagagaaagagtaaaacaacacatatggtgctgctggagatcatcaaggaagaggggctgttagctccatatcggggttggtttcccgttatttcatccctctgctgctccaatttcgtatatttctatacattcaactctctgaaagctttgtgggtgaagggccagcactcaacgacaggcaaggacctggtcgtgggttttgtggccggagtggtgaacgtcctactcaccacccctctctgggtagtgaatacccgtttaaagctgcagggagccaaatttaggaatgaggatattgtccctaccaattacaaagggatcatcgatgcattccatcaaatcatccgtgacgagggaatctctgccctgtggaacggaacatttccatcccttctcctggttttcaatccagcaattcagttcatgttttacgaaggtctgaagcgccagttgctaaagaagagaatgaaactgtcttctctggacgtgttcatcataggtgctgtagcgaaagctatcgcaaccactgtcacttatcccttacagactgtgcaaagtatactacggtttggcagacaccgactgaaccctgagaacaggaccctgggctcccttcgcaacatactctatttactccaccagcgggtgcggaggttcggaatcatgggtctctacaaagggttggaagctaaactgctccagaccgttctaacggcagccctcatgtttctcgtgtatgaaaaactgacggccgcaacttttacagtgatggggttaaaaagggctcaccagcactag

SEQ ID NO: 241268 - DNA, 1086 bp, Artificial Sequence
  Description of Artificial Sequence: Synthetic coding sequence
atgtttagttccgtggcccacctggctagggccaatcccttcaacaccccacatctgcagctggtgcatgatgggctaggagatctgagatcgagctctccaggtccaacaggccagcctaggaggcctaggaatctggcggctgcggcagttgaggaatattcctgtgaattcggctccgccaaatattacgctctttgtgggtttggcggagtgttatcttgtggcttaacacataccgccgtggtacctctggacttggtgaagtgccgtatgcaggttgatccccagaaatacaaaggcatcttcaatggctttagtgtcacactcaaagaggacggggtgcgaggactggccaaagggtgggctccgacattcctcggctacagcatgcagggcttatgcaaatttgggttctatgaggtttttaaggtgttgtacagtaatatgttaggtgaagagaatacttacctttggaggacgtcgctgtatctggcagcgagtgctagtgcagagttttttgctgatatcgcactggcgccaatggaggctgccaaggtgaggatccaaacccagcctgggtacgccaacaccttgagggatgcagcccctaaaatgtacaaagaggagggcctgaaggcgttttacaaaggcgtggcacccctgtggatgagacagattccctataccatgatgaagttcgcctgcttcgaacgtacagtggaagcactgtacaagttcgtggtgcctaagccaagaagcgagtgctccaagccagagcagctggtggttacatttgttgccggatatattgctggtgtgttctgcgcaattgtaagtcaccctgccgacagtgtcgtgagtgtgttgaacaaggagaagggttcctccgcttcactcgtcctgaagcgcctcggctttaagggcgtgtggaagggcctgttcgccagaataataatgatcgggacccttacagccctgcagtggttcatatacgatagcgtaaaggtctacttccgtctgcctagacctcctcctccagagatgcctgaaagcctcaagaaaaaacttgggctgacccaatag

SEQ ID NO: 241269 - DNA, 1776 bp, Artificial Sequence
  Description of Artificial Sequence: Synthetic coding sequence
atggatgacctggacgctctgctcgcagatctggagagtactacctcacatattagcaagagaccagtgtttctgagtgaggagacaccttactcttatcctaccggaaatcatacatatcaggaaatcgcggtgcctccacctgtgccgcctccaccaagctcggaggcactcaacggcacaattctggacccgttggatcaatggcagccaagcagttctcggttcattcaccaacaacctcaatcgtccagtccggtttacggtagttccgcgaaaacgtccagtgtatcgaatcctcaggactccgtgggtagtccttgctctcgcgtgggagaggaggaacacgtgtactcattccctaacaagcagaagtccgcagagcctagccctaccgtgatgtccaccagtctcgggtccaatctctcagaacttgacagattgcttttagagcttaacgccgttcagcataaccctcccggatttccagccgacgaagccaatagttcccccccactgccaggcgcactgagtccactgtatggggtgcccgaaaccaacagcccccttggcggtaaagccggaccactcacgaaggagaaacctaaaagaaacggcggacggggtcttgaggacgtacggccatctgtggagtctctgctggacgaactagagagtagtgttcctagtcccgtaccagcgataacagtgaaccagggggaaatgtctagccctcagagggtgacatccacacaacagcaaaccaggatttcagccagcagcgccacgagggaactcgatgaactgatggccagcctctcagacttcaagatccagggtttggaacaacgcgctgacggcgagcgttgctgggctgctggatggccgcgagatggcggacgcagtagcccgggaggtcaagatgagggtgggttcatggcacagggcaaaacaggctcctcgagcccccctggcggaccccctaagcccggttctcaacttgattccatgctgggttcactgcagtccgacctcaacaaattaggcgttgcaacagtcgctaagggtgtatgcggtgcttgtaagaagcctatcgctggacaggtggttacagccatgggcaaaacttggcatccagagcactttgtgtgcactcattgccaggaggagatagggtctcggaacttcttcgaacgggacggccaaccttattgtgagaaggattatcacaatctgttttccccgagatgctattactgcaacggacccatattggacaaggttgtgacagctttagacagaacttggcacccagaacactttttctgtgcgcagtgcggcgctttcttcggtccggaagggtttcacgagaaggacggcaaagcctactgccgcaaggattattttgatatgttcgcgcctaagtgcggcggttgcgctcgcgctattctggagaactacatttccgctttaaacacactgtggcaccccgagtgcttcgtgtgcagggaatgtttcactccctttgttaatggtagcttttttgagcacgatggtcagccctactgtgaagtgcactatcatgagcgcagagggagtctgtgctctggctgtcaaaaacccattaccggccgatgcatcacagccatggccaagaaattccatcctgagcatttcgtctgcgctttctgtctgaagcagttaaataaaggaacctttaaggaacagaatgacaagccctactgtcagaactgttttctgaaactcttttgctag

SEQ ID NO: 241270 - DNA, 1086 bp, Artificial Sequence
  Description of Artificial Sequence: Synthetic coding sequence
atgttttcttccgtggcccacctagcaagggcaaacccctttaacactcctcaccttcagctagtccatgatggtctcggcgatctgagaagctctagtcctgggccaactggccagcctcgcagacccaggaacctggcggctgctgccgtggaagagtattcttgcgagttcggcagcgcgaagtattacgccctgtgcggttttggaggcgtgctgagctgtggcctgactcacaccgcggtggtccccctggatttggtgaaatgcaggatgcaggtcgacccacagaagtataaagggatatttaacgggttcagcgtgactctgaaagaagatggggtaaggggtctagcaaaagggtgggcgcctacatttctgggttactctatgcaaggcctgtgcaagttcgggttctacgaggtgttcaaggtcctgtacagcaacatgcttggtgaagagaacacatacttgtggagaacatccctttacctggccgctagtgccagtgctgaattttttgccgacattgcattggcccctatggaggctgccaaagtcagaatacagacacaacctggttacgcaaacacacttcgtgacgccgcacccaaaatgtataaggaggagggactgaaggctttttacaaaggtgtcgcgccactgtggatgcgccagataccctatacaatgatgaaatttgcttgcttcgagcgcactgtggaggccctttacaagtttgtggttcctaagccccgttccgagtgttcaaagcctgagcaactggtcgtcacattcgtcgctggttacattgctggagtgttttgcgcaatcgtgagccaccccgctgattctgtggtgtccgtgctcaacaaagaaaagggcagtagcgcaagccttgttctgaaaagattgggctttaaaggtgtctggaaaggactcttcgccaggataattatgattgggacactgacagcactgcagtggtttatttacgactctgtaaaggtctactttcgactgccgcgacccccacccccagaaatgcccgaatctctgaaaaagaagctcggcctgacccagtag

SEQ ID NO: 241271 - DNA, 1086 bp, Artificial Sequence
  Description of Artificial Sequence: Synthetic coding sequence
atgtttagctctgttgctcatctggcacgcgctaaccccttcaataccccgcatcttcaactggtccacgacgggttgggcgacttgaggagcagctctccaggccctactggccagcccagacggccaaggaatcttgctgcggcagcggtggaggaatatagctgcgaattcggatcggctaaatactatgcattatgtggtttcggtggtgttctctcttgcggcctcacacatactgccgtggtccccttagatctggtgaaatgtcgaatgcaggttgacccgcagaaatacaaaggcatttttaatggattctctgtgacccttaaggaggatggtgttagaggcttggccaaggggtgggcccctactttcttggggtactctatgcagggcctgtgcaaattcggcttctacgaggtgttcaaagtgttatacagtaacatgctgggcgaagaaaacacctacctttggagaacctctctttacctcgccgcatcggcgagcgccgaattctttgctgatattgcgctggcgccaatggaagccgctaaggtgcgaattcagacacagcccggatatgcaaacaccttgcgagatgcggctcccaaaatgtacaaagaggaaggactcaaagctttttataagggcgtggctcccctgtggatgagacaaatcccttacacaatgatgaaatttgcatgttttgagaggaccgtggaggctctttacaaatttgtggtgccaaaacccaggagcgagtgtagtaaacccgagcaactcgtcgtaaccttcgtcgcaggatatatcgccggtgtattttgcgctatagtgtctcatccggcagatagtgtagttagtgtcctcaataaagagaaaggcagctccgcgtccctcgtcctgaaacggctgggtttcaaaggggtgtggaagggcttgttcgcccgaatcattatgatcgggactctcacagctctacagtggtttatatatgattcagtgaaggtctattttcgactgccaaggcccccacctcctgaaatgcccgaaagcctcaagaagaagctcggactgacacagtag

SEQ ID NO: 241272 - DNA, 1089 bp, Artificial Sequence
  Description of Artificial Sequence: Synthetic coding sequence
atgttctcctccgtggcgcacttggctcgggcaaacccatttaacacgcctcatctccagctggtgcacgacggtctcggcgatcttcgaagtagctctccaggtcccaccggacagcccaggcgaccaagaaatcttgccgcagctgccgttgaagagcagtatagttgtgactatggctcaggaagattcttcattctttgtgggcttggcggaataatttcatgtggtaccactcataccgctctggttcctctggacctggtgaagtgcaggatgcaagtggatccacagaaatacaagggaatctttaatgggtttagtgttaccctcaaggaagacggcgtgcgaggcctcgcaaagggctgggctccaaccttcctcggctattctatgcaggggctgtgcaagtttgggttttacgaagtctttaaggtgttgtactcaaacatgctgggcgaggaaaacacctatctgtggagaacttcactctacctggccgcatcagcgtctgccgaatttttcgcagatattgcactcgctccaatggaggctgcaaaggtgcgcatccagacccaacccggatacgcaaacactctacgcgacgctgctcccaaaatgtacaaggaggaagggcttaaagctttctacaagggcgtggccccactgtggatgaggcagatcccgtataccatgatgaaattcgcctgcttcgagcgaaccgtggaggcattatacaagttcgtagtccccaagccccgttcggagtgctccaagcctgagcaactcgtcgtgaccttcgtggctggttacattgctggagtgttttgtgctatcgtatcccatccagccgatagtgtggtgtctgtgctgaataaggagaagggctcctcagcttcattagtccttaagcgattgggtttcaagggtgtgtggaagggcctattcgcgagaatcatcatgatcgggaccctgaccgcgctacagtggttcatctatgatagcgttaaagtgtactttcggttacccaggccccctcctcccgaaatgcctgagtcactaaaaaagaaactggggctcacacagtag

SEQ ID NO: 241273 - DNA, 1086 bp, Artificial Sequence
  Description of Artificial Sequence: Synthetic coding sequence
atgttttcctccgtggcccatctcgccagggccaacccatttaataccccacacttgcaattggtgcatgacggtctgggcgatctgcgctcctcctcccctggccctactggccagccacgcagaccaagaaatttggccgcagctgctgtggaggaatattcttgcgaattcgggtcagccaaatattacgcgctgtgcgggttcggaggcgtgctttcatgtggccttacacacaccgccgttgtaccattagacctggtgaagtgcagaatgcaggtcgatccgcagaagtataaaggaatcttcaacggcttcagcgtaactctgaaggaggacggcgtgaggggactggcaaaaggctgggcaccaacctttctcgggtattcaatgcaaggattatgtaagtttgggttttacgaggtgtttaaggtgctgtattccaatatgctgggcgaggaaaatacttacctgtggcgcaccagtttgtatctcgctgctagcgcatctgcggaattctttgccgacatcgccctcgctcctatggaagccgctaaagtacgcattcagacacagcctggttatgctaatacactgcgggatgccgctcccaagatgtataaggaagagggtctaaaggccttttataaaggcgtggcccctctctggatgaggcagataccctatacaatgatgaagtttgcctgcttcgagagaacggtcgaggccctctataaattcgtagtccccaaacccagatcggaatgctctaagccagagcagttagtggtgaccttcgttgccggttacatcgcaggcgtgttttgcgccattgtgtcccatcctgccgattctgttgtgtctgtgcttaataaggaaaagggttcctcggcgtcactcgtgcttaagcgactggggtttaagggagtttggaagggactgtttgccaggattattatgatcggcacactcacagcactgcagtggttcatatatgactccgtgaaagtgtattttcggcttcccagacctcccccaccagaaatgccagaatcgctcaaaaagaagctggggcttacccagtag

SEQ ID NO: 241274 - DNA, 897 bp, Artificial Sequence
  Description of Artificial Sequence: Synthetic coding sequence
atgtcagcaaaacctgaagtgtctttggtgcgggaggcgagccgccaaatcgtcgcaggcggatcagcgggtcttgttgaaatatgccttatgcatcctcttgacgtggtgaagacgcggtttcagattcagaggtgcgccaccgaccccaactcctataaatcactagtcgacagtttccgcatgatattccagatggaggggctgtttggattttataaaggcattctacctcccattttggcagaaacccccaagcgcgctgtcaagttctttaccttcgagcagtataaaaaactcctgggctacgtttcactgtctccggctctcacgtttgctatcgccggactgggaagcgggctgacagaagcgatcgtggtcaatccttttgaggtcgtgaaggtcggccttcaggctaatagaaatacctttgccgagcagccgtcaacagtaggatacgccaggcagatcatcaaaaaagaaggctggggcctccaaggactgaacaagggtttgacagccacactgggcagacacggggtctttaacatggtctactttggattttattacaatgtaaaaaatatgattccagttaataaggaccctatactggagttctggcgtaaattcggaatcggattgctttccgggaccatcgcctctgtaatcaatattcctttcgacgtagctaagtcccgaatccagggccctcagcccgttcccggagagattaagtacagaacttgctttaaaacaatggcaacagtttaccaagaggaaggcatcctggccctctacaaaggcttgctgcccaagatcatgcgtttaggacccggaggagccgtcatgctgttggtatacgagtacacttattcatggctgcaggagaactag

SEQ ID NO: 241275 - DNA, 900 bp, Artificial Sequence
  Description of Artificial Sequence: Synthetic coding sequence
atgtcagctaagcccgaagtctcactggtgagagaggcaagtcgacagattgtcgctgggggatctgccggtctcgtagaaatctgcctgatgcacccactggatgtcgtgaaaacaaggttccagattcaacggtgcgccacggaccccaactcttacaaatccctggtggactcgtttcgcatgatctttcaaatggagggactttttggcttttacaagggaattctgccacccatccttgcagagactccgaagagggcggtcaaattctttactttcgaacaatacaaaaagctgctgggatacgtctctttatcccctgcactgactttcgcaatcgcgggactcggctcagggcttaccgaggctattgtggtgaatccatttgaagtggtgaaagtgggcttgcaggccaatcgcaatacatttgccgagcagccttccactgtcggctatgcacggcaaattatcaaaaaggaaggatggggactccagggcctcaataagggactcaccgccacactgggcaggcacggcgtttttaacatggtgtattttggattttattataacgtgaagaatatgattcccgtgaataaagaccctatactggagttttggcggaaatttgggatagggctgttgtccggaactatcgcaagtgtcattaacattcctttcgatgtcgccaagtctagaattcagggtccacagcctgttccaggtgagataaaatacagaacctgcttcaagacaatggccaccgtgtaccaagaggagggaatcctcgccctgtataaaggtctcttgcccaagattatgagacttgggccagggggagccgtgatgctgctcgtctatgaatatacctacagctggctgcaggagaattggtag

SEQ ID NO: 241276 - DNA, 963 bp, Artificial Sequence
  Description of Artificial Sequence: Synthetic coding sequence
atggtgggatacgacccaaagccagatgggaggaataacaccaagttccaggtcgccgtggccggaagcgtcagcgggctggtcacccgtgccctcatctcacccttcgatgttattaaaattcgctttcagcttcagcacgaacgccttagccgcagcgatccaagtgccaagtatcacgggattttgcaggcaagccggcagatactgcaggaagaaggaccaacagctttctggaaggggcacgtcccagctcaaattctgtctattggttatggggctgtccaatttctaagttttgagatgcttacagaactcgtgcacaggggatcagtttacgacgcccgtgaattctcagtccatttcgtgtgtgggggattggctgcttgtatggctacgctgactgtgcacccagtggatgtactgaggaccagattcgccgctcagggagagccaaaggtgtacaataccctcaggcacgcagtgggcactatgtataggtctgaagggcctcaggtgttctacaagggcctggctcccacactcatcgctatctttccctatgctgggctgcagttctcatgttactccagtctgaagcacctctataagtgggctattccagctgaaggcaaaaagaacgagaacctgcagaacttgttgtgcggcagtggggctggggtgatctctaagacactaacctacccactcgacttattcaaaaaacgcctgcaggtgggtggattcgagcatgcccgagctgcgttcggacaagtgagacggtataaagggttgatggactgcgcaaaacaagttctccagaaggaaggcgcactgggttttttcaaagggctgagtccttctctgctcaaagctgcgctctcgaccgggtttatgtttttttcctacgagttcttttgtaacgtgttccattgtatgaatcgaacagctagtcagagatag

SEQ ID NO: 241277 - DNA, 963 bp, Artificial Sequence
  Description of Artificial Sequence: Synthetic coding sequence
atggtgggatacgaccccaagcccgatggcaggaataataccaaatttcaggttgctgtcgctggcagcgtgtccgggctggtgactagagcactcattagccctttcgatgtcataaagatccgcttccagctccagcacgaaaggctgtctcgcagcgaccctagcgcaaaatatcatggcatcctgcaggccagccggcaaatactgcaggaggagggcccaactgccttttggaaaggccacgtcccagcccagatcttatcaattggctatggcgctgtacagtttttgagctttgagatgctcaccgagctcgtccatagagggtccgtctacgacgccagagaattttctgtgcactttgtatgtgggggactcgcggcatgcatggctaccttaacagtgcacccagtggatgtgctccgcacccgcttcgccgctcagggcgagcccaaggtgtataacacactgagacacgctgtcggcaccatgtacaggagcgaaggcccacaggtgttctacaagggattggcaccaactctgatcgcaattttcccatatgcaggtttgcagttcagctgttactcctcacttaaacacctttataagtgggcaatccctgctgaaggaaaaaaaaatgagaacctccagaaccttctgtgcggttcgggggcaggagtgatctctaagactttaacatacccactcgacctctttaaaaaacggctacaggtcggcggattcgagcacgctcgcgctgcctttggccaggttcgccgttataagggcctaatggattgcgccaagcaagttcttcaaaaagaaggagcactcggattttttaaaggattgtctccttctctgttaaaagccgcactctccactgggttcatgtttttctcctatgaattcttttgtaatgtttttcactgtatgaatagaaccgccagtcagcggtag

SEQ ID NO: 241278 - DNA, 792 bp, Artificial Sequence
  Description of Artificial Sequence: Synthetic coding sequence
atggtaggctacgacccaaagccggacgggcgaaataacactaagtttcaggtggccgtggccggaagtgtgtctggcctggtcaccagagcactgatctcccctttcgatgtcattaaaatccgttttcagctgcagcatgaaagattaagcagatccgaccccagtgcaaagtaccatggcatattgcaagccagcagacaaatcttgcaggaggagggtcctacagctttctggaagggtcacgttcccgctcagatactgagtatcggctatggagcagtgcaggtttacaataccctgcggcacgcggtcggcaccatgtataggagcgaggggccacaggtgttttataaaggactcgccccaaccctcatagctatctttccttacgccggtttacaattcagttgctactcatccctgaagcacctttacaagtgggctattccagcagaaggcaaaaaaaacgagaacctgcagaatctcttatgcgggtccggagctggggtgatttctaagaccctgacttatcctcttgacctgttcaaaaagcggcttcaggttgggggatttgagcatgccagagctgcctttggtcaggttaggcggtacaagggccttatggactgcgccaagcaggttctgcagaaggaaggagctctcggattctttaagggcctgtcgccatctctgctgaaagctgcgctaagtaccggtttcatgttttttagctatgaatttttttgcaatgtcttccactgtatgaatagaacggcatcacagcgctag

SEQ ID NO: 241279 - DNA, 963 bp, Artificial Sequence
  Description of Artificial Sequence: Synthetic coding sequence
atggtaggctacgatcccaagcctgatggtcgaaataacactaagttccaggtagccgttgcaggttccgtgtccgggctggtgacacgggcacttatctcaccctttgatgtaatcaagattagattccagttacaacatgagcggttgagcaggtctgatccaagcgccaaatatcacggcattcttcaagcttcccggcagattctccaggaagaaggtcctaccgccttctggaagggccacgtaccggctcagattctctccatcggatacggggcagtgcaattcctgtctttcgaaatgctgactgaactcgtgcacaggggaagcgtttacgacgccagagagttcagcgtgcacttcgtgtgtggtgggctggcagcctgtatggccaccctgaccgttcacccagtcgacgtgctccgtactagattcgctgcccaaggtgaacctaaagtgtacaacactctgcgtcatgcggtggggaccatgtaccgtagcgagggcccacaggtgttctacaaaggcctcgcccctaccttgatcgcgatctttccgtacgcgggtctccagttctcatgttattcctctcttaagcacctgtataaatgggcgatccctgcagagggaaagaaaaatgagaacctgcagaatctgctgtgcggttctggcgctggagttatctcaaagacactgacatacccactggacctgttcaaaaaaaggctccaggtaggaggattcgaacacgcaagggcggcatttgggcaggtgaggagatataagggtttaatggattgcgccaaacaggttttacaaaaggagggcgctctggggttcttcaaagggctgagcccctctttgcttaaggccgcactgtcaaccggcttcatgttcttctcctatgagttcttctgcaacgtgtttcattgtatgaaccgcaccgcaagtcagcgctag

SEQ ID NO: 241280 - DNA, 963 bp, Artificial Sequence
  Description of Artificial Sequence: Synthetic coding sequence
atggtaggatacgaccctaaacctgacggaaggaacaatactaagtttcaggtagccgtggccggatctgtctccggtttggttacccgggctctcatctcgcctttcgacgtcataaagatccgcttccagctccagcatgagaggctgtcccggtcagacccctcggccaaatatcacggcattctgcaagcctcacggcagatcctccaggaggagggccctacggcattctggaagggtcacgtgcctgcccagatcctctccatcggatatggtgcggtccaatttttaagcttcgaaatgctcacagaactggtccaccggggttccgtttatgatgctagagaattcagcgtgcacttcgtctgtggaggactagccgcatgtatggccacattgaccgtgcatcccgtggacgtgctgcgtaccaggtttgctgcacagggcgagccaaaagtctacaataccttgaggcacgccgttggcactatgtacaggtccgaggggcctcaggttttttacaagggcttggccccaacccttatcgcaatcttcccgtatgctggtctgcagttctcgtgttactccagtctcaagcatttatataaatgggcaataccagccgaaggcaaaaaaaatgaaaatctgcagaatctcctatgtgggtccggtgccggagtgattagtaagaccctgacctaccctttggatctattcaagaagaggctgcaggtcgggggatttgaacacgcacgggctgccttcgggcaggttcggagatacaaaggtctcatggactgcgccaagcaagtgcttcagaaggaaggcgcactggggttcttcaaaggactcagtccaagtctcctgaaagcggctttgtctacaggattcatgttcttcagctacgagtttttctgtaacgtgtttcactgcatgaacaggacggcaagtcagcggtag

SEQ ID NO: 241281 - DNA, 963 bp, Artificial Sequence
  Description of Artificial Sequence: Synthetic coding sequence
atggtgggctacgaccctaagcctgatggtcggaataataccaagtttcaggtcgccgtcgctggcagtgtgtccggacttgtgactcgggcactcatcagtcctttcgacgtcataaagattaggtttcagctgcagcacgagcgcctgtcaaggagtgatccatctgccaagtaccatgggatcttgcaggcttctcgccagatcctgcaagaggaaggacccacggctttctggaaaggccacgtgcctgcccaaattctatcaatcggatacggggcagttcagtttctgtccttcgagatgctcacggagctggttcatcgcggttccgtctacgacgctcgcgaattttctgttcatttcgtatgcggcggtctggcggcatgcatggctacattgacagtgcacccggttgacgtattacgcacgcggttcgcggctcagggagaaccgaaagtatacaatacactgagacatgctgtgggtactatgtaccgcagcgaaggccctcaggtattctacaagggtctcgctcccacccttatcgcgatattcccctacgccggtctacaattttcctgctactcctccctgaaacacttgtacaaatgggctattcctgctgagggcaaaaagaacgaaaatcttcaaaatctgctctgcgggtctggagccggtgtgattagcaagacactgacatatcctttggatttgtttaagaagcgcctgcaagtgggcggatttgagcacgcaagggccgctttcggtcaggtgcggaggtacaaaggcttgatggactgcgccaaacaagtgctccagaaggagggggctctcggtttttttaagggcctgagtcctagcctcctaaaggcagccctcagtaccggttttatgtttttcagctacgaattcttttgtaacgtgtttcattgcatgaatagaacagcaagtcagcgctag

SEQ ID NO: 241282 - DNA, 2028 bp, Artificial Sequence
  Description of Artificial Sequence: Synthetic coding sequence
atggccgcagccaaagtcgcactcaccaagagggccgatccggcagagcttaggaccatttttctcaaatacgcttcaattgaaaagaatggcgaattcttcatgagtcccaatgactttgtcacccgttatcttaatattttcggagagagccagcctaatcctaaaaccgtcgaattgctgagtggagtcgtggatcagacgaaggacggcctgatatctttccaagagttcgtcgcatttgaatcagtgctctgcgctcctgacgctctttttatggtggcttttcagctgtttgataaagccggaaagggggaggtgaccttcgaggatgttaagcaggtgttcggccagacgactatccaccagcatatccccttcaactgggactctgagttcgtgcagctgcacttcgggaaggagagaaaacgccaccttacctacgccgaattcacccagtttctgctggaaattcaattggagcatgccaagcaggccttcgtgcagagagataacgccagaaccggcagagtgacagcgattgacttccgcgacattatggttacaatccggccacatgtgctcaccccctttgtggaagaatgcttggtcgccgctgccggtggcactacatctcaccaggtttctttttcctacttcaatggctttaactctctgctgaacaacatggaactcattagaaagatttactccacactggctggtacccgaaaggatgtggaggttactaaggaagaattcgttcttgctgcacagaagtttggacaggtgactcccatggaggtggatattctgtttcaattggcagatctctatgaaccccgaggccgaatgactctggccgatattgaaaggatcgctcctctcgaagaggggactctccctttcaacctggcagaggcccagagacagaaggcaagcggcgactccgcacggccagtgctcctgcaggttgcagagtcagcctatcgcttcggcctgggcagcgtggctggcgctgttggggctactgcggtgtacccaatcgatcttgtcaaaacacgaatgcagaatcaaagatccaccggatcctttgttggggagctgatgtataagaattcattcgattgtttcaaaaaagtgctgcggtatgaaggctttttcggactgtatcgcggattacttccgcagctgttaggagtggcaccggagaaagccattaaactgacggtaaatgacttcgtgagggataagtttatgcataaggatgggagtgtgccactggctgctgaaattctcgcgggtgggtgtgctggaggctctcaggtcatcttcacgaatcctttagagatcgtaaagatccgccttcaggttgcaggcgaaataactaccggtcctcgagtgtcagccctgtctgtcgtcagggaccttggattcttcgggatatataagggtgcaaaagcgtgctttcttcgggatatccctttttctgccatctactttccatgctacgctcacgtcaaggcatctttcgcaaacgaggacggacaggtcagtcctggaagtctcctcctggctggagctatcgcaggaatgcctgcagcctccctcgtgactcctgcggatgttattaagactagactgcaggtggccgcaagggctggccagacaacttacagcggcgtgatcgattgttttagaaaaattctgagggaagagggtcctaaagccttgtggaagggagccggagccagagtgttccggtcttctccccagtttggggtcacgctactgacctatgaactgctgcagagatggttttacatcgactttgggggtgtcaagccgatgggcagcgagcctgtgcccaagtcccgtattaacttacccgctcctaaccccgaccacgtagggggatataagttggcagtagccaccttcgcaggcattgagaacaagtttggcctgtacctgcctttgttcaaaccttccgtgtctaccagcaaagctatcggtggcggtccctag

SEQ ID NO: 241283 - DNA, 2031 bp, Artificial Sequence
  Description of Artificial Sequence: Synthetic coding sequence
atggctgctgcaaaggtggctcttaccaagcgagcggaccctgcggaactgcgaacaatatttctcaagtacgcatccatagaaaagaacggtgaatttttcatgtccccaaacgattttgtcacacggtacctgaatatctttggcgagagccaacccaaccctaaaaccgtcgaacttctctccggcgttgtggaccagacaaaggacggattaatttccttccaggagttcgtcgcttttgaatccgttttgtgcgcacccgacgcgttgttcatggtggcgttccagctcttcgacaaggccggtaagggggaagttaccttcgaggatgtaaagcaggtcttcggacaaacaactatccaccagcatattcccttcaattgggactccgaatttgtgcagttacacttcgggaaagagaggaaacgccaccttacatacgccgaattcacccagtttttactggagattcagctggagcacgccaaacaggcattcgtgcagagggacaatgccagaacaggaagggtgactgcgatagatttcagggacatcatggtgactatccgacctcacgtgcttacacccttcgtggaggaatgcctagtcgctgcagcagggggtacaactagtcatcaggtgtcgttcagttacttcaacggattcaattctctcctgaataatatggagctgattcgcaagatctattcgactctcgcaggaacacgcaaggatgtcgaggtgacaaaagaggagttcgttctggccgctcaaaagttcgggcaggttaccccaatggaggttgacattctgttccagctcgcagatctgtacgagccaaggggacgcatgactctggccgatattgagaggatagctcccttggaagaggggaccctgccttttaatctagcagaggctcaaaggcagcagaaggcctccggggatagcgctcgccctgttctattgcaggtggctgaatcagcctatcgcttcggcctggggtctgtcgcgggagcagtcggtgcaacagcagtctatcctatcgacttggtaaaaaccaggatgcagaatcagcgaagcactggctctttcgtgggggaattaatgtataagaacagctttgattgtttcaaaaaagtgctccgatacgagggattttttggcctctacaggggtctgctgccgcagctgctgggagtggctccggagaaagccattaaactgaccgttaacgattttgtccgcgataaattcatgcacaaggacggttctgtacccctggcagctgagatacttgccggaggctgtgccggtggttcgcaggtgatttttaccaacccgctcgagatcgtgaaaattcgcctgcaggtagctggagaaattacaacaggaccgcgagtgtcagcactaagtgtggtaagagatctcggatttttcgggatctacaaaggggcaaaggcttgtttcttgcgggacattccattttctgcaatatattttccctgttacgctcatgtgaaggctagctttgcaaacgaggatggccaggtgagtcccggatctctgctactcgccggagccatagccggtatgccagccgcaagcctggtcactcctgcggacgtcatcaagactcgacttcaggtggctgctcgtgccggacaaaccacctactctggggtaatcgactgttttcgtaagattcttcgagaagagggacctaaggcactttggaagggggctggagctcgggtgttcaggagcagtcctcagtttggggttactcttctgacatatgaactgctacagcgatggttttatattgatttcggtggggtgaagcctatgggaagtgagccagtcccaaagtctagaatcaatttgccagctcctaaccctgaccacgtaggtggatacaagctcgccgtcgccacattcgctggcatcgagaacaagtttggtctgtacttgccactgttcaaaccctccgtgtccacttctaaagccatcgggggaggcccttag

SEQ ID NO: 241284 - DNA, 1704 bp, Artificial Sequence
  Description of Artificial Sequence: Synthetic coding sequence
atggaggatgtgaaacaggtctttggtcaaacgactatccaccagcatattccttttaactgggatagcgaattcgtgcaactgcacttcggcaaggagcgaaagcgtcacctgacatacgcagaattcacccagtttttgctggagatccagctagagcacgccaagcaggctttcgttcagagggataatgcacgcacagggagggtgacagcaattgactttcgtgatatcatggtgaccatccggccacatgtgcttactcccttcgtggaggaatgtctcgtggccgcagccggtggaaccacatcgcaccaggtctcattctcctactttaacggattcaatagcctgttgaacaatatggaactcatcaggaagatctattctactctggccggtactagaaaggacgtggaagtgacgaaagaagagttcgtgctcgccgctcagaaattcggccaggtgactccaatggaggtggacattttgtttcaacttgccgatctatacgagcccagaggaagaatgaccttggccgacatcgagcggatcgcacccctggaggaaggtacactgccgttcaacctcgccgaggcacagcgtcaaaaagcttctggggacagcgctcgacccgtacttcttcaagtagccgaaagcgcctataggttcgggttaggtagtgtggccggtgccgtgggggctaccgctgtgtacccaattgacctagtcaaaacccggatgcagaaccaacgcagtaccggatccttcgtaggcgagcttatgtacaagaacagtttcgattgtttcaagaaagtgctccgatacgaagggttctttggtttataccgcggtctgctacctcagctgctcggtgtggctcctgaaaaggctatcaagctgaccgtgaatgactttgtgagagacaagtttatgcataaggatgggagcgtgcctctggctgctgaaatcttggctggcggttgtgccggtggatcccaggtcatcttcaccaatccactagagattgttaagattagactgcaggtggctggggagattacgacaggtcctagggtgagtgccctgtctgtcgtgcgggatctcggattctttggaatctacaagggggcaaaagcttgctttctgcgagatattcccttctcagccatctatttcccttgttacgcccacgtgaaagcatccttcgcaaacgaggatggccaggtgtctcccggaagccttcttttggcaggagcgatcgccggaatgcccgcagcaagtctcgtcactcccgctgacgtcattaagacacgcttgcaagtcgcagcacgggcaggccagactacctacagcggggtgatcgattgtttccgaaaaattcttcgtgaagagggaccaaaagctctctggaagggggctggagctagagtgtttaggagttctccacagttcggggtgacactactgacgtatgagctgcttcagcgttggttctatatagactttgggggagtgaaaccgatgggaagtgaaccagtgcccaagtcacgcatcaacttaccagctcccaacccagatcatgttggcggatataagcttgcagtagcaacctttgcagggatagagaataagttcggactgtacctgcctttgtttaagccctccgtgtctactagcaaggctatcggcggtgggccatag

SEQ ID NO: 241285 - DNA, 561 bp, Artificial Sequence
  Description of Artificial Sequence: Synthetic coding sequence
atgaaacatatgctggctgcgtctgctggagaggtggtcgcttgtttgataagggtcccttctgaggtcgtcaaacaaagggctcaggtgtctgctagcaccaggacatttcagatattttcgaatatcctgtacgaagaggggatccagggcctgtacagaggttacaagtcgaccgtcctcagagaaattccgttcagcctggtgcaattccctctgtgggaatctctgaaggccctgtggagttggaggcaggaccacgtggtagactcatggcagtctgcagtctgtggcgcttttgctgggggattcgcggcagccgttaccacgcctcttgacgtggcaaagaccaggatcaccctggcaaaagccggatcaagtacagccgacggaaacgtgctgagcgtgctgcatggagtctggcggtctcagggactcgcaggactttttgccggagtttttcctagaatggcagcaatctccctcggtggttttatcttccttggggcatatgatcggactcattctctcctgctcgaggtcgggcgaaaatctccctag

SEQ ID NO: 241286 - DNA, 825 bp, Artificial Sequence
  Description of Artificial Sequence: Synthetic coding sequence
atggaccgacctgggttcgtggctgcgctggtggccggaggagtggctggcgtcagcgtcgacctcatcctgtttcctttggatacaataaaaacacgcctgcagagcccccaagggttttctaaggctggcggattccacggtatatacgctggagtgcctagcgccgctatcggctctttccccaacgcagcggctttttttattacatatgaatacgttaaatggttcttgcacgcagattcttcttcctaccttacgcccatgaagcacatgttggcagcatccgcaggtgaagtggttgcctgcttgatccgggttcccagcgaagtcgtgaaacagcgggctcaggtaagcgcatctaccaggacctttcagatcttttcgaacatcctgtatgaggaggggattcaaggcctgtaccgagggtataaatctaccgtgttaagggaaattcctttttctcttgtgcagttccccctgtgggagagcttgaaggctctttggagctggagacaggaccatgtggtggatagttggcaaagcgcagtgtgcggtgccttcgcaggcggatttgctgccgcagttacgaccccactggacgtagccaaaacaagaattacactggccaaggccggatcctccactgcggatggcaacgttctgtccgtcttacacggggtctggaggagtcaaggactggccggacttttcgctggcgtgtttccacggatggcagcgatatccctcggcggatttatttttcttggggcatacgataggacccactctctgctcctggaggtcggcagaaagagtccctag

SEQ ID NO: 241287 - DNA, 66 bp, Artificial Sequence
  Description of Artificial Sequence: Synthetic coding sequence
atggaccggcctggatttgtggccgcactggtgctgttgcacttcctctctcctatgaatatgtag

SEQ ID NO: 241288 - DNA, 477 bp, Artificial Sequence
  Description of Artificial Sequence: Synthetic coding sequence
atggagggcaaaaggaagttagagggcaagccactgaggttccgaggtgtgcaccacgctttcgccaagatcttggccgaaggcggtataaggggcctgtgggccggatgggtccctaacatccagcgggctgcacttgtcaatatgggggatctgacaacctatgacactgttaagcactatttggtgttgaatacccccctggaggataatatcatgacccatggcctctcatccctgtgctctggactggtggcgtctattctaggaacgcccgcagacgttattaagtctcggatcatgaaccagcctagagacaagcagggcagagggttactgtataaatcttctactgactgtctcatccaggcagtgcaaggagaggggttcatgagtttgtataagggctttctgcctagctggcttcgcatggccgctgtgatcgttaattcttcacgcagccaactgaaagtgtag

SEQ ID NO: 241289 - DNA, 972 bp, Artificial Sequence
  Description of Artificial Sequence: Synthetic coding sequence
atgtcagtccccgaagaagaggaaagattattacccctgacccagagatggccaagggcaagtaaattcctcctgtccggttgtgctgccaccgtggctgaattggccacatttccacttgatcttaccaaaacacgactgcagatgcagggagaggccgctctggccaggctgggcgacggcgctcgcgaatcggcaccctatcgcggaatggtgcggaccgcccttggtataattgaggaagaaggattcttgaagctatggcaaggtgtgaccccggctatatatcgccacgttgtatattctgggggtcgaatggtaacttatgagcacctgcgtgaagtcgtctttggtaaatctgaggatgaacactaccccctctggaagtccgtgatcggcggaatgatggccggagtgattggccagttccttgccaacccaactgacctggtcaaagtccagatgcaaatggagggaaagcgtaagttggaaggcaagccgctccggttccggggagtgcaccacgcattcgccaagatccttgctgaagggggaatccgaggcctgtgggccggttgggtgcctaatatccagcgggcagcactggtgaatatgggagacctgaccacctatgacacagtgaagcactacttagtgctgaataccccgctggaagataatattatgacacatggcctgtccagtctgtgcagtgggttggtggcgtctatcttagggacaccagccgacgtcattaagtcaagaatcatgaatcagcccagggacaagcagggacggggtctgttatataaaagctccacagactgtctgattcaggccgtccaaggcgaagggttcatgtccctgtataagggcttcttgcctagctggctcaggatgacgccttggagcatggtcttttggctgacctacgaaaagatccgagaaatgagcggcgtgagtccattttag

SEQ ID NO: 241290 - DNA, 738 bp, Artificial Sequence
  Description of Artificial Sequence: Synthetic coding sequence
atgagtgtacctgaggaggaagaacggctcctgcctctcacccagagatggcctcgcgcttctaagtttctcctttctggttgtgccgcaaccgtggcagagttagctacctttcccctggacttgactaagaccagactgcaaatgcaaggggaggccgcattagctcgcctaggtgatggcgcacgggaatcggccccttaccgtggaatggtgagaaccgctttgggaatcatagaggaggagggattcttgaagctctggcaaggtgtaacacctgcaatctacagacacgtggtgtactctggaggcagaatggtaacttatgaacaccttcgcgaagtggtcttcggcaagtcagaggatgagcattatcctctctggaagtcagtgatagggggaatgatggccggagttataggccagtttttagccaatcctacagacctggtcaaggtgcagatgcagatggagggaaagcgcaagctggaaggaaaacccctgcggttcaggggtgtgcaccacgcctttgcaaagatcctggccgaaggtggaattagaggcttatgggctggttgggtgcccaacattcaacgcgctgctctcgtgaacatgggagatctgaccacctatgatacagtgaagcactatctggtcttgaatacgcccctggaagataacatcatgactcacggcctcagctctgatttggtggggtcccataaagcaatccagtag

SEQ ID NO: 241291 - DNA, 297 bp, Artificial Sequence
  Description of Artificial Sequence: Synthetic coding sequence
tagaacatgggagatctgaccacctatgataccgtgaagcattatctggtgttaaatacaccacttgaagacaacattatgactcacggtctatctagtctttgcagcgggctggtggcctcgatcttgggcacacctgccgatgttatcaagtcccgtattatgaaccagccccgtgataaacaggggaggggcctactgtacaagagcagtacggattgcctaatccaagcggtgcagggcgaggggtttatgagtctctacaaagggttcttaccgtcatggctacgcatgtag

SEQ ID NO: 241292 - DNA, 450 bp, Artificial Sequence
  Description of Artificial Sequence: Synthetic coding sequence
atgtccgaatgcccacttatcctttacatccacaaacacatcgatacttactcccagagttacctctttaacgacctgttttatcccgtctactcgggagggcgaatggtgacatatgagcatcttagagaagtcgtgttcggcaaatctgaagatgagcactatcccttgtggaaatccgtgatcggcggaatgatggccggagtgatcggccagttcctggcaaatcccactgacctcgtgaaggtccagatgcaaatggagggcaaacgaaagctggaaggcaagcccctaagattccggggagtgcaccacgctttcgctaagattctggccgaagggggaattaggggactgtgggctggctgggtacccaacatccagcgcgctgctctggtgaatatgggcgacctcaccacttacgacactgtcaagcattatctggtgtag

SEQ ID NO: 241293 - DNA, 480 bp, Artificial Sequence
  Description of Artificial Sequence: Synthetic coding sequence
tgaatggaggggaagagaaagcttgaaggaaagcccctacgctttaggggcgtgcaccacgcttttgcgaaaattctggccgagggcggaattcggggtctgtgggcgggatgggtgccaaacattcagagagcggcattagtgaatatgggagatctcactacatacgacactgtgaagcattatctggtcttgaacacccctctcgaggataacattatgacacatgggctcagctctctgtgtagtggtctggtcgcgtcaatcctgggcacacctgctgacgtaatcaagagtaggatcatgaaccagcccagagacaagcaggggagggggctgctttataaatctagtacggattgcctgattcaagccgtacaaggggaaggttttatgagcctgtacaaaggttttctcccctcctggctccgcatggcggcagtaatcgtgaatagtagccggtcccaacttaaagtgtag

SEQ ID NO: 241294 - DNA, 714 bp, Artificial Sequence
  Description of Artificial Sequence: Synthetic coding sequence
atgtacctctaccttatgaagatgccagccgcataccaagtatactcaggaggcagaatggtgacttacgaacatcttcgggaagtcgtgttcggcaaaagcgaggacgagcattaccccctgtggaagtccgtcattgggggtatgatggccggagtgatcggccagttccttgccaatccgaccgatcttgttaaggtgcaaatgcagatggagggtaagagaaaattggaaggaaagcccttgagattccggggagtccaccacgctttcgccaaaattttggccgaaggcggaatccggggactctgggcagggtgggtgcctaatatacagagagcagccttagttaacatgggcgatcttacgacctacgatacagttaagcactatcttgttttgaacacacctctagaggacaacattatgacccatgggctgagtagcctgtgttctggactggttgcctcgattctcggaacaccagccgacgttatcaagagcagaatcatgaaccagcccagagacaagcagggcaggggactgctgtacaagtcgagtactgattgtcttatacaggctgtgcaaggagagggttttatgtctctatataaaggattcctgcccagctggctacgtatgactccgtggagtatggtgttttggcttacttacgaaaaaatccgcgagatgagcggtgtctcacccttctag

SEQ ID NO: 241295 - DNA, 1095 bp, Artificial Sequence
  Description of Artificial Sequence: Synthetic coding sequence
atggagttagagggacgcggtgccggtggggtggctgggggacccgcagctgggccaggtcggagcccgggtgagtcagcacttctggatggttggctgcagcgaggagtgggcagaggggcaggtggaggtgaggctggcgcttgcagacccccagtccggcaggaccccgactcaggccctgattatgaagcactgccagctggcgctactgtgacaactcacatggtcgcaggcgctgtagctggtatcctggagcactgtgttatgtatcccatcgattgtgtcaaaacacggatgcagagtctgcagcccgaccccgctgcaagataccgtaatgtcttggaggcattgtggaggatcatccgaacagagggcttgtggaggcctatgcgaggtctgaacgtaactgcgactggagctggtcctgcccacgccctttatttcgcgtgttatgagaaacttaaaaagacgctcagcgacgttatccatccagggggtaactcccatatagccaatggggcagcaggctgcgttgccacactgctccacgatgccgctatgaatcccgctgaggtggtcaagcagcgtatgcaaatgtacaatagcccatatcacagagtcactgactgtgtgagggcagtatggcagaacgagggagcgggtgccttctatagatcttacactactcagctgacgatgaatgtccctttccaagctattcattttatgacgtatgaatttctgcaggaacattttaacccacagaggcgttataatccctcaagccatgtgctgtcaggtgcatgcgccggagccgtcgccgcagctgccaccactcccctggatgtctgtaaaactctcctcaacacccaagaatctttggccctcaactcacacattaccggacatatcaccggaatggctagcgcattccgtaccgtgtaccaggttggcggtgtaacagcctattttaggggagtgcaggcgcgagtgatataccaaataccaagcacggccatcgcttggtccgtgtatgaattcttcaagtatcttattactaagagacaggaggagtggcgggctggaaagtag

SEQ ID NO: 241296 - DNA, 678 bp, Artificial Sequence
  Description of Artificial Sequence: Synthetic coding sequence
agaggtgcggctgggtggtcccattgtcaccacgcccatgggggacgacggaggggaagagacccaggcgcactgcgggacgtgccacatagactgcgacagggggctgcaggctgtgtggctacactgctgcacgatgccgcaatgaatcctgccgaggtcgtcaaacagaggatgcaaatgtacaactcgccataccatcgcgtcactgattgtgtcagagctgtatggcaaaatgagggggcaggcgctttctaccgaagctacaccactcagctcactatgaacgtgccgttccaggccatccacttcatgacctacgagttcttgcaggaacacttcaatccccagaggcgctacaaccctagctcccatgtcctgagcggcgcttgcgcaggggctgtcgccgcagcagcaaccactcctttggatgtgtgtaagaccctgctgaatacacaggaaagtctggccctcaattcccacataactggtcacatcaccgggatggcctcagcgttccgcactgtttatcaggttgggggagtcaccgcctacttcagaggcgtgcaggcccgtgtgatctaccagattccgagcacagccatcgcttggtcagtctatgagtttttcaaatacctcatcactaagaggcaggaagagtggcgggcaggaaaatag

SEQ ID NO: 241297 - DNA, 876 bp, Artificial Sequence
  Description of Artificial Sequence: Synthetic coding sequence
atgagtgccctaaattggaagcccttcgtgtacggaggattagctagtatcacggccgaatgtgggacatttccaatcgacctcactaaaacgcggctgcagattcagggccaaactaacgatgccaaattcaaggaaatcagatatcgcggaatgcttcacgcactcgttcgaattggaagagaggagggcctgaaggccctttatagtgggattgctcccgctatgctgcggcaggctagctatgggaccatcaaaattgggacctaccagagcctcaagagactattcatcgaacggcctgaagatgagaccctcccaattaatgtgatctgcgggattcttagcggagtgatttcaagcacaattgcgaaccctacagacgtgctcaaaataaggatgcaggctcagtccaatacaatccagggaggaatgatagggaatttcatgaatatctaccagcaggagggcacgcggggactgtggaagggggtgtccttgaccgcacaacgtgctgccattgtcgttggggttgagcttcctgtgtatgatatcacgaagaagcacctcattctgtctggcttgatgggcgacacggtttacacccacttcctgagttccttcacctgcggccttgctggcgcactggcctctaaccctgtggatgtggtacgcacaaggatgatgaatcagagagttctgagggacggccgatgttccggatatacggggaccttagactgcttactgcagacctggaagaacgagggctttttcgctctttacaaaggtttctggccaaactggctgcgtttaggcccttggaatatcattttttttgtgacgtacgagcagctgaagaaactcgatctgtag

SEQ ID NO: 241298 - DNA, 651 bp, Artificial Sequence
  Description of Artificial Sequence: Synthetic coding sequence
atgttacgccaggcctcgtacgggacaattaaaataggtacatatcagagcctgaagagactgtttatcgagaggccagaagatgaaacactgccaatcaatgttatctgcggaatcctctcgggagttatctcctccacaatcgctaaccctaccgatgtgctgaagatccgcatgcaagcccagtcaaatactatccagggaggcatgattggcaacttcatgaatatctaccagcaggagggaactagaggcctttggaagggggtctcactcactgcgcaaagagccgcaattgtcgtgggagtggagttgcctgtctacgatataactaagaagcatctgatcctgtccggcctcatgggcgatacagtgtacacccatttccttagcagcttcacgtgcggtctggccggagcactggcgagtaatcctgtggatgtggtcaggaccagaatgatgaaccagagggtgctgcgggacggcaggtgctccggatacacaggaaccctagactgcctgttacaaacatggaaaaacgaaggatttttcgccctctacaagggattctggccaaattggctaagactgggcccatggaacatcatctttttcgtcacttacgagcagctgaagaagctggatctgtag

SEQ ID NO: 241299 - DNA, 723 bp, Artificial Sequence
  Description of Artificial Sequence: Synthetic coding sequence
atgctgcatgctctggtgagaatcggaagagaagaaggattaaaagccctatactcaggcatcgctccggcaatgcttcggcaggcgtcctatggcacaatcaagataggcacctaccagtccctgaaacggttattcatcgagagacccgaagacgagaccctgcctattaatgtaatctgcgggattttatcgggcgtaatcagctccactatagccaaccctacggacgttctaaaaattcgcatgcaggcccaatctaacaccatccagggaggaatgattgggaattttatgaacatttaccagcaggagggcacgaggggactatggaagggagtttctctaaccgcccagcgcgcagccattgtagttggggtcgaattacctgtgtacgacattactaagaaacacttgattctgtccgggttaatgggcgacacagtgtacactcattttttgtcttcctttacttgtggactcgcaggagctcttgcctctaatcccgtggacgtggttcggactcggatgatgaaccagagagttctccgcgacggcaggtgcagtggatacacaggaactctggactgcctcctgcaaacatggaagaacgagggattttttgctctgtataaaggattctggcccaactggctgcgcctgggtccctggaacattattttcttcgtgacatacgaacaactcaagaaactggatttgtag

SEQ ID NO: 241300 - DNA, 948 bp, Artificial Sequence
  Description of Artificial Sequence: Synthetic coding sequence
atgaccggtcagggccaatctgcgtctgggagtagtgcctggtcaaccgtgtttcgtcacgttcgctacgaaaatctaatcgctggcgtgtcgggtggagttttgtccaatctcgcgcttcaccctctggacctcgtgaaaataaggtttgccgtatctgatgggctagagcttcggccaaagtacaacggaattttacattgtctgaccacgatttggaaattagacgggctgcgtggactgtaccaaggtgttactcccaatatatggggcgctggcctgagctgggggttatactttttcttctacaatgccattaagtcgtacaagacagaagggcgagccgagcgattggaggcaacggagtatttagtgagcgccgctgaagccggagctatgaccctctgcatcacaaatcctctgtgggtgacaaagacccggctgatgttacagtacgatgcagtcgttaacagcccgcacagacagtacaagggtatgtttgacacactggtgaagatatataaatatgagggggtgagaggtctgtataagggattcgtgcctggattattcggaaccagccatggagccctgcagtttatggcttacgagctgctgaagctcaagtacaatcagcatatcaacagactccccgaagcccaactgagtacagtcgagtacatttcagtagccgctttgtctaagatattcgctgttgcagctacatacccctaccaggtggttagagcacgcctgcaggaccagcatatgttttatagcggcgttattgatgtgataacaaagacttggagaaaggaaggcgtgggaggattctacaagggaatagctccaaacctgattcgagtgacccctgcttgttgcatcactttcgtcgtgtacgagaacgtgtcccattttctactggatctacgagagaaaagaaaatag

SEQ ID NO: 241301 - DNA, 900 bp, Artificial Sequence
  Description of Artificial Sequence: Synthetic coding sequence
atgaccggtcaaggtcagagtgcctccggctcctctgcctggagcgggggtgttttaagcaatttggccctgcatcctctagacctggtcaagatacgattcgcggtgtcagatgggctcgagctcaggccaaaatataacggaattctgcactgccttaccactatttggaaactagatggactcaggggattataccagggtgtcaccccaaatatttggggcgcaggcctatcatggggtttgtacttctttttctacaatgctatcaagtcatataaaaccgaaggaagagccgagagactcgaggcaactgagtatctggtgtccgctgcggaagctggcgctatgactctgtgtataaccaatcccctgtgggtcactaaaacccggcttatgttacagtatgacgctgtagtcaattcaccgcatagacagtacaaggggatgttcgacacactagtgaagatctataagtatgagggtgtgcggggtctgtacaaagggtttgtaccgggtctcttcgggacttctcacggcgctctgcaattcatggcgtacgaactgctgaaactcaagtacaaccaacacatcaaccggctgcccgaagctcaactctctactgtagaatacatctcagtcgccgctttgtccaaaatctttgccgttgccgcaacgtatccgtatcaggtcgtcagagccaggctgcaagaccagcacatgttctactccggcgttatagatgttattactaagacatggaggaaggaaggagtcgggggattctataaaggcattgctcccaatttgatcagggtgactccagcctgctgcattacgtttgtggtatacgagaacgtttctcacttcttgctggacctcagggagaagaggaagtag

SEQ ID NO: 241302 - DNA, 552 bp, Artificial Sequence
  Description of Artificial Sequence: Synthetic coding sequence
atgaccctctgcataacgaatccattgtgggttacaaagaccagactcatgctccaatatgatgcggttgttaacagtcctcatcgccagtacaaaggaatgttcgataccctggtgaaaatttacaagtatgagggcgtgcggggattgtataaaggatttgtgcctggccttttcgggacaagccacggagctctgcagttcatggcctacgagctccttaagctcaaatataaccagcacattaacagacttccagaggctcaattgagcactgttgagtatatctctgtggccgcactatccaagatttttgcagtggctgcaacctacccttatcaggtggtgcgtgccaggctgcaggatcaacacatgttttactccggagtaattgatgtgatcactaaaacctggcgaaaagagggcgtgggtgggttctacaaagggatcgccccaaatctgattcgagtgacacccgcatgctgcatcacttttgtggtgtatgaaaacgtttctcatttcctgctggacctaagggagaagaggaagtag

SEQ ID NO: 241303 - DNA, 966 bp, Artificial Sequence
  Description of Artificial Sequence: Synthetic coding sequence
atggccaccggtggccagcagaaggagaacacactgctccatctgttcgcgggtggctgcggtgggactgtaggagcgatatttacgtgcccactggaggtcataaagactagactgcagagctccaggttagctttaagaacagtatattatcctcaagtacacttgggcaccatatctggtgccggtatggtgagacccacctccgtaacgcccggactattccaggtcctcaagtctatcctggagaaagagggcccaaaaagtctttttcgcggtttgggacccaacctagtcggggtggccccatcacgggctgtctacttcgcatgctactcaaaggcgaaggaacaatttaatgggattttcgtgccaaattccaacatcgtgcatatctttagtgccggatcagccgcttttattaccaacagtcttatgaatcctatttggatggttaagacaagaatgcagctggaacaaaaagtcaggggatcaaaacagatgaacacgctgcagtgtgccaggtacgtgtatcagacagaggggatccggggattttataggggattgacggcttcttacgctggtatcagtgaaaccatcatctgcttcgctatctatgagtcactgaagaagtacctcaaggaggctccgttggcctcaagtgcgaatggcacagaaaagaattccaccagcttttttggactgatggctgctgccgctctcagcaaggggtgcgcatcttgcattgcttatccacacgaagtgataagaacaagactccgggaagagggcactaaatataaaagcttcgtgcagacggcaaggctggtattcagagaggaaggatatctggctttttacaggggcctgtttgctcagctgatccgccagatccccaacactgccattgtgctgtcaacatacgaactgatcgtctatctgcttgaggaccgcacccaatag

SEQ ID NO: 241304 - DNA, 915 bp, Artificial Sequence
  Description of Artificial Sequence: Synthetic coding sequence
atggagacggtccctcccgctgttgatttggtcttgggcgcaagtgcctgctgcctggcatgtgtcttcactaacccccttgaggttgtcaaaaccagactgcagctccaaggcgagctgcaggccaggggaacctatcccaggccataccacggctttatcgcctccgtggcagccgtggcacgcgctgacggcttatgggggctgcaaaagggtctcgctgccggactgttgtatcaggggctgatgaatggggttcgtttctactgttactctcttgcctgccaggccggactgactcagcaaccaggcggaactgtcgtggccggtgcggtcgcaggggcactgggggcattcgttgggtctccagcttatctgatcaaaacccaactccaggcccagactgtggccgctgtggccgtgggccatcagcataatcaccagacagtcctgggagctttggaaacaatttggaggcagcagggtctgctaggcttgtggcagggcgttggcggtgctgtgccgagagtaatggtggggagtgccgctcagctggccacttttgccagcgccaaagcatgggtccagaagcagcaatggttgcctgaggattcttggctggtcgccctggctggaggaatgatttcatctatcgccgtggtggttgtaatgacacccttcgacgtcgttagcacacggctctataatcagccagttgacactgccggtcggggtcaactatatggcggtctaactgactgcatggtgaagatctggcgacaggaaggacccttggccctttataagggcctgggccctgcctatttgaggctggggcctcacaccatcctgagcatgcttttctgggacgagctgcgcaagctggcagggagagcccagcacaaagggacttag

SEQ ID NO: 241305 - DNA, 888 bp, Artificial Sequence
  Description of Artificial Sequence: Synthetic coding sequence
atggatttcttgatgagcggccttgccgcttgtggcgcttgtgtctttaccaatccactggaggttgtgaagacaagaatgcagctgcagggtgagctgcaggcccctggtacttatcaacgccactatcgaaatgttttccacgcgtttatcacaataggtaaggtggacggactggcggctctgcagaaaggtttggcgccagcactcctttatcagtttttaatgaacgggattcggcttgggacatacggtttagccgaggccggaggttacctgcacactgctgaaggtacccattccccggctcgatctgcagcagccggagcgatggccggagtgatgggagcctatcttggtagccctatctacatggtaaagactcacctccaggcccaggccgctagcgaaattgcagtcgggcatcaatataaacatcaaggcatgtttcaggccctcacggagatcgggcagaaacatggtttagtgggactatggcgaggagccctaggaggtctgccccgtgtgatcgtcggatcctccacacagctttgcacattctcgagcacaaaagatttactttcccagtgggagatttttcctccacaatcttggaagctggcactcgtcgccgctatgatgagtggaattgctgtggtccttgccatggccccattcgacgttgcatgtacgcgactgtacaatcaaccaactgacgcacaaggcaaaaaccgagtgcctaaattcagcgctacatcatgctctgcctcagccccactcctgggaaccaaggatgtacgcatagttaaagggcagactggccatcagctatttaaggtgacacaagccccagggtgctcccccatcctgttaggaacacagtcatag

SEQ ID NO: 241306 - DNA, 876 bp, Artificial Sequence
  Description of Artificial Sequence: Synthetic coding sequence
atggatttcttgatgagtggactagcagcctgcggagcatgtgtgttcaccaaccctctcgaagtggttaagacgagaatgcagctccaaggcgagctccaggctccaggaacctatcaaagacactacagaaatgtattccacgcattcattacaatagggaaggttgacggattggctgccctccagaaaggactagccccagctctgctgtatcaattcctgatgaacggtattcggctggggacttatggtctggccgaagccggaggttatttacatactgccgaagggacacactcccccgctcgatccgccgctgccggagccatggcaggagtcatgggtgcatatcttggtagccctatatatatggtgaaaacgcacttgcaggcacaggctgcatccgagattgctgtgggccaccaatacaagcatcaggggatgttccaggcgctcacagagatcggacagaaacacggcttagtaggactgtggaggggcgcactgggcggtctgccccgtgtaatcgttgggagctctacacagctgtgtactttctcatctaccaaggatctgcttagtcagtgggaaattttcccaccgcaatcatggaaactcgcgctggtggctgcgatgatgagcggcatagccgttgtcttggcaatggccccttttgacgtggcctgtacacggttatacaatcagccaacagatgcccagggaaagggcctgatgtaccgagggatcctggatgctctgctacagaccgctagaacagaagggatattcggcatgtataaagaaccatcaccacaggtgctcagcaatattatgcaatgcttctccgctttcacaggtgatcagagatgctag

SEQ ID NO: 241307 - DNA, 915 bp, Artificial Sequence
  Description of Artificial Sequence: Synthetic coding sequence
atgatccaaaatagtcgaccttcactgctgcagccacaggacgtgggagacaccgttgaaacccttatgctgcatccagtgatcaaagcctttctgtgtgggagcatctccggaacatgcagcacacttctcttccagccactggatctgttaaagactcgattacaaacgctgcagccctcagatcacggcagccgcagagtgggaatgctagccgtattgctgaaggtggtgcgcaccgagtcactcctgggactgtggaaaggaatgagtcccagcattgttagatgcgtgcccggagtcgggatctactttggaactctgtattcccttaagcaatactttctgcggggtcatcctcccacagctttggagtctgtgatgcttggtgtaggcagtcggagcgtcgccggagtgtgcatgtcccctatcaccgttataaagactcgatatgagagcggcaagtatggctatgaaagtatctacgcggctctgcgctccatttaccactcggagggccacagagggctgttcagcggtcttacagccactctccttcgcgacgcgcctttctccggcatctacctaatgttctacaaccaaacgaaaaatatcgtgccgcatgatcaggttgatgctactttaatcccgatcacaaatttcagctgtgggatcttcgccggtatcttagcatccctagtgacacaacccgctgacgtgatcaagacccacatgcagctgtatccattaaaattccaatggattgggcaggctgtcactctgatttttaaagactatggtctgaggggatttttccagggtggaattccacgcgcattgagaaggacactaatggccgctatggcttggaccgtttatgaggaaatgatggcgaaaatgggacttaaaagttag

SEQ ID NO: 241308 - DNA, 1671 bp, Artificial Sequence
  Description of Artificial Sequence: Synthetic coding sequence
atgccacccgagaggaggcggagaatgaaacttgatagaaggactggagcgaagcctaagcggaagcccggaatgagaccagattggaaggcaggcgcagggcctggagggcctcctcagaaaccagccccatcttcccagcgtaaaccccctgctaggccgagtgctgctgctgccgctatcgcagtcgctgcggctgaagaggagaggagactgagacaaagaaacaggttgcgactggaggaggacaagcccgcagtggagaggtgtctggaggagcttgttttcggagacgtcgagaatgacgaggacgcgttgcttcggcgactgaggggacctcgcgttcaagaacacgaggattccggcgatagcgaggtggagaatgaagcaaaaggcaactttccacctcagaagaaacccgtatgggtagatgaggaggacgaagatgaagaaatggtcgacatgatgaataatcgattcaggaaagatatgatgaagaatgcctccgaaagcaaactcagtaaagacaatctgaagaaacgattaaaggaagagtttcagcacgccatggggggagtgcccgcttgggccgagactacaaaacgcaagacatcaagtgatgacgagagcgaagaggatgaggatgaccttctgcaaaggacaggtaactttatatctaccagtacgagtctgcctcgtgggatacttaagatgaagaactgccagcatgcaaacgccgagaggccgactgtagctagaatcagtagcgtccagtttcaccctggcgcacagatcgtgatggtcgccggtctggataacgccgtgtctttattccaggtggatgggaagactaatcccaaaatccagtccatctacttagagcgattccctatctttaaggcctgcttctccgcaaatggagaggaggtgttggctaccagcacgcattcgaaagtgttgtatgtctatgacatgctagccggaaagctgatccctgtccatcaagtgcgtggactcaaagaaaagatcgtccggtccttcgaggtgtcacccgatggcagttttttgttgatcaacggaattgccggatacttacacctgctagctatgaaaacaaaggagctgataggatctatgaaaattaatggtcgtgtagccgcatcaaccttttcctctgactccaaaaaagtgtacgcctctagcggcgacggagaggtgtacgtttgggatgtcaacagcaggaagtgcttaaatcgtttcgtggatgagggaagcctttacggtcttagcattgcaacaagccgtaacgggcagtatgtggcctgtggaagcaactgtggggtggtcaacatttataatcaggactcctgcctgcaagaaactaatcccaaacccatcaaggccatcatgaatttagtgacgggtgttacctccctgacattcaatccaaccaccgagatactggccatagcgtcagagaaaatgaaggaagcagtgaggctagtacatctcccttcttgtacagtgttctcgaactttccagttataaagaacaaaaatattagtcatgtgcacaccatggacttttcgcccaggtctgggtacttcgctcttggcaacgagaaaggaaaagccctgatgtatcggctacatcactactccgacttctag

SEQ ID NO: 241309 - DNA, 1080 bp, Artificial Sequence
  Description of Artificial Sequence: Synthetic coding sequence
atggctgaccaggatccggcagggatcagccctcttcagcagatggtggcctcgggaacaggcgctgtagtgacatctctctttatgacccccttggatgtcgtcaaagtccgactacaatcacagcggcctagcatggcatctgagttgatgccctcgagccgcttatggagccttagctataccaaactgccgtccagtctgcagtctacaggcaagtgcctcctgtattgtaacggggtgttggaaccactgtatctatgtcctaacggcgcacgttgcgccacatggtttcaagaccctacgagatttacagggacaatggatgctttcgtcaagatcgtccgccacgagggcacgcgcaccttgtggtctggtctaccagccacgctggtcatgacagtgccggctacggccatttatttcacggcctatgaccagctcaaggctttcttgtgcggccgagcccttaccagcgacttatatgcaccaatggtcgccggtgcattggcacggctgggcaccgttaccgtgatatcacccctcgagctcatgaggaccaaactacaggcacagcacgtgtcctacagggaacttggggcatgcgtaaggacagctgtggctcaaggcggttggagaagtttgtggctcggttggggcccaactgcgctacgggatgtgccctttagtgcgctctactggtttaattacgaactggtgaaaagctggctcaatggcttccgtccaaaagaccaaactagcgtaggtatgtcgtttgttgcaggaggaataagcgggaccgttgcagctgtattaactctgccctttgacgtggtaaaaacacagcgccaggttgcgctcggggcaatggaagccgtccgtgtaaacccacttcacgtggactccacttggctgctgcttagaaggatccgtgctgaaagcggcacgaaaggacttttcgccggattcctcccaagaatcataaaagcggcaccctcatgcgcaattatgataagcacttacgagttcggcaagtcctttttccaacgccttaaccaggacagactccttggcggttag

SEQ ID NO: 241310 - DNA, 1011 bp, Artificial Sequence
  Description of Artificial Sequence: Synthetic coding sequence
atggccgatcaggaccctgcgggaatttccccactgcagcagatggtcgcctctggaaccggcgcagtggtgacgtcattgtttatgactccactggacgtagtcaaggttcggctacaatcccagaggcctagcatggcatccggcaagtgcttactctattgcaatggagttttggagcccctctatctttgtcccaatggcgctcgctgtgccacatggttccaggacccgacccggttcactggcacaatggacgcatttgtgaaaattgtgagacacgaaggcacacggacgctatggtctgggttacctgcaacactggtaatgaccgtccctgccactgctatatatttcactgcctacgaccaacttaaggcattcctttgtgggagggcattgacatccgacctgtacgctcccatggtggcaggtgcactggccaggctcggtaccgtgaccgttatcagtccactggagcttatgaggactaagttgcaggcgcaacatgtgtcttaccgtgaacttggagcctgcgtacgcaccgcggtggcacaaggtggctggaggagtctgtggctcggttgggggcctacggccctgagggacgtcccgtttagcgcactgtattggtttaactatgagcttgtgaaatcttggctgaacggctttaggccaaaagaccaaacctctgtgggaatgagtttcgtggctgggggaatcagcgggacagttgcggcagtgctgactctccccttcgacgtcgtgaaaacccaaagacaagtcgccctgggcgctatggaagcagttagggtgaatcccttgcacgtagacagcacatggttgctcctgcggaggattcgggctgaatcaggcactaagggcctgttcgctggttttctccccaggataatcaaggccgctccttcctgcgccataatgatctccacctacgaattcggaaaaagcttttttcaacgactgaatcaagatcgcctgctgggaggttag

SEQ ID NO: 241311 - DNA, 1017 bp, Artificial Sequence
  Description of Artificial Sequence: Synthetic coding sequence
atggatcccgaaactcggggacaggaaatcatcaaagtcactcctctgcagcagatgcttgccagctgcacaggcgcaatcttaacctctgtcattgtcacaccactagacgtagttaagattaggctgcaggctcagaataacccactccccaaagggaagtgctttgtgtattctaacggtctcatggaccatctgtgtgtgtgtgaggagggcggtaataaattgtggtacaagaagcctggcaacttccagggtactctggatgctttctttaagattatacggaatgaagggatcaagagcttgtggagcgggcttcctccgactctcgtgatggccgtgccggcaaccgtgatctattttacctgttatgatcagttgtccgctctcctgcggagcaagctgggagagaatgagacctgtattccaatcgtggcagggattgtggcaagatttggagcggtgactgtgatctcccctcttgagctgattcggacaaagatgcagtcaaaaaaattcagctacgtcgaattgcatcgcttcgtaagcaagaaggtatcagaagatggctggatctctctgtggagaggctgggccccaactgtattgagagacgttccattttctgcaatgtattggtataactacgaaatccttaagaagtggctctgtgaaaaatcagggttgtatgagccaacctttatgatcaatttcacatctggagcactcagtggctccttcgcagcggtggctacactgccgttcgatgttgttaagacacagaagcaaactcaattatggacatacgaatctcacaaaatctctatgcctctgcatatgtccacatggataattatgaagaatatcgtcgcaaagaatgggttcagcggcctgttttccggcctcattcccagattgatcaagatcgccccagcctgtgcaatcatgatttccacttacgagttcggaaaggccttttttcagaagcagaatgtgaggcgtcagcagtattag

SEQ ID NO: 241312 - DNA, 1113 bp, Artificial Sequence
  Description of Artificial Sequence: Synthetic coding sequence
atgggcgctcagccaggggagccacaaaacacctgttctcggatacaaaccctgtttcgcagggtcaagaccttgctgatcaaggctcctccacctccccaaccacccccaccaccaccctcatggaaccctggatgcacccacgtatacggttacgcgttcggccatatgcacgacaataaccttgaacacctgccctcccagcaggtgctggataccggcgagcagctgatggttccggtagaggttctagaggtggataataaagaggccttgtggaagtttctcctgtctggtgcaatggccggagcagtgtcccgaactgggaccgcccctctcgaccgagcaaaagtttatatgcaggtctactcttctaagaccaactttactaacctcctgggaggtcttcaatccatggtccaggaggggggattcaggtctttatggagaggtaatggtatcaacgtgctcaaaattgctcctgaatatgcaattaagtttagtgtgtttgagcagtgcaaaaattacttctgcggaatccagggtagtcctccttttcaagagcgtttacttgctggatcactggccgtagccattagccagacactcattaatcctatggaggtgctgaaaactaggcttactctgaggagaacaggccaatataaggggctgcttgattgtgccagacaaattctccagcgggagggcacccgggctttataccgcggatacctcccaaacatgcttggcatcatcccctatgcctgcacagacctagccgtgtatgagatgctgcagtgcttctgggtcaaatctggtagggacatgggcgatcctagtggactggtttccctgagcagcgtcacactgtccactacttgcgggcagatggcgagttatcctctcaccttagtcaggacgaggatgcaggctcaggacaccgtggaggggtctaacccaactatgaggggtgtgctgcaaaggatcctagctcagcagggctggctgggcctatatcgcggaatgacacccacacttttgaaggtcctcccagctggtgggatctcttatgtcgtgtatgaggctatgaagaagactttagggatctag

SEQ ID NO: 241313 - DNA, 729 bp, Artificial Sequence
  Description of Artificial Sequence: Synthetic coding sequence
atgggagcacagcccggtgaaccccagaacacgtgctctcggattcagactctgtttaggagagtgaaaacattactgatcaaagctccaccgcctcctcaaccgcctcctccgcctcctagctggaatcctggatgtacccatgtgtatgggtacgcctttggccatatgcatgataataatctcgagcatctaccctcacagcaggttctcgacaccggagagcaacttatggttccagtggaggttctggaagttgacaataaggaggctctctggaaatttctgctttccggcgctatggccggagccgtcagcaggaccggaaccgctccactggaccgagcaaaagtgtacatgcaactgctaggcaggctgcggcaggagaatagattaaatctcggtggcggaggttgttccgagccccgttcacccgataggacccctgcctgggcgacggagagcaccccccctcgacgaactagcccaacatgttgggggggataccgggcatggagccggagagctgctagtgctccctgcggtggcgctactgctagcacatgttccagactgctgctgtctatgccgagctcttcaccttacagttcgtcagcccgaatcacttctgtggaatacaaggggcctcgtcccagcagatctgtatctctgctggccccatggctgtggccatccccccgaccatcgtctacaccctggcgatgctag

SEQ ID NO: 241314 - DNA, 957 bp, Artificial Sequence
  Description of Artificial Sequence: Synthetic coding sequence
atgggcaatggggtaaaagaaggtcccgtgagactgcatgaggacgctgaggccgtgttaagctcgtctgtctcttccaagcgggatcatcggcaagtcctgtcctctctgttgtctggagcactggcgggtgccctagctaagaccgcggttgccccacttgacagaaccaagattatctttcaggtttctagtaagcgatttagtgccaaggaagctttcagggtgctgtattacacctatttgaacgaggggtttttgagcctctggcgtgggaacagcgccacaatggtgagagtggtgccctatgccgctatacagttctcagcccacgaggaatataagcggatcctgggctcctactatgggtttcgcggtgaggctcttcctccctggcctcgcttgttcgcaggcgctctggccggtacaactgctgcaagcttgacttatccgctggatcttgtaagagccagaatggcggtgactcccaaagagatgtatagcaacatcttccatgtgttcatccgcatcagcagagaagagggcctaaaaacactctaccacgggttcatgcccactgtgctcggcgtgataccatacgctggactctcattctttacatacgagactctaaagtcgttacaccgagagtattctggaaggagacagccttacccctttgagagaatgatcttcggggcttgcgcaggcctcattgggcagtcagctagttatccccttgatgttgtgcgcaggcggatgcaaacagctggagtcacgggatacccgcgagcatcaatagccaggacccttagaacaattgtcagagaggaaggcgcagtgcgagggctgtataagggtctatctatgaattgggtgaaaggcccaattgcggtgggcatttcctttactactttcgacctgatgcagatcctgctaagacacctgcagtcctag

SEQ ID NO: 241315 - DNA, 1011 bp, Artificial Sequence
  Description of Artificial Sequence: Synthetic coding sequence
atgtctgtgctatttttttatatcatgcgatataagcagagtgaccctgaaaaccctgacaatgatcggttcgtgctcgctaaaatcgccactagaaaggcatgtgggctagccttggccaagctcggctatgcaaacaatcgggtcgtggtcctggatggcgacactcgctacagcactttcagcgagatcttcaacaaagaataccctgaaagatttattgagtgttttatggccgagcagaacatggtgtcagtggccttaggctgcgcgtctagaggaagaactattgccttcgcgtctacatttgcggctttcctaacccgagcgttcgaccacattcggatcggcggattggcggagtcaaatatcaacatcattggctcccactgtggggtctctgtaggagatgatggagcttcccagatggccctggaggatatcgccatgtttaggaccatccctaagtgcaccattttttatcctacagatgctgtcagtaccgagcatgccgtagcccttgccgctaatgccaagggcatgtgcttcatcaggaccacacgtcccgaaacgatggtgatttacacaccacaggagaggtttgagattggacaagcaaaagtgctgaggcattgtgtctccgataaagtaaccgtgattggcgcaggcatcaccgtttacgaggcactcgctgctgccgatgaactgagtaagcaggatatttttatcagagttatagatctatttaccatcaaaccattggacgtcgctacaattgtgagcagcgcaaaagcaaccgaaggtcggattataaccgtggaggaccactacccacagggcggaatcggggaagcagtctgtgcagcagtgagcatggacccagacattcaggtccactccctggccgttagtggggtcccgcaatccggcaaatcagaggagctgttagacatgtacggcatatccgccagacatattattgtagctgtaaagtgcatgctgctaaattag

SEQ ID NO: 241316 - DNA, 870 bp, Artificial Sequence
  Description of Artificial Sequence: Synthetic coding sequence
atggccacatggcgaagagatggcaggctgactgggggtcagcggttgttatgtgccggtttggctggcactctttctctcagcctaactgcaccgctggagctggccgcttataggaagttcgtagtcttgtttactgatgacctgggccacatcagccagtggtcctcaattatggcgggtagtctggccggaatggtgtccacgattgtgacttatcctaccgacctcattaagacccgccttataatgcagaacatactcgaacccagctatcgtggactcctccacgccttctccaccatctaccagcaagagggattcctggctctatatagaggggtttctcttacagtcgtcggtgccttgccattttcagctggctccctgctggtctacatgaacctcgagaaaatctggaatggccctcgtgatcaattcagtttgcctcagaactttgctaacgtgtgcctggcagcggcagtgacccagacccttagtttccccttcgaaacagtcaagagaaaaatgcaggcccaatccccttacttgccacactcgggaggggtggacgtgcacttttccggagcagtcgactgctttcggcagattgtgaaggcccaaggagtgctcgggctgtggaacggattgaccgcgaaccttcttaaaattgtgccgtactttgggatcatgttttccacttttgagttctgtaagcggatctgtctgtatcagaatgggtacatcctcagtccgttgtcctataagcttactcccggtgttgaccagagcctgcagccacaggagctgagagaactcaagaagttttttaagacacggaagcccaaacctaaaaagccaactctgtag

SEQ ID NO: 241317 - DNA, 681 bp, Artificial Sequence
  Description of Artificial Sequence: Synthetic coding sequence
atggctacatggcggagagacggaaggctgacagggggtcagcggctgctctgtgctggcctggcagggacgctgtcactgtcccttaccgccccactggaactggccactgtactagctcaggtgggcgtcgtgaggggacacgctcgcggtccgtgggctaccggtcacagagtgtggagagccgagggcctacgtgccctctggaaagggaacgctgtcgcttgtctgcggctgtttccctgtagtgctgtgcaactcgcagcctatcggaaattcgtggttctattcaccgacgatctggggcatattagccaatggtcctccattatggccggatcactggctgggatggtcagcaccatcgtgacgtaccctacagatcttatcaagacaaggttaatcatgcagaatattcttgagccctcatataggggtctcttgcacgctttcagcacaatctaccaacaagagggttttttagccctgtatcgaggcgtgagtttgacggtggtgggaagtgagcctctcccgcctacacagtggcgcagccgttgcccatttctgcggtctagtggtctgctgcccgcagatagcgaggggccaggtggacccggagcattagagtggattgacagccagttcacagaggacagttctattttttggaactatgtgtag

SEQ ID NO: 241318 - DNA, 945 bp, Artificial Sequence
  Description of Artificial Sequence: Synthetic coding sequence
atggaggacaaaaggaacatccagataatcgaatgggagcatctcgataaaaagaagttttatgtattcggggtggccatgaccatgatgattcgagtatccgtgtacccttttactttaattcggactcgcctgcaggtccagaaaggaaagagcctttatcatgggacgttcgacgcatttatcaagatcctgagggcagacgggataacgggactataccgaggcttcctcgtgaacacattcacattaattagcggacaatgttacgtgacgacctatgaattaacaagaaagttcgtggccgattatagtcagtcaaataccgtgaagagcctcgttgcaggtggttcggcttccctcgtggcacaaagcattacggttcctatcgacgttgtgtctcagcacctcatgatgcagaggaaaggggaaaagatgggaagattccaggtgcggggaaatccagaggggcagggagtcgtggccttcggacaaacaaaggatattattaggcagattttgcaggctgacggactccggggtttctaccggggttacgttgcctcacttcttacatatatccccaactcggctgtctggtggcctttttatcacttctatgcagagcagctctcttatttatgcccaaaggagtgtccccacattgtgttccaggcagtctctggccctctggcagcggcaaccgcttccatccttaccaaccccatggatgttattcgaaccagggtacaagtggaaggaaaaaattccatcatcctcacttttcgccagcttatggccgaagaaggcccatggggtcttatgaaagggctgagcgcacggatcatctctgctacacccagcactatcgttattgtagtgggctatgaatccctgaaaaaactgtcattgaggcctgagcttgtggattcccgccattggtag

SEQ ID NO: 241319 - DNA, 489 bp, Artificial Sequence
  Description of Artificial Sequence: Synthetic coding sequence
atggaggacaagcgaaacatccagatcatagaatgggaacatttggacaaaaaaaagttctacgtgtttggagtagctatgacaatgatgattcgagtgtccgtatatccctttactctgatccgcaccagactccaggtccagaaaggaaagtcactttatcacggaacatttgatgccttcatcaagatcttacgcgcagatggaatcacaggcctgtacagaggattcttggtgaatacattcacacttataagtgggcagtgttatgtgaccacttacgaattgactaggaagttcgtcgctgattatagtcagtcaaacacagtcaaaagcctgatggccgaagaagggccatgggggttaatgaaaggtctgagcgcacgaatcattagtgccactcctagtaccatcgtgattgttgtaggttatgagagcttgaaaaagctgtcattgcggccagaactcgtcgactcccgccactggtag

SEQ ID NO: 241320 - DNA, 876 bp, Artificial Sequence
  Description of Artificial Sequence: Synthetic coding sequence
atggaagataagcgtaacattcaaattattgagtgggaacatctggacaagaagaagttttacgtgtttggtgtcgccatgactatgatgatccgggttagcgtgtacccctttacacttatacgtacacgtctacaagtccagaaagggaagtcactgtatcacggcaccttcgatgccttcattaaaattctgcgggcagatggcattactggtctgtatcgcggtttcctggtgaatacatttactctgattagcggtcagtgttatgtgacaacctacgaactgactcgaaaatttgtggcagactactcccagtccaatactgtgaaatcactcgtggcaggtggctccgcttccttggttgcacaatcgattaccgtgcgtggaaaccccgagggacagggcgtcgtggccttcggccagaccaaagatatcattcggcagattctccaggcagacgggctcaggggattttaccgaggctacgtggcgtcccttctgacctacattccaaatagtgcagtgtggtggcctttttaccatttttacgcggagcagctctcatacctatgtcctaaagagtgcccacatattgttttccaggcggtgagcggacccctggctgcagctaccgcctcaatcctgaccaaccctatggatgtcatacgcacacgtgtgcaagtggaaggcaaaaacagcattatcctaacgtttaggcagctgatggcagaggaaggcccatgggggctgatgaaaggcttgagcgctagaatcatcagcgccacgccttctactattgtcatcgtggtgggatatgaatctctgaaaaaactgtcacttcgcccagagctggttgattcgcgacattggtag

SEQ ID NO: 241321 - DNA, 741 bp, Artificial Sequence
  Description of Artificial Sequence: Synthetic coding sequence
atggtgaagatctatcgccatgaatcactgctgggattcttcaagggtatgtccttcccaatagcttccatcgccgtcgtcaattctgtcctgttcggagtctacagtaatacattgttagtgttgaccgccacaagccaccaggagaggcgggcacagccacccagttatatgcatatctttctcgccggttgcacaggcggtttcctgcaggcttattgtctggcgcctttcgaccttataaaagtcagactgcagaaccagactgaacccagagcccagcccggttccccgccacctcgctaccaggggcctgtgcattgcgccgcaagcatttttcgagaagagggacccagagggttattccgtggggcttgggccctgacactgcgagacacccccacagttggtatctattttatcacatacgagggtctgtgccgccagtatactcctgaggggcagaatccttccagcgcgaccgtcctcgtagctggaggctttgccggtatagcctcttgggtagccgcaacaccccttgacatgattaagtccaggatgcagatggatggactccgacgtagagtttaccaaggcatgctggactgtatggttagttccattcgacaagagggccttggcgttttctttcgaggggtaacaatcaacagcgctcgcgcatttccagtaaatgccgtgaccttcctgtcatacgagtatctgctgaggtggtggggatag

SEQ ID NO: 241322 - DNA, 795 bp, Artificial Sequence
  Description of Artificial Sequence: Synthetic coding sequence
atgcccgtcgaggagttcgtcgctggctggataagtggggctcttggtctggtgctggggcatccttttgatactgtgaagctactcggtttctttaagggcatgtcatttcctattgcgtcaattgcagtggtcaattccgttttgttcggtgtttacagtaatacactgctcgtgcttacagctacttcacaccaagaaagacgggcacagcctcctagctacatgcatatctttcttgccggttgtacgggcggattccttcaagcctactgcctcgcaccgttcgacctgataaaggttcggctacagaatcagaccgaacctagggcacagccaggctctccgcctccacgatatcagggtcccgtgcactgtgctgcttccattttcagagaggaaggaccccgtggcttgtttaggggagcatgggcactcacactcagggacacccctacggttggcatctactttattacgtacgagggtctctgcaggcagtacactcctgagggacagaatcctagcagtgcgactgtgcttgtagccggaggcttcgctggtattgcctcctgggtggctgcaacaccactggatatgatcaagtcaaggatgcagatggatggactcagaagaagagtataccaggggatgctggactgcatggtgtctagtattcgtcaggaagggcttggagtcttttttaggggcgtaaccataaattccgccagggctttccctgtgaatgccgtgacattcctaagttacgaatacctgttgagatggtggggctag

SEQ ID NO: 241323 - DNA, 555 bp, Artificial Sequence
  Description of Artificial Sequence: Synthetic coding sequence
atggtgaagatctatcgacatgaaagcgcatactgcctagcaccattcgacctgatcaaagtgcgccttcagaaccagacggaacccagagcacaacccggatctccccctccaaggtaccagggtcccgtgcactgcgcagcctctatctttagagaggagggaccacgcggtctgttccgaggtgcctgggccctgacgttaagagacacccccaccgtcggaatctatttcataacgtacgaaggtttgtgtcggcagtacacacccgaggggcagaatccttcatcagccacggttctggtggcaggcggtttcgcaggtatcgctagctgggtggccgctaccccccttgatatgatcaagagccgcatgcagatggacggcctgcgacgaagagtctatcagggaatgctggattgtatggttagcagcattagacaggagggtctgggagtgtttttccggggtgtgaccattaatagcgcacgcgcattccctgtcaatgctgtgacctttctgagctatgagtacctgttacgatggtggggctag

SEQ ID NO: 241324 - DNA, 867 bp, Artificial Sequence
  Description of Artificial Sequence: Synthetic coding sequence
atgcctgtcgaggaatttgttgcaggttggatctctggagctttaggcctcgtgctggggcacccatttgatacggtgaaggtgagactgcagacacaaacaacctatcgcggtattgtggattgtatggtgaagatctatcgtcacgagagccttctgggtttcttcaagggaatgtcttttcctatcgccagcatagcagtggtcaacagcgtcttgtttggcgtttacagtaatacactgctggtattgacagcaacttcccaccaggaacggagagcacagcccccatcttacatgcacatcttcctggctgggtgtaccgggggattcctccaggcctactgcctcgctccctttgacctgattaaagtgcgccttcaaaaccaaaccgagcccagagcgcagcctggatcaccccctcccaggtaccagggtccagtacactgcgccgcatctattttcagggaggaggggccacggggacttttccgtggagcatgggccctgacacttagagacacccctaccgtgggtatatactttatcacctatgaggggctgtgccgacaatacacccccgaggggcaaaacccaagtagcgccaccgtcctcgtggccggaggttttgcaggtatcgcgagctgggtcgccgctactcccttggatatgattaaaagccgtatgcagatggatggactccggcgtagggtgtatcagggcatgctcgattgcatggtgtcatccattcgccaggagggcctcggagtgttcttcagaggtgttaccattaactcagcgagagccttccctgtgaatgccgtaacatttcttagctacgagtacctgctgagatggtggggctag

SEQ ID NO: 241325 - DNA, 741 bp, Artificial Sequence
  Description of Artificial Sequence: Synthetic coding sequence
atggttaaaatctataggcatgaatcactgcttgggtttttcaagggcatgagcttccccatcgcatccattgccgtggtgaactctgtgctgttcggagtctattccaacacgcttctggttctcaccgctacgtcacaccaagagcgacgggctcagccacccagctacatgcatatattcctggcgggttgcacagggggattcctgcaggcctattgtcttgccccattcgacctgatcaaggtaaggctccagaatcagaccgagccacgtgcacaaccaggttctccaccgccacgctatcagggtcctgtccattgtgcggcttccatctttcgcgaagaaggaccgcgtggtctgtttaggggagcctgggcgttgacactacgtgacacaccgaccgttggcatctacttcatcacttacgaagggctgtgcaggcagtacacaccggagggccaaaatccttcttctgccactgtcctggtagccggtggatttgccggtattgcttcttgggttgcggctaccccactcgatatgataaagtctcgcatgcaaatggatggactgcgcaggcgcgtgtatcagggcatgctcgactgtatggtgtcttccatcagacaagagggactgggtgttttcttccgcggagtgactatcaatagtgcgagggcctttcccgtgaatgcggtgacgttcctcagttatgagtacctgttgaggtggtggggctag

SEQ ID NO: 241326 - DNA, 867 bp, Artificial Sequence
  Description of Artificial Sequence: Synthetic coding sequence
atgcccgtggaggagttcgtggccggttggataagtggcgcattgggtttggttctgggtcacccatttgacacagtgaaggtgcggcttcagacccagacaacttatcggggaattgtggactgcatggtgaagatctacagacatgagagcttattggggtttttcaaggggatgtcctttccaattgcttcgatagccgtcgtgaactctgtgttgtttggcgtctacagtaataccctcctggtcctgacagcaaccagccaccaagagcgtcgcgcacagccaccttcctacatgcacattttcctcgcaggatgcacaggtggctttctgcaggcatactgtctggcccctttcgatttgataaaagtgagattgcagaatcaaaccgaaccacgggctcaacccggatcccccccaccccgatatcagggccctgtgcattgcgctgccagcatctttcgcgaggagggccctcggggtttgtttagaggcgcttgggccctgacccttcgcgatacacccacagtcggcatctacttcatcacctacgaggggctgtgtaggcaatacacaccagagggacagaatccatcttctgccacagttctcgttgcaggtggattcgcaggcattgcttcctgggttgcagccactccgctcgatatgattaaatcgagaatgcaaatggatggactccggaggcgcgtctaccagggaatgctggattgtatggttagctccattaggcaggagggccttggtgtgttcttcagaggagttacgattaattccgctcgcgcatttcctgttaacgcggtaacttttctatcttacgagtacctcttacggtggtggggctag

SEQ ID NO: 241327 - DNA, 357 bp, Artificial Sequence
  Description of Artificial Sequence: Synthetic coding sequence
atgccagtcgaagagttcgtcgcagggtggataagcggcgctcttggactagtcctcggacatcccttcgacacggtcaaggtccgtttgcagacccagaccacatacagggggatagtggactgcatggtcaagatataccgccacgagtctctgctaggtttttttaaggggatgtcctttccaattgcctcaatcgccgtagtgaatagcgtcctcttcggggtttactccaacacgcttctggtcctcactgctacctcccaccaagaaagacgagctcagccaccgtcctatatgcacattttcttagctggctgcactgggggatttttgcaggcgtattgtttggcatag

SEQ ID NO: 241328 - DNA, 1257 bp, Artificial Sequence
  Description of Artificial Sequence: Synthetic coding sequence
atgcatccccgacgacccgatggctttgacggccttggatatcgcggaggggctagggatgagcaaggctttggcggagcgttccccgctagatctttctccaccgggagcgacctgggtcactgggtaactacgccccctgacatccctggctcccgcaacttacactggggagaaaagtcccctccctatggtgttccgactacttcaacgccttacgagggacccacagaagagccattctcctccggcggtgggggatccgtccaggggcagagctcagaacaactaaatagatttgcaggctttggcataggcctagcaagtctctttacggaaaatgttcttgcccatccatgcatcgttttgcgccgacaatgtcaggttaactaccacgcccaacattatcatctgacacccttcacagttatcaatatcatgtatagttttaacaaaacacagggcccacgcgctctgtggaaaggaatggggtctacatttattgttcagggggtaacattgggcgctgagggcatcattagtgaatttactcctctacctcgcgaggtgttgcataagtggagcccgaagcagatcggcgagcacctcttgttgaaatcacttacttacgtagtggcaatgcctttttacagtgcaagcctgattgagacagtccagagcgaaataattagggataatactgggattctggagtgcgtcaaagaaggcataggaagggttataggaatgggtgtgcctcactctaagagactgctccctttgttgtctctcatcttccctacagtattgcatggggtgctccattatattatttcttcagtcatccagaaattcgtactcctgatcctgaaacgcaagacatataattcgcacttggcagagtccacctctcctgtgcaatctatgctggatgcatactttcccgagctaatcgccaactttgccgcttccctgtgttctgatgttattctgtacccactggagaccgttttacacaggctgcatattcaaggcacacgcaccatcatcgacaacacagatctgggctacgaggtactgcccattaacactcagtatgaggggatgagggattgtatcaataccatccgccaggaggagggagtcttcgggttctacaaagggttcggagccgtgatcatccagtataccttacatgctgctgttcttcagattaccaagatcatttacagcacccttcttcagaataacatctag

SEQ ID NO: 241329 - DNA, 1014 bp, Artificial Sequence
  Description of Artificial Sequence: Synthetic coding sequence
atgcacccgaggcgtcctgatggattcgacgggttagggtaccgcggtggcgcaagagacgaacagggttttggcggtgctttccccgcaagatcctttagcacagggtcggatcttgggcattgggttactacgcctcccgacatccccggtagccggaatctgcattggggcgaaaaatcccccccatacggtgtgcctactactagtacgccctacgagggtccaacggaagaacccttttctagcggtgggggaggatccgtgcaagggcaatcttctgagcagctaaacaggttcgccggatttggaattggcttggccagtttatttaccgagaatgttctggcgcatccctgcatagtccttaggcgacagtgccaggtcaactatcacgcccagcattatcatctcaccccttttactgttatcaatattatgtattcattcaataaaactcaaggtcctagagcattgtggaaggggatgggctctacgtttattgtgcagggtgtgaccctcggagccgaggggattattagcgagtttacccccctgcctcgggaagtactgcacaagtggtctccaaaacagattggagagcatctcctgctgaaaagcctgacctacgttgtggccatgccattttattccgcctctttaatcgagacggtgcaatctatgctggatgcttactttcccgagctaatagcaaatttcgccgcttctttgtgttccgatgtgatattatacccgcttgagacagtcctgcatagattgcacatacagggtactcgcacaatcattgacaataccgatttgggctacgaggttctacctataaatactcagtatgagggaatgcgggattgcatcaatactatccgccaagaggagggtgtatttggcttttataaggggttcggggctgtgattattcagtacaccctccatgctgctgtcctgcaaataaccaaaatcatctattcgactctgctccagaacaacatctag

SEQ ID NO: 241330 - DNA, 819 bp, Artificial Sequence
  Description of Artificial Sequence: Synthetic coding sequence
atgtactcttttaacaagacccaagggccacgagcgctgtggaagggtatgggatcaacgtttatcgtccagggtgttacgctgggcgctgaagggataatcagtgagttcacccccttaccacgagaggtgcttcataaatggtcgccaaagcagataggcgagcacttgctgcttaagtctctcacctatgtagttgcgatgcccttctactcagccagcttgatcgagacagtgcagtccgagattatacgcgacaataccggcattctggaatgtgtcaaagagggcatagggagggttattggcatgggagtgccacacagcaaaaggttactgcctctgctcagcctgatatttccaaccgtgttgcacggggtcctgcactacattatcagctccgtcatccagaagtttgtgctgctgattctgaagaggaagacctacaatagtcacctggctgagtccacttcaccggttcagtcgatgcttgacgcctactttccagaattgattgcaaacttcgccgcttcgttgtgctccgacgtcattttgtaccctctggagacagtcctgcaccgactccacatccagggcacaaggactatcatcgacaacacggacctcggctacgaagtcctacctatcaacactcagtacgaagggatgcgggactgtataaataccatcaggcaggaggagggcgtgttcgggttttacaaagggttcggagctgtgatcattcagtatacgcttcatgcagcagtgctgcagataaccaagattatctatagcacattactccaaaacaatatctag

SEQ ID NO: 241331 - DNA, 618 bp, Artificial Sequence
  Description of Artificial Sequence: Synthetic coding sequence
atgcctttctacagtgcttctctgatcgagactgtacaatcagaaatcatccgtgataacacaggcattctcgaatgcgttaaagagggaatcggcagagttataggaatgggggttccccatagcaagcgcctccttccgttgcttagcctaatatttccaaccgttctacatggggtgctgcattacatcatttcctccgtgatccagaagttcgtactgttaatcctgaagcggaagacttacaactctcatctcgctgaatccacctcccccgtgcagtccatgctcgacgcttatttccctgaactgattgcaaacttcgccgcatctttgtgctctgatgtgattctgtacccgctcgagactgtgctgcatagattacatattcagggcacgcggactataattgacaacacagatctcggctacgaggtgctacccataaacacccagtatgagggtatgcgcgactgcattaatacgattagacaagaggagggggtgtttggcttctataaaggattcggcgcagtgattatccaatacacgttacatgccgcagttctccaaatcaccaaaatcatctattctactctgctccagaataacatttag

SEQ ID NO: 241332 - DNA, 984 bp, Artificial Sequence
  Description of Artificial Sequence: Synthetic coding sequence
atgaagactgagcaactcaatcgctttgccggtttcggaattggattggcttctctgttcaccgaaaacgtcctggcccatccatgtattgtgctgcggagacagtgccaagtgaactatcacgcacagcattaccatttgactcccttcactgttatcaatatcatgtactcattcaacaaaacacagggaccccgtgccttgtggaaaggaatgggtagtacattcatcgtgcagggtgtgactctgggtgccgagggcattatttctgaattcaccccattgccgagagaggtgctgcacaaatggagccccaaacaaataggtgaacatctattgctgaagagtttaacgtatgtcgtcgcgatgccattttacagcgcaagccttatcgagactgtgcagtctgaaataatccgcgacaatacgggtatcttggagtgcgtaaaggaaggaatcggacgtgtaataggaatgggcgtaccacactccaaacgactcctgcctttgctgtctctcatttttccaactgtgctgcacggggtcctgcactacatcatctcgtcagtgatacagaagttcgtgctgctcatcctgaaacggaaaacatataattcacacctggccgagtccacatctcccgtccaaagcatgttggatgcctatttccctgaactcattgccaacttcgccgcatctttgtgttccgatgtgatcctgtaccccctagaaactgtactccaccgcctgcacatccagggcacccgaacaatcattgacaataccgacttgggttatgaagtgctgcctatcaacacacagtatgagggtatgcgggactgcattaacaccattagacaggaggagggtgtgttcggcttttacaaagggttcggagccgttatcatccagtacaccctgcacgctgccgtccttcagataaccaagatcatttactctaccctgctgcaaaataacatctag

SEQ ID NO: 241333 - DNA, 771 bp, Artificial Sequence
  Description of Artificial Sequence: Synthetic coding sequence
atgggctccaccttcatcgtgcagggcgtaacgctgggcgcagagggtatcatttccgaatttacccctctgccccgagaggtgctgcacaaatggtccccaaagcaaataggcgagcatttgcttctgaagtcgctcacttatgtagtcgcaatgcccttctatagtgcatccctgatagagactgtgcaaagcgagatcatccgcgacaatacgggaatcctagagtgtgtgaaggagggcatcggacgggtgattggcatgggagtacctcactctaagagattgttgcctctcttatcgctcattttccccacggtgttacatggcgtcctccactatatcatctcctccgtcatccagaaatttgtgctgctgatcctgaaacgcaaaacctacaattctcatcttgcagagagtacctctcctgtgcagagtatgctggatgcttacttcccagagcttattgcaaatttcgcagctagcttgtgctccgatgtgatactttacccgctagaaacagtgctgcatcgtttgcacattcagggcacgaggaccataatcgataacactgatctgggctatgaggttctgcctatcaatacacaatacgaaggaatgcgcgactgcatcaataccattcggcaggaagagggagtgttcggtttttacaagggttttggagccgtcataattcagtatacccttcatgccgcagttctgcagattacaaagatcatctattcaacgctgttacagaacaacatctag

SEQ ID NO: 241334 - DNA, 819 bp, Artificial Sequence
  Description of Artificial Sequence: Synthetic coding sequence
atgtactccttcaataagacacagggacccagagcgctctggaagggcatggggtctactttcatcgtgcagggggtgacattgggagccgagggcatcattagtgagtttacacctctgccacgtgaagtgctgcacaaatggtcccctaagcagattggtgagcacctgctcctcaagtccttaacctacgtggtcgcaatgccattctattctgccagcctcatcgagacagtacagagcgagattatacgcgacaatactggtattctcgagtgcgtgaaggaaggtatcggcagagtgatcggcatgggcgttccccatagcaaacgtctgctccccctgcttagcctgatatttcctacagtattgcatggagtcctgcactatataatttcttcagttatccaaaagtttgtgctgttgatcttaaaaaggaagacctacaattcccatttggccgagtcgacgtcccctgtgcagtccatgctggatgcttattttcctgaactcattgcgaatttcgctgcttctctgtgtagtgatgtgatcctgtacccccttgagacagtcctgcatcgcctgcacatccagggcacccgaaccatcatcgacaacacggacttaggctacgaagtgctgccaattaacacccagtacgagggaatgcgagattgtatcaacacgatccgacaggaggaaggggtgttcgggttttataagggattcggagcagtgataattcagtatacactccatgcagctgtcctccagataacaaagattatctattcaacactgctgcaaaacaacatctag

SEQ ID NO: 241335 - DNA, 2220 bp, Artificial Sequence
  Description of Artificial Sequence: Synthetic coding sequence
atgagtagcgagagtaaagagcagcacaatgttagcccaagagattctgccgagggaaatgactcctatccatccggcattcatcttgaacttcagagggagtcctccacagactttaagcagttcgagacgaacgaccagtgccgcccttaccaccgcattctgatagaaaggcaggagaagtcagatactaacttcaaggagttcgtaatcaaaaaactgcagaagaattgccagtgctctcccgcaaaggcaaaaaatatgatactgggcttcctgccggtcttacagtggctccctaaatacgaccttaaaaagaatatcctaggtgatgtcatgtctggcctgatcgtaggcatcctgcttgtaccacagagcatcgcatatagtctgcttgccggacaggagcctgtgtatggactttacacttctttcttcgctagtatcatttacttcttgctgggtacaagtcgtcacatcagcgtgggcatattcggcgtgctttgcctcatgatcggcgagacagtggatagagaattgcaaaaggccggatacgacaatgctcattccgccccatccctgggcatggttagcaacggttcaacgttgctgaaccacacctctgataggatctgtgataagagttgttacgccatcatggtgggctctaccgtgactttcatcgcaggcgtttatcaggtcgcaatgggctttttccaggtgggctttgtttcagtgtatctgtcggatgccttgctctccggctttgtgacgggcgctagctttaccattctgacctctcaggcaaaatacctgctggggctcaacttgcctagaactaacggagtgggttcgctgatcaccacatggatccacgtgttcagaaatatccataaaaccaacctatgcgatctgattactagtctgttgtgcttactcgttctcctgcctactaaagagctcaacgagcactttaagagcaagctaaaggcacctatcccaattgagttggttgttgttgtagctgcaactcttgcatctcatttcgggaagcttcatgagaattacaattcatccatagctgggcacatccccacaggttttatgccccctaaggtgccagaatggaaccttataccaagtgtggctgttgacgcgatagctattagcatcatcgggtttgcaattactgtctctctcagcgagatgtttgccaagaaacacggttatacagtcaaagccaatcaggaaatgtacgccatcggattctgcaatatcatcccctctttttttcattgtttcacaacatctgccgcactggctaagactctggtgaaagaatccacggggtgtcatacccaattatccggcgttgttacagctttggtcttactgctggtgcttctcgttatagcccctctcttctacagcctccagaaaagtgttttgggtgtcattaccatcgtcaatctgaggggcgctttaagaaaattccgtgacttgcctaagatgtggtccataagcaggatggacactgtcatctggtttgtcactatgctcagctccgccttactaagtaccgagatcgggcttttggtcggcgtgtgtttttcaattttttgcgttatcttgcgaacacaaaaaccgaaaagctcactacttggcctcgtcgaggagagcgaagtctttgagagcgtgtcagcgtataagaatttacagataaagcctggtattaaaatattcaggttcgtggcacctctctactatatcaacaaagaatgtttcaagtcagccttgtacaagcagaccgtcaatccaattctcattaaggttgcttggaaaaaagccgctaagcggaagatcaaggagaaagttgtgacattgggcggaatccaggatgagatgtcagtgcagttgagccacgaccccctggagttgcacactatagtgatcgattgtagcgctattcaattccttgatactgctggtatccacacacttaaggaggtgaggcgggattatgaagcaattgggattcaggtgttgctggcccagtgcaaccccactgtccgcgactccttaactaatggcgagtactgcaaaaaagaggaggaaaacctgctattctatagcgtctatgaggctatggccttcgctgaagtgtctaaaaatcaaaagggcgtgtgtgtccccaacgggctgtccttatcctcagactag

SEQ ID NO: 241336 - DNA, 72 bp, Artificial Sequence
  Description of Artificial Sequence: Synthetic coding sequence
atgagttccgaaagtaaagaacagcacaatgtcagtcccagggactccgctgaagggaacgactcctactag

SEQ ID NO: 241337 - DNA, 2295 bp, Artificial Sequence
  Description of Artificial Sequence: Synthetic coding sequence
atgatcgagccctttggcaatcagtatatcgtagctagacctgtctattccactaatgcctttgaagagaaccacaaaaagaccggaaggcaccacaagactttcctggatcatctaaaagtgtgttgtagctgttcaccccagaaagccaaacgcatcgtcttgtccctgttcccgatagcttcctggctgccggcttacagactgaaggagtggttgttgtctgacattgtttcaggcatttcgactggcattgtcgcagtccttcaaggcctggcttttgctctgttggtcgatattccaccggtatacggattatatgcaagcttcttccctgccattatctacctgttctttggcactagtcgccatatttcagtaggaccatttccaatcctgagtatgatggtcggtctcgcagtgtccggcgctgtgagcaaggctgtgccggaccgcaacgctaccactcttggtctgcccaacaacagcaataacagttccctcctcgatgacgagcgggtacgcgtcgccgcagccgcatccgtgaccgtcctgtcagggatcatacagctggcctttggaatactcagaatcgggttcgtggtcatttacttgtctgagtcactgataagtggctttactacggccgcagctgtccacgttcttgtgtcccaactgaaattcattttccagctgaccgtaccatcgcacactgaccctgtgtctattttcaaagttctctactctgtgtttagccagatcgagaaaaccaacatcgctgatcttgtgacggctctgatcgtactcctcgtggtctctattgttaaggagattaaccaacgatttaaagataaactccccgtgccgatccccatagaattcatcatgacagtgatcgctgctggagtctcatacggttgcgacttcaaaaatcgctttaaggtggcagtggtgggcgatatgaaccctggcttccagcccccaataactccggacgtggagactttccagaatactgtaggagattgtttcggaatagctatggtggcgttcgccgttgccttctccgttgctagcgtgtactctctgaagtatgactaccctctagacggaaatcaggaattaatagccctgggcctaggcaacattgtttgcggcgtttttaggggattcgcaggctcgaccgccctctccagatccgcggtgcaggagagtaccggcggaaagactcagatcgcaggcctgataggagcaataattgtgttgatcgtggttctagctatcggcttcctcttagctccattacagaagtccgttctggctgctctggcattaggtaatctgaaaggcatgctcatgcaattcgccgaaattgggagattatggcgaaaagacaagtacgactgccttatttggattatgaccttcatttttactattgtgctgggtcttggcttggggctcgcagcctccgttgcatttcagttattgacaatagtgtttagaactcagtttcccaagtgctctactctggccaacatcggacgcaccaatatctataagaataaaaaggattattacgacatgtatgagcctgagggcgttaaaatctttcgatgtccctcccctatctacttcgccaacattggattctttagaaggaaactcatcgatgcggtgggcttctctccacttagaatccttcgcaaacgcaataaggccttgcgtaaaattcgtaaactgcaaaaacagggcctgctccaggtgacccctaagggctttatctgtaccgtagatacaattaaagactcggatgaggagctcgacaacaaccagattgaggttctggaccagcctattaacacgactgacctcccattccatattgattggaatgacgatctgcctctcaacattgaagttcctaaaatctccctgcactccctgatacttgacttctcagctgtttctttcctggatgtctccagcgttcgcggacttaaaagtattctacaagaatttatccggataaaggtggatgtgtacatagtaggcacggacgatgactttatcgagaagctcaaccgctatgaatttttcgatggcgaggttaagtcaagtatcttttttctcactattcatgacgccgttctccacatcctgatgaagaaggattatagtacatcaaagttcaacccaagtcaggaaaaagatggtaaaattgactttaccatcaatactaacggcggtctgcgcaatagagtgtatgaggttcctgtggaaaccaaattttag

SEQ ID NO: 241338 - DNA, 1956 bp, Artificial Sequence
  Description of Artificial Sequence: Synthetic coding sequence
atgctcctgcgcaaaattataaagagacaggaggatatcattaggcatttctggatcatatctaagtgcgtggtggcgtcctggttacccgcttataggctgaaggaatggttactgtccgatatcgttagtgggatctctactgggatcgtagccgtgttgcagggccttgctttcgccctgctcgttgacatacctccagtgtacggtctgtacgcctccttcttcccagctatcatctacctcttttttggtacaagtaggcacataagcgtcggcccttttcccattctctccatgatggttggcctcgcagtctctggggctgtttctaaggcagtgcctgatcgcaatgccaccaccctggggctacctaacaacagtaacaacagctccttgttggacgacgagcgagtgcgcgtagccgctgctgccagcgtaaccgtcttaagtggtatcatccagctggcctttggaattttacggatcggctttgttgtgatctatctctccgagagccttatttctgggtttaccactgccgcagctgtgcatgtgctggtgtctcagctgaagtttatttttcagctgacagtcccatcccatacagaccccgtaagcattttcaaagtcctgtattctgtgtttagtcagattgaaaaaacaaacatcgcggacctcgtgaccgcactgatcgtactactggtcgtgtcaatcgtgaaggaaatcaaccaaagatttaaggataagctgcccgtgcctatcccgattgagtttataatgacagtgatagccgctggcgtgagctacgggtgtgactttaaaaacagatttaaggtggcagtggtcggcgacatgaacccgggtttccagccacctattacaccagacgttgaaacctttcagaacacggtcggtgactgctttggaattgcaatggtggccttcgccgttgcctttagtgtggccagcgtgtattctctcaaatacgactaccccctagatggaaatcaggagctgattgctcttgggctcggaaacattgtttgcggcgttttccgcggattcgccggatccactgccctgagcaggtcagccgtccaagaatccaccggcggaaagacccagatcgcagggcttattggtgccatcattgtgcttatagtcgttttggcaatcggcttccttctcgctccactacaaaagagtgttctagcagccctcgcgcttggcaatctgaaaggaatgctgatgcagtttgcggagatcggacgcctatggcgaaaagacaaatacgactgcctcatctggatcatgacattcatatttaccattgttttaggtttaggactcggcctggccgcttccgtcgcctttcagttgttgaccattgtcttccgaactcaattccctaaatgttccaccctggctaacattggcaggaccaacatatataagaataagaaggactactatgacatgtatgagcccgaaggcgtgaagatttttagatgcccttctcctatatactttgccaatattgggtttttcaggcggaaactgattgacgcagttggttttagcccgctacgaatcctgcgtaagaggaacaaagctctgaggaagatccgtaaactgcagaagcagggactccttcaggtgaccccaatcctgcaggagtttattaggattaaagtggatgtgtatatcgttggcactgatgatgactttatagagaaattgaataggtacgaattcttcgatggcgaggttaagagttccatctttttcctaactatacacgatgcagtcttacacatccttatgaagaaggactattccactagtaaatttaatcctagtcaggagaaagacggtaaaatcgactttaccatcaacactaatgggggtttaaggaatcgtgtttatgaagtccccgtggagactaagttttag

SEQ ID NO: 241339 - DNA, 363 bp, Artificial Sequence
  Description of Artificial Sequence: Synthetic coding sequence
atgattgaaccctttggcaatcaatatattgtcgcccgacccgtatactcgacaaatgcattcgaagaaaatcataagaaaacaggaagacaccacaaaacatttttggaccatctgaaagtgtgttgcagttgttcaccacagaaggccaaaagaatcgtcctgtctctttttccaattgccagttggctacctgcctaccgcctaaaggaatggctgttgtccgatatagtttccggaatctccactggcatcgtggcggtgcttcagggcctggcttttgcactgctggttgatatccctccagtctacggtctgtacgccagtttctttccagccatcatttacctgttttttggctag

SEQ ID NO: 241340 - DNA, 2343 bp, Artificial Sequence
  Description of Artificial Sequence: Synthetic coding sequence
atggcagctccaggcggtagaagtgaaccacctcagctaccggagtactcctgtagctacatggtgagtagacccgtctattcagagctggcttttcagcagcagcatgaacgcaggctgcaggaacgaaagacgcttcgcgaaagcctggcgaagtgttgctcatgttcccgcaagagggcgtttggtgtgctcaaaaccttagtccctattctggagtggctacctaagtaccgggtcaaggaatggctgttgagtgacgtaatctcaggagtgagcacaggccttgtcgccacgctccaggggatggcatacgcactgctggccgcagtccctgttgggtatgggctgtactcagccttcttcccgattttgacatacttcatattcggcacgtcccggcacattagtgtgggtccattcccagttgtctccctgatggtaggctccgtcgtcctgagcatggccccagacgagcattttttggttagcagtagtaacggcacagtgttaaatacaacaatgattgacaccgctgcaagagataccgccagagtactgatcgcatctgcgcttaccctacttgtcggcattatccagctgattttcggcggtttgcagatagggtttattgttcggtacctggctgatcctctggtgggagggtttaccacagccgctgccttccaggtactggtgtctcaattgaagatcgttttgaacgtatcaaccaaaaattataatggagtgctcagcattatctacacattggtggagatatttcagaatattggggatacgaacttggctgatttcacagctggactcctgaccatcgttgtttgcatggccgtgaaggagctcaatgatagatttaggcacaaaatccccgtgcccatccccatcgaagtgatcgtcacaatcattgctaccgctatttcatacggtgctaacctcgagaaaaattacaatgcaggaatcgtaaagagtatccccaggggttttctgccaccagagctcccgccagtgtcgctgttctcagagatgctggctgcctccttttcaattgcagtggtcgcctacgctatcgccgtgtctgtcgggaaagtgtacgctacaaaatacgactacaccatcgacggaaatcaggaatttatagccttcggaatatccaacatctttagcgggttctttagctgttttgtagccactacggcgctgtccagaacagccgtccaggagagcactggagggaagacccaagtggctggcattatctctgctgccattgttatgatagcaatcctggctctggggaagctgcttgaacctctgcagaaaagcgtactggcggcagttgttatcgccaaccttaaggggatgttcatgcaactgtgcgatataccacgcctgtggaggcagaacaaaatcgacgcagttatctgggtgtttacttgcatcgtttccataattcttggcctcgatctgggacttctggctggccttatctttggcttactaacagtggtgttgagagtgcaattccccagttggaacggtttgggtagcattcccagtaccgacatttataagagcacaaagaactacaagaacatcgaagagccacaaggagtcaaaatcctgcgattttcctcccctatattttatggcaatgtggacggattcaaaaaatgcattaagtctactgttggctttgacgccattagagtgtataataagcggttgaaggccctgagaaagattcagaaattgatcaagagcgggcagctccgcgcaactaagaatggtatcatctcggacgcagtgagcaccaataatgcattcgagccggatgaagatatcgaagacctcgaagagctcgacatccctaccaaggaaatagaaatccaggtggactggaactcagaactgcctgttaaagtcaacgtacccaaggtgcctattcattcgctggttttagactgtggagcaataagcttcctcgacgtggtgggtgtacgctccctgagagtgatagttaaggaattccagcggattgacgttaacgtgtattttgcctccctgcaggattacgtcatcgaaaaacttgagcagtgtgggttcttcgacgataacatcaggaaggataccttcttcctgaccgtgcatgacgctatcctgtaccttcagaatcaagttaaaagccaagaaggacaaggcagcatcttagagaccatcacccttattcaggattgtaaggatacacttgaacttatcgaaacagaactgaccgaggaggaactggacgttcaggatgaagctatgagaacgctcgcgagctag

SEQ ID NO: 241341 - DNA, 396 bp, Artificial Sequence
  Description of Artificial Sequence: Synthetic coding sequence
atggctgccccagggggaagatcggagccgcctcagctgcccgagtacagctgtagttacatggtgtcacgccctgtgtacagcgagctcgctttccaacagcagcatgaacgtcggctgcaagaaagaaagactctccgtgagagtttggccaagtgttgtagctgtagccgaaagcgcgcatttggggtgctgaaaaccctggttcccatacttgagtggttacctaaatacagagtgaaggagtggctactgtccgacgtgatctctggggtttccaccgggttagtggccacactgcaagggatggcatatgccctgttggccgctgttccagtcggttacggattgtatagtgccttttttccaatcctcacctattttatttttggatag

SEQ ID NO: 241342 - DNA, 1026 bp, Artificial Sequence
  Description of Artificial Sequence: Synthetic coding sequence
atgaggcatgggctcgccgtcccctcagtccttgctgcagttgtcatcgccaatctgaaagggatgtttatgcagttgtgcgacataccccgactgtggagacagaacaagatcgacgcagtgatctgggttttcacttgtatcgtgtcaattatcctggggttggatcttgggctcctggctggtctgatatttgggctgctcaccgtcgtactcagagtacagttcccttcgtggaacgggcttggatccatcccttccactgacatttataagtccactaagaattataagaatatcgaagagccccagggggtgaagatcctacgcttctccagcccaattttctatgggaacgtggacggttttaagaagtgtatcaaatcaacagtgggcttcgatgccataagggtctataataaaaggctcaaggccctgcggaagattcagaagttaattaagagtggtcagctccgcgctacgaaaaacggcattatttctgatgcggtgagcactaacaacgccttcgagcctgacgaagacattgaagacctggaggaattggacattccaacgaaagagatcgagatccaggtcgattggaactccgagctgcccgtgaaagtgaacgtcccaaaagtgccaatccacagcctcgtgctggactgtggcgcaatctcatttcttgacgtggtgggcgtgcgctccctacgtgtgatcgtgaaggagttccagagaatcgacgttaacgtgtatttcgcatctctgcaggactatgtgatcgaaaagcttgagcagtgtggcttcttcgatgacaatattagaaaggatacattttttctgactgtccacgacgccatcttgtaccttcagaaccaggtaaaaagccaagagggacagggtagcattctggagacaataacattgatccaggactgcaaagataccctagagttgattgaaactgagttgaccgaggaagagctcgacgtccaagatgaagccatgcgcactctggcaagctag

SEQ ID NO: 241343 - DNA, 1050 bp, Artificial Sequence
  Description of Artificial Sequence: Synthetic coding sequence
atgatcgccattctggctcttggtaaattgctagagccccttcagaagagtgtgctggctgctgtcgtgattgccaatctcaagggaatgtttatgcagctgtgtgatattccacgcctgtggcgtcagaataagattgacgcggtgatctgggtgtttacctgcatcgtatcaattattcttggcttagatctcggcctgctcgctggactcatatttgggcttttaaccgtggtcttgagagtacaattccccagttggaacggcttgggtagtattccgtccaccgacatctataaaagtacaaaaaattataagaacatcgaggagcctcagggggtaaagattctaagattttccagcccaatcttttacgggaacgtcgacggatttaagaagtgcattaaaagcaccgtcggattcgacgccattagggtgtataacaaaaggttgaaagctctgaggaaaatacaaaaactcattaagtccggtcagctgcgggcaacaaagaacggcatcatatccgatgcagtcagcaccaataacgcatttgagcccgatgaagatattgaggacctggaggagctcgatattcctactaaggaaatcgagatccaagtagattggaactccgaactgcccgtaaaagtgaacgttccgaaagtcccaatccattcacttgtgttagattgtggggctatctcattcctggacgtggttggggtaaggagcctgagagttatcgttaaggagttccaacgtattgacgttaacgtttactttgccagtctgcaagattatgtcattgagaaactggagcagtgtggtttctttgacgacaacataagaaaggacacctttttccttaccgtacatgacgctatcctttaccttcaaaatcaggtaaaaagccaggaggggcaaggaagtattctggagaccatcaccctcattcaggactgtaaggacaccctggagctaattgaaacggagcttacggaagaggaactagacgtccaggacgaagccatgagaaccctggcaagttag

SEQ ID NO: 241344 - DNA, 1104 bp, Artificial Sequence
  Description of Artificial Sequence: Synthetic coding sequence
atgcgtcatggactggcagtccctgtagccggaattatcagcgccgcaatcgtgatgattgccattttagccctggggaagctgctggagcccctgcagaaatccgtgcttgccgcagtggtgattgctaatctaaaagggatgttcatgcagctgtgtgatattcccaggttgtggagacagaataagattgacgctgtgatttgggtgtttacttgcatcgtcagcataatcttaggcctggacttaggactgctggcaggactgattttcggtctgcttaccgtggtattgagagtgcagttccctagctggaacgggcttgggagtatcccttccaccgacatttacaagtccacgaagaactataagaatatagaagagcctcagggcgtcaagatcttaaggttttcctcccctatcttttacgggaacgtggatgggtttaaaaaatgcataaagtccacggtaggctttgatgctattcgtgtctataacaagagacttaaggccctccgaaaaattcagaagctgattaagtccgggcagctacgggcaactaagaatgggatcatttctgatgcagtgagtacaaacaacgccttcgaaccagacgaggacatcgaggatttggaggagctggacatccctactaaggaaatcgagatccaagttgactggaacagcgagctccccgtcaaagtgaatgtacctaaagtcccaatccattccctagttctggactgtggtgccatcagttttctggatgtcgttggcgtccggtccctgcgggtgatcgtaaaagagtttcagcggattgatgttaacgtgtactttgcctctcttcaagactacgttatcgaaaaactggagcaatgcggtttctttgatgacaacattcgaaaagacaccttttttctgaccgtccacgacgccattctctatctccagaatcaggttaaatcgcaggaaggccaaggctcaattttagagactatcactctaatccaggactgcaaagacacgttggagctaatcgagacggagcttaccgaggaggaactggatgtgcaagacgaagccatgcgtacgctcgccagttag

SEQ ID NO: 241345 - DNA, 2235 bp, Artificial Sequence
  Description of Artificial Sequence: Synthetic coding sequence
atggaccacgcagaagagaacgaaattctggctgccacccagcggtattatgtggaaaggcctatcttcagccacccggtgttacaggaaaggctgcacactaaggacaaggtgcctgattccattgccgataagcttaagcaggcatttacatgtactcccaagaagatccgcaacataatctatatgttcttgcccatcactaagtggcttcctgcctacaagttcaaggaatacgtgctgggggatctagtgagcgggataagtaccggtgttctgcaactcccacagggccttgcattcgccatgctggccgcagtacccccaatttttggcctctatagctccttttatcccgtgataatgtactgtttcctgggtacatcgcggcatatttcgatcggtccgttcgcagttatctcattaatgatcggtggggtggccgtccgactagtgccagacgatattgtaatccccggtggagtcaatgctacaaatggcacggaagcaagagacgctttacgcgttaaagtcgccatgtccgtgactctgctgtctgggattattcagttttgcctgggggtgtgccgttttggatttgtcgcaatctatctgactgagccactcgtgaggggcttcactaccgcagctgccgtccacgtgtttacaagcatgctcaaatatttgtttggagtgaagacaaaacggtactccggaattttctccgttgtctactctacggttgccgtgttgcagaacgtgaagaacctgaatgtgtgctccctaggagttggcctgatggttttcggcctactcctcggcggtaaggagttcaatgaacggttcaaggaaaaactgcctgccccaattccactggaattctttgccgtggttatggggactgggataagcgcaggttttaacttaaaggagtcctataatgttgatgttgttggcactctccctctcggactgttgcctcccgctaaccctgacacatctttattccacctcgtgtatgtggatgctattgctatagcgattgtgggtttttccgttacaattagcatggcgaagacactcgccaacaagcacggctatcaggtggatgggaaccaggagctgatcgctcttggactttgcaatagtattggcagtctttttcagaccttcagcatctcctgctccctcagccgcagcctggtgcaagaaggcacgggtggcaagacgcagctggctggatgcctcgccagcttaatgatcttgcttgtgatcctcgccacaggatttcttttcgagtccctgccgcaagccgttctgtcagctatagttatcgtgaatctcaagggtatgttcatgcagttcagcgatctgccctttttctggaggacaagtaaaattgaattaactatttggcttactactttcgttagctccctgtttctgggcctcgattacggactgatcacggccgtgatcattgctctgctgacagtcatataccgaacccagtccccctcttataaggtgctcggcaagctgccagagaccgatgtttatattgatattgacgcttacgaagaagtcaaagaaattcccggaattaaaatcttccagatcaatgccccaatctattacgctaattccgatctctactccaacgccctcaaaagaaagactggggtgaacccggcagtaatcatgggggcaaggcgcaaagccatgagaaagtatgctaaggaagtgggtaacgctaacatggccaatgcaacagtggtgaaggcagacgcagaagtcgatggtgaggatgccacaaagccggaagaggaagatggcgaggtaaaatacccacctatcgtaattaagtcaactttccccgaggagatgcagagattcatgcccccaggagacaacgttcacacagtgattctcgacttcacgcaggttaacttcattgacagtgtgggcgtcaagacacttgccggaatcgttaaagagtatggagatgtcggaatttatgtatatctggctgggtgttctgctcaggtagtgaacgacctgacccgcaaccgattctttgaaaatccagccctgtgggaactgctctttcattcaattcacgacgcggttctcgggagccaacttagagaggcattagcagaacaggaggcttctgcccctccatctcaggaggatttggagcccaatgcaacacccgctaccccggaagcatag

SEQ ID NO: 241346 - DNA, 2058 bp, Artificial Sequence
  Description of Artificial Sequence: Synthetic coding sequence
atggatcacgccgaggagaacgagatcctggcggcaacccagaggtactacgtggaacggcctatcttttctcaccctgtgctgcaggaaaggctgcatacaaaagacaaggtccctgacagtattgcagataaattgaaacaggctttcacctgcacaccgaaaaagatccggaatatcatctatatgttcctgcccatcacgaaatggcttcctgcctataagtttaaggagtacgtgctgggcgatctggttagcggcatttcgactggcgtgctgcagctccctcagggattggccttcgccatgctcgctgcagtgcccccaatctttggcctttactcgtcattctatcccgtcatcatgtactgcttcctcggtactagcaggcacatcagtatcggtccgttcgctgtcatctctctcatgatcggcggtgtcgctgtgagactcgtcccagacgacatcgtgatcccaggcggagtaaacgcaacaaatggcacagaggctcgcgacgctctgagagtgaaagttgccatgagcgtgactctcctgtcaggaattatccagttctgcctgggtgtgtgccgattcggtttcgtcgcaatttatctcacagagccactggtgcgcggtttcaccaccgctgcggcagtgcatgtgttcacatccatgctgaagtacctttttggggtgaagaccaagcgctacagtggtatattctcggtggtctacagtaccgtcgctgtactccaaaacgtcaagaatctgaacgtgtgcagtttgggggttggcctcatggttttcggcctccttctgggagggaaagagtttaacgagcggtttaaagagaagcttcccgctcccatcccactcgaattctttgccgtagtcatgggcaccggtatctccgctggctttaatctcaaggaatcatataatgtggatgtcgtgggaacgctacctctaggcctgctgcccccagctaatccagatacatcgctcttccacctggtctacgttgatgcaatcgctatagctatcgtggggttttcggtgaccatatcgatggctaaaacactcgctaataaacacggttatcaagtagacggcaatcaagaactaatagctctcggactgtgtaacagtatcggctcactgttccagactttctcaatcagctgcagtctctcccggtctctcgtgcaagagggaactgggggaaagactcaactggccggatgcctcgccagcctgatgatcctgttagtcatattagctacaggtttcctctttgagtcactccctcaggcagtcctgagcgcgatagtcattgtaaacttgaaaggaatgttcatgcagtttagcgacctcccatttttctggaggaccagcaaaattgagctgacgatttggttgacgacatttgtgagttcgctgttcctgggcctggattacggcctcatcactgccgttattatcgcgctcctaactgtgatttaccggactcagtcccccagctacaaggtgctgggaaaacttcctgaaactgacgtgtacatcgatatcgatgcttatgaggaggtgaaagaaattcccggaatcaagatctttcagattaatgcacctatatattacgcaaactcagacctctactcaaacgcccttaagaggaagacaggagtgaatcctgctgtgatcatgggggctcggaggaaggccatgcgcaaatacgcaaaagaagttgggaatgcaaacatggcgaacgcaacagtggtaaaagccgacgcagaagtggacggggaagatgcaacgaagccggaagaggaggacggtgaggtgaagtatccccctattgttatcaagagcacgttccccgaggaaatgcagcgtttcatgcctcccggtgacaatgtgcatacagtgatcctcgatttcacacaggtcaatttcatcgactctgtcggtgtgaagactctcgcagggatcgtgaaagagtacggcgacgtggggatctatgtgtacctggcgggatgctcggcgtttattcaaagatag

SEQ ID NO: 241347 - DNA, 534 bp, Artificial Sequence
  Description of Artificial Sequence: Synthetic coding sequence
atgggcgcaaggagaaaggccatgcggaagtatgccaaagaagtggggaatgcgaacatggctaacgctaccgtggttaaggccgatgccgaagtggacggggaggacgctactaagcccgaagaggaggatggggaagtgaaatacccacctatagttatcaaatccaccttcccagaagagatgcagcgctttatgcctcccggagacaatgtgcatacagtcattctagacttcactcaggtgaactttattgacagtgttggggtgaagaccttggccggaatcgtcaaggaatacggggacgtcggcatttatgtgtacctcgcgggttgttctgcacaggtagtgaacgatctgactcgtaatagattctttgaaaaccctgccctctgggagctgctgttccactccattcatgatgcagtactaggatcacagttgagagaagcactggcagagcaggaagctagcgccccaccatcccaggaggatctggagcctaacgccactccggcaacccccgaggcctag

SEQ ID NO: 241348 - DNA, 1008 bp, Artificial Sequence
  Description of Artificial Sequence: Synthetic coding sequence
atggaccacgcggaggagaatgaaattttggctgccacccagcgttattatgtcgaacggccaatcttctctcaccccgtcctgcaggagaggctgcacaccaaagataaggtgccagactctatagctgacaagttaaagcaggcttttacgtgcaccccaaagaaaatccgaaacattatctacatgtttttgccaattacaaagtggctacctgcatacaagtttaaggaatatgtcctgggagacctggtgtctggaataagtactggggtgcttcaacttcctcagggcctggcgtttgccatgctcgctgctgtgcctcctatctttggactgtactcgtctttttatccagtaattatgtactgctttctggggaccagcagacatatctccataggcccttttgccgtcatatccttaatgatcggtggtgtcgcggtgagacttgtcccagacgacattgtgattcctggtggagtcaatgcaacgaatggcactgaagccagagatgcactgcgcgtaaaggtggcaatgtccgtgacccttttatctggaattatccagttctgcctcggggtttgtaggtttggtttcgtcgccatatatttgacagaaccactcgtgcggggatttacgaccgcagcagccgtgcacgtcttcacgtccatgcttaaatacctttttggggtgaaaactaaacggtattcaggcatcttcagcgtggtgtattctacggtggcagtgctccagaatgtcaagaacctgaacgtctgttctttgggcgtcggtctgatggtgtttgggctgctgctcggcggaaaggagtttaatgagcgctttaaggaaaagctcccagccccaatccctctggagttctttgccgtggtgatggggaccgggatcagcgctgggttcaacctgaaggaatcctacaacgtggacgtcgttgggactctgccgctggggttccacacagagatgactaggcggtggcgcccatag

SEQ ID NO: 241349 - DNA, 2145 bp, Artificial Sequence
  Description of Artificial Sequence: Synthetic coding sequence
atggaccacgctgaggaaaatgaaatattggccgcaacacagcggtattacgtagagcgcccaatcttctcccaccccgtccttcaggaacggctacatactaaagacaaagttcctgactctattgctgacaagctaaagcaagcgtttacatgtacccccaagaagatcaggaatatcatttacatgtttttacctatcactaagtggcttcccgcttacaagtttaaggagtacgtcctgggtgacttagtttcaggcatttcaaccggagtgcttcagctgccccagggactggctttcgccatgttagccgcagtgccccctatctttggattgtactcaagcttctaccccgtgattatgtactgctttcttggcactagtcggcacatttcgattgggcctttcgccgtaataagtctcatgattggcggtgtggccgtgcgattggtgccagacgatattgtaattccaggcggagttaacgccacgaatgggacggaggcccgagacgccctaagagtaaaggtggccatgtccgtgaccctgttgtccggtatcatccagttctgcctgggcgtctgtcgtttcggcttcgtggccatttatctgaccgagcctctggtgcgcggtttcacgacagccgctgccgtccatgtattcactagtatgctgaaatacctctttggagtgaagacaaaaaggtactcaggaatcttttccgttgtatactccactgttgctgtcctgcagaatgtgaagaatctcaacgtctgttctttaggcgtgggcttgatggtgtttggattgctgctcggcggaaaagagttcaacgaaagattcaaggaaaaactgcccgctcctatccctctggagttcttcgctgtggttatgggcaccgggatctcggccggtttcaacttaaaagagtcatacaacgtggatgtcgtcggcactttgcctctgggcctgcttcccccagcaaaccctgatactagtctgtttcacctggtctacgtcgatgcgatagctatcgcaattgtcggattctctgtgactatttctatggcaaagacgttggcaaacaagcacggataccaggttgatggcaaccaggagctcatcgcactcggcctgtgcaatagtattggtagcctgtttcagaccttcagtatctcctgttcactgagtcgtagccttgtccaggagggcaccgggggaaaaacacagttagcaggatgcttagccagcctgatgattctgctggttatactcgccacaggctttctcttcgagagcctgccccagacaatttggctcacaaccttcgtttccagtctgtttctaggcctggattatggcctgatcactgctgtgataatagctttgcttaccgtcatctatcgaacacagtcaccctcttataaggtgcttggcaagcttcctgagacggatgtgtacatcgacattgatgcctacgaagaggtcaaggagatccccggaatcaaaatcttccagatcaatgcgccaatttactatgccaatagcgatctgtacagcaatgctctgaagcgcaaaacaggtgtgaatcccgctgtaatcatgggcgctaggagaaaagcaatgcgaaaatatgctaaagaggtgggtaatgcaaacatggccaatgcaacagttgtgaaggccactcaggacgctgaggttgatggggaagatgctaccaaaccagaggaggaggacggtgaagttaagtatcccccaatcgtgatcaaatcgacctttcccgaagagatgcagaggtttatgccgccaggcgataacgttcacaccgtgatcttggacttcacccaggtcaatttcatcgactctgtgggggtgaaaacgcttgcgggtatcgtgaaagaatatggagacgtgggtatctatgtgtacctggctggctgctctgcacaggtggtgaatgacctgacacgcaaccggttttttgagaatccggctctttgggaattactgtttcattcaattcacgacgctgtcctcggttcgcagctgagggaggcacttgcagagcaggaggcctcagctccgcctagtcaagaggatctggaacccaatgcaacacccgcaacaccagaagcctag

SEQ ID NO: 241350 - DNA, 2241 bp, Artificial Sequence
  Description of Artificial Sequence: Synthetic coding sequence
atggatcacgctgaggagaacgaaatcctcgccgctacccagcgctactacgtggagcgtcctatcttctcccatccagtcctgcaagaacgcctgcataccaaagataaggtaccagacagcattgcggacaaattaaagcaagcattcacgtgcacaccgaagaaaattaggaacattatctatatgtttctgcctattaccaagtggctaccagcttacaagttcaaggagtacgtcctcggagatctggtctccggaatcagcaccggagtcctgcagctcccccagggactggcctttgccatgttagctgcagtgccacccatcttcggactctattctagcttttacccagttattatgtactgtttcctaggtacatcccggcacatttcgatcggacccttcgctgtgatctccctgatgattggcggagtggccgtccgtttggttcctgacgacatcgtcattcccggaggagtcaatgctactaacggaacggaagcccgagacgccttgagagttaaggtggccatgagtgtcaccctgctgagcggcataattcagttttgtctgggggtttgcagattcggctttgtcgcaatttatctcacagagccacttgtgaggggctttactaccgcagcagctgtccatgtatttacgagtatgttaaagtacctgttcggggtgaagacaaaacgctactctgggattttctctgtggtgtattcaactgtggccgtgcttcagaatgtcaaaaacctgaatgtttgctcgctcggtgtaggactgatggttttcgggcttttactcggcggaaaggagttcaacgagaggttcaaggagaagctgcctgcaccaatccccctggagttctttgcagtggtgatggggaccgggattagcgcgggattcaacctgaaggaatcttataatgtggacgtggtgggaacactgcctctcggtctgctgccacccgctaacccagacacctccctgttccacctcgtttatgtagacgccatcgcaatagcgattgttggcttctccgtcaccatttcgatggccaaaaccttggcgaataagcacgggtaccaagttgacggaaaccaggaactgattgccctggggctctgtaactccataggctccttgttccagacatttagtatctcatgcagcctgtccagaagtctcgtgcaggagggaaccggagggaagacacagctcgcgggttgcctagctagcctgatgatactactggtcatcctggccaccgggttcctctttgagagtctcccccaggctgttctgagcgctattgttatcgtgaatcttaagggtatgttcatgcaatttagcgatctgccatttttctggcgaacatccaaaatagagttgacaatttggttaacaaccttcgttagcagcttgttcctgggcctcgactatggcctgatcaccgctgtgatcatcgcgcttctcacggtgatttaccggacacaaagccctagttacaaggtattaggaaagctgccggagaccgatgtgtacattgacatagatgcctacgaagaggtgaaggaaattccaggcattaagatctttcagataaacgcacccatttactatgctaactccgatctgtacagtaatgcattgaaaagaaaaaccggggtgaatccagcagtgataatgggggcaagacgcaaggctatgcggaagtatgctaaagaagtgggaaatgcaaacatggcaaacgctacagtggtaaaggccacacaggacgctgaagtggatggcgaagatgccactaagccagaggaggaggacggggaggttaagtaccctcccattgttatcaaaagcaccttccccgaggaaatgcaacgtttcatgccacccggagacaatgttcatacggtgatactcgactttacccaggttaacttcatcgactcggtgggagttaagacgcttgctggtatagtgaaggagtatggagacgtagggatctacgtttatcttgcaggctgtagtgctcaggtggtaaacgatcttacaagaaacaggttctttgaaaatccagctctgtgggagctcctcttccattccatccatgatgccgtactgggctcgcagctgagggaggctctcgccgaacaggaagcttccgctccacccagtcaagaagatctagaacccaatgccactcccgctactcctgaagcgtag

SEQ ID NO: 241351 - DNA, 2124 bp, Artificial Sequence
  Description of Artificial Sequence: Synthetic coding sequence
atggaccacgctgaggaaaatgaaattctagccgctacacagcggtactacgttgaacgtccaatcttcagtcatcccgtactccaagaaagattacacaccaaagacaaagtgccagactctatcgccgataagctgaagcaggccttcacgtgcactccaaagaaaattagaaatattatctacatgtttctgcccattaccaaatggctcccggcttacaagttcaaagaatatgtgttgggagatcttgtcagcgggatttctactggagtgctacagttgcctcaagggccttttgccgtaatcagccttatgattgggggtgtcgcagtgcggctggtgcccgatgatatcgtaatccctggcggtgttaacgcaaccaacgggaccgaagcacgtgatgcccttagagtgaaggttgccatgtctgtcacactcctgtctggcattatccagttctgtttaggtgtgtgtcgatttggatttgtggcaatctacctgacagagcctctggttcgcggatttaccaccgccgctgcagtgcatgtttttactagcatgctgaaataccttttcggagtgaagactaagaggtattccggcatatttagtgtggtgtactctacagttgcagttctgcagaacgtcaagaatctcaatgtttgttctctgggggtgggactcatggtgtttggcttgctactcggcggaaaagaattcaatgaacgttttaaggaaaaactgcccgctccaattccgctcgagttttttgctgtggtcatgggaacgggaatctcagctggattcaatctgaaagagagttacaacgtagacgtggttggaacactccccctgggtttactgcccccagcaaaccccgacacaagcctgttccatctcgtgtatgtggatgccatcgcaattgcaatcgtcggattctccgtgacaatttcaatggcaaagaccttggccaacaagcacggatatcaggtggatggcaatcaggagcttatagctttgggcctctgcaattcaattgggagcctgttccaaacattctccatctcctgtagtctttcaaggagccttgtgcaggaaggcacgggtggaaaaacacaacttgccggttgcctggctagtctcatgatattgttggtgattctggctacaggctttctgtttgagagtcttcctcaggccgttctaagcgctatcgtgattgtcaatctgaaaggaatgttcatgcagttctctgatctcccattcttttggcggacctcaaagatagagctcactatctggctgactacattcgtaagctcactgttcctgggtcttgattacgggctaatcactgctgttatcatcgcactgttgaccgttatatacagaacacagagcccgtcctacaaagtcctgggaaagttgcccgaaaccgacgtatatattgatatcgacgcctacgaggaagtgaaggagataccaggtataaagatcttccagattaatgctcctatctactacgcgaactccgacctctattctaacgcacttaaacgcaagaccggcgtgaacccggctgtaataatgggggctcgcagaaaggccatgcggaaatatgccaaagaggttgggaacgccaacatggccaatgcaactgtggtaaaggcggatgcagaagttgacggcgaggacgcaaccaaaccggaggaggaagacggggaggtgaaatatccccctatcgtgatcaagagcacttttcctgaagagatgcagcgtttcatgccccctggggataacgtacacactgtgatactggattttacccaggtgaattttattgactctgttggagtgaaaactctggcaggtatagtaaaagagtatggtgacgtggggatctacgtgtacctcgctgggtgctctgcacaggttgtgaacgatctcactagaaataggtttttcgaaaatcccgcactttgggaactgctcttccacagtatccatgatgcagtccttggctcgcaactgcgggaggccctggcagaacaggaagcatccgctcctccctcgcaggaagatctggagcccaacgcaacgccagccaccccggaagcatag

SEQ ID NO: 241352 - DNA, 2139 bp, Artificial Sequence
  Description of Artificial Sequence: Synthetic coding sequence
atggatcacgccgaagaaaatgagatcctggccgctactcagcgttattacgtggaacgccctatcttttctcaccctgtacttcaggagaggctacacaccaaagacaaagtacccgactccatagcagataagctgaagcaggccttcacctgtacccctaagaaaataaggaacattatctacatgttcctgcctattactaaatggctgcccgcttataagtttaaagagtacgttttgggcgaccttgtctctgggatttccacaggagttttgcagctccctcagggactggcattcgcaatgctggccgctgtgcctccaattttcgggttatatagctccttttatcccgttataatgtactgcttcctgggcacctccaggcatatttccatcgggccattcgccgtgatttccttgatgattggtggcgttgccgtgaggctggtcccagacgacatcgtcatcccaggtggtgttaatgcgacgaacgggaccgaggccagagatgctttgcgagttaaggtggctatgtcagttactcttcttagcggcatcattcagttttgcttaggcgtttgtcgctttgggtttgtagcaatctatctcaccgagccactagttcggggatttactaccgctgcagctgtgcacgtatttaccagtatgttgaagtacttgtttggagttaagaccaaacggtacagcggtatcttctccgtcgtgtattctactgttgctgtcttgcagaacgtcaaaaatctgaacgtatgctcgctcggcgtagggctgatggtgtttggcctgcttttggggggaaaagaatttaatgagcgctttaaggagaagttacccgctccaattcccctggagttcttcgccgtcgtgatggggaccggcatcagcgcaggttttaatttaaaggagtcctataacgtggacgttgtgggaacgctgccgctgggcctgctgcccccagccaaccccgacacatctctgttccacctcgtgtatgtggacgccatcgcaattgctatcgttggattctccgtgaccatcagcatggccaagaccctggccaacaagcatgggtaccaggtggacgggaaccaggagctgatcgcactgggcttatgtaactcaatcggatctctattccaaacatttagcatcagctgtagtctgtcccggagcctagtgcaggagggaactggtggaaaaacccagttagcagggtgcctagccagtctgatgattctgctggtgatcctggccacgggcttcctattcgagagtctgccccagacaatctggctgacaacatttgtctccagcctttttttaggcctcgattacggcctgatcacagcggtcataattgcactgctgactgtgatataccgaactcaaagcccgagttacaaagtgcttggtaagctcccagagactgatgtttacatcgatattgatgcctacgaagaagtgaaagaaatcccaggaataaagatcttccaaatcaacgcccctatctactacgccaactccgatttgtacagcaacgcactgaagcggaagacaggggtcaatcctgcagttattatgggagcccgtcgcaaggctatgaggaagtacgccaaggaagtgggcaacgcaaacatggctaatgccactgtggttaaagccgatgctgaggtggacggggaggatgctaccaagccagaggaagaggatggagaagttaagtatcctcccatcgtgattaagtctacttttcccgaggaaatgcaacgatttatgccacctggcgataatgtccacacggttatcttggacttcacacaggtgaatttcatcgacagcgtcggggtgaaaacgttggcaggaatagtgaaggaatatggagatgtcggaatctacgtgtacctggccggttgctcagctcaagttgtgaatgacctgactaggaaccgattcttcgagaatccagctctgtgggagctgcttttccactcaatccatgacgccgtattgggatctcaactgcgggaagcactggctgagcaagaagcctcagcaccccctagccaggaggatctcgagcccaacgcaacacccgcaacccctgaagcatag

SEQ ID NO: 241353 - DNA, 1551 bp, Artificial Sequence
  Description of Artificial Sequence: Synthetic coding sequence
atggaccacgccgaggagaacgagatactggccgcaacacagcgctactacgtcgagagacctatcttttcgcatccggtgctccaggagcggctgcataccaaggataaggtccctgacagtattgccgacaagctgaagcaggcgtttacttgtactccaaagaagatccggaatattatctatatgtttctgccaatcacaaaatggctgcctgcttataagtttaaagagtacgttttgggcgacctggtgtccggcatctcaactggcgtgctgcagctcccacagggcttagcgttcgccatgttggccgcagtacctcctatatttggcctatactcttctttctaccctgtcataatgtactgtttccttgggacttcacggcatatttctatcggccctttcgccgtcattagtctgatgatcgggggagtagccgttagactggtacccgacgatattgtgattcctggcggagtgaatgccactaatggcacagaagccagagatgctctgagagtcaaagttgccatgagtgtgactctcctttcgggcattatccagttttgcttgggcgtgtgtagatttggcttcgtggccatctacttgaccgagccactggttcggggtttcaccactgccgcagctgtacatgtgtttacaagtatgctgaagtatctctttggagtgaaaaccaaaaggtattcagggatttttagcgtagtatactcaaccgtggctgtcctgcaaaacgtgaaaaatctcaacgtgtgtagcctaggcgttggcctgatggttttcggtttgcttctgggcggaaaagaattcaacgaaaggttcaaggaaaagctgcccgcaccaattcctcttgaattcttcgccgtggttatggggactgggatctcagctggctttaatctaaaggagtcttacaacgtcgacgtggtgggaaccctgccccttggtctcctgcctcccgcaaatcccgacaccagcctgttccatcttgtttatgtggacgctatcgcaatcgctatcgtgggtttcagcgttactatttccatggccaaaactctggcaaacaaacatggctaccaggtcgatgggaatcaagagctcatcgctctcgggctgtgtaacagtattggcagcctctttcagacattttccataagctgtagcctgtcaaggagcctagttcaggagggaaccgggggtaagacccagttagccggatgcctcgcatcacttatgatcttactcgtgattctggccactggctttttgttcgaaagtctaccacaggctgtgctctctgctatagtcatagtgaatctgaagggtatgttcatgcaatttagtgacctcccattcttctggcgaacctccaagatcgaattgaccatctggctgacaacgttcgtttcgagtctgttcttagggctcgattacggacttatcaccgctgtgattatcgcactgctcaccgtgatctaccggactcagagcttccataccgagatgacaagacgctggaggccgtag

SEQ ID NO: 241354 - DNA, 1422 bp, Artificial Sequence
  Description of Artificial Sequence: Synthetic coding sequence
atggatcacgcagaggagaatgagatactggccgcaactcaacgctactatgtggagcgtcccatcttctcgcaccccgtgctccaggaacggctccacacgaaagataaggtgcctgattctatcgctgacaagctaaagcaagccttcacatgtacacctaagaaaatccgcaatatcatctacatgtttttgccaattacaaaatggctgcctgcctacaaatttaaagagtatgtactcggtgacttggtcagtgggataagtactggcgtgttgcagctgccccagggcctcgctttcgccatgcttgccgcagttccccctatcttcgggctgtattccagtttctatcctgtcataatgtactgttttctaggtacctcaaggcacataagtatcgggccttttgctgtgatctccttaatgattggaggcgtcgctgtgaggctggtgcccgatgatatcgtaattcctgggggagtgaacgccactaatgggaccgaagctagagacgccctccgggtgaaggtcgccatgtcagtgacacttttgagcggaatcatccagttttgtcttggggtatgtagattcggcttcgtggcgatttatttaacagagcccctggtgcgcggattcaccaccgccgctgcagttcacgtcttcactagcatgctgaaataccttttcggagtgaagactaaacgctactctggcatcttttccgtcgtctatagcacagtcgcagttttgcagaatgtaaagaacctgaatgtatgtagccttggcgtgggactgatggtgttcgggctgctcttgggcggtaaagagttcaacgaaagattcaaggaaaaattgcccgctccgatccccctagaatttttcgccgttgtgatgggcacgggcatcagtgcgggattcaatctcaaggagagctacaacgtagatgtggtgggtacactgccattgggactcctcccaccagctaacccagatacgagtctgtttcaccttgtatacgtggatgctattgcgattgccatcgttgggttctctgtgacgatctcaatggccaagaccctcgccaacaaacacggctaccaggtggacggaaaccaggagctgattgcgttagggctgtgcaatagcatcggatctttgttccagaccttcagcattagttgttccctgagcagatccttagttcaggagggaacagggggtaagacccaactggccggttgcctcgcctccctcatgatcctgttagtgatcttggcgacagggttccttttcgagagcctgccccaaacgatttggttgactacctttgtgagctcattgtttctcggactcgattacgggctaatcacagctgttattattgctctgctgaccgtgatctaccgcacccagaggtag

SEQ ID NO: 241355 - DNA, 2139 bp, Artificial Sequence
  Description of Artificial Sequence: Synthetic coding sequence
atggaccacgctgaggagaacgagattttagctgcaactcagaggtattacgttgagaggcccatattttcccatcccgtgctccaggaacggttacatacgaaggacaaggtgccagattccatcgccgataaactcaagcaagcttttacatgtactcctaagaaaattcgcaacatcatctacatgtttctccctatcaccaaatggctgccggcatataaattcaaagaatatgtcctcggcgatctggtttcgggcatctcaaccggagttctccaactgcctcagggcctcgcgtttgccatgttggccgctgtccccccaatattcggactgtattcaagcttctacccagtgattatgtattgctttctgggtacctctagacacataagcatcggcccattcgccgtcatctcgctgatgatcgggggtgttgccgtccggctggtccctgacgatatcgtgatcccaggaggagtgaatgcaacaaatggcactgaagctagggatgcactgcgcgtaaaggtagccatgtccgttacgctcctgtcagggattatacaattctgtctgggggtgtgtcgctttggctttgtagcaatctatctgacggagcccctggtgagggggttcaccaccgctgccgcagttcacgtcttcacgtctatgctaaaatatctgtttggagtgaaaaccaagcgatactctggaattttctctgtggtttatagcaccgtggccgtcctccagaatgttaagaatttgaatgtttgctctcttggcgttgggttgatggtgttcggcctgctgctgggcggaaaagagttcaacgaaagattcaaagagaagcttccagcacctatcccactggagtttttcgctgtggtgatgggtaccgggatttccgctggattcaatttaaaagagagctacaacgtggacgttgtagggactctcccccttgggctgctgccaccagcaaaccccgatactagcttgttccatctggtgtacgtggatgctatagctattgcaatcgttggtttctctgtaaccattagcatggccaagacactggccaataagcacggctatcaggtagacggcaaccaggagctgattgcgcttggcctgtgcaactctatcgggtccctcttccaaactttttccatctcctgttcactcagccgatcgctcgtacaagagggtacaggtggaaaaacacagctagcaggctgcctagcctcattgatgatcctgctggtgattctggccactggctttttgtttgaaagccttccccagactatttggttgaccacttttgtgagcagcctcttcttaggactggattacggcctcatcaccgctgtgatcattgcactgctgacagtgatctaccggactcagtcaccctcctataaggtcctggggaagctcccagaaactgatgtctatatcgatattgacgcttatgaagaggtaaaggaaatacctgggattaaaattttccaaattaatgccccaatttattatgctaattccgacctgtattctaacgcactgaagaggaaaactggcgtcaaccccgctgtgattatgggtgcgcgtaggaaggccatgcgaaagtatgctaaggaggtcggcaacgccaacatggccaatgccaccgtggttaaggcagacgctgaagtggacggcgaagacgcaaccaagcccgaggaagaagatggggaggtgaaatacccgcctattgtgatcaagagcaccttcccggaggagatgcagcggtttatgccccctggtgataatgtgcacaccgtgatcctggatttcacacaggtcaacttcatcgactctgtgggcgttaaaacactggccggtatcgtcaaagagtacggcgatgtgggcatatacgtctatcttgccggatgcagcgcacaggtggtgaacgacttgactagaaataggtttttcgagaatcctgcattgtgggagctgctctttcacagcattcatgatgccgtccttgggtcccaactccgggaagctctcgccgagcaggaagctagtgcaccgcctagtcaggaagacctggagccaaacgcgacgccggctacccccgaggcctag

SEQ ID NO: 241356 - DNA, 1344 bp, Artificial Sequence
  Description of Artificial Sequence: Synthetic coding sequence
atggaccatgcagaggagaatgaaattctggcagccacccagaggtattacgtggagagacctattttcagccatcctgttctccaggaacggttgcacacaaaagacaaggtgcctgattcaatcgcagataaactgaagcaggcctttacctgcactcccaaaaagataaggaatatcatttacatgtttttgcctattacgaagtggctacccgcatacaaattcaaggaatatgtgctgggggacctggtcagcggaatatcaacaggtgtcctgcaactgccccagggtttggcttttgcgatgctagctgctgtccctcccatctttggtttgtactcatctttttacccggtgatcatgtactgtttcttgggaacaagccggcacatttccattggtccattcgcagtgatcagcttgatgatcggcggagttgctgtacgcctagttccagacgacatcgtgattcctggcggtgttaatgcaactaacggcacggaagctcgcgacgcgcttcgggttaaggtggccatgagtgtaacattactgtcgggaataatccaattttgcctgggggtctgcaggtttggattcgtcgccatttaccttactgagccactggtgagagggttcacaacagctgccgctgtacatgtttttacctctatgcttaagtatctgttcggagttaaaacaaaaagatactccggaatttttagcgttgtgtattccaccgtagccgtcctacaaaacgtcaagaacctgaacgtgtgcagcctgggcgttggacttatggtatttggcttactacttggagggaaagagtttaacgagcggtttaaagagaaactgcccgctcctatcccactcgagtttttcgcagtagtcatgggtaccggcatctcggctggcttcaaccttaaagagagttacaacgtggacgtcgtcggcacactccctctggggcttctcccgcctgctaaccctgatacatcactcttccatctggtctatgtcgatgccattgctatagccatagtcggcttcagcgttactatcagtatggccaaaactctggcaaacaagcacggataccaggtggatggaaaccaggaattaatcgccctgggtctgtgcaattcaattggcagcctttttcagaccttctccatttcatgcagtctgtctcgatcactggtacaggaggggaccggcggtaaaacccagactatctggctgacaacatttgtgagcagcctctttctcggccttgactatggattgattactgccgtcatcatcgcactgctgactgtgatatatcggacccagcgttag

SEQ ID NO: 241357 - DNA, 1956 bp, Artificial Sequence
  Description of Artificial Sequence: Synthetic coding sequence
atggggttggccgacgcgtccggtcctagggatacccaagcccttctctctgccactcaagccatggatctgcgacgaagagattaccacatggaacgcccactattaaatcaggaacacctggaggagctgggacggtggggcagcgcgccaagaacccaccaatggcggacctggctccagtgcagcagggctcgcgcttatgcactgctgctgcagcacttgccagtgcttgtttggcttccaagatatcccgtgagagactggttgctgggcgatctcttgagtggcctctcagtggctataatgcagcttccacaaggcctggcctacgctctcctggccggtcttcccccagttttcggattgtactctagcttttaccccgtcttcatctacttccttttcggcacaagtcggcacatttcggtcgtacttgaagtgtgttggaagctgcctcaatccaaggttgggactgtcgtgactgctgccgtggcaggagtcgtccttgtggtggtgaaactgctgaacgacaagctccaacagcaactgcccatgcccattcctggcgaattgctgacactgataggtgctactggaattagctacggtatggggttgaagcatcggtttgaggtcgacgtagtgggaaatatccctgccggattagtccctcccgtcgctcctaatacccaactgttcagtaagctggtcgggtccgcttttaccatagcagtagtaggcttcgctatagctattagcttaggcaaaatatttgccctgcgacatggttatagagtagacagcaatcaggaattggtcgcacttggattgtctaacctcattggtgggatcttccaatgctttccagtgagctgctctatgtccagatccctggttcaggaatccacaggaggcaatagccaggtagcaggggcaatctcatccttatttatattgcttataatcgtcaagcttggggagctgttccacgacttacccaaagcggtacttgccgcaattataatcgtgaatcttaaggggatgttgcgacaactgagtgatatgagaagtttgtggaaagccaatagggccgacctcctgatttggttagtgacattcaccgccaccattctgctgaacctggatctaggcctggtagttgccgtcattttcagtctgctcctggttgtcgtgcgcacccaaatgccccactactctgtcctgggacaggtcccggatacagacatctatcgggacgtagcggaatactcagaggcgaaggaggtgcgaggggtgaaggtcttcaggagctctgcaacagtctacttcgctaatgctgagttttactccgacgccctgaagcagcggtgtggcgtggacgtcgacttcctgatcagtcagaaaaagaagctgctcaaaaagcaggagcagctcaagttaaagcagcttcaaaaggaggagaagcttaggaagcaagccgctagtcctaagggggcttctgtgtctattaacgtgaacaccagcctcgaagatatgaggtctaataacgtggaggactgtaagatgatggtctcgtcaggggacaagatggaagatgccactgcaaatggccaggaagactcaaaagctcccgatggatcaacccttaaagccctgggcctgcctcagcccgacttccatagcctcattcttgacctaggtgctctcagctttgtagacaccgtgtgcctgaaatccctgaaaaatatattccacgacttcagagaaattgaagtcgaagtatacatggccgcttgccactctccagtcgttagccagctcgaggctgggcatttctttgatgctagcatcacaaagaaacacctcttcgcgagtgtgcatgacgctgtgacctttgctcttcagcatccaagaccggtccccgatagcccagtgtctgtgacacgattatag

SEQ ID NO: 241358 - DNA, 2217 bp, Artificial Sequence
  Description of Artificial Sequence: Synthetic coding sequence
atggacctgagacggagagattatcacatggagcgccctcttctcaaccaggagcatctagaggagcttggtcgttggggatctgcccctaggacacatcagtggaggacgtggctgcagtgttctagagcccgagcttacgctctgctcctgcagcacctacctgtcctcgtttggctgcctcgctatcctgtgcgggactggctactcggggatctcctgtctggactctccgtcgccatcatgcagctacctcagggactagcctacgctctactggctgggctcccccctgtattcgggctgtatagcagcttctatcccgtttttatttatttcttgtttggaacctcgagacacatcagtgttggaacatttgcagttatgagtgtaatggtgggatcggtaaccgaatcactggccccacaggccctgaatgattcaatgattaacgagaccgcccgtgacgctgcccgagtacaggtggccagcaccctatccgtccttgtgggcctgtttcaggtcggcttggggctcattcatttcggattcgtggtgacttacctgtccgagcccctggtccgcggatacaccactgctgctgctgtccaggtatttgtatcccagcttaagtatgttttcggattacatctctctagccactcgggtcccctgtctctcatctacacagttctggaagtttgctggaagctgccacaatccaaagtggggaccgtcgttacagccgctgtggcaggagtagtcctggtcgtggtgaagctgctgaatgataagcttcagcagcagctgcctatgcccatccctggcgaactgctcaccctaataggcgctaccggcattagttatggaatgggactgaaacacagattcgaagtggacgtcgtgggcaatatacctgctggcctggtcccccctgtcgcacccaatactcaactgttctctaaattagttggatctgcgttcacaatagccgtcgtaggattcgcaatagccatatccttgggcaagatttttgctctgagacacgggtaccgggtggacagcaaccaggaattggttgccctcggtctttcgaatttgatcgggggtattttccaatgcttccccgtctcctgtagcatgagcaggtctctggtccaggagtcaacaggaggaaattcacaggtggctggggctatcagctctctttttatcctgcttatcatcgttaaactgggagagctgttccatgacctcccaaaagctgtcctcgccgctattatcattgtcaatctgaagggaatgctgcgtcagttgagtgacatgaggtccctgtggaaagccaatagggccgacctgctgatctggctggtgacatttactgccacgatcctgttaaacctcgatttagggcttgtggtcgcagtaatcttctcactgctattagtggtggtgaggacccaaatgccacattacagtgtgcttggccaggtccccgataccgacatttatcgtgacgttgccgaatattccgaagcaaaggaggtgcggggtgtcaaggtgttccgaagcagcgctaccgtgtattttgccaacgcagagttttacagtgacgctcttaagcagcgttgcggagttgatgtggattttctaatatctcagaagaagaagctcttaaagaaacaggagcaactgaaacttaagcagttacagaaggaagagaaactgcgaaagcaggctgctagcccaaagggggcaagtgttagcattaatgtgaatacttctcttgaggacatgagaagcaataatgttgaggactgcaagatgatgcaggtgagctcgggtgataaaatggaggacgcaacagctaacgggcaggaggactccaaggcccctgatggttccaccctcaaggccctaggccttcctcaacctgattttcattccctcattctggacctgggtgctctctccttcgtggacaccgtctgcctgaaatctctcaagaatatcttccatgacttcagagaaattgaggtcgaggtctatatggccgcttgtcatagtccagtcgtctctcagttggaagccggtcacttctttgatgcttcaatcaccaaaaaacacctcttcgcctccgtccatgacgcggtgacatttgccctgcagcacccacgtcccgtaccagactcaccggtctcagttacacgtctttag

SEQ ID NO: 241359 - DNA, 2223 bp, Artificial Sequence
  Description of Artificial Sequence: Synthetic coding sequence
atgggacttgccgacgctagcgggcctcgcgacactcaggccctgctgtctgccactcaggcgatggacctccgaaggagggactatcacatggaacgtccactgcttaaccaggagcacctcgaggagctggggaggtggggcagtgcccctagaacccaccagtggcggacatggcttcagtgctcgcgggctagagcctatgccttgttgcttcagcacttgcccgtcctcgtttggttgccgaggtacccggttagagactggcttctgggcgacctcctgtctggattatcagtggccattatgcagctgccacagggcctggcgtacgcccttctggctggcctgcctcccgtctttggactttacagttcattctaccctgtgttcatctacttcctcttcggtactagtcgtcacatatctgtcggcacatttgctgtaatgagtgtcatggtggggtcagtgactgaatcactggcaccgcaggccttaaacgacagcatgatcaatgagaccgcgagagacgctgccagggtgcaggtggctagcaccctgtcggtgctcgttggcctgttccaggtagggctgggattgatccatttcggattcgtcgtcacctacctgtctgagcccctggtccggggatacactacagccgctgctgttcaggtctttgtgtcccagcttaaatatgtattcggcctccacctgtccagccattcaggaccgctgagcttaatatacactgtgctggaagtatgttggaaactgccacaaagcaaggtgggcacagtcgtaactgcagctgtggctggcgtcgtcctggtcgtggtgaaattactaaacgataagctgcaacagcagctgcccatgccgatacccggtgagcttctgacccttatcggagccaccggaatctcttacggcatgggtttgaaacacagatttgaggtagatgtggtgggcaatatccctgctgggctcgtgcccccagtggcacccaatacacagctattctctaaacttgtaggctcagctttcactatagctgtggtgggattcgctattgccatcagcttgggaaagatcttcgctcttaggcacggctaccgagtggactccaatcaggaactggtagctttaggactttccaatctcattggcggaatctttcagtgctttccagtatcctgcagcatgtcacgcagcctggtgcaagaatccacgggcggtaactctcaggttgccggagctatcagttctttattcatcctacttattatcgtgaagctaggtgagctgtttcatgatttgcctaaggctgtcttggccgctatcataatcgttaatttgaaggggatgctgagacagctaagcgacatgcgtagcctgtggaaggcgaatcgggctgatttgctgatttggctggtcacgtttaccgcgaccatcctccttaatttggacctgggtttagttgtggctgtgatattctccctcttactggtggtcgtccgcactcagatgccccactacagcgtgttaggccaagtccccgataccgacatttatagggatgtcgctgaatattccgaggcaaaggaagttcgcggagtgaaggtctttcggagcagcgccaccgtgtactttgcaaatgcagagttctactcagacgcactgaagcaaagatgtggagtggacgtcgattttctcatcagccagaaaaaaaagttactgaaaaaacaggagcagctcaaattaaagcagcttcaaaaggaagaaaagttgagaaagcaggcgggaccactgctcagtgcctgcctggcacctcagcaggtctcctcgggagataagatggaagacgcaactgctaacggtcaggaagattccaaagcaccggatgggtccactcttaaggccctggggctgccccagcccgactttcactctctgatcctggatctgggagccctctcttttgtggacactgtatgcctgaaaagtcttaaaaatatctttcatgatttccgagagattgaggtggaggtgtatatggctgcttgccactccccggttgtcagtcagttggaagccggacactttttcgatgcaagcatcacaaagaagcatctgttcgcttccgtacacgatgcagtcacattcgctcttcagcatccgagaccggtgccagattcgcctgtctccgtgacacggctgtag

SEQ ID NO: 241360 - DNA, 2280 bp, Artificial Sequence
  Description of Artificial Sequence: Synthetic coding sequence
atgggtctggccgacgcctcgggcccacgcgacactcaggctctgctgtctgctacacaggctatggatctccgacggcgagattaccacatggaacggcctctacttaaccaagagcacctggaggagttgggcaggtggggatccgccccacgtacgcatcagtggcgtacatggcttcaatgcagcagggccagggcctacgccctcctgcttcagcatctccctgtcttggtgtggcttccaaggtaccctgttcgagactggctgttgggggaccttttatctggtctgtccgttgccattatgcagctacctcagggcttggcctacgcactgctggctgggctgcctcctgtcttcggattatactcatccttctatcctgtgtttatctatttcttgtttggcacaagtcggcatatatctgtgggtacatttgctgtgatgagcgtcatggtgggaagcgtgacagagtctctggctccacaggccctgaatgattcaatgattaatgaaactgccagagatgccgcacgggttcaggtcgccagtacactctcagttctcgtgggcctgttccaggtgggattaggcctcatacatttcggctttgtagtcacctacctgtctgagccactcgtcagagggtatactactgccgctgctgtccaagtcttcgtgtctcagctgaagtacgtgttcggcctgcatctgtcatcacatagtggaccactgtcactaatttataccgtgctggaagtctgttggaaacttccccagtccaaggtcggtaccgtggtcacagccgcagtggctggggtcgtgttagtggttgttaaactccttaacgacaaactgcaacagcagctgccaatgcctatacctggcgagctactgacactgattggtgcgaccggaatctcgtatggaatggggctcaagcatcgctttgaagtggacgtagtggggaatatacctgcgggactggtcccgccagtagccccaaatacgcagctgttttcaaagctggtggggtcagcttttacaattgccgtcgtcgggttcgccattgccattagtctaggaaaaatcttcgctctcaggcacggttacagagttgacagcaaccaggaactcgttgccctcgggctgagcaacctcatcggcggaattttccagtgcttcccagtctcttgtagtatgtccaggtccctggttcaggagtccaccggtggtaactcccaggttgccggagccatctcaagtctgttcatcctgctgatcattgtcaagttgggagaactgttccatgatctgcctaaggcagtcctggctgccatcatcattgtgaacttgaaaggaatgctccggcagctctcagacatgagatccctgtggaaagccaatagggctgacctgctcatttggctcgtgaccttcactgcgacaatcctcctgaacctggacttgggcctagtggtcgccgtgatcttttcacttttgctggtggttgtcaggacacagatgccccactacagtgtacttggacaggtaccggacacggacatttaccgcgacgtcgctgagtactctgaggctaaagaagttcggggagtgaaagtgtttcggtcctctgccactgtgtactttgctaatgctgaattttactcagatgccctaaagcagaggtgtggcgtggacgtggactttttgatttcccagaaaaaaaagttgctgaagaagcaagagcagcttaaactaaaacagctgcaaaaagaggagaagctgagaaagcaggctgcttcccccaagggtgcctcagtaagtatcaatgttaacacaagtcttgaggacatgcggtccaacaatgtcgaagattgcaagatgatgcaggtgtcctccggggacaagatggaagatgctactgccaatggccaagaggactctaaggcacccgatggcagtacactgaaggccctgggcctgccacagccagatttccatagtctgatcctagatctgggcgctcttagtttcgtcgatactgtctgtttgaagtctctcaagaacattttccatgactttcgggaaattgaagttgaggtgtatatggcggcttgtcacagccctgtggtttcacagcttgaagccggacacttcttcgatgctagtattacaaaaaagcatctgttcgcttctgtacacgatgctgtcacctttgccctgcaacacccgagaccagtccctgatagtcccgtctccgtgactaggttgtag

SEQ ID NO: 241361 - DNA, 2277 bp, Artificial Sequence
  Description of Artificial Sequence: Synthetic coding sequence
atgggtctggcagatgctagtgggcctcgagacactcaagctctattgagcgcaacccaggcgatggacctgcgccgtcgtgattaccatatggagcgcccattattgaaccaggagcacttggaggagttaggtcggtggggcagtgcccctcggacacaccagtggagaacttggctgcagtgttcaagggctcgcgcttacgcactgttgttgcaacaccttccagtcctcgtgtggctccctcggtaccccgtgagggattggctcctgggagatttgctctctgggctctcagttgccatcatgcaactaccacagggcctcgcgtacgctttgctggcagggctcccaccagtatttggcttgtacagttccttctatcccgtttttatctactttctgttcggcacttcacgccatataagtgtgggtacctttgcagtgatgtctgtgatggtgggaagcgttacagaatctctggccccacaggcactcaacgacagcatgatcaacgagactgcccgagatgcggcaagagttcaagtggcgtctactctgtccgtcttagtagggttgttccaggtggggctcggactgattcattttggatttgtggtcacgtatctttctgagccactcgtgcgtggctacacgaccgcagcagccgtccaagtcttcgtgagccagctgaagtacgtttttggccttcacttgtctagccactctggccctctgtcgttgatatataccgttctggaagtttgttggaagctgccccaatccaaagtgggcacagtcgtaacagctgctgtggccggtgttgttctcgtggtagtgaagctcctgaatgacaaactgcagcagcagcttccgatgccaataccgggagagctccttacgttgatcggagccacaggcattagctacggaatggggttaaaacatcggttcgaggtggatgtggtcggaaatattcctgccggacttgtcccgccagtggccccaaacacccagctctttagtaaactggttgggtccgccttcacgattgcggtggtaggatttgccattgcaataagtctgggaaagatctttgccttacggcacggttaccgcgttgactcgaatcaggaactcgttgcgttggggctctcgaatctcatcggaggaatttttcagtgtttccctgtgagctgcagcatgagtagatccctggtgcaggaaagtacagggggaaattctcaggtggcgggagccatctcttccctttttattcttctcattatcgtgaagctgggcgaactgttccacgatctaccgaaggccgtgctggccgcaattattatcgttaacctcaaggggatgttgagacagcttagtgatatgcggtcactatggaaggccaatcgcgcagacctgctgatttggttagtgactttcacagctaccattctgctcaatctggatctgggcctcgtggtggcggtgatcttctcactgctgctcgtggtagtacgtactcagatgcctcactattcggtcctcggtcaggtgcccgatacggacatctacagggatgtggccgagtacagcgaggcaaaggaagtgcgcggtgtcaaagtgtttagatcttccgccaccgtttattttgccaatgccgagttctattccgatgccttaaaacaaaggtgtggggtggacgtcgattttcttataagccagaagaagaagctgctgaaaaagcaggaacaattaaaactgaagcaacttcagaaggaggagaagctgcgaaagcaggcagctagtcccaaaggggcttcagtgagcattaatgttaatactagcctcgaagacatgcggtctaacaatgtggaggactgtaagatgatggtctcttctggggataaaatggaagacgcgaccgccaacggccaagaagattctaaggccccagacggctccacactgaaggcccttggcctcccacagccagacttccactcactcatcttggatctaggcgcattatccttcgtcgacactgtctgtcttaagagcttgaagaatatctttcatgactttcgggaaatcgaagtggaggtgtatatggccgcatgtcactcccctgtggtgtcacagctggaggccggacatttctttgatgcatctattacaaagaagcatttattcgcctcggtgcatgatgccgtgacctttgctctgcaacatccaagaccagtgcccgactctcccgtctctgtgactcggctgtag

SEQ ID NO: 241362 - DNA, 2262 bp, Artificial Sequence
  Description of Artificial Sequence: Synthetic coding sequence
atgggactggccgatgcatcagggccacgagacacacaagccctcctatctgctacacaggccatggatctgaggcgacgcgactaccacatggagaggccattgcttaatcaggaacacctggaggaactgggccgttggggatccgctcccagaacccaccaatggaggacatggttgcagtgtagcagagcgagggcatatgccttgctcttacagcatcttcccgtgctagtctggctgcctcgctaccctgttcgcgattggctccttggagatctgttgtcgggattgtcagtggcgatcatgcagctaccacaggatcttctgagccgccttcattgttaccattcaaccctgggcctcgcctacgcactgttggcaggccttcccccagtgttcggactttacagttctttttatcccgtgtttatctactttctctttggaacctcccggcacatcagcgtgggcactttcgccgtcatgagtgtaatggtcggaagtgtaactgaatcacttgcaccgcaggccctgaacgacagtatgatcaacgagactgctcgggacgccgcacgagttcaggtggcctcaactctgagtgttctggtggggctcttccaggtgggattaggtctcatacatttcggctttgtagtgacctacctgtccgaaccattggttcgaggctacacgaccgccgcagcggtgcaggttttcgtgtcccagctgaagtacgtttttgggttacatctgagctcccatagtggaccattatcattaatctacacagtactagaagtgtgttggaagctgccccagagcaaggtcggcacagtagtgaccgcagcagtcgcaggtgtggtcctcgtagtggtcaaactgcttaatgacaaactccagcagcaactgccgatgcccatccccggtgaattgctgacacttataggtgcgaccgggatatcgtacggcatgggcttgaagcacagatttgaggtcgatgtggtaggcaacattcccgctgggctcgtccctcctgtggcaccaaacactcagctgttttccaaattggtgggctccgccttcaccattgccgtagtcggtttcgctatcgccatatcattggggaaaatctttgcacttcggcacggatatcgggttgatagcaaccaggaattggtagccctagggctgtcaaacctgatcggcggtattttccagtgtttcccagtgtcctgttctatgagccgcagcctggtgcaagaatcaactggcggaaattcacaggtcgctggagcgatttcttcactctttatcctccttatcatcgtcaaactcggcgagctgttccacgacctccctaaagcagtactggcggctattataatagtaaacctaaagggcatgcttcgccaactgtccgatatgagatctttgtggaaggcaaaccgagccgacctgcttatttggttggtcacctttacagcaacaattctcttaaacctggatctgggtctggtcgtggcagtgattttctctttactgctggtggttgtgcgcacacaaatgcctcactactccgtacttgggcaggtccccgatactgacatttatagagacgtagccgaatacagcgaggcaaaggaagttcgcggagtaaaggtatttcgtagctctgccacagtgtacttcgcgaacgccgagttttactccgatgccctgaagcagcgatgtggggtggacgtggactttctgatttcccagaagaagaaactgctcaaaaagcaagagcagctcaaactcaagcaactgcagaaggaagagaagctgaggaaacaggccggacccttgctcagcgcctgcttggcccctcagcaagtgtccagcggtgacaagatggaggacgctacggccaacggacaggaggacagtaaagcgcctgacggctcaaccctcaaggctctgggactgcctcagcctgatttccacagtctgatcttggatcttggggcactgagctttgtggacaccgtctgtttaaaatccttaaaaaacatattccacgattttcgtgagattgaggtcgaggtgtatatggccgcatgccactctcctgtcgtttctcagttggaagccggtcacttcttcgacgcaagtattactaagaaacacctgttcgcctctgtccacgatgccgtaacgtttgccctgcagcacccacgcccagtccctgacagccccgtgtctgtgacaagactgtag

SEQ ID NO: 241363 - DNA, 2172 bp, Artificial Sequence
  Description of Artificial Sequence: Synthetic coding sequence
atgggacttgcggatgcctccggaccgagggacacacaggcgctgctgtctgcaacccaggctatggatctgcggagaagagattaccacatggaacggccactcctgaaccaagaacacctagaggagctcggtcggtggggctcagcacccagaacccatcagtggcggacctggttgcaatgtagcagagctcgtgcttacgcgcttctccttcaacacctcccagtcctggtttggctgcctaggtaccctgttagggattggcttctcggagatttactgtccggcctgtcagtggcgatcatgcagcttccccagggccttgcatacgccctgctagcaggactccctcctgtgttcgggttgtactctagcttctacccagtgtttatctacttcctctttggcacttctaggcacataagtgtggcaacacccggtcccctaccactcttgacagctccaggccgtccgaccggcggtgccggacccgatcctctaaggctgagggggcacctgccagtaaggacatcctgtcctaggctgtatcactcctgctcctgtgccggactccggctgaccgcccaggtgtgtgtttggccacctagcgaacagccactgtgggctacagtccctcaccttcttctggaagtatgctggaaacttcctcagtcaaaagtggggaccgtcgtgacagccgcagtggctggggtagtgctcgtggtcgtgaaactgctgaatgacaagttgcaacagcagcttcccatgcctattcctggagagcttctgaccctgatcggggctaccggtatcagctacgggatgggacttaagcaccgcttcgaagtggatgttgtgggaaatatcccagccggactcgtgccaccagttgcccctaacacccagctcttctcaaaactcgttgggtcagccttcactatcgccgtcgttggtttcgcaattgccattagcctcggcaagatctttgcccttagacatgggtacagagtggattcaaaccaagagttggtcgctctgggtctgtcaaatctgatcggaggaattttccagtgcttccctgttagctgtagcatgtcacgaagtctggtccaggaaagcaccggaggcaatagccaggttgcgggtgccatttccagcctcttcatcctgttgatcattgtcaaactgggagaattgttccatgacctgcctaaagcggtcctcgccgcaattattattgtgaatcttaagggcatgctgaggcagcttagtgacatgcggagtttatggaaggccaacagagctgatcttctgatatggctcgtgacctttaccgctaccatactcctgaatcttgatctaggactggtagttgccgtaatttttagtctcctgttggtggtggtgcgcactcagatgcctcactatagtgtgttgggccaggttcccgacactgacatataccgcgacgtggctgagtactccgaagccaaagaggtaagaggcgtgaaggtcttcagatcctctgctaccgtgtacttcgccaacgctgagttctacagtgatgcactgaagcagcgctgcggggtcgacgttgattttctaatatcacagaaaaaaaagttactaaagaagcaggagcaactcaaactcaagcagcttcagaaagaggagaagctgagaaaacaggctgcatcccccaagggcgcaagtgtcagcatcaatgtcaatacatccttagaggatatgagaagtaataacgtcgaggattgcaagatgatgcaggtctcctccggggataaaatggaggacgcaacagcaaatggccaagaagattccaaagcgcctgatggatctacgctcaaggccctgggactgccgcagcccgactttcattcgttaattctggatctaggcgctctgagctttgtagacactgtgtgtctcaagtcactgaagaatatctttcatgacttcagagaaatcgaagtggaggtgtacatggccgcttgccacagccccgtggtgtcgcagttggaggcaggtcacttcttcgacgcttccatcactaagaagcatttatttgcgtccgtacacgatgccgtgacattcgcactgcagcacccccgaccagttccggattctccagtctccgtgacaaggttgtag

SEQ ID NO: 241364 - DNA, 1941 bp, Artificial Sequence
  Description of Artificial Sequence: Synthetic coding sequence
atgcgggcacctggcgcaggggctgcctccgttgttagcctggcactgctctggttgctcggactcccttggacttggtccgcagccgctgccctcggggtttatgtcggctcgggcggatggagattcttgagaatcgtgtgtaaaactgctagaagagacctctttggtctgtcagtgctgatcagggtgcgcctggaactccgccgacatcaacgggcagggcatacaattcctaggattttccaggcggtggtgcagcggcagcctgagagattagcattagtcgacgccggaacaggagagtgttggactttcgctcagctggacgcatatagtaacgccgtggctaacttattccgacagctcggtttcgcgcctggagatgtagttgcaatatttttggaaggcagacccgaatttgtgggactgtggctaggtcttgccaaggcgggtatggaagctgcacttctaaacgtcaacctgcggcgtgagcccctggccttttgcctggggacaagcggcgctaaggctctgatcttcggcggagaaatggtggccgcagtagctgaagtctctggccatcttgggaaatcactgattaagttctgttcaggggatcttggaccagaaggaattcttccagatacccatctgctggatcctttgctcaaagaggcttcaacagctccactggcgcagattccttccaaaggtatggacgacagactgttttacatctatacctctgggaccactggccttcccaaggccgcaatagtggtgcacagcaggtactatagaatggctgcttttggacatcatgcttacagaatgcaggcagcagacgtgttatatgattgcctgcccctatatcatagcgccggtaacattatcggagtgggccagtgtctgatatacggccttactgtggtgctgagaaagaaattctcggcatccaggttttgggacgactgtattaagtataattgcaccgtggtgcagtacattggagaaatatgtagatacttgctgaagcagccggtgcgcgaggctgaaaggcggcatagggtacgtcttgccgtaggtaacgggttaaggcccgcaatctgggaagagtttacagaaagatttggggtaagacagatcggagaattctatggtgccactgagtgcaactgcagtatcgccaatatggatggcaaggttggctcatgtggatttaactcacgaatcctgccgcatgtgtaccccatccggctggtgaaggtcaatgaagatactatggagttgctgagagacgcacaggggctgtgtattccatgtcaggccggagagcctgggctgctggtcggccagatcaaccagcaggacccactcagacggtttgacggttatgtgtctgagtcggcgacaagcaaaaagattgcacattccgttttctctaagggggatagcgcctacttgtccggagacgtgctagtcatggacgagctggggtatatgtatttcagagaccgtagcggcgacacattccgctggcgcggtgaaaacgtgtccaccacggaagtggagggtgtgctttctcgactccttgggcagaccgatgttgccgtctacggagtcgccgtccctggcgtcgaggggaaggcagggatggccgctgttgccgatccccatagcttgctcgacccaaacgccatctaccaggagctgcagaaggtgttggcaccatacgctaggccaatcttcctccgcctgctaccacaggtggatacaactggtacgttcaaaatccagaaaactaggctgcagcgggaggggtttgacccacggcagactagtgatagactcttcttccttgatctgaaacagggccattaccttccgctgaacgaggctgtttacacacgaatctgcagcggcgcatttgccctgtag

SEQ ID NO: 241365 - DNA, 723 bp, Artificial Sequence
  Description of Artificial Sequence: Synthetic coding sequence
cctgagtttgttggtctgtggctaggattggcaaaggctggcatggaagccgcattactgaacgtaaacttgcgccgtgagccactggctttctgcttgggaacttctggtgcgaaagcgttgattttcggcggagaaatggtggccgcagttgctgaggtttcaggccatctgggtaagtccttaatcaaattctgttctggtgatctgggcccagagggcatcctgcctgatacacaccttctggacccactactcaaggaggcatccactgcccctcttgcacagatcccctctaagggcatggatgatagactattctatatctatacatcagggacaaccggactgcctaaagctgccatcgtcgtgcacagtaggtattaccgaatggccgcattcgggcaccatgcctaccgcatgcaggccgctgacgtgctttacgattgcttgccactgtatcattccgccggaaatattatcggggtcggccagtgtcttatctatgggttgaccgtcgtgctgcggaaaaagttttctgcctccaggttttgggatgactgtattaagtacaattgtacttggcatggaccttcgtggacggaaaaattggaaccccagcgcaatccttgcctcagcgctgccctggttcccctgtgcctccccccactgcctgcctttcaacctctgtcaccctctattcctgtcccagtttggccctag

SEQ ID NO: 241366 - DNA, 1941 bp, Artificial Sequence
  Description of Artificial Sequence: Synthetic coding sequence
atgcgcgcacctggagccggtgccgctagtgtcgtatctcttgctttgctctggctgctgggactcccatggacatggtccgcggctgccgcactgggcgtctacgtgggctccggcggttggcgctttcttaggatcgtgtgcaagaccgctcgaagagacctgtttgggctctctgtgctgatccgagtgcggctagagctccgtagacaccagagagctgggcatacaattccccgaatctttcaggccgtggtacagcgacagcctgaaagactggcactcgtcgacgcaggcacaggggagtgctggacctttgcccaactggatgcttactctaacgccgtcgctaatttgttcaggcaactgggtttcgctcccggagatgtggtcgcaatatttctggaaggacggcctgaattcgtggggctttggcttggcctggctaaggccggaatggaagctgctctcctgaacgtcaacttacgcagggagccactcgccttctgcttgggcacgtctggggctaaggcactgatttttggaggggaaatggttgctgcagtggctgaagtgagtggacacctcggaaaaagtctcattaagttttgcagtggcgatctaggcccagaaggtatcctccccgacacgcatttattagaccctctgttgaaggaagcctctaccgcgcctctggcacagatccccagcaaggggatggacgatagactgttttatatctatacgtcgggcacaaccggtttgcccaaagccgcaatcgtggtgcatagccgctattatcggatggctgcttttggtcaccatgcgtaccggatgcaagctgccgatgtgttgtatgactgtctgcctctctatcactctgctggtaacattattggggtcggacagtgcttaatctacggacttaccgtagtgctccggaagaaattcagcgctagccgcttctgggacgactgcataaaatataattgcaccgttgtccagtatattggagaaatatgtagatacctgctcaagcagcccgtgagggaagccgaacggagacatcgggtgcggctggcagtgggaaatggtcttaggcctgccatttgggaagaatttactgagcgattcggcgtgagacagattggcgaattttacggggcaacggaatgcaattgtagcattgcaaacatggatggcaaggtgggtagctgcggctttaacagcaggatattaccacacgtttatcctatccgactggtcaaagtgaacgaagacaccatggagctgttacgcgatgcacagggactctgtattccctgtcaggcaggggaacccggacttctggtaggacagataaaccaacaggacccactacggagatttgacggctacgtttcagagagtgccacgtctaagaaaattgcccattccgtcttctctaagggcgattctgcgtacctcagcggagacgttcttgttatggacgagctgggctacatgtacttcagggatagatcgggggatacgtttcggtggcgaggagaaaacgtgtccacgaccgaggtagaaggcgtcctatctagactgctggggcagaccgacgtggcggtgtatggtgtggctgtgcccggagtggaaggaaaagcaggtatggcagcggtcgcggacccacattcgctactcgatcctaatgccatctatcaggagcttcagaaggtgctcgcaccgtacgcccgtcccattttcctgagattgcttccacaggtggacacaactgggacctttaaaatccagaagactagactgcagcgcgagggtttcgatccgcgacagaccagcgatagattgttctttctcgacctgaaacaggggcattatctgccattgaatgaggctgtttacacaagaatttgttctggggcttttgctttatag

SEQ ID NO: 241367 - DNA, 1863 bp, Artificial Sequence
  Description of Artificial Sequence: Synthetic coding sequence
atgcttagtgccatttacactgttttagccggtctacttttcctgccactacttgtgaatctgtgctgtccctacttcttccaagacatcggctattttctgaaagtagccgctgtgggacgtcgtgtgagaagttacggcaagaggcgtccagcccgaactatcctcagagccttcctggagaaggcaagacagactccccataagccattcctcctgtttcgagacgagacattgacctatgcccaagtcgaccgcagatccaatcaggtggcgcgtgccttgcacgatcatctgggtttacgccagggcgattgtgtcgctctcctgatgggaaacgaacccgcttacgtctggctgtggttggggctggtgaaattagggtgtgcaatggcctgcctgaattataatattagagctaaatcgctgctgcattgttttcaatgctgtggcgcaaaggtgctcctggtatccccagagttgcaggctgccgtggaggagatcttgcctagcttaaagaaggacgacgtctccatttactacgtgagtaggaccagcaatacagacggaatcgatagctttctggacaaggtcgacgaggtgagtactgagccaatccccgagtcctggcgttcagaggtcacgttctctacacccgctctctacatatacaccagcgggaccacagggctgccaaaggcggctatgataacccaccagcgtatttggtatggtacagggttaacgtttgtctcaggcctgaaggccgacgatgtaatctacatcacactccccttttaccactccgcggcactactgatcggaattcatggctgtattgtggcaggcgcaactttggcgttaaggacaaaattttctgcctctcagttctgggacgactgtcggaagtataatgttacagtcattcagtatatcggtgagctccttaggtatctttgtaattcacctcagaaaccaaacgacagggaccacaaggtacgtctggcactgggtaacggtctccgcggtgacgtctggaggcagttcgtgaagagattcggtgacatttgcatttacgagttctacgcagctaccgaaggcaatattggctttatgaattacgcacgtaaagtgggggcagtggggcgagtgaattatttacagaagaagatcataacctatgacttgattaaatatgacgtcgagaaggacgagcctgtccgcgatgagaatggatactgtgtcagagtgcctaaaggagaggtagggctgttagtctgtaagattactcagctaactccttttaatggatatgcaggcgcaaaagcccagaccgaaaagaaaaagctcagagatgtcttcaagaaaggagacttgtacttcaactcgggggacctccttatggtcgaccacgaaaactttatctactttcacgatcgggtgggggacacattccgctggaaaggcgagaacgtggctacaactgaggtagctgatactgtgggcctagttgattttgtgcaggaggtgaacgtttacggtgtgcacgtacccgatcacgagggacgaatcggaatggcttctattaaaatgaaggagaatcacgagttcgacggcaagaaactgtttcaacatatagctgactacctccccagttatgccaggcctagatttttgcggatccaggatactatcgaaataaccgggacctttaaacacaggaagatgaccttggtggaagaaggcttcaatccagcggtgatcaaggacgctttgtatttcctcgatgatacagccaaaatgtatgttcccatgactgaagacatctataatgccatctcggctaaaacactgaagctgtag

SEQ ID NO: 241368 - DNA, 1704 bp, Artificial Sequence
  Description of Artificial Sequence: Synthetic coding sequence
atgctgtctgccatttatactgtcctggccggacttctctttctgccgctgctcgtgaatctgtgctgtccttactttttccaggacatcggatattttctgaaagtagcagcagttggcaggcgagttcgctcatacggtaagcggagacccgcacgcacgattctgagagccttcttggagaaggcgcgacagactccacacaaacccttcctgttattcagagatgaaacgctcacctacgcccaagtagacaggaggagcaatcaggtcgccagggcattgcatgaccacttgggtttaaggcagggtgattgtgtggcattactcatgggcaatgagccagcttacgtgtggctgtggctcggactggtgaaactagggtgtgccatggcgtgcttaaattacaacatccgagcgaaatctctgctgcactgtttccagtgctgcggggctaaagttttgcttgtctctcctgagctccaggcggcagtggaagagatcctgcctagtctcaaaaaggacgacgtttctatttactatgtgtcacggactagtaacacggacggtattgattcctttctggacaaggtggatgaggtctcaactgagcctatacccgagtcgtggagatcggaggtgacatttagtacccccgctctgtacatttatacctccggcaccacgggtgcgactttggcactcaggactaaattcagcgcgtctcagttctgggacgattgtcgtaagtataatgttacggtgatacagtacattggggaactgttaagatacttgtgcaactcaccccagaagcccaatgacagggaccacaaggtccgccttgcactcgggaacgggcttagaggagatgtgtggcgacaatttgtgaagaggttcggggatatttgtatctatgaattctacgcagccaccgaaggcaacatcggcttcatgaactacgctcggaaggtcggcgctgtgggaagagtaaattatctgcagaaaaaaatcatcacctacgatctgataaagtatgatgtcgaaaaagatgaacctgtccgcgacgaaaacggctattgtgtacgtgtgcctaaaggcgaggtcggactgctggtgtgcaaaattacgcagctgacgccattcaacggatacgctggggctaaggcccagacagaaaagaaaaagttgagagatgtgtttaaaaagggcgatttatattttaattctggggacctcctgatggttgaccacgaaaatttcatctacttccacgatcgtgtcggggacaccttcaggtggaaaggcgagaacgttgccaccaccgaggtggctgatacagtgggcctcgtcgacttcgtgcaggaggttaatgtgtacggggttcatgtccctgatcatgaagggagaatcggtatggcctccattaaaatgaaagagaaccacgaatttgatggcaaaaaactgttccagcatatagcagattatttaccatcttacgcaaggccaaggttcctccggatccaggatacaattgagatcacaggtacattcaaacacagaaagatgacacttgtcgaagaaggtttcaaccccgctgtgatcaaggatgcactgtactttttagatgatacggcaaagatgtatgtgccaatgacagaggacatctacaacgcgatctccgcgaaaactcttaaactctag

SEQ ID NO: 241369 - DNA, 2436 bp, Artificial Sequence
  Description of Artificial Sequence: Synthetic coding sequence
atgccaaaacctcccaaacctcgtaataacctcgaagacaggcataatccagggattcaaggcagacgggaacatcggccagggcctggccgtgtcagagctgccagctctccagggggatcagcaccccgagcagaacggcgactgtggggcgagggatgggagtctggcgcagccccacacccacattcttccagggtatcagctctgagaccatgcggagttgtgggggcttgggtcggcatgggtgtatgccagcgaaccagagccccatggaaagaaaaaagtcagctcgaaagggctgcgctggggtttcggaaggggggaagcgggatgttcgcttccggatggaatcagacagtccctattgaagaggccggatcgatggctgctctgcttttattacccctgctattgttgctgcctctgcttcttctgaaacttcacttgtggccccaattacggtggctaccagctgacttggccttcgccgtgagagccctctgttgcaagcgagctttaagagcccgagctttagcagcggctgctgccgaccccgagggaccagaaggcggatgctcattggcatggcgactggctgaattagcccaacagcgagctgctcacacattcctgatccatggctcacgtcgttttagttactcagaggcggagagggagagcaaccgcgctgcaagggcgttccttagagctttaggttgggactggggaccggacggtggagacagcggcgaggggtcagcaggcgagggtgaacgagcggctcccggagctggggacgcagcagcagggagcggggcagaattcgccggaggagacggggctgcaagagggggaggtgctgccgctccattgtccccaggcgctacagtggcacttctcttgcctgctgggcctgaattcctgtggctgtggttcggcctggctaaagccggtctacggacagcatttgtccccaccgcgctgagacgaggccctctgctccactgccttagatcctgtggcgctagggcccttgtcctagccccagagtttctcgaaagcctggagcctgacctgcctgcactgagggctatgggactccacctgtgggccgcaggcccaggcacccatcctgcagggattagcgacttattagccgaggtctcggccgaagtcgacgggccagtgccgggttatctgtcaagcccacagagcattacagacacatgtctctacatctttacctccggcacaactggacttccaaaggctgcaagaatttctcacctgaagatactgcagtgtcagggcttttatcagctgtgtggtgtacaccaagaggatgttatctatctggccttgcccctgtaccacatgagcggctccctgctaggtattgtcggatgtatgggcatcggcgctaccgtggtgctgaaatctaaatttagtgcagggcagttttgggaggactgtcaacagcaccgggttacagtgttccaatacataggagagttatgtagatacctcgtcaaccaaccgccttccaaggctgagcggggacacaaagtacggctggctgtcgggagcgggttgcgccctgacacctgggagcggtttgtacggcgttttggcccactgcaggttttggagacctacggactgacggaaggcaacgtagctactatcaattatacaggacaacggggagccgtcggccgagcctcatggctttataaacacatctttcccttcagcctgatccgctatgatgtcactacgggcgagcctataagggatcctcaggggcattgtatggccaccagccccggagaacccggactgctcgtggcaccggtgagccagcagtctcctttcctaggatatgcgggaggccctgagttagcccagggtaagctgctgaaagatgtcttccggccaggtgacgtgttctttaacaccggagatctgctggtgtgtgatgatcagggctttctaaggttccacgatcgcactggggacacattcagatggaaaggagaaaatgtcgctaccactgaagttgccgaggtctttgaagccctcgatttcctgcaagaggtgaatgtgtatggcgtaactgtgccagggcacgaaggacgggcaggcatggctgcgctagtgctcagacctccccacgcactagacctgatgcagttgtatactcacgtgtccgagaacctacccccatacgccagaccgcgttttctgcggctgcaggaatcgctcgccacgacagaaacgttcaagcagcaaaaggtgcgcatggcaaacgaaggcttcgaccctagcacgctttctgatcctctctacgtgctggatcaagcagtgggcgcatacttgcccctcacaactgctcggtattccgcactgctggcaggcaacctgagaatatag

SEQ ID NO: 241370 - DNA, 2193 bp, Artificial Sequence
  Description of Artificial Sequence: Synthetic coding sequence
atgggcgtgtgccagcggacccgggctccatggaaagagaagtctcaattggagagagcagccctcggatttcgcaagggtggatccggcatgttcgcctctgggtggaaccaaaccgtgcctatcgaagaagcaggaagtatggctgccctgctcctgcttcctctgttgttactgttaccattattgttgctgaaactgcacctttggccccaacttcgatggctccctgctgacctcgccttcgctgtgcgggctttgtgctgcaaaagggctttgagggcgagagcacttgctgccgctgcagcagacccggaggggccagagggtggatgttcactggcgtggaggcttgctgagctggcacaacaaagagctgcacacacattcttaatacacggatctaggcggttctcctacagcgaagcggaaagagagtccaaccgcgctgctagggccttcttacgtgcactcggatgggattggggcccagacggaggagactcaggtgagggttccgctggagaaggcgaaagagctgcccctggcgctggtgatgccgcagctggctccggtgccgagtttgctggtggcgatggcgctgcgaggggagggggagccgctgcacctcttagtcctggcgctacagtagccctgcttctgccagccggacctgagttcctgtggctgtggttcggcctggctaaagctgggttacggactgcgttcgtccccactgccctccggaggggcccactcttacactgtcttagaagctgtggggcaagagcacttgtactcgccccagaatttctggaatcgctggagcctgacctaccggcactccgtgctatgggtctgcacctgtgggccgcaggcccagggacccatcctgccggaatcagtgatctgctcgctgaggtatccgccgaggtggatgggcctgtccctggttatcttagtagcccccagtccattacagacacttgtctctacattttcacaagcggtacgacaggacttcctaaggctgcccgaatcagtcacttgaagattctgcagtgtcaaggcttttaccagctctgcggggtgcaccaagaggatgtgatctatctcgcgctgcccctgtaccacatgagcgggtctctcctcggaatcgtcgggtgcatgggtatcggcgcaacagtggttctgaaaagcaagttctccgcaggccagttctgggaggactgccagcagcaccgtgtgaccgtcttccaatacatcggagaactctgcaggtatcttgttaatcagccccctagtaaggctgagagaggccacaaagtgagactggcagtgggatctgggctccggcctgacacatgggagcggttcgtcagaaggtttgggccactgcaagtgctggagacctacggtttgacagaaggcaatgtagccacaatcaattataccgggcagaggggggcagtgggaagggcaagctggctctacaagcatattttcccgttcagcctgatccggtatgatgttaccactggggaaccaattcgggaccctcaggggcactgtatggccaccagcccaggagaacccggtttactcgttgcccctgtgtcacaacagtccccattcctgggatacgcgggtgggcctgaactcgcccagggaaagcttttgaaggatgtcttccgccctggcgacgttttctttaatacaggggatctgttagtttgtgacgatcaggggtttttgagattccatgatcggacaggcgacacctttcgatggaagggcgaaaacgtagcaacaactgaggtcgcggaagtctttgaggcgctggattttctgcaagaggtgaacgtttacggtgtcacagtccccggacatgaaggacgcgctgggatggccgcactcgtcttgagacctcctcatgccctggacctcatgcagctctatacacatgtgagcgaaaacctgcccccatatgctcgccctcgcttcctgaggttacaggagagtttggctacaacagagactttcaagcagcagaaggttcggatggctaacgaaggctttgacccaagcaccttgtccgatcctctctatgtcctggatcaagcagtgggtgcgtaccttccgctgacaaccgcccgatacagcgccctccttgctgggaatctgcgcatctag

SEQ ID NO: 241371 - DNA, 1932 bp, Artificial Sequence
  Description of Artificial Sequence: Synthetic coding sequence
atgctactgggcgctagtctggttggggttctactttttagtaagctcgtgctgaagctgccctggacacaggtcgggttcagcctgctttttctgtacttgggcagtggcggatggagattcatcagagtgtttataaagaccattcgtcgagacatcttcggaggcctcgttttgttaaaagtcaaggcaaaagtgcgtcagtgtctgcaggaaaggcgtaccgttccaatcctgtttgcctccaccgtgcggagacatcctgacaaaaccgctttgatcttcgaggggaccgacacgcactggacttttaggcagttagacgagtacagcagtagcgtcgccaacttccttcaggcacgagggctagcttccggggatgtggccgctatttttatggagaataggaacgagtttgtcgggttatggttgggcatggcaaagctgggagtagaggccgcactgatcaataccaacctgcgcagagacgccctgctgcactgtcttacaaccagcagagccagggctctcgtctttggctccgaaatggcctctgccatatgcgaagtgcatgcatcactggaccccagtctgagcctgttctgttctgggtcttgggagcctggggctgtcccgccttcgacagaacacctggacccactgctgaaggatgcacccaagcatctcccatcatgccccgacaaaggattcacagataagctgttttacatttatacatcaggtaccaccggactacctaaagctgccatagtagtccattcacggtactacaggatggccgcattggtgtactacggatttcgtatgaggccaaatgacatcgtttacgactgcctgcctctgtaccactcagctgggaacatcgttggcattggccagtgtctgctgcacggcatgacagtggttattagaaaaaaattcagcgctagccgcttctgggacgattgtatcaagtataactgtactattgtccagtacatcggggagctgtgccgttacctccttaaccaacccccaagagaggccgaaaaccagcatcaagtccggatggccctcggaaatggcctccggcaatctatctggactaatttcagtagccgcttccatatccctcaggtagccgagttctacggcgctactgaatgcaactgcagcctcggcaacttcgattcacaagtgggagcctgtgggttcaatagccggattctttccttcgtctaccccatcagattggtgagagtgaatgaggataccatggagctcattcgcggacccgacggtgtctgtattccttgtcaaccaggggagcctggacagctggtgggcagaataatccagaaggatcctctcagaaggttcgatgggtacctgaaccagggcgcaaataataagaaaatcgctaaggacgtatttaaaaagggagaccaggcctacctgactggggatgttctggtcatggacgaactaggatatctctattttagggacagaacaggtgacacattcaggtggaagggcgaaaacgtctcaactaccgaagtcgagggtacattatctcgcctgcttgatatggctgatgttgctgtgtacggcgtggaggtacccggaacagaagggagagctggcatggcagcggtggctagtcctacgggaaactgcgatttggagcgcttcgctcaggtcttggagaaagagctgcctctatacgcacgaccgatttttctgcggctgctcccagagcttcataagaccgggacctacaagtttcagaagacagaactgcgcaaggaaggtttcgacccggcaatcgtgaaggaccctctcttttacctggatgcccagaaggggaggtacgtgccgttagatcaggaggcatattcaagaatacaggctggggaagaaaaactgtag

SEQ ID NO: 241372 - DNA, 714 bp, Artificial Sequence
  Description of Artificial Sequence: Synthetic coding sequence
atgcctttgacactaagtaccctcctccagccaggtcgcatctggaccggaaggcgagcagcggagcctactccgggacataacgctgcctggtctctgtcaggcggtggagctgcagttttacaggccggtgccgaaactgcactggacccaggcggaattctccccgtggtgcccctgctgggcatttggcgactggccctccatccaggactgcatcaggatcatcaggcttatctgaccggggacgttttggttatggacgagctgggctatctctacttcagagaccgcaccggggatacattccggtggaaaggtgagaacgtcagtacgactgaagtggagggaacgctctcccggctcctcgacatggccgacgtggccgtctatggggtggaggtgccaggaaccgaggggagggccggaatggctgctgtcgccagtccaaccgggaactgcgatttggagagatttgctcaggttctggaaaaagaactacccctgtatgcccgacctatcttcctgcggctgctgcctgagctccataaaactggcacttacaaatttcagaaaaccgaattgagaaaggaaggctttgacccagcgatcgtgaaagacccactgttctatctggatgcccagaagggcaggtatgtgcctcttgatcaggaggcttactcccggattcaagcaggagaggaaaagctgtag

SEQ ID NO: 241373 - DNA, 2073 bp, Artificial Sequence
  Description of Artificial Sequence: Synthetic coding sequence
atgggcgttcggcaacagctggctttactgctgttgttgctcctactgctctggggattagggcagcccgtgtggcccgtcgcagtggcactcactctccggtggctcctcggggacccaacatgttgtgtgctgcttggtctggctatgctggctcgcccttggctgggaccttgggtccctcacggattatcactggccgcagctgctctggcactgacactgttgcccgcacgcctgcccccaggactgagatggcttccagccgacgtaatcttcctggctaagatcctacatctgggcctaaagatccgaggctgcctctctcgccaaccaccagacaccttcgttgatgcgttcgaacgccgagcccgagcccaaccaggccgtgccctgcttgtttggacgggcccaggtgccggtagcgtcacttttggagagctggatgcgcgagcatgtcaggccgcttgggcgctgaaagcagaactgggagaccctgcaagtctatgcgccggagagcccaccgctttactggttttagctagccaggcggtccctgcactgtgtatgtggctaggactcgctaagttgggctgtcctaccgcttggattaatccccacggacgagggatgcctctggctcactccgtactgtcaagcggtgcgagagtgttagtggtggatcctgatctgcgagaatcattagaggaaattctcccgaaactccaggccgagaatattagatgtttctacctttcccacaccagccctacaccaggcgtgggcgctctgggagctgcactggatgcagcaccatcacatcccgtccctgcagacctccgtgccggtatcacatggcgcagtcctgcgctgtttatctacaccagtgggacgacgggcttgcccaagccagcgattctcacccacgagcgcgtcctccagatgagcaagatgttatctctctcaggcgctacagcagatgacgtggtctatactgtgctgccattgtatcatgtgatgggactggtagtcgggatcctggggtgcttagatttaggagctacctgcgtcctggccccaaaattcagtacgagctgtttctgggacgactgcagacaacatggagttacggtgatcctgtatgtgggcgagcttttaaggtacctatgcaatatccctcagcagccggaggatcgcacccacaccgtgcggctggcgatgggtaatggtctgcgggctgatgtctgggaaaccttccaacaacgctttggcccaatccgcatctgggaggtgtacggctctactgagggtaatatgggtctggtgaactacgtaggtaggtgcggagcattagggaagatgtcctgcctgctcagaatgctcagccctttcgaacttgttcagtttgatatggaggccgcagagccagtgcgagacaaccaggggttttgtatccctgtcgggctgggagaacctggcctgcttctgacaaaggtcgtctctcagcagccttttgttgggtatcgaggacctcgggaattgtccgaacgcaaattggtgagaaatgtgcggcagtcaggcgacgtttactataacaccggagatgtccttgcaatggacagagaagggtttctttactttcgcgaccgcttgggggacacgtttagatggaaaggcgagaatgtgtccacccatgaggtggaaggcgtcctgagccaggtggacttcctgcaacaagtgaacgtgtacggcgtctgcgtgcctgggtgtgagggtaaggtgggcatggccgctgtgcagctcgctcctgggcagacttttgatggagaaaaactttatcagcatgtcagagcatggttgcccgcatatgcaactccacacttcatccgtatccaggacgccatggaagtcacgtccacatttaaactgatgaaaacacgccttgttcgggagggctttaacgtgggcatcgtagtggatccacttttcgtcttagacaatcgggctcagtcattcagaccccttacggccgagatgtatcaagccgtgtgtgaaggaacctggcgattgtag

SEQ ID NO: 241374 - DNA, 1950 bp, Artificial Sequence
  Description of Artificial Sequence: Synthetic coding sequence
atggagaatgatccaagtcgcaggcgagaatccatatcactgacccccgttgctaaggggctcgagaacatgggtgcagattttttggaatctttagaagagggtcagctaccgaggtccgatctgagcccagccgagattaggagcagctggtctgaagctgctccaaaacccttctctcgctggagaaacctgcagcccgctcttagagcacgctccttttgccgcgaacacatgcagctgttccgttggattggtacaggcttgttgtgtaccggcttatctgctttcctcctggtggcttgtcttcttgacttccagagggccctagcactgttcgtgctgacctgtgtggtcctgacctttctggggcacagactcctgaagaggctactgggacccaagcttcgacgcttcttgaagccccagggccacccgcgtctgttactgtggtttaagcgaggtttagcccttgcagctttcctgggtttagttctttggctgtcccttgacacgagtcaacgacccgagcaactggtgagcttcgctggcatctgtgtctttgtcgctctgctgttcgcgtgcagtaagcatcactgtgccgtttcctggagagcagtttcttggggcctgggcctgcagttcgtgttgggccttctggtgattaggactgaaccaggttttatcgctttcgagtggctgggcgagcagatcagaatatttctgtcatatactaaagccggatcctcatttgtgttcggagaagcgctggttaaggatgtgttcgcttttcaggtcttgccaataatagtgttcttctcctgcgtaatttccgttctgtaccatgtggggctgatgcagtgggtaatactgaagatagcttggcttatgcaagtgactatgggcaccaccgccaccgagactctaagcgtcgccggtaacatatttgtgtctcagaccgaagccccactccttataagaccatacctcgccgacatgaccctttctgaagtccacgtggtcatgaccggcggatatgcaacaattgccggttctctgctgggtgcctacatctctttcggtattgatgccacatcactcattgccgcttccgtgatggcggcaccgtgcgcgttagcactgtctaaactggtgtaccccgaggtggaagagagcaaatttcggcgagaggagggtgttaagttgacatacggcgatgctcaaaacctgatcgaagcagcctctactggcgctgccatctcagttaaggttgtcgccaacatcgctgctaatctgattgcttttttggcagtgctcgatttcatcaacgccgcactgtcttggctcggggacatggtcgacatccaggggcttagcttccagctgatttgcagctacatattgcgtcccgttgcatttttgatgggcgtggcatgggaagactgtcccgtggttgccgagctgctgggcattaaactgtttcttaatgagttcgtagcctaccaggatcttagcaaatacaaacagcggagactagccggagcagaagaatgggtgggggacaggaagcagtggatttccgtgcgagccgaagtacttacgaccttcgccctgtgtgggtttgcaaatttcagttccatcgggatcatgcttggcggtcttacctccatggtgccacaacgtaagtcagatttcagccagatagtattgcgtgccttgttcaccggcgcatgtgtgtccctggtaaatgcttgtatggccggaatcctgtacatgcccaggggggcagaggtggattgtatgagcctgctaaacactactctgagctcctccagttttgagatctaccaatgttgtagagaagcattccaatcagttaacccagaattctcgcctgaggccctggataactgttgtagattctacaatcataccatctgtgcacagtag

SEQ ID NO: 241375 - DNA, 528 bp, Artificial Sequence
  Description of Artificial Sequence: Synthetic coding sequence
atggaaaatgacccaagccgcaggcgcgagagcatcagcctgacacccgtagcgaagggtctcgaaaacatgggagctgatttcttggaatctttggaagagggtcagctgcccaggtccgaccttagtccagccgaaatcaggtcatcctggagcgaggccgctcccaaaccattctcgagatggaggaatcttcagccagctctgcgggcacgcagcttttgtcgtgaacacatgcaactttttcgctggattggcactgggctgttgtgcacgggcctgagcgccttcctgttggtggcctgtttactcgattttcaacgggcacttgcgctctttgttctgacctgcgtggtgctaacttttctgggacatcggctgctgaagcgcctgctgggtcctaaactgcgcagattcctgaaaccccagggccacccacggctcctactatggttcaaaagggatccacgaccctggtccaaggaggggccaaatcagtacctccctcaaatcacatggacagtgtag

SEQ ID NO: 241376 - DNA, 1950 bp, Artificial Sequence
  Description of Artificial Sequence: Synthetic coding sequence
atggagaacgaccccagccgtcggagggagagcatcagccttacccccgttgccaaggggctggagaatatgggtgcagactttttagagagtttggaggagggacagctgcctagatccgatctgagcccagccgagatccgcagttcatggtcagaagccgctccaaaacccttctcccggtggagaaacttacagcccgctttaagggcccgatctttctgccgcgagcatatgcagttgtttcgttggatcggaacagggcttctttgcaccggcctgagcgcctttttgctggtggcctgtctgctcgacttccaacgtgccctcgctctgttcgtgctgacctgtgtagtcctgacgtttcttggtcacagattgttgaagcgattactgggccctaagctcagacggtttctcaaaccccaagggcatcctcgcctacttctatggttcaagcggggactagccctcgctgcattcttgggattagtgctctggctgagtctggatacatcacagagaccagagcagctggtctctttcgcagggatatgtgtcttcgtcgccctgttgttcgcctgctctaagcatcactgtgcagtctcatggcgtgccgtgtcctggggactcggcctccagtttgtcctcgggctcctggtcatccggactgaacctggattcatcgcattcgaatggctgggtgaacaaatccgcatatttctgtcctacaccaaagcaggtagtagcttcgtgtttggggaggccctcgtgaaagacgttttcgcttttcaggttctaccaattattgtctttttcagttgtgtaattagcgtgctgtatcacgtgggtctgatgcagtgggtcatattgaaaatcgcctggttaatgcaggtcactatgggtactacagccaccgaaacattgtcagtggccggtaatatcttcgtgagccagaccgaagcacccctgctaattcgtccatatcttgccgatatgaccttatccgaagtgcatgtggttatgacgggcggatacgccacaatagctggctccctgttaggcgcttatatctcctttggcatagacgccacctctttgatcgcagcatctgtcatggcggctccttgcgccctagccctatcaaagctcgtttaccctgaagtcgaggagagtaaattcaggcgagaggagggtgtgaaattgacatacggcgacgctcaaaatcttattgaggcagcttcaactggagcagccatctctgtcaaggtcgttgcgaatattgctgcaaatttaatagcattcctggctgtccttgattttatcaacgcggctctgagctggttgggcgatatggtagacatccaggggcttagcttccagctgatctgttcctacattttgaggccagtggcctttctgatgggggtggcctgggaggactgtccagtggtagctgaactcctgggtatcaagctttttttgaatgagtttgtggcctaccaggacctgagcaagtacaagcagaggcggctggccggagctgaagaatgggtcggcgatcgcaaacaatggatctccgtacgggctgaggtactgactaccttcgcactttgtggattcgccaacttcagctccattggcatcatgcttggaggcctgacgagcatggtcccacaacgaaaaagtgatttcagccagatcgtgctgagggccctgttcacaggagcctgtgttagtcttgtgaacgcctgtatggctggcattctgtatatgcccagaggagcagaggtggactgtatgtctctgctcaataccactttgtcaagctcttccttcgagatttatcaatgctgccgtgaagcattccagagcgtcaatcccgagttctctcccgaggcactcgacaactgttgtagattctataatcatactatctgtgcgcaatag

SEQ ID NO: 241377 - DNA, 1632 bp, Artificial Sequence
  Description of Artificial Sequence: Synthetic coding sequence
atggagaatgacccatcaaggcggagggagtcaatcagtctgaccccggtggctaaaggactggagaatatgggcgctgatttcctggagtccctcgaggagggacagctacctaggtctgacttgagccctgcagagatccgatcgagttggagcgaggcagcccctaaaccgttctcgcggtggcgcaatctccaacccgctttgcgagccagatccttctgtcgagagcacatgcaattatttcgctggattggcacgggactgctctgcactggcctgagcgctttcctcctggttgcctgtctcttagacttccagagagcgttggccttgttcgtcctgacctgcgttgtccttactttcctggggcacagacttctcaagcggctgctggggccaaagcttcgtcgctttctgaaaccccagggacaccctaggttactgctatggtttaaacgcggattagcgctcgcggcatttctgggactcgtcctgtggctgagcttggatacatcccaacgtccagagcagctggtgtcatttgcaggcatctgcgttttcgttgctctgctgtttgcttgcagcaagcaccactgcgcagtctcttggcgagccgtatcctggggcctaggcctgcagttcgtgctggggctactggtaatccggactgaaccaggattcattgctttcgaatggctgggagagcaaataagaatattcctcagttacaccaaagctggatcttcatttgtgtttggggaggccctcgtcaaagacgtgttcgcatttcaagttcttcctatcattgtgttcttcagctgcgtgataagtgtcttataccacgtgggtctcatgcaatgggtgatcctgaagattgcctggctcatgcaggtcaccatggggactaccgcaacagagacgctctcagttgcagggaacatttttgtcagccagactgaggcaccccttctgatcaggccttacttggctgacatgacccttagtgaggttcatgtggtgatgactggagggtacgctaccatagccggttccctgttaggggcatacatctctttcggcattgatgccacctccctgatagcggctagcgtcatggctgctccttgcgcgctcgctctgtccaaactggtctacccagaggttgaagaatccaagttccgcagggaagagggtgtcaagctaacttatggcgatgctcaaaacctgatcgaagctgctagcacgggggctgcgatctccgttaaagtagtagctaatattgcagcaaaccttattgccttcttagcagttttagatttcattaacgctgccttgtcctggctgggggacatggtggatattcaggggctaagctttcaactcatttgcagctatatcctgcggcctgttgcatttctgatgggtgtggcatgggaggactgcccagtggtggccgaattgctgggtatcaagttgttcctgaatgagtttgtcgcctatcaggatctgtctaagtacaaacagaggagacttgctggcgcagaggagtgggtgggcgaccgcaaacagtggatatctaggaggggattagccatgctgactcgcctcgtgctgaactcttggccatag

SEQ ID NO: 241378 - DNA, 1911 bp, Artificial Sequence
  Description of Artificial Sequence: Synthetic coding sequence
atggaaaacgatccatctagacgcagggagagcattagcctcacacccgtggccaaaggcctggagaacatgggcgcagactttctcgagagcctcgaggagggtcagttacccaggagtgacctgagcccagctgagatcaggtctagctggtcggaggccgctccaaagcccttctcaagatggcggaacctccagcctgctttacgcgctcggtccttttgtcgagagcacatgcagttgttccggtggatcgggacggggttgttatgcaccggcctttctgccttcctcctagtagcttgcttactcgattttcagcgcgcactcgcactgttcgtgctcacatgcgtggttctgacatttctggggcatcggcttttgaaaagactcttaggtcccaagttaagacggttccttaagcctcagggccatccaagactgcttctgtggttcaagcggggtctggctttggctgcctttctggggctagtgttgtggttaagcctggatacatctcaaagacctgagcagttggttagcttcgccggaatctgtgtcttcgtggctctgctgttcgcttgttccaagcaccattgtgcagtgagctggcgcgctgtttcctggggtctcggcttgcagttcgtgctgggtctgctcgtgatacgtacagaaccgggttttattgcgttcgagtggttgggcgagcagatcaggatctttctgtcatacaccaaggccggatccagcttcgtgttcggcgaggcactggttaaagatgtattcgctttccaagtcctcccaatcatcgtgttcttttcctgcgtcatctccgtactatatcacgttggcctgatgcaatgggtaattctgaagattgcctggctaatgcaggtgaccatgggcaccactgctaccgaaacattaagcgtcgcgggaaatatcttcgtctctcagaccgaagccccattgttgattcgtccatatctcgctgacatgacactgtcagaagtgcacgttgtcatgacaggcggatatgctaccattgccggatcacttcttggagcctatatttcctttggaatagatgcaacaagccttatcgctgccagtgtgatggctgcaccctgtgccttggccctgtcgaaactggtataccccgaagttgaagagagcaagttcaggcgggaggagggagtgaaactgacctatggtgatgcccagaatctgatagaggccgctagtacgggagccgcaatcagtgtcaaggtcgtggcgaatatcgcagcgaatctgattgccttcttagctgttttggatttcattaacgcagcgctgagttggctcggtgacatggttgatatccagggcttatcgttccagctgatatgcagttacatccttcggccagtcgctttcctcatgggagtggcctgggaagattgtcccgttgtagccgaactgctcggcatcaagctgtttttgaatgaatttgtcgcttatcaggatctctccaagtataagcagcggcgactggctggtgctgaagagtgggtcggggaccggaaacagtggatcagtgttcgcgctgaagttctgacaacttttgctctttgtgggttcgctaatttctcttcgattggcattatgcttggcggactgaccagcatggtgcctcaacgcaaatctgatttttcccaaatcgttttaagggcactgtttaccggcgcttgtgtgagcttggtgaacgcctgcatggctggcattctttatatgccacgaggcgcagaggtggactgtatgtccctcttgaacaccacactgtctagctccagctttgagatctatcaatgctgcagagaggcgttccagcgcatatttaagtctacacccgctgaaagccaaccatag

SEQ ID NO: 241379 - DNA, 864 bp, Artificial Sequence
  Description of Artificial Sequence: Synthetic coding sequence
atgcagctcttcagatggattgggacgggacttctgtgcaccgggctgagcgccttccttctagttgcctgcttgctggactttcagagggccctggctttgtttgtccttacatgtgttgtcctgacattcctgggtcaccggcttctaaaacgtttgctcgggccaaagctccgacgctttcttaaaccacagggacatcctcgactgctgctttggttcaaacgcggactggcgctggccgcattcctgggtttggtgctttggctgagcctagatactagccagcgaccggaacagctggtgtcatttgctggcatctgtgtcttcgttgccctgctgttcgcctgctccaagcatcattgcgctgtctcctggcgggctgtaagttggggtctgggtttgcaattcgtattaggcctgctggtgatccggacggaacccggattcattgcgttcgaatggcttggggaacaaatacggattttcctgagctacaccaaggcgggatcatctttcgtgtttggggaagcgctcgtaaaggacgtgtttgccttccaggtgttacccattatcgttttcttctcctgcgtgatctccgttctataccacgtgggtctgatgcaatgggtgattctcaagattgcctggctgatgcaggttacaatgggtaccaccgcaacggaaacactgtcagtagctggaaacatctttgtgtcacagacggaggctcctcttttgatccgcccatatctggccgatatgacattaagcgaagtgcacgtggtgatgaccgggggatacgctacaatcgctggtagcttactgggtgcctacatctctttcggacttgaaaagctgtag

SEQ ID NO: 241380 - DNA, 1452 bp, Artificial Sequence
  Description of Artificial Sequence: Synthetic coding sequence
atggaaaatgatccatcaagaagaagagagtctatctccctcaccccagttgccaagggcctggaaaatatgggcgcagactttcttgaatccctggaagaagggcagctgcctaggtctgacctcagtccggcagaaattagatcttcttggagcgaggcagctcccaaaccattcagcagatggcgaaatctccaaccagccttgcgagctcggagcttttgccgtgagcacatgcagctgtttagatggataggcacaggtttgctgtgcacggggttgagcgctttcctgctggtggcctgcctactggactttcaacgtgccctggcattgtttgtgctgacctgtgtcgtactgacattcctgggccaccgcctgctaaaaaggctcctgggccctaaactaagaaggttcctcaagccccaaggccaccccaggttgctgttgtggttcaaacggggtctcgccctggctgctttcctgggcttagtgctgtggctttccctggatacaagccaacgccctgagcagctggtctcttttgcagggatttgcgtgtttgtagctctccttttcgcatgttcgaagcaccattgtgccgtgagttggcgagcagtgagttggggacttggactgcagtttgtgcttggcctactagtcattcgaaccgaaccagggttcatcgcgtttgaatggctcggcgaacagatacggatcttcctgagttacaccaaagcaggctcctcttttgtcttcggagaggccctcgtaaaagatgtttttgcatttcaggtgcttcctatcattgttttctttagctgcgtcatatccgtcctttaccacgtgggcctcatgcagtgggtgattctgaaaattgcctggctgatgcaggtgacaatgggaaccaccgcaacagaaaccctgagcgtggctggaaatatctttgttagccagaccgaggctcctttgctgatacgcccatatctcgctgatatgacgctctcagaagtccacgtggtcatgaccggcggatacgccaccatcgcgggttccctgctgggagcttacatctccttcggtgtccgcgcagaagttttgactaccttcgccctgtgcggttttgctaatttttccagcatcggcattatgctcggcggactgacaagtatggtcccacagaggaagagtgactttagccagattgtgctgagggccctgttcacgggggcttgtgtctcactggtgaatgcctgcatggcaggcattctgtacatgcccagaggagccgaggtagattgtatgtccctgctgaacacaactttgtcttcttcttctttcgagatatatcaatgctgccgtgaggctttccagagtgtgaacccggagtttagccccgaagcgctggacaactgctgcagattctacaaccataccatctgtgcacaatag

SEQ ID NO: 241381 - DNA, 1977 bp, Artificial Sequence
  Description of Artificial Sequence: Synthetic coding sequence
atggagaaagcgagcggacggcagtctatcgccctgtctaccgttgagacaggcacagtcaatcccggactagagctaatggagaaggaggtcgaacccgagggatccaagcgaacagatgcacagggacattctttgggcgatgggctgggcccaagtacctatcagagacgcagccgctggccattttctaaagcccgatcattttgcaagactcatgcttccttgtttaagaagattctcctcgggcttctgtgtctggcctatgctgcctaccttcttgctgcttgtatcctgaattttcagagagcacttgccctgtttgttattacatgtcttgtgatattcgttttagtgcatagtttccttaaaaaactgttaggtaaaaaactgacccgctgtctgaaaccgttcgagaatagccgcttacggctctggaccaagtgggttttcgcaggggtctctctcgtaggactgattctctggttagcactggacaccgcccaaagaccagaacaactcatccccttcgctgggatatgtatgtttatccttatattattcgcctgctctaagcatcatagtgccgtctcgtggcggacagtgttctcaggacttggtctgcagtttgttttcggtatcttagttattcggactgacctgggctacactgtctttcaatggctcggagagcaggtacaaatctttttgaattatactgtagccggttcgtctttcgtcttcggagatacgctggtcaaagatgtttttgcttttcaggctctgccaataattatctttttcggatgcgtcgtatctattctttattatctcggcctggtccagtgggtagtgcaaaaggttgcttggttcctccagataaccatgggtacaacggccaccgagaccctagccgtcgcgggaaatatcttcgtcgggatgaccgaggcacctttactgatcaggccctatctcggcgacatgaccctctcagagatacatgctgtcatgaccggaggctttgcaacgataagcggcaccgtattaggagcattcattgcattcggagtggacgccagctctctcatcagcgcttctgtgatggccgcaccctgtgcgctggcctcctcaaagcttgcctacccggaagtggaagagagcaaatttaagagcgaagaaggcgtcaagctacccagggggaaagagagaaatgtgcttgaagcagctagcaatggggctgttgacgcaatcgggctggcaaccaacgtcgctgcaaacctcatagctttcctcgcagtcctcgcctttatcaatgcagccctgagttggcttggcgagctcgtggacatccaggggctgacattccaagttatttgctcgtatctgcttcgccctatggtgtttatgatgggcgtggaatggaccgactgtcccatggtagccgagatggtcgggattaagttcttcatcaatgagttcgtcgcctatcagcagttgagtcagtacaagaataaaaggcttagcggcatggaagagtggatagagggggaaaagcagtggatatcagttagagccgaaataatcacgaccttctccctttgtggcttcgccaacctcagcagcattggaatcacactggggggactcaccagcatcgtgccccaccgtaaaagcgacttgtcaaaggtggtggtgcgcgctcttttcaccggcgcatgcgtctccctgatttcagcttgcatggcaggaatcctgtatgttcctaggggggcagaagctgactgcgtctcattccctaatacatctttcaccaatcgtacctatgaaacatatatgtgttgcagagggctttttcagagcacgtccctgaatgggaccaaccctccctcattttcgggtccatgggaggacaaagaattttcagcgatggccttgaccaattgttgcggtttttacaataatactgtctgtgcctag

SEQ ID NO: 241382 - DNA, 2076 bp, Artificial Sequence
  Description of Artificial Sequence: Synthetic coding sequence
atggagctgcgttctaccgccgcacccagagctgaaggctactctaacgtcggctttcagaacgaggaaaattttttagaaaatgagaatactagcggcaacaattctattcgttccagagcagtgcaaagccgggagcacaccaatacaaagcaggatgaggaacaggtcactgtcgagcaggactcacccagaaacagagagcatatggaagacgacgacgaggagatgcagcagaaaggctgcctggagcggagatacgacaccgtttgtgggttctgccggaagcacaaaactacactgaggcatatcatatggggtatcctactagcagggtatctggtgatggtaatatccgcctgcgtcctgaactttcaccgggctctgcctctttttgtaataaccgtggccgcaatcttctttgtggtttgggatcatctcatggcaaaatacgagcacaggatcgacgaaatgctgtcacctggacggagattgttgaactcacactggttttggctgaaatgggtcatatggtcgtctctagtactcgcagtgatcttttggcttgcttttgatacagcaaaattagggcagcaacagcttgtgagcttcggtggcctgatcatgtatattgtgcttctgttcttgttcagcaaataccccaccagggtatattggaggccggtgctgtggggcattggcctgcaatttctgctcggtctcctcatccttcggacggaccctggttttattgcttttgactggttaggacgacaggttcagacctttcttgagtacactgacgcaggcgcatccttcgtttttggggagaagtacaaggatcacttctttgcatttaaggtccttcccatcgtggtattttttagcacagtaatgtctatgctctactatctggggctcatgcagtggataattagaaaagtggggtggatcatgctcgtgacgaccggtagttccccaattgaaagtgtcgtggcatctggcaacatcttcgttggccagacggaatcgccgctgcttgttcggccatatctgccttacatcacgaagagtgagttgcatgcaataatgaccgccggattctcgacaatcgccggttcggtgctcggtgcttatatatcgttcggggttccatcctctcacctgctaacggctagtgtcatgtccgctcctgcatcattggctgctgctaaactgttttggccagagactgagaagcccaaaatcaccctgaagaacgcgatgaagatggagagcggggactcagggaaccttctggaagctgctacacagggggctagctcctcaataagtctagtggctaacattgccgtcaatcttattgcattcctggcactgttaagctttatgaacagcgctttatcttggtttgggaacatgtttgattaccctcagctgtcttttgaactcatctgtagctacatcttcatgcctttttcgttcatgatgggcgtggaatggcaagactctttcatggtagcacggttgattggatacaagacctttttcaacgaattcgtggcttacgagcatctcagtaaatggattcatctccgcaaagagggaggtcccaaattcgtgaacggagtgcagcaatatatcagcattaggtcagagattattgcaacatacgcactgtgtggattcgctaatatcggctcattggggatcgtaatcgggggtttaacaagtatggcccctagtaggaaaagagacatcgcttcgggagccgtgcgcgcacttatcgcagggacagtggcctgcttcatgaccgcttgcattgcaggaatactttcttcaaccccggtcgacatcaattgccatcacgtcttggaaaatgctttcaacagcactttccctgggaataccacaaaggtgattgcttgttgccagtccctcctgagttccactgtagctaaggggcctggagaagtgattcccggtgggaaccactctctgtatagtttaaaaggttgttgcaccctgcttaacccttctaccttcaactgcaatggcatcagtaacacgttctag

SEQ ID NO: 241383 - DNA, 1869 bp, Artificial Sequence
  Description of Artificial Sequence: Synthetic coding sequence
atggaagatgatgatgaggaaatgcagcaaaagggatgtctggaacgtagatacgacacggtttgtggtttctgccgaaaacataagaccacacttaggcatatcatttggggaatcctcttggcagggtacttggttatggtcattagcgcctgcgtcttaaactttcacagggccttgcccttgttcgttattaccgtcgcagccattttctttgtggtatgggatcacctgatggcaaagtatgagcaccgcatcgatgaaatgttgtctcctggcagaaggctgctgaatagccattggttctggctgaagtgggtcatttggagctctctcgtgcttgcagtgatcttttggctcgcctttgacaccgccaaattgggacaacaacagctggtgagtttcggtggacttattatgtatatcgtccttttgttcctgttcagcaaatacccaaccagagtgtactggcgtcctgtcttgtgggggattgggttacagtttttgctcgggctactaatactcagaaccgaccccggattcatcgcatttgattggcttgggaggcaggtccaaacctttcttgagtacactgacgccggagcgtcttttgtgtttggagaaaagtataaggaccacttttttgcgttcaaggtcctgcctattgttgtgtttttctccactgtgatgtcaatgctgtactatctgggcctcatgcagtggataattcgcaaagtggggtggatcatgctagtgaccactgggagctcccccatcgaaagcgtagttgcatctggcaatattttcgtgggtcagaccgagagccctctattagtgcgcccttacctaccgtacataacgaagtctgagctgcacgcaatcatgaccgctggattcagcactattgccggttctgtcctaggagcttacatcagtttcggtgtaccaagtagtcaccttttaaccgcgtcggtgatgagcgcaccggcttcactggccgcagccaaactgttctggcccgaaactgagaaacccaaaataacactcaaaaacgccatgaaaatggaatctggcgacagtggaaacctcttggaggccgcaacacagggcgcatctagttccattagcctggtggcaaatattgccgtgaatctgatcgcctttctcgcacttttgagttttatgaacagcgcgctatcatggtttgggaatatgttcgattacccacagctgagtttcgagctaatttgcagttacatctttatgccatttagtttcatgatgggcgtggaatggcaggactcttttatggtagctagactcatcggctataagactttcttcaatgagtttgtggcatacgaacatttaagcaagtggattcatttaaggaaggagggtgggccaaaattcgtgaacggtgtccagcaatatattagtatcaggtcggaaatcattgcgacttacgcgttgtgcggttttgcgaatataggcagcctcgggatagtgattggcggtctcacgtctatggcgccatcacgaaaaagggacatcgcgagtggggcagttcgggcattgattgccggaactgtggcctgctttatgaccgcatgtatcgctggaatcctgtcatccacacccgtggatattaattgtcaccatgttctcgaaaacgccttcaattctacattcccgggtaacacgactaaggtaatcgcctgctgccagtcactcctgtccagcacagtggctaagggccctggagaagtcatccctggcggtaaccattccctgtactccctgaagggatgctgtacactgctgaacccttctaccttcaattgtaatggcatcagcaataccttctag

SEQ ID NO: 241384 - DNA, 1608 bp, Artificial Sequence
  Description of Artificial Sequence: Synthetic coding sequence
atgaggcgagaaagaacacggggtccacaggcatgggagttccctagtccaactaagtccgggtgtagcctacagagtctcagtagagatctgcgggaactgagggagggggaaaaacctgaggatcaggcggagactgaggagtcatggcaggggctcgcccgaaaaacaccaggaaaagcctgtgccccagaggggggaagctgccagccaggaaaaaccgagaacaccatcactatgactacgagtcaccagccccaggacaggtataaggcggtgtggctgattttttttatgctgggcctgggcaccctgctgccttggaacttttttatgacagctacgcaatatttcaccaataggctggatatgtcacagaacgtctctttggtgactgcagaactcagtaaagatgcacaggcctcagcggcaccagccgcacccctgccagaacggaacagtctgtcagccattttcaataacgtcatgacactatgtgcaatgctgcccctgttgctgttcacttatcttaattcatttctccatcagaggattcctcagtctgtccggattcttggcagcctggtggcgatcctattagtgtttctgatcacagctatccttgttaaggtgcagctcgatgcccttcccttttttgtgatcacgatgattaaaattgtcctcattaacagctttggtgcaatattacagggctccctctttggacttgccggacttttacctgcaagttacacagcgcctatcatgagcggtcaaggtctggcaggattcttcgcatcggtggccatgatttgcgccattgctagcggatctgaactcagcgagtccgcgttcggctactttataacggcttgcgccgttattatcctgactatcatatgttatctcggcttacccaggttggagttctatcgctattatcaacagctgaagctggaaggcccaggcgagcaggagactaaactcgacttgatcagcaaaggagaggaaccccgagcgggtaaggaggagtccggagtttccgtgagtaattctcagcctaccaatgagagccatagtatcaaagcgattttaaagaatattagcgtgttagcgttttctgtctgtttcatattcaccataaccattggaatgtttcctgcagtcacagtggaggtaaagtcttctattgctgggtcctctacctgggaacgctactttatccccgtgtcttgttttctgacattcaacattttcgactggctggggagatctcttaccgccgtattcatgtggccaggtaaagacagcagatggttaccaagcctggtcctcgctagactggtgttcgttcctttgcttttgctctgtaatatcaagcccaggcgctacctgaccgtggttttcgagcatgatgcctggtttatctttttcatggcagctttcgcattttccaacggctatctcgcgagtctatgcatgtgttttggccctaagaaagtcaagcccgcagaggctgaaacggcgggtgccatcatggccttcttcctatgcctcgggctagccttaggagcagtgttctcgtttcttttccgtgcaattgtgtag

SEQ ID NO: 241385 - DNA, 1371 bp, Artificial Sequence
  Description of Artificial Sequence: Synthetic coding sequence
atgaccacgtctcaccagccccaggacagatataaagctgtgtggcttatcttttttatgcttggcctgggtaccctgttgccttggaatttcttcatgaccgcaacacagtacttcaccaataggctggacatgagccaaaatgtcagcttggtgaccgccgaactgtccaaagacgcacaggcttcagccgctcccgcagccccattgcccgagcgtaactcactgtctgccattttcaacaacgtgatgaccctctgtgccatgctgccccttctgctgttcacttatttaaacagtttcttgcaccaacgtatcccacaatccgttaggatactgggtagcctcgtggcgatcctgctggtgtttcttatcactgccattcttgtgaaagtgcagcttgacgctcttccattctttgtaattaccatgataaagatagtcttgatcaacagcttcggtgctatcctgcaaggatctctgtttgggctggcaggcctgctgcccgcatcatatactgccccaataatgtctggccagggcctcgccggttttttcgcctccgtcgcaatgatctgtgcgattgcctcaggctccgaactgagcgagagcgcctttggttactttatcactgcgtgcgcagtgattatactgaccattatatgctatttaggcctgccacgattagaattctatcggtattaccagcagctaaaactcgaaggcccaggtgaacaggagactaaactggacctgatctccaaaggcgaagagccgagggccggtaaagaggaaagcggagtgtctgttagcaatagccagccaactaacgaatctcatagtataaaggccattctcaagaatatcagcgtcctggcgtttagtgtatgcttcatcttcaccattactataggtatgttccccgcagttaccgtggaagtgaaatcctcaattgccggttccagtacttgggagcggtacttcatcccagtttcatgcttcctgacatttaacatattcgattggctgggccgaagcttgactgcagtgtttatgtggccagggaaagatagccgatggctccccagtctcgtgttagcaaggctcgtgtttgtgccactgctgctgctctgcaatataaagcctcgacgataccttacagtggtgttcgaacatgatgcctggtttatcttttttatggctgcctttgctttttccaacggctatctggcttctttatgcatgtgtttcggcccaaaaaaggtcaagcccgcagaagccgagaccgctggggcaattatggcgttctttctatgtctcggcctggcactcggtgcggtgttctccttcctctttagggccatcgtgtag

SEQ ID NO: 241386 - DNA, 1371 bp, Artificial Sequence
  Description of Artificial Sequence: Synthetic coding sequence
atgacaacaagccaccagcctcaggatcggtataaggctgtgtggcttattttcttcatgcttggacttggaaccctgctgccttggaatttttttatgactgcgacacaatacttcactaatcggctggacatgtcccagaatgtaagtttggtaacagcagagctgtcaaaagacgcgcaggcctcagccgcacccgcagcaccgctccccgagcggaattccctcagcgccatctttaataatgtgatgaccttatgcgctatgctgcctcttttgctgttcacctacctgaatagcttcctgcaccaacgcatcccccagagcgtcagaatcctgggctcattagtcgccattttgttggtcttcctgatcactgccatcctcgtgaaggtacagctggacgcacttccgttctttgtgatcactatgattaagatcgtgcttattaacagtttcggcgcaatcctgcagggaagcttatttggactggcaggactgttgcctgcctcttacaccgctccaattatgtcagggcaaggcttggctggtttcttcgcctccgtggcaatgatttgcgcgatcgccagcggatccgaactatccgaatccgccttcggctacttcatcacggcctgcgctgtaattatcctgacaattatttgttatctcggacttcctaggttagagttctaccgctattatcaacagctaaagcttgagggcccaggagagcaggagaccaagctggatttgatcagtaagggagaggaacctagggctggtaaagaagagtctggtgtgagtgtttccaactctcagcccaccaatgagagtcattcaatcaaggctattttgaaaaatatctcagtgctggccttttcagtctgtttcatcttcactatcactatcgggatgtttcccgcagtcaccgtagaggtcaagagcagcattgctgggagcagtacatgggagcgctactttattcccgtctcatgttttcttaccttcaacatttttgactggcttggtcggtccctgacagctgtattcatgtggccaggaaaggatagtaggtggctgccctctctggtgctggcacggttggtctttgtacctctgttgctgctctgcaatatcaagccccgacgatatcttacagtcgtattcgaacatgacgcttggtttatttttttcatggcagcattcgccttcagcaatggctatctcgcatccctctgtatgtgttttgggcctaagaaggtgaaacctgccgaagccgagactgccggtgcgattatggcattctttttgtgccttggtttggcacttggtgcagtattcagctttctgttccgggcaatagtgtag

SEQ ID NO: 241387 - DNA, 1371 bp, Artificial Sequence
  Description of Artificial Sequence: Synthetic coding sequence
atgacaacctctcatcaacctcaggaccgatataaggcagtctggctgattttcttcatgctggggctcgggactctgctcccttggaacttcttcatgaccgccacccaatactttactaacaggctggatatgtcccagaacgtgtccctggtcacggcagagttaagtaaagatgctcaggcaagcgctgcccctgcagccccactaccagagcgcaacagcctttctgcgattttcaataatgtgatgacactttgcgcgatgctcccgctgctcctgttcacctatctgaactcattcctgcaccagaggatccctcagtcagtaaggatcttgggcagcttagtagcaatcctgctggtatttctcatcaccgctatcttggtcaaggtgcagctggacgccctcccctttttcgtgatcacgatgattaagatagttttaatcaacagcttcggtgcaatacttcagggtagcctcttcggcctggccggtctcctgccagctagctacaccgcacccatcatgtcagggcaaggtctggccggattctttgccagcgtagctatgatctgtgccattgcgtctggatctgaactgtcagagagcgcgttcgggtattttatcacagcttgcgcagtgattattctgacgatcatatgttacttgggactgccacgcctggaattttataggtactatcagcaattaaagctggagggtcccggagaacaggaaactaaactcgatctgattagcaaaggcgaagaaccaagagccggaaaggaggagagcggagtgtctgtatctaattctcaacctaccaacgaaagtcattctatcaaggccatcctcaagaacatttctgtcctcgcctttagcgtgtgttttatcttcaccataactattgggatgtttcccgctgtcaccgttgaggtcaagtcttccatcgccggaagctccacctgggagcgatattttattccggtaagttgctttctcacattcaatatattcgactggttgggccgtagtctgaccgccgtgttcatgtggcccggtaaggacagccggtggctcccttctcttgtactggccagattggtgttcgtgcctctgctgctgctgtgtaatatcaagccacgcagatacctgactgtggtctttgagcacgacgcctggtttatattctttatggccgctttcgctttctcaaacgggtaccttgcatctctctgcatgtgtttcggtcctaagaaagtgaaaccagctgaagctgagacagcgggagctattatggccttctttctatgcctcggactggcactcggggctgtgttcagtttcctttttcgtgccatcgtgtag

SEQ ID NO: 241388 - DNA, 1371 bp, Artificial Sequence
  Description of Artificial Sequence: Synthetic coding sequence
atgacgacatcccaccaaccgcaggaccgctacaaagctgtatggctaatctttttcatgctgggtctggggaccttgcttccatggaatttcttcatgacggcgacccaatacttcacaaatcgtctcgacatgtcacagaacgtttcactcgtcacggctgaacttagtaaagatgcgcaggccagcgccgcacctgctgcacccttgccggagaggaactcattgagtgctatcttcaacaacgtgatgacgctgtgtgccatgttgcccctgctactatttacctatctcaacagtttcctccaccagagaatcccccagtccgtgaggatcttgggaagcctggtggccattttgctcgtgtttctgatcaccgctattctggtgaaagtgcagctggatgcactcccatttttcgtgatcaccatgattaagatcgtgcttattaattctttcggtgcgatcctccaggggtctctgtttggactggctggacttctgccagcctcttacacagcaccaattatgtccggccagggcttagccggttttttcgcctccgtagccatgatctgtgccattgcaagtggctccgaactatcggagtcagcctttggatattttattacggcctgtgccgtcataattctaactatcatctgctaccttggtctccccagactggagttctaccgttattaccagcaactgaagcttgagggccctggtgagcaagagacgaagctggatttgatctccaagggagaagagccccgagccggaaaagaggaatctggggtgtcggtgagcaatagtcagcctacgaacgaaagtcacagtattaaggccatactgaagaacatctctgtcctggcctttagcgtctgtttcatttttaccattacaataggcatgtttcccgctgtgacagtcgaagtgaaaagctcaatcgctgggtcgtccacctgggaacgctatttcatccccgtgagctgtttcctgacctttaacattttcgactggctgggacgatcattaacagccgtcttcatgtggccaggaaaggacagtaggtggctgcccagccttgtgcttgcaagactggtttttgtacccctgctgcttctttgtaatatcaagcctaggaggtatcttacagtcgtttttgagcacgatgcatggttcatctttttcatggccgctttcgccttcagcaatgggtacctcgcctctctgtgcatgtgttttggtcctaaaaaggttaagcccgctgaggctgagacggccggtgctatcatggcgttcttcctgtgtttgggattagcccttggtgccgtctttagctttctgtttagagccatagtttag

SEQ ID NO: 241389 - DNA, 1371 bp, Artificial Sequence
  Description of Artificial Sequence: Synthetic coding sequence
atgaccaccagccaccagcctcaagaccggtacaaagctgtgtggctgatctttttcatgcttggacttggtactctgcttccctggaactttttcatgaccgccacccagtacttcactaataggttagatatgagccagaatgtgagcctggtgacggcggaactgtccaaggacgcacaggcatccgccgcacctgcagcgcctctgcctgagagaaactcactgtccgccatctttaacaacgtgatgaccctctgtgctatgctgcccttactgttgttcacatacctaaactctttcctccaccaacggattccccagagtgtccgcatcctggggtcgttagtggctattctcctggtcttcctgattaccgctatactcgttaaagttcagcttgacgcgctcccatttttcgtcataaccatgatcaagattgtgctgattaattcttttggggctattctccagggtagcttattcggactagccggtctgttgcccgcatcttataccgcacccatcatgtctggacaaggtctcgccggatttttcgctagcgtagccatgatttgtgccatagcatcaggctccgaactcagcgagtcagccttcgggtacttcataactgcctgtgcagtgattatcctgactatcatctgctatctgggcttgcccaggctggagttctatcggtattaccagcagttgaaactcgaagggccaggggagcaggaaaccaaattggaccttatctccaagggtgaagaaccaagggccggaaaggaggaatcgggggtctctgtgtcaaattctcagccaactaatgagtcacattccataaaagcaatactcaaaaatatcagtgtgctcgccttttcagtgtgttttatcttcaccattaccatcggcatgttccccgctgtgactgtcgaggtgaaaagctccatagcaggctcaagtacctgggagcggtattttatccccgtgtcttgtttcttgacatttaacatcttcgactggctcggccgatcacttacagccgtgtttatgtggcccggtaaagacagccgctggctcccatctctcgtccttgctcgccttgtttttgttcccctgttgctgctctgcaatatcaaaccacgtagatatttaacagtggtcttcgaacacgatgcctggttcattttcttcatggcggcatttgctttttcgaacggttatttagcctccctgtgcatgtgtttcggccctaagaaggtaaagcccgcagaggccgagaccgccggagccattatggccttttttctctgtctcggtctggctctgggcgcagtcttcagcttcctctttagagctatagtgtag

SEQ ID NO: 241390 - DNA, 1371 bp, Artificial Sequence
  Description of Artificial Sequence: Synthetic coding sequence
atgacaacttcccaccaacctcaggacagatacaaggcagtttggctgatcttttttatgctcggtctgggtaccctgcttccatggaacttcttcatgaccgccactcagtacttcacaaatcgactcgacatgtcacagaacgttagtttggtgactgcagagctgagtaaagatgctcaggcatcagcagccccagctgccccattgccagaacggaattccctgagcgccattttcaacaacgtaatgacactttgtgcgatgctgcccttactcctgtttacatacctgaattcgttcctgcaccagcgtatcccccagagtgtcagaatattaggatccctcgtggccatactgctcgttttcctgatcactgctattctggtgaaggtgcaactggacgcgctacccttttttgtgatcaccatgataaagatcgtcctgatcaacagcttcggtgccatcctccaaggcagcctgttcggactggccggactgctcccagctagttacactgcacctatcatgagcggacagggtctggctggctttttcgcctctgtggccatgatatgtgctatcgcctcagggtccgagctgtctgagagtgcttttggttattttatcactgcttgtgctgtgattattctgaccattatttgttatcttggcctacctcggctggagttctaccggtattaccagcaactgaaactggaaggtcctggtgagcaggagacgaaactggaccttatcagcaagggtgaagaacccagagcaggcaaggaggagtctggcgtctcagttagcaactcgcaacccacaaacgaaagccattccattaaagccattttaaaaaatatctccgtgctggcattcagtgtgtgttttatctttacaattaccattggcatgtttcctgcagtcactgtcgaggtgaagtcctcaatcgctggctccagtacttgggagcggtattttatacctgtatcgtgctttctgaccttcaacatatttgattggttagggcgatcacttaccgccgtgtttatgtggcctggcaaggacagccgttggctcccgtccctggtgctggccaggctagtgttcgtcccactcctgctgttgtgtaatatcaagcccagaaggtacttaacagtcgtattcgaacatgacgcatggtttatattcttcatggctgccttcgccttcagcaacgggtatcttgcaagcctgtgtatgtgctttggccctaagaaagtaaagcccgctgaagcagagacagctggagccataatggccttctttttatgtttgggcctcgctttgggggcagttttttcttttttatttcgggcaattgtgtag

SEQ ID NO: 241391 - DNA, 1371 bp, Artificial Sequence
  Description of Artificial Sequence: Synthetic coding sequence
atgacgacctcccaccagcctcaggacaggtataaggccgtttggctgatattttttatgcttggactgggaacgctcttaccatggaacttctttatgacagcaactcagtatttcactaataggttggatatgagccagaacgtgtcactggtcaccgctgaactgtctaaggacgcccaggccagcgctgctccagccgcaccactacctgaaagaaactctttgagcgccatctttaataacgtgatgacactttgtgcaatgctccccctgctgctgtttacctacctgaatagcttcctgcaccagcgcataccccaatccgtcagaatcctcggcagtctggtggcaatcctcttagtgtttctgattaccgccatcctggtgaaagtccagttggatgccttacccttcttcgtgattacaatgatcaagattgtgctgatcaattcgttcggcgcaatacttcaaggtagcctattcggcctggccggattactcccggctagttatactgccccaatcatgagtggccaaggtctcgcgggatttttcgcctcagtggccatgatatgtgcaatagcaagcgggagtgagctgtcagagtccgcattcgggtatttcatcactgcatgcgcagtgatcatacttactattatttgttatctgggtcttccacgcttggagttctataggtattatcagcaactgaaactcgaggggccaggtgagcaagagactaagctagacctcatatctaagggtgaggaaccacgagctgggaaggaagagtcaggagtcagtgtctctaatagtcaaccaactaatgagagccacagcattaaggctatcttgaagaacataagcgtgctggccttttcagtctgttttatcttcacaattacgattggcatgttcccagcggttacggtagaagtgaaatcaagcatcgccggaagttccacttgggagaggtactttattccagtctcctgttttctaacattcaacatctttgattggctgggcaggagcctcacagcggttttcatgtggcctggcaaggactccagatggctgccaagcctggtcctggcaagactggtctttgtgcccctcctcctcctgtgcaacatcaagccgcgacggtacctgaccgttgtgttcgagcatgatgcctggtttatatttttcatggctgctttcgccttcagcaatggatatctcgcctccctctgcatgtgcttcggcccaaaaaaggtcaaacccgctgaagctgagacggccggagccataatggcctttttcctttgcttgggcctggccttaggtgctgtcttttccttcctgttcagggcaatcgtctag

SEQ ID NO: 241392 - DNA, 1371 bp, Artificial Sequence
  Description of Artificial Sequence: Synthetic coding sequence
atgaccacgtctcatcagccacaagaccggtataaagctgtgtggctgatcttcttcatgctgggactgggaaccctcctaccctggaattttttcatgactgcgactcagtatttcaccaatcgcctggacatgagccagaacgtgagcttggtgactgcagaactgagcaaggatgcccaggcgtcagccgctccagctgctcctctgccggaacgcaactcactgtcagccatctttaataacgtcatgaccctgtgcgctatgctgcccctgctgctctttacgtatctgaattcttttttgcatcagcgtataccccagagcgtacgaattctcggcagcctggtcgcaatattgctggtctttctgattacagctatcctagttaaggtacagttagatgctctgcccttctttgtgatcacaatgatcaaaatagtgctgatcaactctttcggtgctatacttcaggggtcactgtttggcctcgcgggactgctgcctgctagctacactgccccaattatgtcaggccagggtctggccggtttctttgccagcgtggcaatgatctgtgccatagcttccgggagtgagctgagtgagtccgcgttcggatattttataaccgcgtgcgccgtgatcatcctgactatcatttgttacctgggcctgccaaggcttgaattttataggtactatcagcagctgaagttggagggcccaggcgaacaggaaactaaactcgacttaatatcaaagggggaggagcctcgagccggtaaagaggagtccggcgtttcagtatcaaatagccagcccaccaatgagtcccactccatcaaagccatcctgaagaatataagcgttcttgcattctccgtctgcttcattttcaccatcaccatcgggatgtttcccgctgtcactgtggaagtgaagtcctcaattgcaggatcgagtacctgggaacgttatttcatccccgttagttgtttcctcacctttaacatattcgactggcttggcaggtctcttaccgccgtgtttatgtggcccggaaaggactcacggtggctcccttccctagtcctcgcacggcttgtattcgtgccactgctgctgctctgcaacattaagcccagaagatatctgaccgtagtgtttgaacacgacgcgtggtttatttttttcatggccgcttttgcctttagtaacgggtacctcgcttcactgtgcatgtgtttcggacccaagaaagtaaaacccgctgaggcggagacggccggtgccattatggctttcttcctctgcttggggctggccctgggggctgtgttcagcttcctgttccgtgcaatcgtgtag

SEQ ID NO: 241393 - DNA, 1371 bp, Artificial Sequence
  Description of Artificial Sequence: Synthetic coding sequence
atgactacctcgcaccagccgcaagatagatacaaagcagtctggctgatcttttttatgctaggcctgggaaccctcctcccctggaatttctttatgacagctacgcagtactttaccaatagacttgatatgtcacagaatgtgtccttggtgaccgctgagctttctaaagatgcccaggcctctgcggctcccgctgcacccctgccagagcgcaattccctctccgccattttcaacaacgtcatgacactttgcgctatgctgcctctgctcctgttcacttatttgaatagctttctgcatcagcggatcccccaatccgtccggatcctgggcagcctggttgctattttattggtgtttctaatcactgctatcctggtaaaggtacagcttgatgctctgccatttttcgtgatcacgatgatcaagattgtgctcatcaactcattcggggctatcctgcaggggagtttattcggtttagcgggactgttgcccgcatcctacacagccccaattatgtctgggcaggggttggccggattttttgcgtccgtggctatgatttgcgcaattgcctcagggagcgagctatcagagtcagcgtttggctacttcatcaccgcctgtgccgttatcattttgactattatctgctacttgggcctccccagactggaattttacaggtattatcagcagcttaagttagagggtccgggagaacaggagactaagctggatctgatttctaaaggagaggaaccaagggccggtaaagaggagtcaggggtcagtgtgtcaaattcacaacccacaaatgagtcacactctatcaaagcgatacttaagaacatcagtgtgctcgcgttctcagtttgttttatctttactatcacaatcggaatgtttcctgctgtcactgtggaggtgaaaagctctatcgccggttccagtacatgggaaagatactttatccctgtttcttgctttctaaccttcaatatttttgattggctggggagatccctgactgctgtctttatgtggcccggaaaggactcaagatggttacctagtctcgtcctagcgaggttagtctttgtgccactcttgctactatgcaatatcaaaccacggaggtatttgaccgtcgtcttcgagcacgatgcatggttcatctttttcatggctgcctttgcgttctctaatggctacctggcgagtctgtgcatgtgcttcggaccaaagaaagtcaaaccagcagaagcggagaccgctggcgctatcatggcattctttctgtgcttggggctcgctctgggcgcagttttctctttccttttcagagctattgtgtag

SEQ ID NO: 241394 - DNA, 510 bp, Artificial Sequence
  Description of Artificial Sequence: Synthetic coding sequence
atgagaagagaaaggacccgtggccctcaggcctgggaattcccaagtcctactaagagcggttgctcactgcagagcctcagccgatacaaggcggtgtggctgatcttttttatgctgggactcggcacgctcctcccctggaatttttttatgactgccacacagtatttcaccaaccggctggacatgtcccagaatgtttctttagtcaccgcagagcttagcaaggatgcgcaggcctctgcggctcccgctgcacccctgcccgaacgcaatagcctctctgctatattcaacaatgtgatgactctctgcgccatgctgcccctgctattgtttacttacttgaactctttcctacaccaaaggatcccccagagtgtgcggatactcggctccctagtggctattctcctggtgtttcttattactgcaatcctggtcaaagtacagctggacgctcttccttttttcgtgattactatgattaagattgtgctgatatag

SEQ ID NO: 241395 - DNA, 1371 bp, Artificial Sequence
  Description of Artificial Sequence: Synthetic coding sequence
atggccagaggcgatgccccacgggatagctaccatctggtcggtattagtttctttatcttaggccttggtactctgctgccatggaatttcttcatcacggccataccttacttccaggctagacttgctggagcaggcaactctactgccaggatcctgtccacgaaccataccggacctgaagatgcatttaatttcaataattgggtgaccttactgagccaattgcctctgctgctgtttacactgcttaacagttttctttatcagtgcgttcctgaaacagttcgtatccttgggtcactactggctattctccttctctttgccttgaccgcagcccttgtgaaggtggacatgagccctggacccttcttctctattactatggcatccgtctgctttatcaattctttttctgcagtgctccaggggagcctctttgggcaacttggtacgatgccgtctacctactccacgctcttcctgtctggacagggcctggccggaatctttgccgctttggcgatgctgctgagtatggccagcggggttgatgccgaaacttctgccctggggtattttatcactccatgcgtcggcatcttgatgagcattgtctgctacctgagccttccccaccttaagtttgccagatattacttagccaacaaaagctcacaggcacaggcccaggagcttgaaaccaaagcggagctcctccagagcgacgagaacggaatccccagttctccccaaaaggtggctctgaccctagatctggacctcgagaaggagccagagagtgagccagatgagccgcaaaagcccggaaagcccagtgtgttcactgtcttccagaaaatatggctgaccgccttgtgcctggttttggtcttcaccgtcaccttatccgtgttcccagcaattactgccatggtgacaagctcaacgagtcctggtaaatggtctcagttcttcaatcctatttgttgtttcctcctcttcaacatcatggactggctgggcaggagcctaacgagctattttctgtggcctgacgaggatagtcggctcctgcccctcctggtatgtctgcgtttccttttcgtcccgcttttcatgctatgtcacgttccacagcggtcacgcttgccaatcctgtttccccaggatgcttacttcatcactttcatgctcctttttgctgtatctaacggctacctcgtcagcctgactatgtgcctagcacccaggcaggtgctgccacatgaaagagaggtggctggtgccctcatgacgttcttcctcgctctggggctatcgtgcggagccagtctctcgtttctctttaaagcattgctgtag

SEQ ID NO: 241396 - DNA, 1371 bp, Artificial Sequence
  Description of Artificial Sequence: Synthetic coding sequence
atggccagaggcgacgctccacgggattcctaccacctggtgggcatctctttctttatcctcgggctcggcaccctccttccttggaattttttcataacagccatcccgtattttcaggctaggttagctggagcaggaaattctaccgccagaatcctctctaccaaccacactggccctgaagatgcttttaatttcaataactgggtgactctactatcacagctgccccttctgctgttcaccctgctgaatagttttctgtaccaatgcgtccctgaaactgtacggattcttggatcactcctggctattcttctgcttttcgcactgacagccgcattagttaaagttgacatgtcacctgggccttttttttctattacaatggcatccgtgtgtttcattaattccttcagcgcagtgttgcaaggctcactcttcgggcagctaggcacgatgccttcgacctattctaccctgtttctcagtggtcaggggctcgcaggtatcttcgccgctctggccatgctgctcagtatggcctccggagtggatgccgagacaagtgccctggggtacttcatcactccatgcgtgggtatccttatgtcaattgtgtgctacctcagcctcccccacctgaagtttgccaggtattacttagccaataagtcctcccaagcacaggctcaggagcttgaaaccaaggccgaactgttgcagtcagacgagaatgggattcccagctcaccgcagaaagtggcactgacactcgacttggacctggaaaaagagcccgagagtgagccagacgagcctcagaagcctggcaagccatcagtcttcacagtgtttcagaaaatctggctaacagccctgtgcttagtcctggtgttcaccgtaacactgtccgtgtttccagccatcaccgcaatggtgaccagcagcaccagcccgggaaaatggagccaattcttcaacccaatttgctgttttctgctgtttaacataatggattggctcgggcgtagcctgacttcatacttcctatggcctgatgaggacagcagacttctgccgctgcttgtatgcttgcgtttcttgtttgtgcctctgttcatgctctgccacgtgcctcagcgctctcggctacctattctctttccccaggatgcctacttcatcaccttcatgcttctcttcgctgtttcaaatgggtaccttgtctcactgacaatgtgcttggcaccacgacaggtgctgcctcatgagagagaggtcgccggagcgctaatgacattctttttagccctgggcctgagttgtggtgccagcttgtcatttctgttcaaagcattgctctag

SEQ ID NO: 241397 - DNA, 1371 bp, Artificial Sequence
  Description of Artificial Sequence: Synthetic coding sequence
atggcccgtggagacgctccccgtgattcttaccacctggtagggatctccttctttatcctggggctcggtacccttctgccctggaatttctttataaccgcgattccttacttccaagcccgacttgccggagccggtaactctacagcgcgtatcttatcaacaaatcacaccggacctgaagacgcttttaacttcaataattgggttacacttctgtcccagctgccattgctcctgttcactctgctgaattccttcctgtatcaatgtgtaccagagacagtgagaattctaggctctctcttagccatcctcctgttatttgcacttactgccgctctggttaaagtggatatgtcacccggaccattctttagtatcacgatggccagcgtatgcttcataaattccttcagcgcggtcctacagggttcactgtttggccagctgggcaccatgcccagtacatattccactttattcctgagcggccagggcctcgctggtatattcgccgcattagctatgctcctgtctatggcatcgggagttgatgcagagacatctgccctgggttacttcatcacgccatgtgtcgggatactcatgtcaatagtgtgttatctgagtctccctcatcttaagtttgccagatactatctggcaaacaaatctagtcaagcacaagcacaggaactggagacgaaagccgagctcctgcaaagcgatgaaaacggaataccctcttcccctcagaaggtggctctcacactggatctggatctggagaaggagcccgagtcagagccagatgaaccccaaaagcccggtaaaccatccgtgttcactgtgtttcagaaaatttggttaactgctctgtgtctcgtcctggtttttacggtaactctgagcgtcttcccagccattactgctatggtcactagtagcacatcccccggtaaatggtcacagttcttcaatcccatttgctgtttcctcctgttcaacatcatggactggcttgggagatctctgacaagctacttcctctggcccgatgaagactccagattgctgcccctgctggtgtgtctgcggtttctgtttgtaccactgtttatgctatgtcacgttcctcagcgatcgcgcctgcccatactgtttccccaggacgcttactttatcacctttatgctgctgttcgccgtgagtaatgggtacctcgtgtccctgaccatgtgcctagctcctagacaggtccttcctcatgagcgggaggtggccggagctcttatgactttttttttggccctggggctgtcctgcggcgctagcttgtcattcctgttcaaagccttgctctag

SEQ ID NO: 241398 - DNA, 1428 bp, Artificial Sequence
  Description of Artificial Sequence: Synthetic coding sequence
atggctgtggtaagcgaagatgacttccagcattcgtccaattctacttatcgaaccacgtcaagctcccttcgcgctgatcaggaggcactgcttgagaagctcctggacagaccaccccctggcctgcagcgacctgaagaccggttttgtgggacctatatcattttcttctcgctcggcatcgggtccctgctgccatggaatttctttatcactgccaaagaatactggatgtttaaacttcgcaactccagttcacccgcaacaggagaggaccccgagggcagcgacattctgaattactttgaatcgtatctggcagtggctagcactgtcccatctatgctttgcctagttgccaacttcctgttagtgaatcgagtcgctgtacatatacgggttctggcctctctgactgtgatactggctattttcatggtaattactgccttagtaaaagttgatacgtcttcatggacacgtggcttttttgcggtgactatcgtgtgtatggttattctgtccggtgcaagcacagtgttctcttctagcatatacgggatgacagggtcgtttcccatgcgcaactcccaggcccttatttccggcggagctatgggaggtacagtttccgcggtggccagccttgtggaccttgctgcgagctctgacgtccgcaattctgccttggccttcttcttaacggctaccgtgttcttagttctatgcatgggcctgtatctcttgttaagcagactagagtatgcccgatattatatgagacccgtgctcgcggctcatgtgttcagcggggaggaggagttgccccaggatagcctctctgctcccagcgtagcaagtcgctttatcgacagtcatacaccaccactaaggcccattctgaagaagactgcttcgttgggcttctgtgtaacctacgtgttcttcattactagtctcatttatccagccatttgtaccaatatagagtcgctgaataagggctccggaagcctgtggacgacaaagttcttcatccccctgaccacctttctcctgtataattttgcagacctttgtggccgtcagctgacagcatggatacaagtgccaggccctaacagcaaggcattacctggcttcgttctactgagaacttgcttaatacccctgtttgtgctatgcaactatcaacccagagttcatcttaagactgtggtgttccaatccgacgtgtatcctgcccttttgagctctctccttggattatccaatggatatctgagcaccctggcgctcctgtatggccctaaaatcgtcccccgtgagctcgccgaagcaactggagtggttatgtctttctatgtctgtctgggactgactctcggctccgcttgtagcacgctgttagttcatctgatatag

SEQ ID NO: 241399 - DNA, 1590 bp, Artificial Sequence
  Description of Artificial Sequence: Synthetic coding sequence
atgagccaagatacagaagtggacatgaaagaggtcgagctgaatgagctggaacctgagaagcagcctatgaacgcagccagcggggctgcaatgtccctggccggtgctgaaaaaaatggcttggtcaaaatcaaggtggctgaggacgaggcagaagccgctgcggctgctaaattcaccgggctgtcaaaggaagagctgctgaaggtagctggtagccccggatgggtgaggacgcggtgggctctgctccttctgttctggcttggatggctaggcatgcttgccggtgcagtagttatcatcgtgagagcccctcgctgtagagagcttccggcacagaagtggtggcacactggcgcactctatcgcatcggggatcttcaggcatttcaaggccacggcgcaggcaatcttgctggcctgaaggggaggctggactaccttagttcccttaaggtgaaaggtctcgtgctgggccctatccacaagaatcagaaagatgatgtggcacagaccgacttgctgcaaatcgatcctaactttggttcaaaggaggactttgatagcctcttgcagtctgcaaagaagaagagtatccgtgtgatcctcgacctgacccccaactatagaggagagaatagctggttctcgacccaggtagatactgttgccacaaaggttaaagacgctctggaattttggctccaagccggagttgacggttttcaggtgagggacattgagaatctgaaagacgcttcatcctttctcgctgaatggcagaacatcaccaaaggatttagcgaagatcggttgctcatcgctgggacaaacagcagcgacctgcagcagatcttgtcactgctggagtccaacaaggacctcttgcttacttccagctatcttagcgactccgggtccaccggcgagcacaccaaatctctggtgacacagtatttgaacgcaactggcaatcggtggtgctcatggtccctgagccaggcacggttattaacaagtttccttcctgctcagcttctgaggctgtatcaattaatgctgttcacactcccaggaacacccgtgttttcttatggcgatgagatagggcttgacgccgctgccttgcccggtcagcctatggaagcacctgtgatgctctgggacgagtcatcctttcccgacattcccggagccgttagtgctaatatgacagtgaaagggcagtcagaggatcctggaagtctgctgagcctgttccgaagactctcagatcagagatccaaggagcgctctctcctccacggcgacttccacgcttttagcgccggtcctggcttgttttcatatatcagacattgggatcagaatgagaggtttctggttgtgttaaacttcggggacgtgggactctccgcaggtctgcaggcgtccgacttgccagcctccgcgtcgctgccggcaaaggcagatcttttattaagcacacagccgggaagggaggaaggcagccctctggaactggaacgactcaaattggagccccacgaggggctgctgctccgattcccatacgcagcatag

SEQ ID NO: 241400 - DNA, 1707 bp, Artificial Sequence
  Description of Artificial Sequence: Synthetic coding sequence
atggagctacagcccccagaagcgtccatagccgtagtaagcattcccaggcagcttcccggatcacactctgaggccggagtccaagggctgtcagcgggtgacgattcagggacaatgtctcaggatactgaggtcgatatgaaggaggtagagctgaacgagctggagccagaaaaacagcccatgaatgccgcaagcggggcagccatgtccctggcgggtgcggaaaagaatgggcttgtgaagattaaagtcgccgaagatgaggccgaggctgccgcagccgcaaagtttactggacttagtaaagaagagctgctcaaggtggccggatcacctggatgggtcaggacgcggtgggctctgctgctgctgttctggcttggttggctcggaatgcttgcaggcgctgtcgtgataatcgtacgagctccccgatgccgggagttgcctgcccagaagtggtggcacaccggggcactttaccgaatcggagacctgcaggcttttcaggggcatggcgctggaaacctcgcagggctgaagggaaggcttgattacctctcctctctgaaggtaaagggcctcgtgctgggcccaatccataagaaccagaaggacgatgttgcacaaactgaccttttacagattgaccctaacttcggctctaaagaagatttcgacagcctccttcaatcagccaagaaaaaatccattcgcgtaatattggatctgacccccaactaccgaggtgagaattcttggtttagtacgcaggtcgacacggtcgcgaccaaagttaaggacgcgctggagttctggttgcaagctggcgttgacggctttcaggtgcgcgatatcgaaaatcttaaggatgccagcagtttccttgctgagtggcagaacataaccaaaggtttcagtgaggacagacttctgattgctggaaccaatagctccgacctacagcagattctatcgctcctggaatccaacaaagaccttctcctcacctcgagttatctgtctgattctgggtcgacgggggagcatacaaagagcctcgtaacacagtatctgaatgctacaggcaacaggtggtgttcttggagtctgagccaggccaggctgctcacttctttccttccggctcagctgttgagactgtatcagctcatgctatttactctgcccggtacccccgtgttttcctatggggatgagatagggttggatgcagcggctttgcctggacaaccgatggaagcacccgtcatgctgtgggacgaatctagcttcccagacatccccggagctgtgtcagctaatatgactgtaaaaggacaatccgaagacccaggttctttactgtcccttttccgtcgcctatctgaccagcgctcaaaagagaggagcctgctgcacggcgattttcacgccttctctgcaggtccaggactgttctcatacatcagacactgggaccagaatgaacgctttctggtcgtgctgaacttcggggatgtgggtttgtcagctggcctccaggctagcgatctgccagccagcgcctcccttccggcaaaagctgacctcctcctgagcactcagccaggcagagaggaaggctcacccctggaactggagcggctcaaattagaacctcacgaggggctcctgctacgttttccatatgccgcttag

SEQ ID NO: 241401 - DNA, 1893 bp, Artificial Sequence
  Description of Artificial Sequence: Synthetic coding sequence
atggaattgcagccccctgaagctagtattgccgtggtgtcaattcctcgccagctgcctggaagtcactcagaggccggtgttcagggactgtccgctggcgacgatagtgagctgggaagccattgtgttgcccaaactggactggagttgcttgccagcggcgacccacttccatcagctagtcagaatgccgagatgatagaaacagggtcggattgcgtcacacaggccggactccagttgttggcgtcttcggaccctcccgctctggcttctaagaatgctgaagtgacaggaaccatgagtcaggacacggaagtggatatgaaagaagtggagttgaatgaattggaacctgaaaagcaaccaatgaatgcagcctctggcgctgctatgtccctggccggagcagaaaagaacggactagttaaaatcaaggtggcagaagatgaggctgaagccgctgccgcagcaaagtttaccggcttgagtaaagaggagctgctgaaagtggctggctcacccggatgggttcgaacgagatgggcccttctccttttgttttggctggggtggttaggtatgctcgccggagcagtggtgatcatagtgagagcgcctcgatgtagggaactcccggctcagaaatggtggcatactggggcactgtacagaatcggcgacttgcaggcttttcagggtcacggagccggtaacttggcgggacttaagggacgtctcgactatcttagctctctgaaagtgaaaggtttagtcctcggccctatccataagaaccagaaggacgatgtggctcagacggacctacttcagatagaccctaacttcggcagcaaggaggactttgatagcctgctgcaaagcgctaaaaagaagtctatcagggtgattttggatctgacgcccaactaccggggtgaaaactcgtggttttctacacaggtagacactgtcgccacgaaagtgaaggatgccctcgaattttggctgcaggcaggagtggatgggtttcaggtcagggacattgagaatcttaaggatgctagctcatttctcgcagaatggcaaaatataactaaaggattcagcgaggacaggctgcttatagcgggaactaattcctctgacttgcagcagatactgtcgctcctagaatccaacaaggacttactcctaacttcaagctacctgtcagactccgggagcaccggcgagcatacaaaatcactagtcacacaatacctgaacgccaccggaaatcgctggtgttcctggagcctcagtcaagctcggctgctgacatctttcctgcctgctcagctactgaggctatatcagttgatgctgttcactctgccagggactcccgttttctcgtatggagacgagataggccttgatgctgctgctctcccagggcagccgatggaggctccggtgatgttatgggacgagtcatcattcccggatattcccggtgccgtaagtgcaaatatgaccgtaaaaggtcagtcggaggaccccggtagcctgcttagtctgttccgcaggttgagcgatcagaggtctaaggaacggagtttgttgcatggcgatttccatgccttctcagcaggccctggcctgtttagttatatccgccactgggaccagaacgagcgatttctggtagtgctcaacttcggcgatgtaggcctgagcgcaggcctgcaggcgtctgacctccctgcctctgcttcattacccgctaaggcggacttgctgctgtcaacgcaacccggacgagaagaggggagtccactcgagctcgagcgcttaaagctcgagccccacgaggggttgctgctccgttttccatacgccgcttag

SEQ ID NO: 241402 - DNA, 1896 bp, Artificial Sequence
  Description of Artificial Sequence: Synthetic coding sequence
atggagctgcagcctccggaggcatccattgctgtcgtatccatcccaagacaactgcctgggtctcactcagaggctggcgtgcagggtctttcagctggggacgatagtgaaacaggatccgactgtgtgacacaggccggactgcagctgctagcatcgtccgatcctccggcactagcctccaagaacgccgaagttaccgtggaaacaggctttcatcacgtctcacaggctgacatcgaatttttaacaagcattgaccccactgccagcgccagtggaagcgccggaatcacagggacgatgagtcaagataccgaagtggacatgaaagaggtggaacttaatgagctcgagccagagaaacagcccatgaatgctgcatctggcgcagctatgtccctcgctggtgctgagaagaatgggctcgtgaaaattaaggtcgctgaggatgaggccgaagcggctgccgcagccaagttcacaggtctaagtaaagaggagttgctcaaggttgccggatctccaggctgggtcagaacccgctgggcactgcttcttctgttctggctggggtggctcggaatgttagccggagccgtggtcattatcgtgagggccccacggtgtcgagaactcccggctcaaaaatggtggcacaccggggctctttatcgcattggtgatttacaggcatttcaggggcacggcgcagggaacctggctggcctcaagggacgactggactacctctcctcgttgaaagtgaagggccttgtactgggcccaattcataagaatcaaaaagacgacgtggctcaaaccgatcttctccagattgatcctaattttggttcaaaggaggacttcgattctctactgcagtccgcgaagaagaagagcattagggtcatcctggatctcaccccaaattataggggcgagaattcctggttttctacgcaggttgacactgttgcaacgaaggtgaaggatgccctggagttctggctgcaggcaggagtcgatgggtttcaagtccgggatatcgagaatctgaaagacgcatccagcttcctggccgaatggcagaacatcaccaaggggttttctgaagacaggttgctaattgctggtacaaacagtagtgatttacagcagatcttgtccctgttagaatccaataaggacctgctgctcactagctcatacctcagtgattccggcagtacaggcgagcacacgaaaagtctggtgacacaatacctgaacgccacaggcaatagatggtgctcatggtcgctgtcacaggcacggttgctgacatcctttctcccggctcagttgctgcgactgtatcagttgatgctgtttactctccccggtacacctgtgtttagctacggcgatgagatcggtctggacgcagctgcactccctggccagcctatggaagcccctgtcatgctttgggatgaaagcagctttccagacatcccgggagcagtgtctgccaacatgacagttaaagggcagtccgaggatccaggctcattgctctctctgtttcgccgactgagtgaccaacggagtaaagaacgttctctgctgcacggtgactttcacgcattctcagcgggtccagggctgttttcatacatccgacactgggatcagaatgagcgctttttggtcgtgcttaatttcggcgacgtgggcttgtccgctgggcttcaagcttccgatctccccgcaagtgcctccttgcccgctaaggcagacttattgctttcaacgcagccaggacgcgaggaagggtctcccttggaactggagcgcctgaagctggagccacatgaaggcctgttgctgcggttcccctacgccgcatag

SEQ ID NO: 241403 - DNA, 1986 bp, Artificial Sequence
  Description of Artificial Sequence: Synthetic coding sequence
atggaactgcagcctcctgaggcatccattgccgtcgtgagcattccacgccagctgcccggaagtcacagcgaagccggagtgcagggcctctctgccggagacgactcagaactgggtagccattgtgtggcccagaccgggctggagctcttggcaagcggagatccactccctagtgctagccagaatgccgaaatgatcgagactggatcggattgcgtgacacaggctggactgcaactgcttgcttccagcgatcctcctgctctggcatcaaaaaatgctgaagtcacagagaccgggttccatcatgtttcccaggcagacatcgaatttcttaccagcatagatcctaccgcttctgcctctgggtccgcgggtataaccggaacaatgtcacaagacaccgaagttgacatgaaagaagtggaactcaacgaactagagccggagaagcagccgatgaatgcagcctctggagccgcaatgtcccttgccggagcagagaagaatggacttgtgaaaataaaagttgcggaagacgaagccgaggccgcagctgctgccaaatttaccgggctgtccaaagaggaactgcttaaagtggccggatccccgggatgggtaagaactaggtgggcacttctgttgcttttttggctgggctggttggggatgttagcaggtgccgtggtcataatcgtgcgtgctccacggtgtagggagctgcccgctcagaaatggtggcatacgggagccctctataggatcggagaccttcaggcattccaggggcatggtgccggaaacttagctggcctgaaaggcaggctcgattacctgagttctctcaaggttaagggattagtgctcggccctattcacaagaatcaaaaggatgatgtggcgcagactgacctattgcaaatcgatcccaatttcggcagtaaggaagactttgacagcctgctacaatctgccaagaaaaagtctattagggtgatcctagatctgactccaaattaccgcggtgaaaatagttggttttctacccaggtcgataccgtagctacaaaggttaaagacgccctggaattctggttgcaagccggtgtggacgggttccaagtgcgtgatatagagaacctgaaggacgccagctccttcctagctgaatggcagaatatcaccaaagggtttagcgaggatcgtctgctgatagcaggcactaattcctccgacctacaacagattctttccctcttagaaagcaacaaggatctgctgctgactagtagttatctgtccgattcaggatctacaggggaacataccaaaagtctcgttacgcagtatctcaatgccactggtaatagatggtgcagctggagcctctctcaggccagacttctgacttcattcctgccggctcagctgctccggctgtatcaactcatgctgttcactctcccaggcacacccgtgttctcttacggggatgagataggcctggacgctgctgcactgcccggacaaccaatggaggctcccgtgatgctctgggacgagtccagtttccctgatatacccggagcagtgtcagctaatatgacagtcaaaggacagtcagaagatcctggatcactactgagcttgtttaggagactgtccgatcagaggtccaaggaacgctcactgcttcacggtgattttcatgctttttctgcagggcctggcctattcagctatatcaggcattgggatcagaatgagagatttctcgtggtgctcaactttggcgatgtgggcctttctgcaggactgcaggccagcgatctccctgcgtccgcatctctgcctgccaaggcagatctgctgctgagcacccagcccggacgggaagaagggtccccacttgagctggagaggttaaagctggagccacacgagggactcctcctgagattcccttacgccgcttag

SEQ ID NO: 241404 - DNA, 1536 bp, Artificial Sequence
  Description of Artificial Sequence: Synthetic coding sequence
atgtctcaggatactgaggtggatatgaaagaggtagagctgaacgagctcgaacccgaaaaacaaccaatgaatgccgcaagtggcgctgcaatgtctctcgccggagccgaaaaaaacgggctagtgaaaattaaagtggccgaggatgaggccgaggccgcagccgctgcaaaattcaccggcctgtccaaagaggaacttctgttctggctgggatggctcggtatgctagccggagccgtcgtgatcatcgtgcgcgcaccccgttgccgtgagctgcccgctcagaagtggtggcacaccggcgctctgtataggattggcgatcttcaggctttccagggccacggggctgggaatcttgctggtcttaaagggcgtttagactacctgagtagtctgaaggttaaaggcttagtactggggccaattcacaaaaatcagaaagatgatgtggcccagacagacttgcttcagattgaccctaacttcggcagcaaggaggattttgatagcctcctgcagagcgcaaaaaagaagtcaattagagtgattcttgatctaaccccaaactatcggggagaaaattcctggttttcaacccaggtcgatacggtggctacaaaagtgaaggatgcacttgaattctggctgcaggcaggcgtggatggtttccaggtgagagacatagaaaatttgaaagatgccagtagcttcctggccgaatggcagaatattacaaagggattttctgaagataggctgcttatcgccggaacaaattcatctgatctccagcaaatcctgtcgctgctggagagtaataaagacttgttacttacatcctcatacctgtccgactctggcagcaccggcgagcacacgaagtccctggtgacccagtacctcaatgctacaggaaaccggtggtgttcctggtccctttctcaggctaggctgctcacgtcattcctcccagcccagctgctgaggctgtatcagcttatgttgttcacacttcccggtactcctgttttttcttatggtgatgagatcggcttagatgcggcagcccttcctggacaaccaatggaggcccctgttatgctgtgggacgaatccagttttcctgacataccaggggctgtatccgcaaatatgacagtgaaaggtcagtccgaagacccaggctcactccttagcctattccgacggctgtcggaccaaaggagcaaggaaagatcccttttgcacggggacttccacgcttttagcgcgggacccggactctttagctatatacggcactgggaccagaatgaacgcttccttgtggtgctcaacttcggagatgtgggcctctctgcaggcctgcaggccagtgatctaccagcaagcgcctcattgcctgccaaggctgatctgctgctctcgacccagcctgggagggaggagggttcacccctcgagcttgagcgactgaaactggaaccccacgaggggctgctgctgagattcccctatgccgcttag

SEQ ID NO: 241405 - DNA, 408 bp, Artificial Sequence
  Description of Artificial Sequence: Synthetic coding sequence
atgtctcaagacaccgaggtggacatgaaagaagtcgagctgaatgagctcgaaccagaaaaacagcctatgaacgccgcaagcggagctgccatgtcgctggcaggcgcagaaaagaacggcctcgtaaagataaaagtagccgaggatgaggctgaggctgcggcagctgcaaaatttactgggctgtcgaaggaggagcttcttaaggtggctggcagtccaggctgggttcgaacgcgatgggctcttttgcttttgttttggttggggtggctggggatgctagccggtgcagttgtcattatcgtgcgggcacctagatgtcgggagctgccagcccaaaaatggtggcacactggagccctgtacaggattggcgatctgcaagcctttcagggacactag

SEQ ID NO: 241406 - DNA, 2058 bp, Artificial Sequence
  Description of Artificial Sequence: Synthetic coding sequence
atggcggaagataaatcaaagagggattccatagagatgagcatgaagggatgccaaaccaataacgggttcgttcataacgaggatattctagagcagacccccgatccaggatccagcactgataacctcaagcatagcacaaggggcatactgggcagtcaggaacctgatttcaaaggcgtgcaaccttatgcaggaatgcccaaggaagtcctatttcagtttagcgggcaggcccgataccggatccctcgtgagatcctgttctggcttactgtggccagcgtcctcgttctgatcgctgccacgattgctatcattgcgctgagcccaaaatgtctggattggtggcaggaaggacccatgtaccaaatttatccaagaagcttcaaggactccaacaaggatggaaatggagatctgaaagggatccaggataaactggattatattaccgccctgaacatcaagactgtttggatcacttctttttacaaatcctcacttaaggacttccgctatggagtggaggacttccgtgaggtggatccaatatttggcactatggaagacttcgagaaccttgtcgccgcaatacacgacaagggattaaagttgataattgacttcatccccaaccacacttcggacaaacacatatggtttcagctgtcacgcactcggaccggtaagtacacggactattatatttggcatgattgcacacacgagaatggcaagaccattcctcccaacaattggctgtcagtgtacggtaatagcagttggcattttgacgaagtgaggaaccagtgctacttccatcaattcatgaaggagcagcccgaccttaattttagaaatcctgatgtacaggaagagattaaagagatcctccgattctggctgactaagggagtagatggattttctctggacgcagtcaaatttctcttggaggctaaacatctgagggacgaaatccaggttaataaaacgcagattcctgatactgttacgcaatacagtgaactctatcatgactttacaaccactcaggtgggtatgcatgatatcgtgcggtccttccgccagacaatggaccaatactcgacagagccaggcagatatcgctttatgggcactgaagcttatgccgaaagcatcgacagaaccgtgatgtactatggactccccttcatacaggaagcagattttcccttcaacaactatttgtccatgttagataccgtaagcggcaacagtgtgtacgaggtgattacatcatggatggagaacatgcctgaaggcaagtggcccaactggatgatcggaggcccagacagtagcagacttactagcaggctgggtaatcagtacgtaaatgtgatgaatatgctgcttttcactctgcccggtactcctatcacttattatggcgaagaaatcggtatggggaacatcgtggctgctaatctcaatgagagctatgatatcaatacacttaggtccaaaagtccaatgcagtgggacaactccagtaatgccggatttagcgaagcctccaatacctggctacccacaaattctgactaccatactgtgaacgtcgatgtccagaaaacacagccaagaagcgcgttgaagctgtatcaagacctgtccctgctgcacgccaacgaactgttactaaaccgcggttggttctgccatttgaggaacgattcccattatgttgtatacacacgcgagctggatggcatcgaccgaatcttcatcgtggtattaaacttcggggaatcaaccctgcttaacttgcataatatgatatcaggcctgcccgctaagatgaggattcgcctgtccactaactccgccgataaaggctctaaggttgatacttcgggtatctttctcgataaaggtgagggtttaatcttcgagcacaacaccaagaacctcttgcacaggcagacggccttcagggacaggtgcttcgtgtcaaacagggcgtgctactcgagtgttctgaacatcctatatacaagctgctag

SEQ ID NO: 241407 - DNA, 1866 bp, Artificial Sequence
  Description of Artificial Sequence: Synthetic coding sequence
atgaaaacattctggtctagacctagaatacagttctcaggccaagcaagatatcgcataccaagggaaatattattctggctgaccgtcgcaagcgtgctggttctgatcgccgctacaattgccatcattgccctgtctccgaaatgcctggactggtggcaggagggtcccatgtatcaaatttatccacgctcattcaaagactcgaataaggacgggaatggagatctgaaaggcatacaagataagcttgattatataactgctcttaacattaagacagtatggatcacctctttctataagtcgtcactgaaggacttccgctatggtgtcgaagacttccgcgaagtggacccaatctttgggacaatggaagacttcgaaaacctggtggctgctatccacgacaagggactgaagctcatcatcgatttcattccgaaccacacctccgacaagcatatatggttccagttatcccggactcgaactggtaaatacactgattactacatatggcacgattgtacccatgaaaacgggaaaacaatccccccaaataattggctcagtgtgtatggtaatagtagttggcacttcgacgaagtgcgaaatcagtgctacttccaccagttcatgaaggagcaaccggacctgaactttagaaaccctgacgtccaagaagagattaaagaaattctcaggttctggctgacaaagggcgtagacggctttagtctggacgccgtcaagtttctgctagaggctaaacacctgcgagacgagattcaggtcaacaagacacaaatacccgacaccgtgactcagtacagcgagctgtaccacgacttcacgacaacccaagtgggcatgcacgacatcgttcgcagtttcagacagacaatggaccagtactccactgagcccggacgctataggttcatgggtacggaagcttatgccgaatcaatcgacagaactgtcatgtactatggcctgccatttatccaagaggcagattttcctttcaacaattacctgtctatgctcgatacagtttcgggaaacagcgtttacgaagtaatcacttcatggatggagaatatgcctgaaggcaaatggcccaattggatgattggcggaccagatagtagtcgacttacatctagactggggaatcagtacgtgaacgttatgaatatgctgctcttcacccttccaggaacccccattacctattatggcgaagaaatcggtatggggaacattgtggctgctaatctgaatgagagctacgacatcaacactctgcgaagcaaaagcccgatgcaatgggacaacagctccaacgccggattcagtgaggcatccaacacgtggttacctactaattccgactaccacacggtcaatgtggatgtccaaaaaacccaaccacggtctgctttaaagctgtatcaagacctctctctcctacatgcaaacgaactgttattgaacagggggtggttttgtcacttgcgcaatgactctcactacgtggtctataccagagaattagacgggatcgatcgtattttcatcgtggttttaaactttggggagagcacgctgttaaaccttcataatatgatctccggactacccgctaagatgagaattcgcctttctacaaacagcgccgataaaggaagtaaggtggacacgtcggggatcttcctcgacaagggcgaggggcttatctttgagcacaacaccaaaaacctgctgcatagacagaccgcttttagggaccgttgtttcgtctcaaacagggcctgctactccagcgtgctgaacatcctatatacatcatgttag

SEQ ID NO: 241408 - DNA, 1656 bp, Artificial Sequence
  Description of Artificial Sequence: Synthetic coding sequence
atggccgaggataaatctaagagggatagtattgagatgtcaatgaaaggttgccagacaaacaacggcttcgtgcacaacgaagatatccttgagcagactcccgacccaggttcctctactgacaatttaaagcactcgacgcggggtatcctaggctcacaggagcctgacttcaagggcgtacagccgtatgctggcatgcctaaggaagtgttattccagttctccggtcaggcccgatatcggatcccacgggagattctcttttggctgactgtagcttcagttctggttctgattgccgcaacaatcgccattattgcattaagccccaaatgtctggattggtggcaggaggggcctatgtatcagatttatcctcgcagctttaaagacagcaacaaggacggaaacggagatttgaaaggcatccaggataagctggattacattaccgccctgaacatcaagacagtctggataacatccttctataagtcctctcttaaagattttcgctatggagtcgaagattttcgggaggtagatccaatattcggaaccatggaggacttcgagaacctggtggccgctatacacgacaagggcctgaaactcattatcgatttcattcccaaccacacaagcgacaaacatatttggttccagctttcacgtacccggaccggcaagtataccgattactacatatggcatgactgcacacatgagaatggcaaaacaatcccccctaacaactggcttagcgtgtatggaaatagctcttggcacttcgacgaggtgcgcaatcagtgttatttccaccaattcatgaaagaacagccagaccttaactttaggaatcccgacgtgcaggaggagattaaagagatactcagattttggctgaccaaaggcgtggatggttttagtctggacgctgtgaagttcttgctcgaagctaagcatcttagagacgaaatccaggtcaataagacgcagatccctgacactgtcacccaatactccgaactctaccacgactttacaaccacccaggtaggtatgcacgatatagtgcgatcgtttagacagactatggaccaatatagtacagagcctgggaggtaccggttcatggggaccgaggcctacgctgagagcatagacagaactgtgatgtattatggactgcctttcatccaagaggccgatttccctttcaataactatctgagtatgctggacaccgtaagcgggaactccgtgtacgaggttattaccagttggatggagaacatgcccgaaggaaaatggcctaattggatgatcgggggacctgacagttccaggcttacctcacggcttggaaaccagtatgtaaatgttatgaacatgctgctgtttacgctccctggtacaccaattacctactacggagaagagatcggcatgggcaatatagtggcagccaatctgaatgaaagctacgatataaacaccttgaggagtaagagtcccatgcagtgggacaacagctccaacgccggattctccgaagcatcaaacacttggctgcctaccaacagtgattaccacactgtcaatgtggatgtcctgctgagacatccttgttcttccgcagtggcatag

SEQ ID NO: 241409 - DNA, 1524 bp, Artificial Sequence
  Description of Artificial Sequence: Synthetic coding sequence
atgggttgctggggtagaaacaggggcagactgttgtgcatgttggccctcacctttatgtttatggttttggaggtcgtggtcagcagggtcacctcctctctcgcgatgctatcagactcattccacatgctgagtgatgtgttggcactggtggtggcactcgtggctgaacgcttcgcacgaagaacacacgcaactcagaaaaacacatttggatggataagagccgaggttatgggtgcactggtgaacgccatcttcttgaccggtctgtgcttcgccatcctgctggaggcaatcgagcgcttcatcgagccacacgagatgcagcagcccctggtggttctcggagtgggtgttgcaggactgctggttaatgttttgggcctgtgcctgttccatcaccattctggcttttcgcaagactctgggcatggccattcacacggtggtcacggccatggccatggcctgccaaaagggcctcgtgttaaaagcacgcggcctgggagctcagacatcaatgtggctcctggagagcagggtcccgaccaggaggagaccaatactctcgttgccaatacgtctaatagcaacggattgaaactggaccccgcagatcccgaaaaccctaggagtggagacacagtggaagtccaggtcaatggaaacctagtgagggagccagatcatatggagctggaggaagaccgcgctggacagctcaatatgcggggagtttttctgcacgttctcggcgatgccctgggtagtgtcatcgtcgtggtgaatgccctcgtgttctattttagctggaagggttgttcagaaggcgatttctgtgtgaatccatgctttccagatccctgcaaggcttttgtggagatcatcaattccacccacgcatccgtatacgaagctgggccatgctgggtcctctacctcgaccctaccttgtgcgttgtcatggtgtgtatcttgctatatacaacctatccactcctcaaggagagcgcgctgattttactgcaaacggtgccaaaacagattgacatacgcaacctaattaaagaactacggaacgtggaaggggtagaagaggtccatgaactacacgtctggcagcttgctggaagtaggataattgctaccgcccatattaaatgtgaggatccaacatcctatatggaggtggcgaagacaatcaaagatgtcttccacaaccacggaattcacgccaccaccatccagcctgaatttgccagcgtaggatcaaagtcttccgtcgtgccgtgcgagcttgcctgtcgtacacagtgcgctttgaaacagtgctgcggcaccctgccacaggccccatcgggcaaagatgctgagaagaccccagcggtgtcaatttcctgcctggaactgtcaaacaacttagagaaaaaaccacgcaggaccaaagccgaaaatatcccagctgtcgtcatcgagattaagaacatgcccaataaacagccagaaagtagcctgtag

SEQ ID NO: 241410 - DNA, 1119 bp, Artificial Sequence
  Description of Artificial Sequence: Synthetic coding sequence
atggaggccaaagagaagcagcacctgctagatgccagacctgcaatcaggtcctacacgggatccctgtggcaggaaggagccggatggatacccctgcctcgccctgggctcgatctgcaagcaatagaactggctgcccagagcaaccaccattgtcatgcgcagaaaggcccagattctcattgtgatcccaaaaagggaaaggcgcagcgacagctctacgtcgctagtgccatatgcttactgtttatgattggcgaagtagtgggcggatacctggcacattctttggccgttatgacagacgctgctcacctcttaaccgatttcgccagtatgctaatcagcctgttctccctctggatgagctccaggcccgctacaaaaactatgaacttcggatggcagcgcgctgagatccttggcgcactcgtgtctgtcctttcaatatgggtcgtgacaggcgtgctggtttaccttgccgttgaaaggctgatcagtggggactacgaaatagatggcggaacaatgctcatcacttccggatgtgctgtcgcggtgaacatcatcatggggctcactctacaccagagtggtcatggacattctcatgggaccaccaatcagcaggaagagaatccatctgtgcgggctgccttcattcacgttatcggcgatttcatgcagtctatgggagtcctggttgctgcatacatactctacttcaagccggagtataagtacgtggatccaatctgtacatttgtattctctattctggtgcttggaaccacactgacaatcctcagagatgttatacttgtactgatggagggcactccgaagggcgttgattttaccgccgttagggacctgttgttgtccgtggaaggcgtcgaagcgttgcactccctgcacatctgggccttaactgttgctcagcccgtgttgtccgtgcacatcgccatcgcacagaatactgacgctcaagctgtgctaaagaccgctagttcacggttgcagggcaagtttcactttcataccgttactatccagattgaggattatagtgaggacatgaaggactgccaggcatgccaaggcccatcagactag

SEQ ID NO: 241411 - DNA, 972 bp, Artificial Sequence
  Description of Artificial Sequence: Synthetic coding sequence
atggaggcaaaggagaaacagcacttgcttgacgctaggcccgcaatcaggtcctacaccggaagcctgtggcaagagggggcaggctggataccgttacccaggcccggactcgatcttcaggcaattgagttagcggcacaaagcaaccaccactgccatgcgcagaagggaccggactcccattgtgacccaaaaaaggggaaagcacagaggcagctctatgttgcatctgcaatttgtctgttattcatgatcggtgaggtggtcgaaatcctgggagcgctagttagcgtcctgtcaatctgggtcgtgacaggagtgcttgtttatctggcggtggaacggttgatttccggcgattacgaaatcgacgggggaacaatgttgattacctctggctgtgccgtggccgtgaacattattatgggactaaccctgcaccagtctggacacggacacagccatggcacaaccaatcagcaggaggaaaacccatccgtgcgggcagccttcatccatgtgatcggcgacttcatgcagtctatgggcgtcctggtggcggcttacatcctctatttcaaacctgaatataaatacgtggatcctatttgcaccttcgtattttctatactagttcttggcaccaccctgactatcttgcgcgacgtgatcctcgttctgatggagggaacaccaaagggggtggattttaccgcggtcagagatttactactgtccgtggaaggagtggaggccctgcactctctgcatatatgggctctgacagtggcacagcctgtgctctccgtgcacattgccatagctcagaacactgacgctcaagctgtcttgaagactgcaagcagccggctgcaagggaagtttcatttccacactgtgactattcagattgaggactatagcgaggatatgaaagactgccaggcctgtcagggccctagtgactag

SEQ ID NO: 241412 - DNA, 345 bp, Artificial Sequence
  Description of Artificial Sequence: Synthetic coding sequence
atggggccaagaaggcggtcgcgtaaacctgaggcacccaggcggagatcaccgtccccgactcccacccctgggcctagtcgacgaggtccatctttgggtgccagcagtcaccagcattccagacgtcggcaaggctggctgaaagagatcagaaaactgcaaaagtccactcaccttctgatcagaaagctccccttttcaaggctagcggctgaagcgtttctcgtccatctctttgaagacgcatacctgctcacactgcacgctggacgcgtaacactattcccaaaggatgtgcagctggctcggaggatcagggggctagaagagggcctaggctag

SEQ ID NO: 241413 - DNA, 300 bp, Artificial Sequence
  Description of Artificial Sequence: Synthetic coding sequence
atgccttttcaccattgtcaccgggacccactgccacctcctggactcaccccagagcgcttgcacgcacgaaggcagctgtatgccgcatgcgctgtttgctttgtgtttatggctggcgaagtggtggggggttatctcgcccattccctagctattatgacagatgccgctcatcttctcgccgatgttgggagcatgatgggatccctgttctcattgtggttgagcactagaccggctacacgcacaatgactttcggctggcacaggagcgaaacactcggcgctttggcctag

SEQ ID NO: 241414 - DNA, 723 bp, Artificial Sequence
  Description of Artificial Sequence: Synthetic coding sequence
atgcccttccaccactgtcacagggatccactgccccctccgggtctgacccctgaacgcctccacgccagacggcagctttatgctgcctgcgctgtctgttttgtctttatggcaggggaagttgttggtgggtatttagcccactcgcttgctatcatgaccgatgccgctcaccttcttgccgatgtgggcagtatgatgggctccctgttttctctttggctgtccacccgcccagcgacccgcacgatgacatttggctggcatcggagtgaaacactcggcgctctggcgagcgtggtatccctgtggatggtcacagggattctcctttacctggcctttgtgagactcctacatagcgattaccatatagaaggcggtgcaatgctgctgacggcaagcatcgccgtttgcgcgaacctgctgatggcatttgtcctgcatcaggcaggcccaccccattcacatggcagtagaggcgcagagtatgcgcctctggaggaaggtcctgaggagcccctgcctctggggaatacaagcgtgcgtgcagccttcgtgcatgtactcggcgatctgctccagtcctttggcgtgcttgcagcctcaattttgatctatttcaagccacaatacaaggctgcggaccctatttcaacatttctgttcagcatatgtgcactgggctccaccgcccctactctacgcgacgtcctgtag

SEQ ID NO: 241415 - DNA, 1152 bp, Artificial Sequence
  Description of Artificial Sequence: Synthetic coding sequence
atgcgagtggcggctggggctcgcggagaaaatatcgagcatcttaaattaagactcgaggctaggccccctacacttcttctattcaccgaaccgagcgagccattgcctgaagaatccaaacccgtggagatgccttttcatcattgtcacagagatccactgccacccccaggcctgaccccagagcgtttgcatgcgagacgacaactgtacgcggcttgtgcagtatgcttcgtctttatggcaggcgaagtggttggagggtatttggcccatagcctggcaatcatgaccgacgccgcacacctgcttgccgacgtggggagcatgatgggctcactgttcagtctctggctatctaccagacctgcgacaaggactatgacattcgggtggcaccgctctgagaccttgggcgcactggctagcgtggtgagcctgtggatggtgactggcatactgctgtacttggctttcgttcggttgctgcacagcgattaccacatagaggggggagccatgcttctcacagcgagtattgccgtgtgcgccaacctgttaatggcctttgtcctacaccaggctggcccaccacatagccacggcagccgtggcgctgagtatgccccattggaggaagggccagaagagcccctgcctctcggaaatacctctgtgcgggctgcttttgtccacgttttgggagacctcctccagtcctttggcgtgctggctgcctccatactgatctacttcaaacctcagtacaaagcagcagaccccatcagcacgtttctcttctccatttgtgccctggggtcaaccgcaccgacacttagggacgttcttcgcatccttatggaagggacgcccagaaacgtcgggtttgaacctgtccgggacactctcctcagtgtgccgggagtgcgcgctacacatgagctgcacctgtgggccctgactctcacatatcacgtggcgagtgctcacctggctattgattcaacagcagatcctgaagccgtactggccgaagcatctagccgactgtatagtcgttttgggttctcatcctgtaccttacaagtggagcagtaccagcctgagatggcccagtgtcttcgctgtcaagaaccaccgcaggcctag

SEQ ID NO: 241416 - DNA, 336 bp, Artificial Sequence
  Description of Artificial Sequence: Synthetic coding sequence
atgcccttccaccactgtcatagggatccgttgccccctcctggcctgacacccgagcgacttcacgccagaagacaactctatgccgcttgcgccgtttgctttgtctttatggcaggagaagttgtgggcggatatcttgcccattctctagccatcatgaccgacgccgcacatctcctggctgacgttggtagcatgatgggctcgctgtttagcctgtggttgagcactcggccagccacaagaacgatgacttttggctggcatagatcagaaacgctaggggctctcgctagtgttgtctccctctggatggtaacagggatcctttag

SEQ ID NO: 241417 - DNA, 1290 bp, Artificial Sequence
  Description of Artificial Sequence: Synthetic coding sequence
atggcaggttccggagcgtggaagcggctaaaatcgatgctacgcaaggatgatgctcccctattcctgaacgacacctcggcattcgacttctccgacgaagcaggagatgaagggttatcaaggttcaataagctccgagtcgtggtagccgacgacgggtcagaagctccagaacggccagttaacggggcacatcctacgctgcaggcggatgacgattccctccttgatcaggacctacccctgacaaattcccagctctctttgaaagtcgatagttgcgataactgttctaagcagcgcgaaatcctaaagcagcgcaaggtcaaagccaggctgaccattgccgctgtcctgtacttgctgtttatgattggagagcttgtcggcggatacattgcgaactctttggctatcatgacagacgcccttcacatgctcactgacttgtccgctattatcctcacactgctggcattgtggctctcttccaagtccccaaccaagaggttcactttcggctttcatcgtttggaggtcttgtcagcaatgattagtgtgcttctagtttacatccttatgggtttcctgctctatgaggcggtccagaggaccattcatatgaactacgagatcaacggagatattatgctaataaccgcagctgtgggggttgccgtcaacgtgatcatgggattcttactcaatcaatcaggccaccgacacagtcactctcacagcttgccctctaacagtcctacgcgcggtagcggttgtgaacgcaaccacggacaagactcccttgcagtgcgcgctgccttcgtgcatgcactcggagacttggtacagagcgtgggcgtcctgatagccgcttacattattcgtttcaagcccgagtacaaaatcgctgacccaatttgcacctatgtcttcagcttactcgtagcgtttactacctttagaatcatctgggataccgtagttattattttagaaggggtcccatcacacttgaacgtggattacatcaaggaagctctgatgaaaatcgaggacgtgtacagcgtcgaagacctaaacatttggtcactcacaagtggaaaatcaactgcaatcgtgcatatacagctgatccctggctcctccagcaagtgggaagaagtccaaagcaaagcaaaccatctgttgttgaacacctttggtatgtatcgttgcacgattcaactgcagagctacaggcaggaagttgaccgtacttgcgctaattgtcagtctagcagtccctag

SEQ ID NO: 241418 - DNA, 357 bp, Artificial Sequence
  Description of Artificial Sequence: Synthetic coding sequence
atggaagagaagtatggcggtgacgtactggccggtcccggaggcggagggggtctgggaccagtcgacgttccatctgcgaggcttaccaaatatatagtgttgctgtgttttacaaaatttctgaaagccgtgggattgttcgagtcctacgatctcttaaaggccgtccatattgttcaattcattttcattctgaagcttggcacagccttctttatggttctctttcagaagccttttagttcaggaaagacaatcaccaagcatcagataatcggcagcctcaaaatccctggcaggaaagaatttaaagacaagaaattgaacgatcctagaaagctcgtgggcaattag

SEQ ID NO: 241419 - DNA, 2298 bp, Artificial Sequence
  Description of Artificial Sequence: Synthetic coding sequence
atggaggagaagtacgggggagacgtgctggctggtcccggaggtgggggtggcctcggaccagtggacgtccccagtgcacgcctgaccaagtacatcgtgcttctctgcttcacaaagttcttgaaggctgtcggcctgtttgaatcatatgatctcctcaaggctgtacacatcgtccagttcatcttcattctgaaattgggcactgccttctttatggtgctgttccaaaagccgtttagcagcggtaaaacaattaccaagcatcagtggataaagatctttaaacacgccgttgcaggctgtattatttctctactgtggttttttggcctgaccctgtgtggaccgcttagaaccctgttactgttcgaacactctgacatcgtggtcatctcgctgcttagtgtcctctttacatcctccggaggtggacccgcaaagaccagaggcgctgccttctttatcatcgctgtgatatgtctgttgttgttcgacaatgatgacctgatggccaagatggccgagcacccagagggacaccatgactccgcgcttacccatatgctgtatacagccatcgctttcctgggtgttgccgatcataaaggaggcgtgctactgctggtgcttgctttatgctgtaaagtgggcttccataccgcttcccggaaactcagcgtggacgtcggcggagccaaaaggctccaggctctgtctcatcttgtctcggtactcctgttatgtccttgggtaatagtgctgtccgtgaccacggagtccaaggtggaatcttggttttccctgattatgccctttgcaacagtcattttctttgtcatgattctggacttttatgtagacagtatttgttccgtcaagatggaggtcagcaaatgcgctaggtatggcagtttccctatattcatctccgcactgctgttcggcaatttctggacacatccgattacggatcagctgcgcgctatgaataaggccgcacatcaagagtcgaccgagcacgtgctctcaggaggggtggttgtcagtgcaattttctttatcctcagtgctaacatcctaagttcaccctctaaaaggggccagaaaggcactctgattggctactctccggagggaacacctttatacaattttatgggcgatgctttccaacattcatcacagtccatccctcgatttatcaaagaatcactgaaacagatcctagaggagtccgacagccgtcaaatcttctacttcctttgcctgaatctcctctttactttcgtggagctgttctacggggtgttaacaaattccctgggattaatcagtgatgggtttcatatgctcttcgattgttcggccctcgttatgggactgttcgcagccttgatgtcccggtggaaagcgactcggatattcagctacggctacggtaggatcgagatcctctctgggtttatcaatgggcttttccttattgtcatcgctttcttcgtatttatggagtcagtggcacgccttatcgaccctcccgaacttgacacacatatgttaactccggtctccgtgggaggcctgattgtcaatctcataggaatctgtgctttctcccatgctcactcgcacgcgcacggcgcaagtcaagggagctgtcattcttcggatcacagccattctcaccatatgcatggtcacagcgaccacggacatggtcatagtcacggctctgcaggcggaggaatgaatgcaaacatgagaggtgtcttcctgcacgtcctcgcagataccctgggctccattggggtgattgtctctacagtcctgattgaacagttcgggtggtttatcgccgacccgttgtgctctctgtttatagccatcctcatatttctctcagtggtgccgttgatcaaagacgcttgtcaagtcctccttctgcgcctcccacccgagtatgagaaagaacttcacattgcacttgaaaaaatccagaaaattgagggccttatatcctatcgtgatccccacttctggaggcactcagcatcgattgtggcaggcacaatacacatccaggtgacctctgacgtgttagaacaaaggatcgtgcagcaagttacaggcattctgaaagacgctggagtgaacaacctgaccatacaagtcgagaaggaagcctactttcagcacatgagcgggttgagcaccggctttcacgacgttcttgcaatgacgaagcagatggagtcaatgaaatattgtaaggatggcacctacatcatgtag

SEQ ID NO: 241420 - DNA, 1083 bp, Artificial Sequence
  Description of Artificial Sequence: Synthetic coding sequence
atgggggacgcatttcagcattccagtcaatcaattccaagattcatcaaggagtctcttaaacaaatcttggaggaaagcgattcccgccagattttctatttcttatgcttgaacctgctgtttaccttcgtggagctcttttatggagttctgaccaacagccttggcttaatcagtgacggctttcatatgctctttgattgttcagctctggtgatgggtttgtttgcagcacttatgtcaaggtggaaagctacaagaatttttagttacggctacgggagaatcgagatactgtctggcttcatcaatggactctttctgattgtcattgccttttttgtgtttatggagtccgtggcccgtttgatagacccacccgaactcgacactcacatgctgacgccctgccactctcacgctcatggggctagccaggggtcttgccattcctcagaccactcccactcacatcacatgcatggacactcagaccacggtcacgggcattcacacggaagtgccggaggtgggatgaatgcaaacatgaggggcgtatttctgcatgtgttggctgatacattggggagtattggtgtaattgtgtctaccgtgcttatcgaacaatttgggtggttcatcgccgaccctctttgttcactgttcattgctattctgatatttcttagcgtcgttcctctgattaaggatgcatgccaggtgctgctgttgaggttgccaccagaatatgaaaaagagctgcatatagctctggagaaaattcagaaaattgaaggtttgattagctatcgggaccctcacttttggagacacagcgcgtctatcgttgctggcaccatccacatccaggtgactagcgatgttctcgaacagagaatcgtgcagcaggtaaccgggatactgaaagatgccggtgtcaataatctcactatccaggtggagaaagaggcctatttccagcacatgtcaggtctgtcaaccggcttccatgacgtgttagcaatgaccaagcagatggagtccatgaagtactgtaaagatggaacatacatcatgtag

SEQ ID NO: 241421 - DNA, 1386 bp, Artificial Sequence
  Description of Artificial Sequence: Synthetic coding sequence
atggggaccatccacctatttcgaaaaccacagcgctcattctttggcaagctccttcgagaattcagactggtggcagccgacaggcgaagctggaaaatcttgttgttcggggtgatcaaccttatctgcacagggtttctgctcatgtggtgttcaagcactaactccatagctctcaccgcatacacttatttgaccattttcgacttgttttcactgatgacctgcttgatctcatactgggtgacattgcgcaagccatccccagtttactctttcggatttgaacgccttgaggttttggccgtatttgcatccacagtgttggcacaactgggtgcgttgtttatcttgaaagaatctgctgagaggttcttggaacagcctgagattcacacagggagattgctggtgggcacatttgttgcactgtgcttcaatttgtttactatgctttcaattaggaataaaccattcgcctacgttagcgaagccgcaagtacatcgtggctccaggaacacgtggccgacttgtctaggtcactctgcggcataattcccggactgtcatccattttcctgccccgaatgaatccatttgtcctgattgatctcgctggggctttcgcactctgcatcacatatatgctcatcgagatcaacaactactttgcagtggacactgcgtcagcaatcgcaatcgccctgatgacttttgggaccatgtatcccatgtcggtttacagtgggaaagtcttgctacagaccaccccgccacacgtgatcggacagctggataaattgatcagagaagtctcaactttggatggcgtgctcgaggtgcggaacgagcacttctggacactcggctttgggagtctggctggttccgtccacgtgaggatacggagggacgctaacgaacagatggtgcttgcacacgtcacgaaccgcctgtataccctcgtctccacactcacggtccagatttttaaggatgactggatcaggcccgcactactgtccggtcctgtggcggctaacgtgctaaacttttccgaccatcacgtaataccgatgcccttattgaaaggaaccgatgatctcaacccagttacgtcgactccagccaaaccatcatccccccctcccgaatttagcttcaacacccctggcaaaaacgtcaatccagtgatcctgctcaacactcagacacgaccctatggcttcggtctgaatcatgggcacactccttattcaagcatgttgaaccagggtctaggagtccctggcattggcgcaacccagggtctgcgtactggttttaccaatatacccagccgctatggcaccaataaccgaattggccagcctcggccttag

SEQ ID NO: 241422 - DNA, 795 bp, Artificial Sequence
  Description of Artificial Sequence: Synthetic coding sequence
atgaacccattcgtgttgatagacctggccggagcattcgctttatgtatcacctacatgttgattgagatcaacaattattttgctgtcgacaccgcgtccgcaatagcgattgcactgatgacttttggcaccatgtatcccatgtctgtgtactctggtaaggtactactgcagactacaccgcctcatgtgatcggtcagcttgacaaactcataagagaagtgtcaacccttgatggcgtgcttgaggttcgaaatgaacacttttggacgcttggttttgggtctctcgcaggatcagtccatgttcggatccgcagagacgcgaatgagcaaatggtgctggctcatgtgactaatcgcctgtacacattggtttccacactgactgtgcagatattcaaggacgactggatccgaccagcccttttgtcagggcctgtggcggcaaatgtcctgaacttctcggatcaccacgttatcccgatgccactcctcaaaggcactgatgatctaaatcctgtgaccagtactccagccaagccttcttcccccccacctgaattctcctttaacactccaggaaaaaacgtgaatccggtcatcctactgaatactcagactcgtccctacggatttggactgaaccatgggcacactccctattcctcaatgctcaatcagggtctgggagtacccggtattggggctacacagggactccggaccggatttactaacatcccctctcggtacggaactaacaatagaatcggccagcccaggccctag

SEQ ID NO: 241423 - DNA, 1506 bp, Artificial Sequence
  Description of Artificial Sequence: Synthetic coding sequence
atggggacaatacatctgtttagaaagcctcagcgttccttctttggaaaactgcttcgggagtttcgcctggtggctgcagatagacgcagctggaaaatcctcctgtttggagtaattaacctgatctgtactggatttcttttaatgtggtgttcaagtacaaattcaatcgcattgacagcctacacatatctaaccatttttgacctgtttcgggatggggttagccccttttggttgggatggtcccagacaccggatttaaagtggagtacgcatttgggcttgccgaaatgctgggataataggagggagcttccatgtctgtctaattctttgatgacctgtttgatctcctactgggtaacccttcgcaagccctccccagtttactcatttgggttcgagcggctagaagtgctcgcagtctttgcttccactgtcttggcacaactaggcgcattgttcatcctcaaggagagcgctgaaagattcctggaacaaccagaaattcacacgggccgtctgctcgtgggtacttttgttgccctatgcttcaaccttttcaccatgctctcgatcagaaacaagccctttgcctacgtgagcgaagcggcatcaacaagttggctgcaggaacatgtagcagacctctcacggagcctgtgcggaatcatccctgggctgtctagcatcttcctgccaaggatgaaccccttcgtgctcattgacttagccggagctttcgccctgtgtatcacctacatgctgattgaaattaacaactactttgccgtggacacagcctcagccattgcaatcgccctaatgaccttcggcactatgtacccaatgagcgtatatagcgggaaggtgctcctgcagactacaccaccacacgttatcggtcagctggataaactaattcgggaggtgagtactttagatggagttctggaagttcgcaacgaacacttctggactctgggcttcggatctttagctgggtcagttcacgttagaattagaagggatgctaatgaacagatggtgctggctcacgttactaatcgattgtatacattagtgtcaacactgactgtacagatttttaaagacgactggatcagacccgctctgctgtctggtcccgtagctgcgaacgtcctcaactttagcgaccatcacgtgattcccatgcccttgctaaaaggcaccgacgacctaaaccccgttactagtacgcccgcaaaaccgagcagcccaccacccgagttttcattcaacacccctggaaaaaacgtaaacccggtgattctactgaacactcaaacaaggccgtacggcttcggcttaaaccacggccacactccgtactccagcatgctcaaccagggcctgggcgtcccagggattggggctacccagggattgagaactgggttcactaatatcccctccagatatggtacaaacaaccggatcggacaaccgaggccttag

SEQ ID NO: 241424 - DNA, 1164 bp, Artificial Sequence
  Description of Artificial Sequence: Synthetic coding sequence
atgacttgccttatatcatactgggtgacgctgcgtaaaccgtccccagtgtatagtttcggatttgaaagactggaagtgctcgcagtattcgccagtactgttttagcacagctcggtgcactgttcatcctcaaggaatcagccgaacgctttctcgagcaacccgagatccacaccggcaggttactggtggggaccttcgtggccctgtgctttaacctctttacgatgctatccattcggaataagccgtttgcttatgtctctgaggccgcttctacctcctggctccaagagcatgtggcagacctgtcgcgcagtctgtgcggtataatccctggacttagcagcatcttcctgcctcgcatgaatcccttcgtgctgatagatctcgccggagccttcgctctgtgcataacctatatgctgatcgagattaataattacttcgccgtcgacacagcttcagccattgcgattgcattaatgacatttgggaccatgtacccaatgtcagtttacagcgggaaggtgctgctgcagacaacacccccacacgttataggacagctggacaagctgatcagggaagtgtcaacactggacggtgttcttgaagtgagaaacgagcacttctggaccctcgggttcgggagcctggccggtagcgttcatgtgaggattcgtcgagatgccaatgagcaaatggtgctcgctcacgttactaatagactttacactctggtatcaactctcacagtgcagatcttcaaggatgattggatcagacctgccctgctgtctggtccagtcgcagcaaatgtcctcaatttctccgaccatcacgtgatccccatgcctctcctaaaagggacagacgacctgaatcctgtgacctccacacctgctaaaccctcttcaccccctccagaattctcgttcaatactcccggaaagaacgtaaaccctgtaatcttgctgaacacccaaacacggccttacggtttcgggctgaatcacgggcataccccatacagctcgatgctgaatcaaggcctgggggtcccgggaatcggcgctacccaagggctgcgtactggctttaccaacattccctctcggtatggaacaaacaacagaatcggacagccccgtccctag

SEQ ID NO: 241425 - DNA, 1317 bp, Artificial Sequence
  Description of Artificial Sequence: Synthetic coding sequence
atggggaccattcatctgtttcgcaagccccagcgctcttttttcggcaaactactgcgagagttcaggctggtggcggcagatcggagaagctggaagatacttctgtttggcgtcattaacctgatatgcaccggtttcctgttaatgtggtgcagttccaccaatagtattgccctcacagcgtatacctacttgacaattttcgatttgttctcacttatgacctgcttaatcagctattgggtgaccctgagaaagcccagccccgtgtacagcttcgggtttgaaaggctggaggtcctggccgtctttgcatctactgtgctggcccagctgggcgctctattcattctcaaagaaagcgctgagcggttcctggagcagccagagatccataccggcaggttacttgtcggcaccttcgtcgctctgtgctttaaccttttcaccatgttaagtatccggaataagccttttgcctacgtaagtgaagcagcttcaacaagctggctgcaggagcatgtcgcagacctgagccgatcactctgcggcatcattcctgggctgagcagcatcttcctgccacggatgaacccttttgtcctaatagatctagccggtgctttcgcactctgtatcacttacatgctcattgagataaataactattttgctgtggatacagcatcggccattgccatcgctttaatgaccttcggcactatgtatcccatgagcgtgtactccgggaaagtgctgcttcagactactccaccccatgtcattggacaactagataaactcatccgtgaggcgggtagcgttcatgtcaggattcgaagagacgcgaacgaacagatggtcttggctcatgtgacgaatcgactgtacaccctcgtgagcaccctcacggttcagattttcaaggatgattggattagacccgctctgctatcaggccctgttgcagcaaacgttctgaatttctctgaccatcacgtgatccccatgcccctgctgaagggcaccgatgacttaaaccccgtgactagcacccctgccaagccaagcagccctccgccagaatttagcttcaacacacctggcaaaaatgttaatccagttatactgttaaacactcagactcgtccctacggcttcgggttgaatcatggacacacaccatactcctcgatgctgaatcagggactcggcgttccgggaatcggcgcaacacagggtctccgcactggctttaccaacattccatctagatacggtacaaataacagaatcggtcaacctcggccatag

SEQ ID NO: 241426 - DNA, 1299 bp, Artificial Sequence
  Description of Artificial Sequence: Synthetic coding sequence
atgagctggaagattctgcttttcggggtgataaacttaatctgtaccgggttcttattaatgtggtgctctagtactaattcaatcgctcttactgcatatacctatctgaccattttcgacctgttcagcctgatgacctgtctgattagctattgggttactctccggaagccctcccccgtgtatagctttggcttcgagcgacttgaagtcctcgccgtgttcgcttcaacagttctggctcagcttggggcactattcatcctgaaagagtcagctgaaagatttctcgaacaaccggagatccacacaggcaggctgctggttggtaccttcgtagccctgtgctttaaccttttcaccatgctgagtattaggaataaaccgttcgcctacgtgtctgaggcggctagcacgtcatggctgcaggaacatgttgcagacctgtcacgcagtctctgtggcattatccctggtctctcaagcatcttcctgccccgaatgaacccatttgtgctgatcgatctggctggagctttcgccctttgtatcacatatatgctcattgaaattaataattactttgcagtggacaccgcttctgcaattgcaatcgcacttatgacatttggcaccatgtatcctatgtccgtgtactctggcaaagttcttctccaaactactccgccacatgtgatcggacagctcgacaaactgatacgggaggtatctaccctcgatggcgtgctggaagtgcgcaatgaacatttttggacactgggattcgggagcttggcgggatccgtacacgtgagaatccggagagacgccaacgagcagatggttctggcacatgtgaccaatcgtttatacaccctggtaagtaccctgactgtacaaatctttaaggatgactggattcgtcctgcactactctctggcccagtggcagcgaatgtcctgaatttctccgaccaccacgtgattcctatgccacttttaaaaggcactgatgacctcaaccccgtgacatccacacctgccaagccctcgtctccgccacctgagttctcatttaatacgccaggcaaaaatgtgaaccctgtaatactgctaaacactcagacacgtccatacgggttcggcctgaaccacggacacacgccatattcaagtatgctgaatcaagggttgggcgtcccaggaattggcgctacccaaggactccgcacaggttttaccaacatacccagcagatacggcacaaataatcgaatcggtcagcccaggccatag

SEQ ID NO: 241427 - DNA, 1131 bp, Artificial Sequence
  Description of Artificial Sequence: Synthetic coding sequence
atgcttcctttgtcaattaaggatgacgagtataaacccccaaaatttaatctgtttggcaaaattagtggatggttcaggtcgatcttgtcagataaaacctctagaaatctcttcttcttcctgtgcctgaatctgtcatttgcctttgtcgagttgctctacggcatttggagcaattgcctcggattgatctcggacagcttccatatgtttttcgacagtactgctatccttgccggtctagcggctagcgttatctcaaaatggcgcgacaacgatgccttctcatacggctacgttagggctgaggttctcgcgggatttgtaaatggattgtttctcatcttcaccgccttcttcatcttctcagagggcgttgagcgcgcactggcccctcctgatgtccaccacgaacgcctgttgctcgtcagtatcctgggcttcgttgtgaatctcattggtatttttgtgttcaagcacgggggacacggccactcacatgggagcggccatggtcacagtcatagtctgttcaatggggctctggaccaagcacatgggcatgtagaccactgccattcccatgaggtcaagcatggcgcagcccacagccacgaccacgcacacgggcacggtcacttccactctcatgacggccctagcttgaaggaaaccaccggtccctcaagacaaatcctgcagggggtttttctccacatcctggccgacacgttgggatctatcggcgtgatcgccagtgccatcatgatgcagaactttggccttatgatcgccgatcctatctgcagtattcttatagcaatcttgattgttgtgagcgtgatcccgctcctacgggaaagtgtgggcattctcatgcagagaacccccccacttctagagaacagcttgccccagtgttatcagcgggttcaacagctccaaggagtttatagcttacaggaacagcacttctggactctgtgttctgacgtctatgtaggaactcttaagctgatcgtggcccctgatgcagatgccaggtggatcttgtcgcagacccacaacatcttcacacaggcgggagttcgccaactgtacgtccagatcgatttcgccgctatgtag

SEQ ID NO: 241428 - DNA, 273 bp, Artificial Sequence
  Description of Artificial Sequence: Synthetic coding sequence
taagttatcccactccttagagagtctgtcggtattctgatgcagagaaccccaccgctgcttgaaaacagtctcccacaatgttatcagagggtgcaacagctgcagggcgtttattcgctgcaggaacagcacttctggaccctatgttcagacgtttatgttggcactctcaagctaatcgttgccccagatgccgacgccagatggattctgagccaaacccataatatattcacccagaagctcgaagaggagaacgagaacctgtag

SEQ ID NO: 241429 - DNA, 1131 bp, Artificial Sequence
  Description of Artificial Sequence: Synthetic coding sequence
atgctccccctgtctattaaagacgatgaatataagccacccaaattcaatctgtttggtaaaatttcggggtggtttcgcagcatactttccgacaagacctctaggaacctcttcttctttttatgtctaaatttgagcttcgcttttgtggaactgctgtatggaatatggtctaattgtctgggtctgatatcggacagttttcacatgtttttcgacagtacggccattctcgcgggattggctgcaagtgtgatcagcaagtggcgtgacaatgacgccttcagctatggatatgtgcgggctgaggttcttgccggattcgtcaacgggctgttcctgatttttactgcattcttcatctttagtgaaggagtggagcgggcattagcacctccggatgttcatcacgagcggcttttgttggtgtccattttaggatttgtggtcaatttgatcggaatttttgtgtttaagcatggcggacatggacacagccatggatccggacacggacactcccattctctgttcaacggggctctggatcaggcccatgggcatgtagatcattgccactcccatgaagtcaaacacggtgccgcacactcacacgaccacgcccatggtcacgggcacttccattcccacgacggcccatccctcaaagaaaccaccgggccaagccgtcagatcctgcaaggagtgttcctgcacatcttggccgataccctagggtccatcggagtcatagcatctgcaattatgatgcagaactttggcctgatgatagccgacccaatttgctccatactgatcgccatcctgatcgtggtcagcgttatccccctcttacgggaaagtgtcgggatccttatgcagcgcacccccccactgctggagaattctctgccccagtgttaccagcgcgttcagcagctccaaggagtgtactctctccaagagcagcacttttggacactttgctcagacgtctacgtggggacacttaagttgatcgtggcacccgacgccgacgctaggtggatcctgagccagacgcacaatatattcacgcaggcaggcgtgagacagctctatgtccagatcgatttcgccgcaatgtag

SEQ ID NO: 241430 - DNA, 963 bp, Artificial Sequence
  Description of Artificial Sequence: Synthetic coding sequence
atgtaccattgtcactctggctccaagcctacagagaagggagcgaatgagtatgcttatgcgaaatggaagttatgctctgcatcggctatttgtttcatttttatgatcgcagaggtagtgggcggtcatattgcgggaagccttgctgtagtgacagacgccgctcacctgttgatagatcttacatctttccttttatctctatttagtctgtggttgagtagtaagccgccatcaaagcggctcacgtttggctggcatagagcagaaatactgggggctctcctgtcaatcctctgcatttgggtcgtgaccggagtactggtgtatttagcctgcgaaagactgttatatccggattatcagatacaggccaccgtgatgatcattgtttcttcctgtgccgtggcggctaatattgtgctcactgtggtattgcaccagcgttgccttggacacaatcataaagaggtacaggctaacgcatcggtccgcgcagctttcgtacacgccctaggcgatctctttcaaagtatatccgtgttgataagcgccctgattatctatttcaagccagagtacaagattgcagatccaatttgcaccttcatattctccatcctggtgctggccagcacaatcactatcttgaaggatttttctatactgcttatggagggggttcccaagtctctgaactacagcggcgtcaaagagctaattttagccgtggacggtgttctgtccgtgcatagcctacacatctggtctttaactatgaatcaggtgattctttcagcccacgtggccactgcggcttctagggatagccaggtcgtgaggagggaaattgccaaggccttgtctaagagcttcaccatgcacagcctaacaatccaaatggaatcaccagtcgatcaggaccccgactgtcttttctgtgaagacccttgtgattag

SEQ ID NO: 241431 - DNA, 1110 bp, Artificial Sequence
  Description of Artificial Sequence: Synthetic coding sequence
atggagttcctggagcgcacatacttggtgaacgacaaagccgctaagatgtacgcttttactctagagagcgttgaactgcagcagaaaccagtcaacaaggatcagtgtcccagggaacggccagaagagctggagagcgggggtatgtaccattgccactctgggtctaagcctacagagaaaggcgctaatgagtacgcctacgccaagtggaaactgtgctcagcatcagccatttgttttatctttatgattgcggaagttgttggaggacatatcgccggatcgttggctgtagtgacagatgcggctcatttactcattgacctgacttcctttttgctgagcctgttttcactctggttaagtagcaaacccccttccaagcgactcacctttggctggcatagggcagagatattgggagctctgttgagcatactgtgtatctgggtcgtaactggggtgttggtatacctcgcatgtgaaagactcctctatcccgattaccagatccaggcaactgtgatgatcatcgtctctagctgcgccgtggccgctaacattgtcctcaccgtggtgcttcaccagagatgcttggggcacaaccacaaggaggtgcaggctaacgcatctgttcgtgcggctttcgtacatgcccttggagacttgtttcaatccattagcgtcctgatcagtgcccttatcatatattttaagcccgaatacaaaattgccgacccgatttgtacgtttatttttagcatccttgtgttagccagcactatcacgatcttgaaggacttcagcatcttactaatggagggtgttcccaagagcttgaattattccggcgtaaaagagctgatcttagccgtcgatggcgtgctgagcgttcactcacttcacatctggagtttaacaatgaaccaggtgattttgtctgcacacgtggctacagcagcctcccgggatagccaggtggtgaggcgggaaatcgctaaagcattgtctaaatcctttacaatgcacagtcttaccattcagatggagtctcctgtagatcaggaccccgactgcctcttttgcgaagatccatgtgactag

SEQ ID NO: 241432 - DNA, 1458 bp, Artificial Sequence
  Description of Artificial Sequence: Synthetic coding sequence
atgggcaggtactcagggaagacatgtcgactcctgtttatgctggtgctgaccgtagcgttttttgtcgccgaactggtgtccggttatctagggaatagcatagccctgttgtccgactcgtttaatatgttgagcgatttgataagtctgtgtgtggggctgagcgccggatatatcgcccgacgtccaacaaggggattttcagccacctacgggtatgcacgcgcagaggtggtgggagctttgtcgaatgctgtgtttcttacagcactctgtttcacgatctttgtggaggccgtcctaaggctcgcgcgaccagagcggatcgatgatcctgaactggtgttaatcgtgggtgtgttaggcctactggtgaacgtggtcggccttctcatctttcaggattgtgccgcatggtttgcatgctgccttcgtggaaggagcagacggctccagcaaagacagcagctcgccgaaggctgtgtgcctggagcatttggagggccacagggtgctgaggaccctagacgagccgctgaccccaccgccccaggtagcgactccgcagttactttaagaggcaccagcgtcgaaagaaagcgggagaaaggtgcaaccgtctttgccaatgtagccggtgattccttcaacacacagaatgagcctgaggacatgatgaaaaaggagaagaaatccgaagcattaaatatccggggtgtactcttgcacgtgatgggcgacgccctcggttccgtggtcgtggtcatcacggccataattttctacgttctgccacttaaatctgaggacccttgcaattggcagtgctacatcgacccctcgcttaccgtcctgatggtgatcataatactcagttctgcattccccttgattaaagagacagctgctatacttttacaaatggtacccaaaggggtcaatatggaggaattgatgtcaaaactgtccgcagttcctggtatctcttcagtgcacgaagtgcacatctgggaattggtgagcggcaagattattgctaccctgcatattaagtacccaaaggaccggggttatcaggacgccagcaccaagattcgggagatcttccaccacgctgggatacataacgtgacaattcagttcgagaacgtagacctgaaggaaccattggaacagaaggatctgctgcttttatgcaacagcccttgcatcagtaagggctgcgccaaacaactgtgctgtccacctggcgcacttcctctggcacacgtcaatgggtgcgctgagcataacggaggcccaagtctggatacatacggatccgacggcctgtcaagaagggacgctcgcgaggttgccatcgaggtgtcgctggatagttgcctgagcgatcacggccagagcttgaataagacgcaggaggaccagtgctatgtgaatcgaacacacttctag

SEQ ID NO: 241433 - DNA, 723 bp, Artificial Sequence
  Description of Artificial Sequence: Synthetic coding sequence
atgggggacgccttgggcagtgtggtggtcgtgattaccgcgattattttttacgtgcttccactaaagtctgaggatccctgcaactggcagtgctatatagacccgtctctgacagtcttgatggtaattatcatcctttcatctgccttcccactgatcaaagaaacagccgcaattctgctgcaaatggtccctaaaggagttaatatggaggaattgatgagcaagttatcggctgtacccggaatctcgtccgtccacgaagtgcatatttgggagctcgtatctggaaaaatcattgccaccctgcatatcaagtatccgaaagacagaggttaccaggacgcttcgactaagattagagaaatctttcatcacgccggaatccacaacgttacaattcagttcgaaaatgtggacctcaaggaaccacttgagcagaaggacctccttcttttgtgcaacagtccatgcatatctaaagggtgcgctaagcagctgtgctgtccacctggcgctctgccactggcccatgtgaatggatgcgcagaacacaacggcggtccctccttggatacctacggatctgacggtctgagcaggagggatgcccgtgaggtggccatcgaagtgagcctggattcatgcctgagcgatcacgggcagtccttaaataagacacaagaagaccagtgttacgtgaatcggacacacttttag

SEQ ID NO: 241434 - DNA, 672 bp, Artificial Sequence
  Description of Artificial Sequence: Synthetic coding sequence
atggggagatattctgggaaaacttgccgcctcttattcatgctggtgctgacagtcgccttttttgtggccgagctggtctccggatacttgggaaactcgatagccctcctgtcagactctttcaatatgctgagcgatctaatctctctgtgcgtgggtctctctgccggttatattgccaggcgccctaccaggggcttctctgctacctacgggtacgccagggctgaggtggtgggagcccttagcaatgcagtgtttttaaccgcgctttgcttcaccattttcgtggaggcagtcctccgtttggctcgacccgaaagaatcgatgacccagagcttgtcctgatcgtgggagtgctgggcctgctggtgaacgtggtgggactgttgatttttcaggattgcgccgcttggttcgcgtgctgtctcagaggtcgttctagacggcttcaacaaagacagcagctggcagagggatgcgttcccggagcctttggaggtccccaaggtgcagaagacccgaggcgcgctgccgaccccactgcaccaggcagcgactctgctgtgacgttgcgcggtacgtctgtagaacgcaaaagagaaaagggcgctacggtttttgccaacgtggccgaactgattcataacactaggtttttactgtag

SEQ ID NO: 241435 - DNA, 567 bp, Artificial Sequence
  Description of Artificial Sequence: Synthetic coding sequence
atggaccatagccatcatatggggatgtcgtatatggattccaactcaacaatgcagccgagccatcatcatccaactacttcagcatcacatagccatgggggtggcgactcaagtatgatgatgatgcccatgacgttctatttcggcttcaagaacgtcgagctcttattcagcggtttagtcattaataccgctggggagatggccggtgccttcgtggctgtctttttgttagccatgttctatgaaggattaaagatcgcccgagaatccctcctaaggaagtcccaggtttccatccgctataactccatgcctgttcctgggcctaacgggaccattctcatggagacacataaaactgttgggcagcagatgctgtccttcccacatttgcttcagacatgttgggactatcggcacgagccacctcacctcagcctctctcccagttattactctgatttgaattatcccaagaaggcgaaggtcctgctgcgggtgagtgtcgaactgatgattcaagaagccttgatgatcacggccggtgattccctctgttag

SEQ ID NO: 241436 - DNA, 573 bp, Artificial Sequence
  Description of Artificial Sequence: Synthetic coding sequence
atggatcacagccaccatatggggatgagttacatggacagcaattctaccatgcagccatcccatcatcacccgaccacaagcgcttcccacagccatggcggaggcgacagctccatgatgatgatgcccatgaccttctacttcggattcaaaaatgttgaactgttgtttagcgggctcgttattaacaccgctggcgaaatggcaggcgctttcgttgcagtctttcttttggccatgttttatgaaggcctgaagattgcaagggagtcactgctgcgcaaaagccaggtcagcatccgatataattccatgcctgtcccagggcctaatggcacaatcttaatggagactcacaaaactgtgggacagcagatgctgagcttccctcacttgctacagacagtgctgcatattattcaggtggtcataagttactttttaatgctcattttcatgacctataacggatacttgtgtattgcagtcgctgctggagcgggaacaggatattttctgtttagctggaagaaagccgtggtcgtggacatcactgagcactgccactag

SEQ ID NO: 241437 - DNA, 432 bp, Artificial Sequence
  Description of Artificial Sequence: Synthetic coding sequence
atggccatgcattttatcttctccgacaccgccgtcctcttattcgacttttggtccgtgcactctccggctgggatggccctgtcagtcctggtcctgttgttgctagctgtgctctacgaggggatcaaggtgggaaaggccaagctgctaaaccaggttcttgttaaccttccgacgagcatatctcagcagacaatagccgagaccgatggagattcggcaggtagcgactccttcccagtaggtaggactcaccaccgatggtacctgtgccatttcggacagagcctcattcatgtgatccaagtggtaataggatactttatcatgcttgcagtcatgagctacaacacctggattttcctgggcgtcgtgctcgggagtgctgtgggttattatttggcctatcctctcctctcaacggcatag

SEQ ID NO: 241438 - DNA, 1650 bp, Artificial Sequence
  Description of Artificial Sequence: Synthetic coding sequence
atgtcaccaactatctcccacaaagattcatccagacagaggaggcccggaaacttttctcacagtctggatatgaagtcaggacccctgccccctggcggatgggacgatagtcaccttgacagcgcaggtagagagggtgatagggaagctctcctgggtgacactgggacgggagattttctgaaggcccctcaaagttttcgcgctgaactttctagcatcttactcctcttgtttctttatgtcctccaggggattccactggggctggcagggtcgattcctctgatcctgcagtccaaaaacgtgtcttataccgatcaggcatttttttcattcgttttttggccctttagcttaaagctgttatgggctcccctggtggacgcggtctacgttaagaattttggcaggcgcaaatcttggctggtgcctactcaatatatcctcgggctgttcatgatatacctatcgactcaggtcgacagactgctcgggaacacagacgaccgcacgcctgacgtgatcgccctgactgttgccttcttcctgtttgagtttcttgcagccacacaggacatcgcggttgacgggtgggctctgactatgctgtccagagagaacgtcggctacgcatccacctgtaacagtgtcggtcaaaccgcagggtatttccttggtaacgtgctgtttctggccttggagagtgctgatttctgtaataagtacctgcggtttcagcctcaacccagggggatcgtgactctgagcgatttcctgttcttctggggcaccgttttcctcattaccacaactttggttgccctgctcaagaaagagaacgaggtgtcggttgtcaaagaggagacacaaggaatcactgacacttataagctgctgttcgctataattaagatgcctgccgtgctgacgttttgcctgctgatcctaacggccaaaattggattcagtgccgctgacgccgttaccgggctgaagctggtcgaagagggcgttcctaaagaacatcttgctctgctcgccgtccccatggttccactccagatcattctccctctgataatttccaagtatacagccggacctcagcccctcaacacattttataaggccatgccctatcgactgctgcttgggttggaatatgccctgctagtctggtggacgcccaaggtggagcatcagggcggtttccctatctattattatatcgtggtgctcttaagttatgcattacaccaagtcactgtgtattccatgtacgtgtctatcatggccttcaacgctaaggtgagcgatcccctgatcggcggaacatacatgaccctgctgaataccgtgagcaatttaggtggaaactggccgtccactgttgctttatggttagtagatcctctgaccgtgaaagagtgcgtgggagcttccaaccagaactgtcgtactcctgacgctgttgaattgtgcaaaaagctcggcggatcttgtgtgaccgccctagatggctactacgtggaatccatcatttgtgtcttcataggtttcgggtggtggttctttctgggcccaaagttcaaaaaactacaagatgaaggttcatcatcctggaaatgtaagagaaacaactag

SEQ ID NO: 241439 - DNA, 1650 bp, Artificial Sequence
  Description of Artificial Sequence: Synthetic coding sequence
atgagcccgaccatttctcataaggatagcagccggcaaagacgacccggtaatttctcacactcattggacatgaaatctggccctttgccacccggagggtgggatgacagccaccttgactccgcaggcagagagggtgaccgcgaggcactactgggagacacaggtacaggagactttcttaaagcaccgcagtccttcagggccgagctttcctccatcctcctgttgttgtttctgtacgtcttgcaggggatccccttaggtttggccggatctatccccctcatattgcagtccaaaaacgtttcctacaccgatcaagcatttttttccttcgtcttctggcccttttcactgaagctattatgggcccctttggttgatgcagtttacgttaagaatttcgggagacgcaagtcatggctggtacccacacaatatattctgggtctcttcatgatctatctcagcactcaggtggaccgtctgctcgggaacactgacgaccgcactccagacgtcatagcactgactgtggccttcttcctgttcgagtttctggccgctacccaggacatcgccgtcgatggatgggcattaactatgctctcacgagaaaatgttggatacgcttcaacatgtaactctgttggacagaccgcgggttactttttgggcaacgtgctgtttctggcccttgagtctgctgacttttgcaataaatatctaaggttccagccccagcccaggggaattgttactttatccgacttcttgttcttctggggaacagtatttttgattaccaccacccttgtggctcttctaaagaaggaaaacgaagtgtcagtggtaaaagaagagacgcagggtattacagacacctataaactgctgttcgccatcattaagatgccagccgtcctgaccttttgcctgctgatcctgactgccaaaattgggttctccgctgccgacgctgttactggccttaagctggttgaggagggcgttccaaaagaacaccttgcactacttgccgtcccaatggtgcccctgcagattatactccccctcattatctcgaaatatacggctggcccacagcccctaaacacattttacaaggcaatgccataccggttactattgggtctggaatatgctctgctcgtctggtggacccccaaggtggaacaccagggaggtttccctatttactactatattgtagtgctcctgtcatatgccttgcatcaggtgactgtgtactctatgtacgtgtctatcatggcctttaacgcaaaggtgtctgatcctttgattggcggtacttatatgacgctgttaaacactgtgtctaatttgggaggaaattggcctagcaccgtggccctgtggctggtcgaccctctaactgtgaaggaatgcgttggcgctagcaaccagaattgccgtacaccagacgctgtcgaattatgtaagaagctcggaggctcttgtgtaactgccttggacgggtactatgtggaatccataatatgcgtctttatagggtttggatggtggtttttcctcggaccaaagttcaaaaagctgcaggacgagggaagctcatcatggaaatgcaagagaaacaactag

SEQ ID NO: 241440 - DNA, 1920 bp, Artificial Sequence
  Description of Artificial Sequence: Synthetic coding sequence
atgctgagctatggggaacgcctgggatctcctgctgtctcccccttacccgtgaggggaggccacgtgatgcgtggcactgccttcgcctatgtcccctccccacaagtgttgcacagaatcccgggtacctcagcctatgccttcccttcactgggtccagtggcattggctgagcacacatgtccatgcggcgaggtccttgaacgccacgagccgctgcctgcgaaactggctcttgaagaagaacagaaacctgaaagtaggctggtgcccaaactgcgacaggcaggcgcaatgttactgaaagtgccattgatgctgacattcttatatctgtttgtgtgcagcctggacatgctctcaagcgctttccagctggcaggcggaaaggtcgctggcgatattttcaaggacaacgccattctaagtaatccggtcgccggtcttgtggtcggtattctcgtgacagtactggtgcagagctccagtacatccacaagtatcatcgtaagtatggtgagcagtggcttattggaagtgtctagcgccattcccattatcatgggtagcaatatcgggacaagtgtcacaaacaccatcgtggccctgatgcaggctggcgacagaaccgattttcggagagcattcgcaggtgcaactgtgcacgattgcttcaattggctatccgtgctcgtgctgttgcctctggaggccgctaccgggtatttgcaccacatcactcgattggtggtcgcaagctttaacatccacggcggaagagacgccccagatctgcttaaaatcattaccgaaccctttacaaagctcataatccagctcgatgaatctgtaatcacctcgatagctaccggagacgaatccttgagaaaccacagcctgattcagatctggtgccaccccgatagtctccaggcaccaactagcatgagccgggcagaagcgaactcaagccagaccctggggaacgctacaatggaaaagtgcaaccacatttttgtcgacacgggactgcccgacctggcagtaggcctgattctcctcgcaggtagtctcgttttactttgtacttgcctgattttgctggtcaagatgctcaattctttgctgaaagggcaggtcgccaaagtgattcagaaggtgatcaataccgattttccagctccttttacttgggtgacgggttattttgccatggtcgtaggtgctagcatgaccttcgtagtgcagtctagtagtgtgtttacctccgccataactccactaatcggcctgggggtgataagcattgaacgcgcataccccctgaccctagggtcgaatataggaacaacaaccacggctattctggctgctctcgcttctccacgggagaaactgtcaagcgccttccagatcgctctttgccattttttcttcaacatcagcggcatcttgttgtggtaccctgtgccatgtacccgactgcccatcagaatggccaaagccctgggaaaacgaacagccaagtacagatggttcgccgtgttgtacctcctggtatgtttcctcttgctcccctccctggtgtttgggatctctatggctggctggcaggtgatggtgggagtgggtactccgttcggagcactactggcctttgtcgtgttaatcaacgtcttacaatcaaggtccccgggacatctgcctaaatggttgcagacttgggatttcctaccccgatggatgcattcattaaaacctcttgaccacctgatcacacgcgcaaccctatgctgcgcacgcccagaacccagatcccctccactgcctcccagggtcttcctggaggagttgcctccagccaccccaagccctcgcctagcattgcctgcgcatcataacgccacacgcctgtag

SEQ ID NO: 241441 - DNA, 330 bp, Artificial Sequence
  Description of Artificial Sequence: Synthetic coding sequence
atgctctcctacggagagagattgggatctccggctgtctcgcctttgcccgtgcggggaggccacgtgatgaggggaactgcttttgcttacgtgccaagccctcaggtgctgcacaggattccaggcacatccgcatatgcatttccttctctgggcccagttgccctggccgaacacacatgtccatgcggagaggtgctggagcgacacgagcccttgcccgctaagttggcgctcgaagaggaacaaaaaccagaatcccggcttgttccaaaacttcgacaggcaggcgcaatgttactcaaggtgcccctcatgctgacatag

SEQ ID NO: 241442 - DNA, 1023 bp, Artificial Sequence
  Description of Artificial Sequence: Synthetic coding sequence
atgctgtcctatggagaacggttaggaagccccgcagtgagtcccttacccgtaaggggaggccatgtcatgaggggcaccgcctttgcttatgtgccatcaccacaggtactgcaccgcatcccagggacatctgcttacgctttccccagtttggggccagtagcactggccgaacacacatgcccttgcggtgaggtgctggaacgacatgagcctctcccagctaaactggccctggaggaggaacagaaacccgaatcccgcctggtacccaagcttcggcaggcgggagcgatgcttctgaaggtgccactgatgctcacatttctgtacctgttcgtttgcagtctcgacatgttgtcctcagcttttcagctggcgggagggaaggtagccggagatatcttcaaggacaacgccattctgtcgaaccctgtcgccggactggtagttggcatactcgtcacagtcctcgtgcagtccagtagcacctctacctccattattgtttccatggtgagcagtggcctccttgaagtctcctctgccatcccaatcattatgggctcaaacattgggacaagcgtcaccaatacaatcgtcgccctcatgcaggccggagatagaactgacttcaggcgagcgtttgccggtgccaccgtacacgactgctttaattggttgagtgtgctggtgttgttacccctcgaagcagcaactggttatctccaccacatcactaggttggtggtggcctcttttaatatccacgggggtcgggacgccccagatctgctcaagatcatcacagaaccattcactaagttaatcatccagttagatgaaagcgtcataacttccattgcaaccggggatgaaagtctccgtaaccatagtcttatccagatttggtgccaccccgactctctccagcagaatttggaagggcgagagatcactcactttgacctgaggaagaaacaagccatggaggacagttcggtgccccactgtccatag

SEQ ID NO: 241443 - DNA, 2073 bp, Artificial Sequence
  Description of Artificial Sequence: Synthetic coding sequence
atggcaccatggccagaactgggagatgctcagcctaaccctgacaaatatttagaaggtgctgccggtcagcagccaaccgcccctgacaaaagcaaggagactaataaaacggacaatactgaagcccctgtgaccaagattgagctcctcccttcctacagcaccgctaccctcatagacgagcctaccgaggtggacgacccctggaacctccctactctgcaggactcagggataaaatggagcgagcgggacaccaaaggaaaaatcctgtgtttttttcagggcattggaagattgatcttactgttggggttcctgtacttttttgtttgttccctggacatcctgagttccgctttccagctggttgggggaaagatggcaggacagttctttagcaatagcagcataatgagcaatccgctcttgggcctggtgatcggcgtcctggtcactgtgctggtgcagagctcgagcacctccacgtccatcgttgtctccatggtctcatcctccttgctgacagtcagggcagcaatccccatcatcatgggggctaatatcggaacctcaattactaatacaatcgtcgccttgatgcaggtcggagacaggtctgagttccgcagagctttcgccggagccacagtgcatgatttctttaattggctgagcgtcctcgtgctactgccagttgaggtggcaacccattacctcgaaattatcacacagcttattgtggagtcattccactttaaaaatggagaagatgctcctgacttgcttaaggtcattaccaagccgttcacgaagctcatagtgcaattagataagaaggtgatttctcagatcgctatgaacgatgaaaaggccaagaataagtcccttgtgaagatatggtgcaagacattcacgaacaagacacaaattaacgtcacagtgccaagcacagctaactgcacatctccaagtctgtgctggacagacggaatccagaactggaccatgaaaaacgtaacttacaaggagaatattgcaaagtgccagcatatcttcgtaaatttccacctgcctgatctagcagtaggaactattttgctgatcctgtcacttctcgtgctctgtgggtgcttgatcatgattgtgaaaattcttgggtcagtgcttaaaggccaagttgccaccgtgatcaagaagactataaacactgactttccctttcccttcgcctggctgaccggctacctcgcaatcctagttggcgctgggatgacctttatcgtccagagctcctctgtgttcacctccgcactcacccccctcataggcataggagtcatcacaatcgagcgagcttaccctctcaccctgggctccaacatcgggactaccactacggcaatcctggcagcgttggccagccccggtaacgcgctgcgctcaagtctgcagattgccctctgccattttttctttaatatttctggtatcctcctgtggtatccaattccatttaccagactgccaattcgaatggctaaggggctcggcaatatcagtgccaagtataggtggtttgccgtgttctacctcatcatatttttctttctaatccctttgaccgtgtttggactgtcattagctggatggagagtcctcgtcggagtcggagttcccgtggtgttcattattatcctcgtgctgtgcctgcggttactgcagtcccgttgccctagggtgctccctaagaagttgcaaaactggaacttccttccactgtggatgcggagtcttaaaccttgggatgctgtggtcagcaaattcaccggatgtttccagatgaggtgctgctgttgctgcagagtgtgttgccgcgcttgttgccttctctgcgactgcccaaagtgctgcagatgtagcaaatgttgcgaggacctagaagaagcgcaagagggccaggatgtgcccgtcaaagcacccgagacgtttgacaatataacgatttctagagaggcccaaggggaagtgcccgcaagcgattcaaaaactgaatgcactgctctgtag

SEQ ID NO: 241444 - DNA, 2070 bp, Artificial Sequence
  Description of Artificial Sequence: Synthetic coding sequence
atggccccatggcccgaactcggcgacgcccaacctaacccagataaatatctcgaaggagccgctggtcagcagcctactgcgccagataagagcaaagaaactaataagaataataccgaggcccctgttaccaagatagaactgcttccctcgtacagtacagcaacgttgatcgatgagccaacagaggtggacgatccctggaaccttcctaccttgcaggactccggtatcaaatggtccgaacgcgacactaaaggaaagattctatgcttttttcaaggcattggcaggctgatcctcctgttgggattcctttacttttttgtgtgttctctggacattctctcatctgcatttcagcttgtgggaggaaaaatggccggacagtttttttctaacagtagtattatgtcaaatcccctcctcggtctcgtaatcggcgtacttgtcaccgttttagttcaatcgagctctacctctactagtatcgttgtaagcatggtgtcatcctcgttactgaccgtaagggcagctatccccataataatgggcgcaaacatcggcacatctatcaccaacactattgtcgcccttatgcaagtcggcgatagaagtgaatttagacgagcgttcgctggcgcaactgtgcacgactttttcaactggctcagcgtgctggttctgctacctgttgaggtcgctactcactacctggagattattactcagctgatcgttgaatcttttcacttcaaaaacggagaggacgcacctgatctcctgaaagttattactaaaccattcacaaagctcatagttcaactagacaaaaaggtaatatcccagatcgccatgaatgacgagaaggcgaagaataagtccctggtcaagatctggtgcaagacattcaccaacaagacccagatcaacgtgaccgtgcccagcacagcaaattgcacatctccaagtctctgctggacagatggtatacaaaattggaccatgaaaaatgtgacatacaaggagaatatcgcgaaatgtcagcacatctttgtgaattttcatttaccagatctggccgtagggactatcctactgatactgtcactgcttgtcctgtgcgggtgcctcattatgatcgtgaagatcctgggctccgtgctgaaagggcaggtggcaacagtcattaagaagacaatcaataccgactttcctttccccttcgcttggctcaccggatatctcgccattctcgtcggtgcaggtatgacttttatcgttcagagttctagcgtttttacttctgcacttacccctctgataggtatcggcgtcataactatagaaagggcctaccccctgacattgggaagcaacatcggcacgactaccaccgccatcctggctgcgctagccagccctggcaacgctctgagaagttctctgcagattgccctgtgccactttttttttaatatctccgggatcctactctggtatccaattccatttaccagattaccaatccggatggccaaaggcctgggcaacatatctgccaagtaccgctggttcgcagttttttacttgattattttcttcttcctaatccctctgactgtgtttggcctgtccctggcaggctggcgcgtgctcgtgggagtgggtgtgcctgtggtgttcattattatccttgttctttgtctgcggctgctgcagtcgcgctgtcccagagtgctgcctaaaaagttgcagaactggaacttcctgcctttatggatgagaagtctgaagccatgggatgcggtggtgagtaagttcactggttgcttccagatgaggtgttgttgttgctgcagagtgtgctgtcgggcatgctgtcttctgtgcgactgccctaaatgttgtcggtgttctaagtgctgtgaagatttggaggaagcacaagaagggcaggatgtccctgttaaggcccctgaaacctttgacaacatcacaatctctcgagaggctcagggcgaagtgcctgcttctgattctaaaacagagtgcacagctctatag

SEQ ID NO: 241445 - DNA, 2070 bp, Artificial Sequence
  Description of Artificial Sequence: Synthetic coding sequence
atggctccttggcccgagctgggtgacgcccaacctaatccagacaagtacctcgagggagcggctggacagcagcctaccgccccagataaaagtaaagaaaccaataagaataatacggaggctcctgtgactaagatcgagctcctgcccagctattccaccgcaacattgatcgacgagccgacagaagttgatgacccatggaacctccccaccttacaagacagcggaattaagtggagcgagcgagacaccaaagggaaaatcctgtgttttttccagggaatagggcgactaatccttctgctcgggttcctgtattttttcgtgtgttccctcgacatattaagttcagcttttcaacttgtcggcggaaaaatggctgggcaatttttcagcaacagctctataatgtctaaccctctcctaggcctggttatcggcgtgcttgtgacggtgctggtgcagagctcatccaccagcacaagcattgtggtgagcatggtgtctagtagcctgctaaccgtgagggccgctattcccatcattatgggcgctaatataggcacatcgattacaaacacaatcgttgcattaatgcaggtcggtgatagatccgaattccggcgtgcatttgccggtgctacagtccatgatttctttaattggctgagcgtgcttgttctgctccccgtagaggtggccactcactatttggagataattactcagctgatcgtggagagttttcacttcaagaacggcgaagacgcgcctgatctcctgaaggtgattaccaagccatttaccaagttgatcgtccagctggataaaaaggtaatcagccagatcgcaatgaatgatgagaaagctaaaaacaagagtcttgtgaagatttggtgtaagaccttcactaacaagacccagataaacgtgaccgttccgagcacagcaaattgtacctctcctagcctttgctggacagacggaatccagaactggaccatgaaaaatgtgacttacaaagaaaatattgctaagtgccagcacatcttcgtgaattttcacttgccagacctggctgttgggacgatactgctcatcttgtctttactcgtgctatgtggctgcctgatcatgatcgtgaaaatcctgggctccgtgctgaaaggccaggtggctacagttattaaaaagaccatcaatactgatttccccttccccttcgcctggctcacgggatacctggccatccttgtgggagctggcatgacgttcatcgtccaatcttccagcgtgtttaccagcgccctcactcccttaatcggaattggcgttattaccattgagcgtgcctatcctctgaccttgggctctaacatcgggaccactactacagccatcctcgccgctctggcctccccagggaacgctttgaggagttccctccagattgcgctgtgtcatttcttttttaacatttctggaattctgctctggtatccgattcctttcactaggcttcccatccgaatggccaagggcctcggtaatatatcagccaaatataggtggtttgctgtgttttatctgattatcttcttctttttaatccccctgaccgtgtttggactctctctggctggttggagggttctcgttggtgtgggcgtgcccgtggtctttattattattttagtgctgtgcctgagacttttgcagtcacgctgtcccagagtattgcctaagaagctgcagaactggaactttttgccgttatggatgagatccctgaagccctgggacgctgtagtgtccaagttcactggctgctttcagatgcggtgttgttgttgctgccgcgtgtgctgtagagcatgttgtttactgtgtgattgccctaaatgttgtagatgcagcaagtgttgtgaggacctggaggaggcacaggaggggcaggatgttccagttaaggcacccgagacttttgacaacatcaccatttccagagaagctcagggggaagtaccagctagcgacagtaagacagagtgtaccgctctgtag

SEQ ID NO: 241446 - DNA, 486 bp, Artificial Sequence
  Description of Artificial Sequence: Synthetic coding sequence
atggcaccttggccagagttgggcgatgcccagcccaatcccgacaaatacctggaaggggctgccggtcagcaacccactgccccagacaaatccaaggaaacaaacaagactgacaatacagaagctccagtcactaaaatcgaacttctaccctcctattcgaccgcaaccctgattgatgagcccactgaggttgacgacccctggaatctccccacactgcaggactcaggcataaaatggtctgagcgcgacacaaaaggaaagattctgtgtttctttcaggggataggaagattaattctgctattaggattcctttacttttttgtgtgttctctggatatactgagttcggccttccagctcgtgggaggaaaaatggccggacaatttttctcaaattcctctatcatgagcaacccactccttggtttggtaatcggagtgttagtgacagtgctggtgcagtcgtcatcctag

SEQ ID NO: 241447 - DNA, 492 bp, Artificial Sequence
  Description of Artificial Sequence: Synthetic coding sequence
atggctccttggcccgagctcggggatgcacagcccaaccctgataagtatcttgagggcgctgcagggcaacagccgacagccccagataaatcgaaagaaacaaataagaacaataccgaagcccctgtgaccaagatcgaactgctgccctcttattcaaccgcgacattaatcgacgagcccacagaagttgacgacccctggaacctgccaactctgcaggacagcggaatcaagtggtccgaacgggatactaagggtaagatcctgtgctttttccagggaataggaagattgatcctgttactgggttttctctactttttcgtctgctccctggatatcctctcgtctgcttttcaactggttggtggcaaaatggctggacagtttttctcgaacagttccattatgagtaatccattactcggtctggtgattggagtacttgtcacagtccttgttcaaagttctagtactagcacctag

SEQ ID NO: 241448 - DNA, 1800 bp, Artificial Sequence
  Description of Artificial Sequence: Synthetic coding sequence
atgccatcttccctcccaggctctcaggtaccgcaccctacactcgatgctgtcgacctggtggaaaaaactctgcggaacgagggaacgagctcatcagctcctgtcctggaggagggcgatacagacccatggactctgcctcagctgaaggatactagtcagccatggaaagaactgcgtgtagcaggccgtctcaggagggtagctgggtccgtgctgaaagcctgcggcctgttgggctcattatatttcttcatatgctctctcgacgttttgagctcagcgttccagctgttggggtctaaagtagccggagacatatttaaggataatgtcgtgctgagtaaccctgtggcgggtctggtcatcggcgtcctggtcacagcgctcgtccagagtagcagcactagctccagcattgttgtgagcatggtggcagctaaactgctcactgtccgcgtgtccgtgccgatcattatgggggtcaatgtcggaaccagcataacatctacactggtttccatggctcaatcgggcgaccgggacgaattccagcgcgctttctccggttcagccgtccacggaatattcaactggctcacggtgttagttttgcttcccctggaaagcgccacggcgctgctggaacggctcagcgagctcgctttgggtgctgcgagcctcacaccccgagcacaagccccagacatccttaaggtgctgacgaaacctctaactcacctcattgtgcagttagattctgatatgatcatgtctagcgccacgggaaatgcgactaactcatcgctgattaagcactggtgtggaacaactggccagccaactcaggaaaatagcagctgtggcgctttcggaccctgcactgagaagaattcgactgcacccgcagaccgcctgccctgtcgccacttgttcgcaggaacggaattgactgatctcgcggtggggtgcattctgttggcaggatctctcctggtgctatgtggttgcttagtcctaattgtgaagttgttgaacagtgtccttcggggacgggttgcgcaggtcgtccgcaccgtgatcaacgccgatttcccattcccattgggatggctggggggatatctggcagtgctcgcaggtgcgggtttgacatttgcccttcagagttcatctgtatttacagctgcggtcgtgccgcttatgggagtaggcgttattagcctggacagggcctatcctctgctgctgggtagcaacattggcacgacaactacggctctcctagcagcacttgcatctcctgctgacaggatgctttccgctttgcaagtcgcactgatacatttcttcttcaatctggctggtatcttactgtggtacctcgtgcctgctctgcggcttccaataccattggccaggcattttggcgttgtgacagcccgttaccgctgggtggccggagtgtatctgttgttgggattcttgctgcttccgctggccgcattcggcctttctctggccggaggaatggaacttgcggcagtgggagggccattggtggggttggtcttactagtgatcctcgtgactgtactccagcgcagacgacccgcatggctgccggtgcgtctgcgctcttgggcctggctcccagtttggctgcattccctggaaccatgggacagactggtgacgaggtgttgcccatgtaatgtttgtagcccgcctaaggcaaccaccaaggaggcatactgctatgagaaccccgagatcctggcgtcccagcaactgtag

SEQ ID NO: 241449 - DNA, 1800 bp, Artificial Sequence
  Description of Artificial Sequence: Synthetic coding sequence
atgccttcttccctgcccggatctcaggtgccccatccaactctggacgcagtcgatcttgtggagaagacacttcggaatgaaggtacttcaagctcggctcctgtgcttgaggaaggagataccgacccatggactcttcctcagctaaaagacacttctcagccttggaaggaattaagggtggcagggaggttacgcagggtggccggaagtgtgctgaaagcttgcggattactgggctcactctatttctttatctgctcactcgatgtgctgtcaagtgcatttcagctgttggggagcaaggtggctggtgacattttcaaggataatgttgttctctccaatccagtggccggactggtgattggagtcctggttaccgctctggttcaatcatcatccacctcgtctagtattgtggtttccatggtggcagctaaattactgacagttcgcgtgtccgtaccaatcatcatgggggtgaatgtggggacctctattacctctaccctcgtgtctatggcacagtcgggagaccgcgatgaatttcagcgggctttctccggttccgcagtacatggtatcttcaattggctaaccgtgctggtccttctgccactcgagtctgccacggctctcctagaacggctgtccgagctggccctgggtgcagcctcgctgactcccagagcgcaggctccagatattctgaaagtgctcaccaaaccactcacgcatctgatcgtgcagcttgatagcgatatgatcatgagcagtgcaaccgggaacgctaccaatagctccctgattaagcactggtgcggcaccacagggcagcctacccaggagaatagcagttgcggcgcatttgggccttgtactgaaaaaaatagcactgctcccgcagatagacttccgtgtagacatctctttgccggaacggaattgacagatcttgctgttggatgcatcttactggctggcagcttgctggtgttatgcggctgtctggtattgatcgtaaaactgctgaactccgtgctgcgcggacgtgtcgcgcaagtcgtcagaacagtcatcaatgctgactttccatttcccctgggctggttggggggatacctcgctgtccttgcaggagcaggcctgacctttgcactgcagtcatcttcagtattcactgccgctgtcgttcccctgatgggagtgggagttatttctctggatagagcctaccccctcttactagggtcaaacatcggaaccaccaccacagcgttactcgctgccctagcttctccggctgatagaatgctgtcggcattacaggtcgccctgatacactttttcttcaacctggccggaatactgctttggtatctggtgcctgccctcaggttgccgattccactggcccgacactttggtgtcgtgaccgctagatatagatgggtggcaggtgtgtatctgcttctggggttcttactgctaccacttgccgctttcgggctgagtcttgcaggcggaatggagctcgccgcagtcggtgggccactggttggcttagtgctattggtaatcctggtgaccgtcttacagagacgcaggcctgcctggctcccagttcgccttcgttcctgggcctggctccccgtttggctccatagcctggaaccttgggataggcttgtcacccggtgttgcccctgcaatgtgtgctctcctccaaaggcaacgacgaaagaggcgtattgttacgagaatcccgagatactggccagccagcagctctag

SEQ ID NO: 241450 - DNA, 570 bp, Artificial Sequence
  Description of Artificial Sequence: Synthetic coding sequence
atgaccctaatggcagcggtctataccattgctctaagatacacccgaacatctgacaaagagctgtatttcagtacaaccgcggtgtgtattaccgaggttatcaagttgctgctctctgtcggtatcttggctaaagagaccggctccttaggcagattcaaggccagcttaagagaaaacgttctaggatcaccaaaggaactgctcaagctatctgttccttccctggtgtatgccgtgcaaaataacatggcctttctcgccctttctaatctggacgccgctgtttaccaagtgacatatcagctaaagattccctgtactgcactttgcaccgtccttatgcttaatcgaacgttgtccaaacttcagtgggtgtcagtttttatgttatgcgccggtgtaacactggtgcaatggaagcccgctcaggccaccaaggtcgtcgagtatatcctgaaaaagtttaaggagttcaggtattttagtctgggagagaagcactcgaacgttagcatcagggactattgtgacatcagctggaggctactcgtacgatggtcctag

SEQ ID NO: 241451 - DNA, 1014 bp, Artificial Sequence
  Description of Artificial Sequence: Synthetic coding sequence
atggctgctccacgggataatgtgactttattgtttaaattatattgcctggcagtgatgactttgatggccgctgtgtatacgatcgctttaaggtatacaagaacatccgataaggaactctatttcagtacaaccgccgtctgcatcactgaggtgattaagctgctcctgagtgttggaatcctggccaaagagactgggtctctcggaaggttcaaggcttctctccgagagaatgtacttgggtccccaaaagagttgcttaagctgtcagtgcccagcctcgtttacgccgtccagaataacatggccttcttggctctttcaaatctcgatgccgctgtctaccaggtgacttaccaactgaaaattccatgtacagctttgtgtacggtgctgatgctaaatcgcaccctaagtaagctgcagtgggtcagcgtgtttatgctttgtgcaggagtcaccttggtccagtggaagcctgcccaggcaacaaaggtggtggtggaacaaaacccacttctgggattcggggctatcgccatcgccgtgctatgctctggctttgccggtgtgtacttcgagaaggtgctgaagtcaagcgatacgagcctttgggtgcggaacatccagatgtatctctccggcatcatcgtgacccttgctggagtttaccttagtgacggagctgagatcaaggagaaggggtttttttatgggtacacttactacgtctggtttgtgatcttccttgcttcagtgggcggactgtatacatccgtggtcgtgaagtacactgacaatatcatgaagggcttttcagccgctgcggctatcgttctatctacaatcgcctcagtcatgttattcgggctgcagattactctgactttcgccctgggtaccctattagtttgtgtcagtatctatttgtatggtctcccacgccaggacacaaccagcatccagcaaggagaaaccgccagcaaggagcgggtcattggagtgtag

SEQ ID NO: 241452 - DNA, 837 bp, Artificial Sequence
  Description of Artificial Sequence: Synthetic coding sequence
atggctgcccctagggacaacgttactctactattcaagctgtactgtctggccgttatgaccctaatggccgcagtgtatacaatagcccttagatacaccaggacatccgacaaggagctttacttctctaccacagcggtgtgcattactgaggtcattaagctgctgttgtcggtgggtatcctggccaaggaaacaggctcactggggcgtttcaaagcaagcctgagagaaaacgttcttggaagtcctaaggaactgttgaagttgtctgtgccttccctcgtctatgctgtgcagaacaacatggcattccttgcactgtcaaatctggatgccgcagtctaccaggtgacctaccaactaaagataccttgtactgcactgtgtactgtgctgatgttgaatagaactctgagcaaactgcaatgggtcagtgtattcatgctctgcgccggagttacattggtgcaatggaaacccgcacaggccactaaggtcgtcgtggagcagaatcccttgctgggcttcggtgccatcgcaatagctgttttgtgctcaggatttgctgtgctggccagtgtgggaggcctttacacctctgtcgtagtcaagtacacggacaacatcatgaaaggattctccgctgctgctgctatcgtcctaagcacgatcgcctctgtgatgctgtttggactgcagattaccctcactttcgcactcggtactttgctggtgtgtgtcagtatctatttgtatgggctcccaagacaggatacgacatccatccagcagggcgaaaccgccagcaaagagagggtgatcggggtgtag

SEQ ID NO: 241453 - DNA, 570 bp, Artificial Sequence
  Description of Artificial Sequence: Synthetic coding sequence
atggccgcaccaagggacaacgtcaccttgctgttcaaactgtactgtctggcagtgatgacattgatggctgctgtatataccatcgcgctccggtatacacggacctcagataaagaactgtacttttctacgacagctgtttgtataaccgaggttataaagctgttgcttagtgtaggcattctcgccaaagaaacggggtcgctgggcaggttcaaggcaagcctgcgagagaatgtgctggggtcccctaaagagctgctgaaactttctgttccaagtcttgtgtacgccgttcagaacaacatggccttcctggctctttctaacctcgatgccgctgtgtaccaagtcacatatcagctgaaaatcccctgcaccgccttgtgcaccgtgctcatgctgaatagaacactgagcaagctgcaatgggtcagtgtgtttatgctgtgtgctggcgtcacactagtccaatggaaacccgctcaagccactaaggttgtctttctgcaggttcttgtcgcgtcaaccttactcctctggctatctacacagacaacatcctag

SEQ ID NO: 241454 - DNA, 537 bp, Artificial Sequence
  Description of Artificial Sequence: Synthetic coding sequence
atggcggctcctagggacaacgtgactttgctattcaagctgtattgcctggcggtgatgaccttgatggccgctgtgtacacaatagcattacgctacaccaggaccagcgataaggagctgtacttctcaaccaccgcagtgtgtattacagaagtcatcaaactattgctttccgtgggcatcctagccaaggaaactggcagtctggggcgattcaaggccagcctgcgagagaacgtcctgggcagtcctaaggaacttctgaaactgtccgtaccatcccttgtttatgctgtgcagaataatatggcatttctggcactgtctaacctggatgcggcagtttaccaggtgacctaccagctcaaaattccttgcaccgcactgtgtacagtgttaatgctgaaccgcaccctcagcaagttacagaagaaagacttctccatggttacgcacatcatgtcaggacttagctcggtcagcatccaggagctgaaggtgctgtctcgatcatttatttttttcctgtcgtag

SEQ ID NO: 241455 - DNA, 612 bp, Artificial Sequence
  Description of Artificial Sequence: Synthetic coding sequence
atgcttaaccgtaccctgtccaaactgcagtgggtttcagtgttcatgctctgtgctggggtgacacttgtgcaatggaaaccagctcaggcaaccaaggtggtggtggagcagaatcctctccttgggttcggcgcaattgcaattgccgtgttgtgtagcggattcgcaggagtatactttgaaaaggtccttaaaagctcagacaccagtttatgggtgcggaacatccagatgtacctgtccggcattatcgttactttggcaggagtgtacctgagcgacggcgcagagatcaaggagaagggcttcttttacggatatacttattatgtgtggttcgttatctttctagcttcagtggggggtctttacacttccgtggtggtcaaatataccgacaatatcatgaagggattctccgccgctgccgcaatagtcttgtccaccattgccagcgtgatgctattcgggttgcaaatcacgcttacctttgcgctggggacgctgttggtatgtgtgtctatctatctgtacgggctgccccgacaggatactacctccattcagcagggcgagacagcctccaaagagagggtgatcggagtgtag

SEQ ID NO: 241456 - DNA, 1191 bp, Artificial Sequence
  Description of Artificial Sequence: Synthetic coding sequence
atggccgcagtgggcgctggcggttccaccgctgctcctgggcctggtgccgtgtccgctggtgccttagaacccggaactgcctctgccgcacaccgcagactgaaatatatctctctggccgtgctagtggtccaaaatgcctcacttatcctgtctattagatacgcacggaccctcccaggcgaccggtttttcgccacaaccgcagttgttatggctgaagtgctgaaagggttgacctgcctactgctcctgtttgcgcagaaacgaggtaacgtgaagcacctggtcctcttcctgcacgaggcggtgctggtgcaatatgtggacacattgaaattagcagtgcccagtttaatttatacgctacaaaataacctccagtacgtggccatatctaatctccctgcagctactttccaggtgacgtaccagctcaaaatcctgacaactgccctgttcagtgtgctgatgctaaatcgttccctttcccgcctccaatgggcatcccttcttctgctgttcacaggcgtcgctatcgtgcaggcccagcaggcaggcggaggcggacccaggcccctggatcagaatcctggtgctggtcttgccgctgtggttgcttcctgcttgagctccggcttcgccggtgtatattttgagaagatcttgaagggttcatccggtagcgtgtggctgcggaatctccagctggggttgttcggcacggccttaggacttgttgggttgtggtgggcagagggaaccgctgtcgctacaagggggttcttcttcggatacacaccggcagtgtggggagtggtcctcaatcaagcatttgggggactattggtcgccgtggtggtgaaatatgctgataacatcttgaagggctttgccactagccttagcatcgtgctgtccaccgtcgcgagtataagattgtttggatttcacgttgacccccttttcgccttgggtgcaggcctggtgattggcgcagtgtacttgtattctcttcctcgcggtgccgctaaggcaatcgccagtgcttccgcatctgcatctggcccttgcgtgcaccagcagcccccaggccagccaccccctccacagctttccagccaccgaggtgatcttatcacagagcccttcctgccaaagctgctgacaaaggtgaagggttcctag

SEQ ID NO: 241457 - DNA, 492 bp, Artificial Sequence
  Description of Artificial Sequence: Synthetic coding sequence
atggctgccgtcggcgcaggcggatctacagccgctccaggacccggagcagtttcagctggagcgctagaacccggaaccgcatctgcggcacaccggaggctaaagtacatctcactcgcggtgttagttgtacagaacgcttcactgatactatccatcagatatgccagaaccttacccggtgatcgtttttttgccacgacagccgttgtgatggctgaggtgcttaaaggtttaacatgcttattactcctgttcgcccagaagagaggtaacgtgaaacacttggttctgttcctccacgaggcggtgctggtccagtacgtagacactttaaagctggccgtgcccagtctaatctacaccctacagaacaacctgcagtacgtggctatatccaacctacccgctgccacctttcaggttagtccaaagccatccatggcaccagaagagcttaccgggctgggcacaggggtgtgggagtag

SEQ ID NO: 241458 - DNA, 657 bp, Artificial Sequence
  Description of Artificial Sequence: Synthetic coding sequence
atgaagttgtgccgagacgcccataggcgcttaaagtacatatcactcgcagttttggtcgtacaaaacgcatcacttatcctcagcatccgctacgcaaggacgctcccaggcgatagattttttgcaactactgctgtagttatggccgaggttctcaagggactgacctgtcttctgttactgttcgcgcagaagagaggcaacgtcaaacaccttgtgctgttcctgcatgaggccgtactggttcagtacgtagacacgctgaagctggcagttccttctttgatctataccttacaaaacaatctgcagtacgttgccatctcgaaccttcctgccgctacatttcagccatccccacggtgcagccaaagccacagcttatgcttatgcctcagactccgggcacttaggagtcctgcagcctcacgagcggctacgactactgctgctgtctttcccccatggcgccctcatcatggggctctgtccgcaaaagtatctgcgggagaggtgcgagcgggttccaatgggggtacgcaggggagaggaaccggcgtggagggagtgggccatcttcaggatccaagccggcatccccctggtccaggaagctccggcttcgggcgatggagtttcctgccaggccactag

SEQ ID NO: 241459 - DNA, 1182 bp, Artificial Sequence
  Description of Artificial Sequence: Synthetic coding sequence
atggcagctgtgggagctggtggatccaccgcagctcccggacctggtgccgtgtctgcaggagctctggagcctggcacagcatctgccgcacacaggcgcttgaagtacatctctcttgctgttttggtggtgcagaacgcttcactcatcttgtctatccggtacgcaagaacactgcccggagatagattctttgctactactgccgtggtcatggccgaggtattgaaaggccttacatgtctcctgctcctgttcgcccagaagaggggcaacgtcaagcacttagtgctatttctgcatgaagccgtactggtgcagtatgtcgataccctaaagctggcagttccttcactcatctacacgttacaaaataaccttcagtacgtggctatatccaacctaccagctgccacgttccaggtgacctatcagcttaagatcctgaccaccgcactgttctcggtgctgatgctgaatcggtctctctctcgcctacagtgggcatccctactcctactgttcacaggtgtggccatagttcaggctcaacaagcagggggaggcggtcctcgccctctagaccaaaatccgggagcaggtctagctgcagtcgtggcctcctgcctttcttccggatttgcgggtgtctatttcgaaaagattctaaaaggttccagtggcagcgtctggcttagaaacttacagctcggcctattcggcaccgccctgggcttagttgggctgtggtgggccgagggaaccgctgtagccaccagaggctttttcttcggttacaccccggcagtgtggggggtggtgttgaatcaggccttcggcggactcttggtggctgtggtcgtcaaatacgctgacaacatcctgaaaggattcgctaccagcctgtcaattgtgttgtcaaccgtggcttctatccggcttttcggatttcatgtggacccgctttttgccttgggcgcaggtctggtcatcggggctgtttacctgtatagcctgcccagaggggctgcaaaggctatcgcgtcagcatccgcctcagcgtctggtccctgtgtccatcaacagcccccaggtcagccacctcctccccagctctcttcacataggggagacctcatcactgaaccgttcctgcccaagagcgttcttgtaaaatag

SEQ ID NO: 241460 - DNA, 675 bp, Artificial Sequence
  Description of Artificial Sequence: Synthetic coding sequence
atggccgctgtaggcgcagggggatcaaccgcggctccgggacccggtgccgtgtctgcaggagccctagaacccggaacggcctccgcggcacatagacggttgaagtatatctctctggctgtgctggtggtgcaaaatgcaagcttaattttgtcaatccgctacgccaggaccctgcctggcgacagattcttcgccaccacagcagtggtgatggcagaggtgttgaaagggctgacttgcctgcttctcctgttcgcacagaaacgtggaaatgtcaaacacctggtgcttttcttgcacgaggccgtcctcgtgcaatatgtggacaccctgaaactcgctgtgcctagtttaatctacaccctgcagaataatctgcaatacgtcgccatcagcaacctaccagctgcaacgtttcagccatcgcccagatgttcccaaagccacagcctgtgcttatgtttgcgcttacgtgcacttcgatcccctgcggctagtcgggctgccaccaccaccgctgctgtctttccaccttggagacctcatcacggagccctatcggcaaaggtggcccaccagggtgaggggttcctggccgctggcatcgaggatattggcctggcctcattctctctgcttgccctgggtccggctgggactaagctctag

SEQ ID NO: 241461 - DNA, 999 bp, Artificial Sequence
  Description of Artificial Sequence: Synthetic coding sequence
atggcggctgtgggggcaggcggatctacggctgctccaggacccggagccgtctcggccggagccctggagcctggaactgcaagtgccggaaacgtaaaacacctggtgctctttttacacgaggctgttctcgtccagtatgtagatactctcaaactggccgttcccagcctgatctacacgctccagaacaatctgcagtatgtcgcaatttccaatctcccagcagcaacttttcaggtcacatatcaacttaagatcctgaccacagcgctgttctcggtgctcatgcttaacaggtccctcagccggctgcagtgggccagccttttactactctttaccggagtagccatcgtgcaggctcagcaggccggaggcggaggcccacgccctctggaccagaaccctggggctggccttgccgctgtagttgcgtcttgcttgtcttctggtttcgcgggagtgtactttgaaaaaatcctaaagggctcttccggatcagtatggctgagaaatctacaactggggctattcggcaccgccttaggattggtcggcctgtggtgggcagaagggacagcggtcgctacacgaggatttttttttggatacacaccagcagtatggggcgtagtcctcaatcaggcattcggtggattattggttgccgttgtggttaaatacgccgacaacatactgaaggggttcgctacctcattgtctatcgtactgtccactgtcgcctccatacgactgttcggtttccacgtggacccgctgtttgccctgggcgctgggcttgtgatcggtgccgtgtacttgtactcattacccagaggagctgctaaggcaattgcaagcgcatcagcctcagcaagtggcccttgtgtgcatcaacagcctcccggacagcctccccctcctcagctctcctctcatcggggagacctcatcaccgaaccatttttgcccaagtccgtactggtaaaatag

SEQ ID NO: 241462 - DNA, 729 bp, Artificial Sequence
  Description of Artificial Sequence: Synthetic coding sequence
atggcagccgtcggtgctggcggtagcaccgcggctcctgggccaggggcagtgtctgcaggcgcactggagccaggaacagccagcgctgcacaccgaagactgaagtacatttcgctggccgtgcttgtcgtccagaatgcgagcctaatcctgagcatacgctacgcacggactctgcctggcgatcggttctttgcgactacagctgtcgtgatggccgaagtccttaaggggctaacctgcctcctcctgctgttcgcccagaaaagagggaacgtgaagcatctggtactgttcctccacgaagccgtcctggtgcaatatgtggatacactcaaactcgctgttcctagcttgatttacacactccagaacaatctccagtacgtcgcgataagcaatctgccagcggctacttttcaaccaagtcctcggtgttcccaaagtcactccctgtgcctgtgcctgaggctgcgcgcactaagaagtcctgctgcttccagagctgcaacgaccactgccgctgtatttcctccttggcgtccccaccacggagctctgagcgccaaagtctccgcaggcgaggtccgtgccggatccaatggaggtacccagggtcggggaaccggggtggaaggtgtggggcacctgcaggaccctagcagacatccgcctggacccggaagctcgggcttcggtcggtggagctttctgcctgggcattag

SEQ ID NO: 241463 - DNA, 531 bp, Artificial Sequence
  Description of Artificial Sequence: Synthetic coding sequence
atggcagaggtgctgaagggcctaacatgcctcttgttgctattcgcccagaagagggggaacgtgaaacatctggtcctttttctccatgaggctgtgctggtgcagtacgtggataccttgaagcttgccgttcccagcctgatctacactctccagaataatcttcagtacgtggccatttctaatctccctgcagccacttttcaggtaacctatcagctgaaaatactgacaacagccttgttttccgttctcatgcttaataggtctctcagccgactgcagtgggcgagtctgcttctgctcttcactggagtggctattgtacaggctcagcaggcaggtggtggaggtccacgacccctggaccaaaatccaggcgcaggactggcggcagtggtggcaagttgtctgtcaagcggcttcgcaggcgtgtatttcgagaaaattctgaagggtagcagcggatccgtgtggctcaggaatctgcagctggggcttttcgggaccgcccttgggcttgtgtag

SEQ ID NO: 241464 - DNA, 1266 bp, Artificial Sequence
  Description of Artificial Sequence: Synthetic coding sequence
atggctgctgttggggctggcggatctacggctgctccagggccaggagctgtcagcgccggagctcttgagcctgggacagcctcagcggaacttctcctgacatgggaggaagccgaggctagaggccaaggcctcccacagcctttgccagatacaagcgttcggatccctgcgcatcgaaggttaaagtatatttccttagcagtcctagttgttcagaacgctagcctgatcctatccatccggtacgcccgtacgctgcccggagacagatttttcgctacgactgccgtcgtgatggccgaggtgcttaaaggcctcacctgcctcctgctcctgttcgcccaaaaaaggggtaacgtgaagcacctggtgctttttctccatgaagcagttcttgtacagtacgttgataccttgaagcttgctgtcccgagccttatatatacgctgcagaataatctgcagtatgtcgctatctccaacctcccagccgcaacctttcaagtgacgtatcagctcaaaatcttaacgaccgcgctgttcagcgtgttgatgttgaacagatctcttagtaggctgcagtgggcctcacttttgctgctgttcacgggagtagcgatagtccaggctcaacaagccggaggtggcggacccaggccactcgatcagaacccaggtgctggactggcagcagtggtggcctcttgtctgagtagcggtttcgcgggagtgtatttcgaaaagattctcaaaggcagtagcggcagcgtgtggctacgaaacctgcagctggggctgtttggcacagcactcgggctcgtgggattgtggtgggcagagggaacagctgtagccacacggggtttcttcttcggatatactcctgctgtttggggcgttgtgctgaaccaggcctttggcggactgctagtggcggtcgttgtgaagtatgcggacaacatcctcaaaggattcgctacatccctgtctatcgttctgtctaccgtcgctagtatcagattgttcggtttccacgtggatccattattcgccctaggcgctggattggtgatcggagccgtgtatttgtacagcttgcctagaggtgccgctaaggctatcgcctccgctagtgcaagcgccagcggcccttgcgttcaccagcagccgcctggccagcctccaccaccacagctgagctcccataggggcgacctcatcactgagccattcctgccgaagtctgtgctggtgaaatag

SEQ ID NO: 241465 - DNA, 1068 bp, Artificial Sequence
  Description of Artificial Sequence: Synthetic coding sequence
atggccgaggtgcataggagacaacatgcccgtgttaaaggggaagccccagcaaagagcagtacactccgcgacgaggaggagctcggtatggcctcagccgagacgctaacagtgtttctgaaactgttagctgccggattctatggcgtgagttctttcctgatcgtggtggttaataaaagcgtactgacaaactataggtttccctcgagcctgtgcgttggtttgggccagatggtagccaccgtggctgttctctgggttgggaaagccctgagagtcgtgaaatttccagatctggataggaatgttccaagaaagacctttccactacctctgctgtacttcggaaatcagataacgggcctcttttccaccaaaaagttaaaccttcccatgtttaccgttttgagaaggttttcgatactgttcactatgttcgctgaaggagttctgctgaagaagacatttagctgggggataaagatgacggtgtttgctatgatcatcggagcttttgtggcggctagcagcgatctcgccttcgacctagaaggctacgcctttattttaatcaatgatgtcctcacagccgcaaatggcgcatatgtgaaacagaagctggattcgaaagagctggggaagtacggacttctgtactataatgcgctgttcatgatcttgccaactttagccatcgcctactttactggggatgctcagaaggcggttgagtttgaaggctgggccgacactctgttcctgctgcaatttacccttagctgcgtcatgggctttatcctgatgtacgctacagtgctgtgtacacagtacaattcagccttaacgactaccattgtaggctgcattaagaacattttaatcacatacatcggaatggtatttggcggagattacatctttacctggaccaacttcatcgggctcaatatctcaattgctgggagtctggtctacagctatatcactttcactgaggagcagcttagcaagcagagcgaggccaacaacaagctggacattaagggaaaaggcgcagtgtag

SEQ ID NO: 241466 - DNA, 783 bp, Artificial Sequence
  Description of Artificial Sequence: Synthetic coding sequence
atggttgctacagttgcagtcttgtgggtgggaaaagccctccgggtggtgaagtttccggacctggataggaacgtgcctcgaaagacttttcccctcccactcctttacttcggaaatcagattacaggattgttttccactaaaaaattgaacctaccaatgtttacagtcctacgtcgcttttcaatccttttcacgatgtttgcagagggagtgctactcaaaaaaactttttcctggggcataaaaatgactgtctttgcgatgattatcggagctttcgtggcagccagttcagatttagcgtttgatcttgagggttacgccttcatcctgatcaacgatgtgctgactgccgcaaacggtgcctacgtgaagcagaaactagatagtaaggagttaggtaagtatggactgttatattacaacgcgctgtttatgatcttaccgaccctggctatcgcctacttcaccggcgatgctcagaaagcagtggagtttgaaggctgggccgacactctgtttctcttgcagttcacgctgagctgcgttatgggcttcatcctcatgtatgctaccgtcctgtgtacgcagtataattctgctctcacgacaactattgtgggatgcattaagaacattctcataacatacattggaatggtattcggcggtgattacatattcacatggaccaattttataggcctgaacatctcatgcatttgccaccgaggcctgtgcgagctacgggtgggctcagctaccttgggcggatag

SEQ ID NO: 241467 - DNA, 1104 bp, Artificial Sequence
  Description of Artificial Sequence: Synthetic coding sequence
atgagttcaaggagcgtcctgagtcccgtggttgggactgatgcacctgaccagcacctggaactcaagaaaccacaagagttgaaggaaatggagcgtctccccctcgcaaacgaagataagacaatgtttgctaacctgaagtacgtgtctttagggattcttgttttccagacaacgtccctcgtcctgaccatgagatacagccgaaccttgaaagaggagggccctaggtaccttagcagcacagcggtcgtcgtggcggagctgctcaagatcatggcctgcattcttctcgtctataaggattcaaagtgcagcctgcgcgctttgaatagggttctccatgacgaaattttaaacaaacccatggagacgctgaaacttgccattccatccggaatttacaccctgcagaacaacctcttgtacgtggccctgtccaatctggatgccgctacataccaggtcacctatcagctaaagatcctgaccaccgccctgttctcagtttctatgttgagcaaaaagcttggtgtataccagtggctgtccctcgtgatcctgatgacaggcgtggcatttgtgcagtggccatctgacagccaactggactcgaaagaactctccgccggaagtcagtttgtgggccttatggcggttctgaccgcatgctttagcagcggatttgcgggagtgtatttcgagaagattctgaaggagaccaaacaatccgtttggatcagaaacattcagctgggattcttcggatctatcttcggccttatgggcgtgtacatatatgacggcgaattggtgtctaagaacgggttcttccagggttataatagattaacatggatcgtggtggtcctacaagcactcggaggcctcgtaattgcagccgtcataaagtatgcagacaatattctaaagggtttcgctacatctctgtcgataatcctctccacccttatctcttacttctggttgcaggacttcgtcccaacgtcagtcttctttctgggcgcaatcctcgtcattaccgcgaccttcttatacggctacgacccaaaacctgctgggaatcctaccaaagcctag

SEQ ID NO: 241468 - DNA, 978 bp, Artificial Sequence
  Description of Artificial Sequence: Synthetic coding sequence
atgttcgccaatttaaaatacgtatccctcggtatactggtttttcagactacctcactagtactgacaatgaggtactcccgaactcttaaggaggagggcccacgttacctctcgtcaacggctgttgttgttgcggaattactgaagatcatggcctgcatcctgctggtgtataaggactcaaagtgctctctcagggccctcaaccgagtcctgcacgacgagatcctgaacaaacccatggagacgctcaagcttgccataccctccgggatctacaccttgcaaaataacttactgtatgtggcacttagtaatctggatgccgctacataccaggtcacatatcagctcaaaatcctgaccaccgccctcttttcggtttcgatgttgtctaaaaaacttggcgtgtaccaatggctgagcctcgtgatcctcatgaccggagtggctttcgtgcaatggccatcagactcccagcttgatagcaaggaattgtctgccggaagccaattcgtagggttgatggctgtccttacggcctgtttcagtagtgggtttgccggagtttactttgagaagatccttaaggaaaccaagcagagcgtctggattaggaatattcagttgggatttttcgggtcgatttttggactaatgggagtgtacatttatgatggagaactggtatccaaaaatgggttctttcaggggtacaacagactgacctggattgtggtcgtcttgcaagcactcggagggctcgtaattgccgcagttataaaatatgcagataacatcctgaagggatttgcaacgtcactgtctatcattctgtccacacttataagctatttttggcttcaggatttcgtgccaacttccgttttctttctgggtgccatcctcgttatcaccgccaccttcttgtatggatatgacccgaaacccgcaggaaacccaacaaaagcttag

SEQ ID NO: 241469 - DNA, 675 bp, Artificial Sequence
  Description of Artificial Sequence: Synthetic coding sequence
atgttcgccaatttgaagtacgtgtcgctcggaattctggtgtttcagaccacctccttggtattaactatgagatattccagaacgctgaaagaagaagggcctcgctatctgagttctactgccgtggtcgtggcggagttgctcaaaatcatggcttgtatccttctggtatacaaagacagcaagtgctctctgagggctcttaatagagtattgcacgacgaaattctcaataagcccatggagacactcaagctcgccatcccatccgggatttacaccttgcagaacaatcttctctatgtggccttaagcaaccttgacgccgctacctaccaggtgacctaccaactgaaaatactgacaaccgcgttgttcagcgtctctatgttatccaaaaaactcggcgtctatcaatggctgtccttagtcatcttgatgaccggagtggcgtttgtccagtggccaagcgacagtcagctcgactccaaggaactatccgcagggagtcagtttgtggggcttatggctgtgctgactgcatgtttctcctccggattcgctggggtgtatttcgagaagatactgaaggagaccaaacagtccgtgtggatccgcaatattcagctcgggttttttgggagcatcttcggacttatgggggtgtattag

SEQ ID NO: 241470 - DNA, 978 bp, Artificial Sequence
  Description of Artificial Sequence: Synthetic coding sequence
atgttcgcaaaccttaaatacgtgtccctcggaatattagtcttccagactactagtctagtgttaaccatgaggtattcccgaaccctcaaggaagaaggccctcgctatttgtccagtaccgctgtggtcgtcgcggagctattaaagatcatggcttgcatcttgctggtatacaaagattcgaaatgttctctgcgagcacttaaccgtgttcttcatgatgaaatcctgaacaagccaatggagaccttgaagctggcaatccccagtggaatctacaccctgcaaaacaacttgttgtatgttgctctttccaacctggatgccgctacataccaagtgacttatcagcttaagatcctcaccactgcactgttcagtgttagtatgctgtccaagaagctgggcgtctatcagtggctctccctggtcatcctgatgaccggagtggcatttgtccaatggccgtcagattcccagctagactcgaaggaactctccgccggttcccagtttgtgggcctgatggcagtgctaaccgcttgcttctcatccggtttcgctggcgtgtactttgagaagattctcaaggagacaaagcagagtgtgtggattcgcaacattcagctgggctttttcggctctatttttggcctgatgggtgtctacatatatgatggggagctagtgagcaagaacggtttcttccagggctacaacagactgacttggattgtggttgtgttacaggccctcggcggactcgtaatagccgcagtgatcaaatacgccgacaatattctaaagggtttcgccacatctctatctatcattctcagcactctgatttcctatttctggctgcaggactttgttcctacatctgtgttcttcctgggcgcaattctcgtgataacggctacattcctgtatggttacgatccaaaacccgcaggcaacccaactaaagcctag

SEQ ID NO: 241471 - DNA, 663 bp, Artificial Sequence
  Description of Artificial Sequence: Synthetic coding sequence
atgtttgccaatctgaagtacgtgtccctcggaatcctcgttttccaaacaacctccctggtgctgactatgcggtactctagaacccttaaggaggaaggccctcgctatttgtcttcaacagcggtggtggtggctgagctccttaaaatcatggcatgcatcctcctcgtctacaaagatagcaagtgtagtttaagagctcttaacagagtgctccacgacgagattcttaacaaacccatggagacactgaagttggcaatcccatctgggatctatactctgcaaaataacttgctttacgtggcccttagcaatctcgacgccgctacataccaggtgacctaccaactcaagatattaactaccgcactgtttagcgtgtcaatgctgtccaagaagctgggagtttatcagtggttgtctttagtcattttgatgaccggcgttgcgttcgtgcaatggcctagtgactctcagctggactcaaaggaactgtcggccggaagtcagtttgtgggactcatggccgtcttgaccgcgtgtttttctagcggcttcgctggggtttatttcgaaaaaatcttaaaggaaaccaaacagtcagtgtggatccggaacatccagctggtttctttcagcctggaaccctctctgtag

SEQ ID NO: 241472 - DNA, 258 bp, Artificial Sequence
  Description of Artificial Sequence: Synthetic coding sequence
atgttcgcaaatctcaagtacgtcagcttgggaatcttggtctttcaaactacatctcttgtcttgactatgagatatagccgcaccctgaaggaggagggcccaagatacctttcaagcacagccgtggtggtagctgaactgcttaagataatggcctgcatcctcctggtgtacaaggactcaaagtgtagcttaagggccttgaacagagtactccatgacgagattctaaataagccgatggagacattgtag

SEQ ID NO: 241473 - DNA, 1104 bp, Artificial Sequence
  Description of Artificial Sequence: Synthetic coding sequence
atgtccagcagaagcgtgctgtctcctgtggtagggactgacgccccagatcagcacctggagctgaaaaagcctcaggagctgaaagagatggaacgcctgcctctggcgaacgaggacaagaccatgttcgctaatctgaaatacgtgtccttagggattcttgttttccagaccacctccctggtgctgaccatgcgttattcccgcactctcaaggaggaaggccctcggtacctttcatcaacggccgtggttgtggccgaacttctgaagatcatggcttgtattctattggtttacaaggactccaaatgctccctgagagccttgaacagagtgctgcatgacgaaatattgaataagcccatggagacactgaagctggctatcccgagtggcatctataccttgcaaaacaatctgttgtatgttgcgcttagcaacctggatgcggctacctatcaagtaacctatcagttaaagatcctgacaacagcactgtttagtgtctccatgctgagcaagaaactgggggtataccagtggctttcactggtcatcctgatgaccggagttgcattcgtgcagtggccgagtgatagtcagctggacagcaaggagctttcagcaggaagccaatttgtgggcttaatggccgtgttgactgcttgtttttccagcggcttcgcaggcgtgtattttgagaaaatcttaaaagagactaaacagagtgtgtggatcagaaatatccagctggggtttttcggttcaatatttgggctgatgggcgtttacatctacgacggcgagctcgttagcaaaaatggattcttccagggctacaacagattgacttggattgtcgttgtgctgcaagcactcggcggactcgtgatcgccgcagtgatcaagtatgctgataatatcctgaaaggattcgccaccagtctctccatcatcctgtccaccctaattagctatttttggctccaggactttgtgcctacatccgtgttcttcttaggagcgatcttagttatcacagccacgtttctgtatggatacgacccaaaacccgctggaaatcctactaaggcctag

SEQ ID NO: 241474 - DNA, 969 bp, Artificial Sequence
  Description of Artificial Sequence: Synthetic coding sequence
atggcctcaagctcctcattggtacctgaccgtctgcgtctccccttatgttttctgggggtcttcgtctgctatttctactatggaatcttgcaagaaaaaataacaagaggcaagtatggcgagggtgcaaagcaagagacctttacctttgctcttacattagtgtttatacagtgtgtaataaatgctgtctttgcgaagatactgatacagttctttgacacggctcgcgtggatagaacaaggtcctggctgtatgcagcatgcagcatctcttaccttggcgcaatggtttcatcaaattcggctcttcagtttgtcaactatccaacacaggtgctggggaagagttgcaagcccatccccgtaatgctactaggagtgactcttctaaagaagaagtatcccctggccaagtatctgtgtgttcttctgatcgtcgctggagttgccctctttatgtataaacctaagaaggtcgtgggcatcgaggaacataccgtggggtacggagagctgctgctgctgctcagcctcacattggacgggctcaccggtgtatcccaggaccacatgcgggcacactatcagacggggtctaatcacatgatgttaaacattaacttatggtcaacactcctgcttggaatggggatcttgtttactggagaactgtgggaattcctatcattcgccgagcgctaccctgccattatctacaacattcttctgttcgggctcacttccgctttgggtcagtcttttatttttatgactgtcgtatacttcgggcctctgacgtgttcaatcattacgaccacacgaaaattttttacaattctggcctctgtgatattgtttgccaatcccatttcccctatgcaatgggtgggtacagtgctcgtcttccttgggttgggcctggacgcaaaattcggaaagggcgcaaagaagacaagccattag

SEQ ID NO: 241475 - DNA, 450 bp, Artificial Sequence
  Description of Artificial Sequence: Synthetic coding sequence
cctcaaagctgcctaatcggaaagattagtcgagctcgggaccagtctaggggctgtcgatttccctggcccagcggcatggaacctcgcacaagggtcgggcctcttctggtcttacccgatgcttgcaagcaaccaatcaggcccagaccttggtgtcactccaggaatacagtctccagctgtctgggaactagaggcaagtacggcgaaggagccaagcaggaaacattcacctttgctctgactttagtgttcatacagtgcgtgatcaacgcggtgttcgccaagatatggtggattgtgccaggggctggaagcatgctgcccgttttgtccccaatttgggtgccatggagtcccgctatccagcactatagcctttctaccacccagctgcggtcactggtgaatcctgcatcgcagagccaaagctgcagcctcggctag

SEQ ID NO: 241476 - DNA, 1080 bp, Artificial Sequence
  Description of Artificial Sequence: Synthetic coding sequence
atgagacccctgccacccgtcggagacgtccggctggaactcagcccgcctcctcctttattaccagtccccgtggttagcgggtccccagtgggttcatctggccgacttatggctagttcgtcttcactcgtcccagaccgccttaggctgcccctttgttttttgggtgtgttcgtctgctatttttattacggcattctccaagagaagatcacaagaggcaagtatggagagggtgctaaacaggagacgtttaccttcgcactgaccttagtctttatccagtgcgtcatcaatgctgtcttcgcaaagattctgattcagttctttgacacagccagagtagataggactagaagttggctatacgccgcttgctcaatcagctatctgggcgcaatggtgtcctccaattccgccctgcagtttgtgaactaccctacacaagtgcttggcaaaagttgcaaaccaatcccagtcatgctcctgggcgtgactctgttgaagaagaagtaccccctggccaagtatctctgtgtacttttaatagtggcaggagttgcgctgttcatgtacaagcccaagaaggttgtagggatcgaggagcacactgtcggttacggcgagctgctgttactcttatccctgaccctcgatggcctgaccggagtgagccaggatcacatgcgggcacactatcagacgggctccaatcatatgatgcttaacatcaacctttggtcaacgctgctgctggggatggggatcctttttaccggcgaactttgggaattcctctctttcgccgagagatatcctgccattatctacaatattctcttgttcgggctgacctccgctcttgggcagtcatttatcttcatgacagtcgtttactttggtcctctgacctgctctataattaccactacgcggaagtttttcactatcttagcaagcgtgatcctgttcgcaaaccctatctctcctatgcaatgggtaggtaccgtcttggtgtttttgggactcggactggacgccaagtttgggaagggggctaaaaagacaagccattag

SEQ ID NO: 241477 - DNA, 720 bp, Artificial Sequence
  Description of Artificial Sequence: Synthetic coding sequence
atggcatccagttctagcctggttcccgataggttaaggctgcccctctgtttcttgggggtcttcgtctgttacttctactatggtatcctgcaggaaaagatcacacgcggtaagtatggggagggcgcaaaacaggaaaccttcaccttcgccctgaccttggtgtttatccagtgcgtgatcaatgcggtctttgccaagattctgatccagttcttcgacactgctcgagtagatcgcaccaggtcctggttgtacgctgcctgttcaatatcgtatctgggggcaatggtctcatcgaacagtgctctgcagtttgtgaactacccgacgcaggtgcttggaaaaagttgcaagccaattcctgttatgcttctgggagttactttactcaaaaagaaatatcctctcgccaagtacctgtgcgtgcttctgatcgtggccggagttgctctgttcatgtacaaaccaaaaaaagtggtgggtattgaggagcacacagttgggtacggcgagctgctgctcctcctgtctctgactctcgacggactcaccggtgtgtcacaggaccacatgcgcgctcactatcagactgggagcaatcacatgatgctgaacattaacctgtggtccacattgttgctgggcatgggtgagagtcagttttgctgcagttcccatgtgtcccctgaggggagactgccatcctctttctag

SEQ ID NO: 241478 - DNA, 597 bp, Artificial Sequence
  Description of Artificial Sequence: Synthetic coding sequence
atgctcttgggagtcacactactgaagaagaagtatccgcttgcgaaatatctttgtgtgctgctcattgtcgccggagtcgccctctttatgtacaagcctaagaaagtcgtgggtattgaggagcacaccgtgggttacggagagttattgctgctgctcagtctgacactggatggcctcaccggtgtaagccaagaccacatgagagcacactaccagacaggctccaaccacatgatgctcaatattaatctctggagcactttactgctgggcatgggaatactgttcactggagaactgtgggagttcctgagcttcgccgagcggtaccctgccattatttacaacattctcctctttggactaacatctgcactgggccaatctttcatcttcatgaccgtggtgtattttggtccccttacctgctctattattactaccacgagaaagttctttaccatcctggcatctgtgatactgtttgctaatcctatcagcccgatgcaatgggtggggacggtcctggtatttttgggactgggacttgacgctaagtttggtaaaggagccaagaaaacctcccattag

SEQ ID NO: 241479 - DNA, 570 bp, Artificial Sequence
  Description of Artificial Sequence: Synthetic coding sequence
atgctactgggcgtgaccctgttaaagaagaaatatcctctggcaaaatacctctgtgttttactgatcgtcgccggtgtggccttatttatgtataagcccaagaaagtggtgggcattgaagagcacacagtcggatacggcgagctgctgcttctgcttagtctgacactggacggtttgaccggtgtgagccaggatcacatgagagcacactaccagaccggttccaaccacatgatgctgaacattaacctttggtctactttattgctcgggatgggaatcctgttcactggagagctatgggagtttctgagtttcgcagaacgctaccccgctatcatatacaatatacttctgtttgggctgacctccgccctaggtcagagtttcatatttatgaccgtggtctactttggtcccctcacatgttccataattactactactcggaaattcttcacaattctggctagtgtgattctgtttgcaaatcctatcagtcccatgcagtgggtgggaaccgtcttagtcttcctggccatgggatcttgttgcgtggcgtag

SEQ ID NO: 241480 - DNA, 1179 bp, Artificial Sequence
  Description of Artificial Sequence: Synthetic coding sequence
atggatgccaggtggtgggccgtagtggtcttggccgcattccccagtttaggcgcagggggagagacacccgaggctccaccagaatcttggactcagctctggttttttcgctttgtagtgaacgccgctggctacgcctcattcatggtcccaggctatctgctggtgcaatactttcgccgaaagaactacctggaaactggcagagggctctgctttcccctggtgaaggcgtgtgttttcggcaacgagccaaaggcttccgatgaagttcctctggcgccacggaccgaggcagccgaaaccacacccatgtggcaggctcttaaacttttgttctgcgccactggcttgcaagtgtcatatctgacctggggcgtcctgcaggagcgggtcatgacaaggagctatggagccaccgccacttctccaggggagaggttcacggactcccaattcctggtgctcatgaatagggtgctcgcgcttatcgttgccggactctcctgcgttttatgcaagcagccacggcatggcgcaccaatgtatagatactccttcgcatcactctcaaatgttctgtcatcttggtgccagtacgaggccctcaagtttgtgtccttcccaactcaggttcttgcgaaggcgtccaaggtaattccagtgatgctcatgggcaagctggtgagcagaagaagctacgagcattgggagtatctgactgccaccctgatctccatcggggtgtccatgttcctgctttcctctggccctgaaccacggtcaagtcctgccacaacgctctccggcctattcacagtcggcagcctactggaacagggagcgctgctcgaagggaccaggtttatggggcgacacagcgaattcgcggctcacgcgctgctgctatctatctgctcagcctgcggacagctgttcatcttttatacgatcgggcagtttggagccgctgtcttcaccattataatgactctgagacaggcgttcgccattctcttgagctgtctcctgtatggccacaccgtgactgttgtcggaggtcttggcgtcgccgtggtcttcgctgccctgctcctccgggtctacgcacgtggcaggcttaaacagagaggtaagaaggctgtacctgttgagtctcctgttcagaaggtgtag

SEQ ID NO: 241481 - DNA, 1299 bp, Artificial Sequence
  Description of Artificial Sequence: Synthetic coding sequence
atggacgctcggtggtgggctgtggttgtactggccgcttttccctcactgggggcaggcggagagacccccgaagcaccgcctgagagttggacacagctttggttcttccgttttgtggtaaacgccgctggctatgcctccttcatggtccccggatacctgctcgtccagtatttccgcagaaaaaattacctggaaacagggagggggctgtgcttccctctggtgaaggcctgtgtgtttgggaacgagcccaaggctagcgacgaggtaccacttgccccacggacggaagcagccgagacgactcctatgtggcaagctcttaaactgttgttttgtgcaacaggccttcaggtcagctacctcacttggggagtgctgcaagagagggtgatgacacggtcttacggtgcgacagccacgagcccaggcgaaaggtttaccgactcacagttcttggtgctgatgaaccgcgtgctggccctgattgtagcaggcctcagctgcgtgctgtgcaaacagcctcgtcatggggctcccatgtaccgatatagttttgccagtctaagtaacgttttgagcagctggtgtcagtatgaggccctgaaattcgtaagcttccccacccaggttctggctaaggccagtaaagtaattccagtgatgctcatgggcaaacttgtatcaaggaggagctatgagcactgggaatatctcaccgccaccctcattagtattggagtctcaatgttcctgctctcatccggacccgaaccacgcagttcaccagctaccaccctctctggcctcattctactggcaggatatattgcctttgacagtttcacaagtaattggcaggacgcgttgtttgcttataagatgtcaagcgttcagatgatgttcggtgtaaacttctttagttgcctgtttactgttggctccctgctggaacagggggcattactcgaagggacccggttcatggggaggcactcagagttcgctgcccacgcgctgttattgtcaatttgttccgcctgcggccagttgttcattttctatacaattggacagtttggggcagcagtgtttaccatcataatgacactccgtcaagcttttgcaatcctcctttcttgtctgctatatggtcatactgtcacagtggtgggagggcttggggtggcagtggtgtttgccgctctgctgctgcgcgtctatgccagagggagattaaagcaaagaggcaaaaaagctgtaccagttgaatctcctgttcagaaagtgtag

SEQ ID NO: 241482 - DNA, 900 bp, Artificial Sequence
  Description of Artificial Sequence: Synthetic coding sequence
atgacgcggtcctatggggcaacagcgaccagcccaggtgaaagattcaccgactctcagttcctggtgctaatgaaccgcgtgctcgcactgatcgtcgccggattatcatgcgtattatgcaaacaacccagacacggggcacccatgtaccgctattcctttgctagcttatcaaacgtactgtcctcctggtgtcagtatgaggcactgaaattcgtctcctttccaactcaggttcttgcaaaggcgagcaaggtgatccctgtcatgctgatgggcaagttggttagtaggagatcttacgagcattgggagtaccttaccgccaccctcatctcaattggtgtgtccatgttcttgctctcctctggccctgaacctcgtagctctccagcaactacgctcagcggcctgatactgctagcgggatatatcgcgttcgactcttttacatctaactggcaggacgcactttttgcctataaaatgtcaagcgtccaaatgatgttcggcgtgaattttttttcatgtctgttcactgtgggttcgctgctggaacagggggctcttctggaaggaacccgcttcatgggaaggcattcggaatttgccgctcacgccttgctcctcagcatctgtagcgcttgcggccaactcttcatcttttatacaataggccagtttggagccgctgtgtttacaattataatgacactccgacaggcatttgccatcttgttgtcatgcctcctgtacggccatacggtgaccgtggttgggggattaggcgttgctgtggtgtttgcggctttgttactgcgcgtttacgccagaggcaggctcaaacaaagaggcaagaaggccgtacctgtagagtctcccgtgcaaaaggtttag

SEQ ID NO: 241483 - DNA, 1020 bp, Artificial Sequence
  Description of Artificial Sequence: Synthetic coding sequence
atgctcctggccatgcctgcgctgtggtacctcgcgacttcctggtgttctacttcaggcggaagaaccacttggcgtcccgtctcctaccttacttggggcgttctgcaggaacgcgtcatgactcgctcctacggtgctactgccacaagccctggggaacgtttcacagatagtcagtttctagtcctgatgaacagggttctcgccctgattgttgcagggctgagctgtgtgctgtgcaaacagcctaggcacggtgcccctatgtaccgttacagtttcgccagcctctctaatgttttaagcagctggtgtcagtatgaagctctgaagtttgtctcttttcctacgcaagtactggccaaagcttccaaagttatacctgtgatgctgatgggaaaactggtgagtcgtcggagctacgaacattgggagtacctcaccgcaacactgatttcaattggcgttagtatgttcttattgtcttccggaccagaaccacggtccagccctgctaccacacttagcgggctcatactgttggcaggatatattgcattcgactcatttacgtcaaactggcaagacgcgctcttcgcctacaagatgagtagcgtacagatgatgtttggcgttaactttttcagttgtctgttcaccgtcgggagtctgctcgaacagggtgccctcctagaggggaccaggttcatgggacggcactccgagtttgccgctcatgcgctgctcctgagcatctgctcagcatgcgggcagctgttcatcttttacacaatagggcagttcggagccgcagtgtttacgatcattatgaccctgcgtcaggcgttcgcaatcttgttgtcatgtttgctgtacggccatactgtgacagtcgtcggcggactgggggtggccgtggtgtttgctgctctgctgctccgggtttatgcccgaggccgtctgaaacagagggggaaaaaggctgtgcccgtggaatccccagttcagaaagtatag

SEQ ID NO: 241484 - DNA, 852 bp, Artificial Sequence
  Description of Artificial Sequence: Synthetic coding sequence
atggacctgacgcagcaggcgaaggacattcaaaacatcaccgttcaggagacgaacaagaacaactcggagtctattgaatgctccaagatcaccatggacctcaagtttaacaatagccgtaaatacatctcaattaccgttccaagtaaaacacaaactatgagtccgcacatcaaatctgtggatgacgtcgtcgtgcttggcatgaatcttagcaaatttaacaaactcacacagttcttcatatgcgttgctggcgtttttgtgttctacctgatctatgggtatctccaggagctgatcttttctgtcgaaggcttcaagtcttgcgggtggtatttgacacttgtccagtttgccttctactcgatcttcggcctgattgagctgcagttgattcaggacaaaagaagacgcattccaggcaagacatacatgattatcgcgttcctaaccgtcggtactatgggcctttctaacacctcactgggctacttgaattaccctactcaggtcatcttcaaatgttgtaaactcatccccgtgatgttgggcggagtattcattcaaggaaaaagatacaatgtggccgatgtgagtgccgcaatttgcatgagcctaggtctaatatggttcacgttagccgattcgaccacagcaccaaattttaatctgactggggtggtgctgatttccctggctttgtgtgctgatgccgttattggaaatgttcaagagaaggcaatgaaactgcataatgcctcgaattccgaaatgaatattacaactagctcttactcaggtgtcttcatttttcccaacaagctgaagatcccactagttctgtag

SEQ ID NO: 241485 - DNA, 1206 bp, Artificial Sequence
  Description of Artificial Sequence: Synthetic coding sequence
atggatcttacccagcaggcaaaggatatacagaatatcaccgttcaggaaacaaataaaaataacagtgagtccattgagtgtagtaagatcacaatggacctcaaatttaacaattctaggaagtacatttcaatcaccgttccttcgaaaactcagaccatgtctccccatatcaaatccgtagacgacgtggtggtcctgggtatgaatctatccaaattcaataaactaacccagttctttatctgtgtcgccggagtgttcgttttttatttaatatacggctacctccaggagctgatcttcagtgttgagggctttaaatcctgtgggtggtatttgaccctggtgcagttcgctttctattctattttcggattaatagaactgcagctcattcaagataagaggcggaggatcccgggtaagacatatatgataattgcctttctgacggttgggaccatgggactgagcaataccagcctgggctatctgaattaccccacccaggtcattttcaaatgctgcaaactcattcctgtcatgcttgggggagtgtttattcaaggaaagcgctacaatgtcgcagacgtatccgcagcaatttgtatgtcactaggtctgatttggtttacactggcggattccactacagcccctaacttcaacctgactggcgtcgtcctgattagcttggcactttgtgcagatgcagtcatcggtaatgtgcaggagaaggcaatgaaattacataacgcgtcaaatagtgagatggttctgtattcgtactccattgggtttgtttacattctgctgggcctaacatgcacatctggcctcggaccagccgtgacattctgcgccaagaatccagtccgcacatacggatacgcatttctgttttctcttaccgggtacttcggcatctcttttgtactcgccctgattaagattttcggggcactgatcgccgtaactgtcaccaccggtcgtaaagcaatgaccattgtactcagttttatcttttttgccaagccattcacattccaatacgtctggtccgggctcctggtggtccttgggatctttttaaacgtctactccaagaacatggataagattcggctaccatccctgtacgatctgattaataagagtgtggaggcacgaaagtcacgcacgctggcccagactgtatag

SEQ ID NO: 241486 - DNA, 657 bp, Artificial Sequence
  Description of Artificial Sequence: Synthetic coding sequence
atgctgagactagcccagacccctaggcgtctgcccagcccttttcgcgttacctaccgaccttggggcacccgcgcattcggcgctttccctgtgtttggtacacaaatctcttcgcccccagagaatttggataccgcacacttaccgcatcctgagggtgcctttgaggagtggatgagatctggatggaaaaaaagggatcttactcaacaagcaaaagacatccagaatatcacagttcaagaaaccaataaaaataattcagaatccatagagtgctccaagataaccatggatctgaaatttaataacagccgaaagtacatctcgatcacagtgcccagcaagacgcagacaatgagcccccatattaagtctgttgacgacgtcgtggtgctggggatgaacctgtctaagttcaacaagttgacccaattctttatctgcgtcgctggagtttttgtgttctatctgatctatggatacttgcaggagctaattttctccgttgagggattcaaatcttgcgggtggtatctgacactggtgcagtttgcgttttactctatcttcggtctgatcgagttacagctgattcaagacaagcggcgaaggtatgtggtctgtttttacttcttgatcttcctgtactag

SEQ ID NO: 241487 - DNA, 996 bp, Artificial Sequence
  Description of Artificial Sequence: Synthetic coding sequence
atgcgcccagcactggcggttggcctggtcttcgctggttgctgtagtaacgttatttttctcgagctgctcgccaggaaacacccgggatgtggaaatattgttacatttgcacaattcctgtttattgccgtggaagggttcctctttgaggctgaccttggccgaaagcctcctgctatccctattcgctactacgcgatcatggtgactatgttttttacagtttccgtggtcaacaactacgctcttaatctcaacattgcgatgcctttgcacatgatcttccgttctggctcactcattgctaacatgattctcggaatcatcattctcaagaaaagatactctatctttaaatatacttccattgccctggtgtcggttggcatattcatctgtacattcatgtcagccaagcaggtaacatctcagagctcactttctgagaatgacggctttcaggccttcgtttggtggctgctgggtattggtgcactgaccttcgcactgctgatgtcagcccgaatgggcatctttcaggaaacactctataagcgatttgggaagcacagtaaggaagccctgttctataatcatgcgctgccactgccgggatttgtttttctggcgtcggacatatatgaccatgccgtgctcttcaataagtccgagctgtacgagatccccgttatcggagtcactttgcctattatgtggttttatctcttgatgaacataattacacaatacgtttgtatcagaggggttttcattttgactaccgaatgtgcctcgctgaccgtgaccttggtcgtcaccctccgaaagtttgtgtccctgatctttagcatcttgtacttccaaaatccctttaccctgtggcattggctgggtacattgttcgtcttcattgggaccttgatgtatactgaggtgtggaacaacttgggcactactaaaagtgagccccagaaggacagcaagaaaaactag

SEQ ID NO: 241488 - DNA, 1095 bp, Artificial Sequence
  Description of Artificial Sequence: Synthetic coding sequence
atgaacagagcccctttaaagagaagtcggattctgcacatggccctaaccggtgcatccgaccccagcgcagaggccgaggcgaatggcgaaaagccctttctgctccgcgcactgcaaatagccttagtggtcagtttatactgggtgacttctatcagtatggtgtttctgaataagtaccttctggacagcccaagccttcggttggatacccctatttttgtgacattctatcaatgtttagtgactaccctgttatgtaagggccttagcgcccttgccgcttgctgcccaggcgcagttgatttcccaagccttcgcttggatctaagagttgctaggagcgttcttcctctgtctgttgtgtttatagggatgattacatttaataatttatgcctaaagtatgtgggggtcgcattctacaacgtcggccgaagtctcacgaccgtgtttaacgtgctcctctcctacctcctgttgaagcagaccaccagtttctacgctctactgacttgtggaattataatcgggggattctggctgggtgtggaccaggagggcgcagaaggcacactgtcctggttgggtaccgtgttcggagtgttggcatccctgtgcgttagcttaaatgccatatacactactaaagtccttcccgctgttgatggatctatctggaggttgacattttacaataatgtgaacgcatgcattctctttctgcccttgctgttgctgctgggtgagctccaagccctgagagactttgcacaattagggtccgctcacttttggggtatgatgaccctcggcggactgttcggtttcgctataggatatgttaccgggctccagataaaattcacctcccctctcacccacaacgtctcgggcaccgccaaggcctgcgcgcagaccgtgctggcagtgctgtattacgaggagaccaagagcttcctttggtggacgtctaacatgatggtgttaggcggatcttcagcttatacctgggtgcggggatgggagatgaagaagacccccgaagagccatctcccaaagattcagagaaatccgccatgggggtgtag

SEQ ID NO: 241489 - DNA, 1056 bp, Artificial Sequence
  Description of Artificial Sequence: Synthetic coding sequence
atggcactcacaggtgcttctgacccttcagctgaggctgaagcaaacggggagaagcccttcttgctcagggcactccagatagccttggtggtaagcctctactgggtcaccagcataagcatggtcttcctgaacaaatacctactggattcccctagtctccgactcgacactcctatcttcgtcaccttttatcagtgcctcgtaaccactttactctgcaaaggcctgtctgccctggccgcatgctgtccaggcgctgtggacttccctagcctgcgtctggacctccgagtagcgaggagcgtcctgcccctgagcgtggtttttatcggaatgataacgttcaataacttgtgcctgaagtatgttggtgttgctttctataatgtcgggagatccctgaccaccgtatttaatgtattattaagctacctcctactcaaacagaccacaagcttctacgcgttgctgacctgcggcatcatcatcggcggattttggttaggggtagaccaggaaggcgcagaaggcaccctgagttggctgggcactgttttcggcgtgctggcctctctgtgtgtgagcctgaacgcaatttacaccacaaaggtgctacccgcagtagacggttctatatggcgccttaccttctacaataacgtcaatgcttgtatcctgtttttgccactgctactgctcttaggcgaactacaggccttgcgcgactttgcccaattgggatcggcccacttctgggggatgatgacactaggaggactgttcggatttgctatcggttacgtgacaggcttgcaaataaagtttactagccccctgacccacaatgtttccggtaccgctaaggcatgtgctcagaccgtgctggccgtgttgtattacgaagagaccaaaagcttcctctggtggaccagcaatatgatggtcctcgggggtagctccgcctatacgtgggtgcggggatgggaaatgaagaaaacccctgaggagccaagccctaaagatagcgagaagtctgcaatgggtgtctag

SEQ ID NO: 241490 - DNA, 1056 bp, Artificial Sequence
  Description of Artificial Sequence: Synthetic coding sequence
atggctctgaccggcgcatctgatccatctgccgaggcagaggcaaatggggagaaaccatttctgctgcgcgcactccagatcgcgctcgtggtctcactttactgggtcacttcaattagtatggtctttttaaataagtacttgctagattcaccatctctccgcctcgatactccgattttcgtgacgttctaccagtgccttgtgacgactctgctttgcaagggactgtctgcactggcagcgtgctgccccggtgctgtggacttcccaagcctaaggcttgacctgcgagtcgctcgtagtgtcttgcccctatcagtggtgtttatcggaatgatcacattcaacaatctgtgtctcaagtatgtgggcgtcgccttttataacgttggacggtcactgacaacggtcttcaatgtcctgcttagctatctcctcctaaagcagacaactagtttctacgcattactgacctgtggtatcattatcgggggattctggctgggagtggaccaggaaggcgcagagggaaccttgtcatggttaggtactgtctttggtgtactggccagtttgtgtgtctctctgaacgccatctataccaccaaagtcctgccggctgtggacgggtctatctggcggctgactttttacaataacgtcaacgcctgtatcctgttcctgccgctgctgctgctgttaggcgaactgcaagcccttagggactttgcacaactgggaagcgctcacttttggggcatgatgaccctaggaggcctgttcggcttcgccattggttatgtaactggcctccagatcaagttcaccagtccgttgacacacaatgtaagtggcaccgctaaagcctgtgctcagaccgtgctagctgttctttactacgaggagacaaagagctttctgtggtggacctctaacatgatggtactcgggggaagtagcgcatatacctgggtgcggggttgggaaatgaaaaagactcctgaggagcccagtccgaaggactcggaaaaatccgctatgggggtctag

SEQ ID NO: 241491 - DNA, 219 bp, Artificial Sequence
  Description of Artificial Sequence: Synthetic coding sequence
atggctttaactggtgcatcagacccttcagccgaggccgaggcgaacggcgagaaaccctttctgctccgggcactgcagatcgccctggttgtgtccttatactgggtaacctctatctctatggtgtttctgaataaatacctgctcgacagccctagcctgagactcgacactcctatctttgtaaccttttatcagtgcctggtgacgacgtag

SEQ ID NO: 241492 - DNA, 498 bp, Artificial Sequence
  Description of Artificial Sequence: Synthetic coding sequence
atggccttaacgggtgccagtgatccatctgcagaagctgaagcaaatggggaaaaacccttccttttgcgagctctccagatagcactagtcgtttcactgtactgggtcaccagtatcagtatggtatttctcaacaagtacctgctggattcaccctctctccgtcttgatacacctatctttgtgacattttaccagtgcttggtaacaacccttctgtgcaaaggactctccgctctggctgcctgttgcccgggtgcagtcgattttccatctttgcggctggacctaagagttgcgaggagtgtgctccctttgtctgtcgtgtttatcggaatgattaccttcaataatttgtgcttaaaatatgtgggagtagccttctacaatgtgggaaggtccctcacaacagtctttaacgtcttactatcctacttactcttgaaacaaactacttccttttacgctctgctgacgtgtggtatcattatctag

SEQ ID NO: 241493 - DNA, 741 bp, Artificial Sequence
  Description of Artificial Sequence: Synthetic coding sequence
atgaaccgggctcctctaaagcgatctcgcattctacatatggctctgaccggcgcaagtgacccctcagccgaggccgaggctaacggagaaaagcccttcttattaagggcgctgcagatagcattggttgtgagcctgtactgggtgacaagcatttcaatggtgttccttaacaaatatctgctcgacagcccctctctgagactagatactcccatcttcgtgacattctatcagtgccttgtgacaaccctactgtgcaagggcctctcggccctggctgcttgctgccccggtgctgtagatttcccctctttgcgtcttgatctccgcgtggcaagaagcgtcctgccccttagtgtcgtgttcattgggatgatcactttcaacaacctctgtttgaagtatgtgggcgtcgcattctacaatgtaggcaggtcattgaccacagttttcaatgtgctgttaagttatcttctgctgaagcagaccaccagtttctacgcactgttgacctgtggtattattattggcggattctggctgggcgtcgatcaagagggagccgagggcacactcagctggcttggaacagtattcggtgttctagcttcattgtgcgttagcctgaatgctatttacacaactaaggtattgccggctgtcgacggttccatttggcgactcacattctacaataatgtgaacgcctgcatactcttcctgcccctgctctag

SEQ ID NO: 241494 - DNA, 1014 bp, Artificial Sequence
  Description of Artificial Sequence: Synthetic coding sequence
atgacagcaggaggccaagcagaagcagagggcgctggtggcgaacctggcgcagcgagactgccatcacgcgtggctcgcctgttgagcgctctgttttacgggacttgtagtttcctcatcgtgctcgtgaacaaggctctccttacaacctacggctttccctcaccaatcttcttaggaattgggcaaatggccgctaccatcatgatcttgtatgttagtaagttgaacaaaatcatccatttcccggatttcgacaaaaaaattcccgtgaagctcttccccctgccgctgttgtacgttggtaaccatatctcgggactctctagcacctcaaaactgtcgctgcctatgttcaccgtgctgcggaagttcactattcccctgactctgctgttggagactattatactgggaaaacagtactccctaaacatcattctatctgttttcgctattatcctgggagcttttattgctgctgggagtgatttggcctttaacctggaagggtacatttttgtcttccttaatgatatttttacggccgcaaatggagtctacaccaagcaaaaaatggaccctaaggaactcggtaaatacggggtactgttctataatgcttgcttcatgatcattccaacattgatcatatcagtctctacgggcgatctccagcaagcaacggagtttaaccaatggaagaatgtggtgtttatactacagttcctattgagttgcttcctgggcttcctcctgatgtacagtactgtgttgtgttcctactacaatagtgctctcacaactgccgttgtcggggcaatcaaaaacgtgtctgtcgcctacatcggtatcctgattggcggagactatattttttccctcctcaacttcgtaggactgaacatttgcatggccggtggtctaagatactcctttctgaccctgagttctcagttaaaaccgaagccagtgggggaagaaaacatatgcttagaccttaaaagctag

SEQ ID NO: 241495 - DNA, 492 bp, Artificial Sequence
  Description of Artificial Sequence: Synthetic coding sequence
atgaccgctggcggacaggcagaagccgagggggcaggcggtgagcccggtgccgctcgccttcctagcagggtggccagactcctaagtgccctgttttatggcacttgcagctttcttatcgtgcttgtcaacaaggctttactcactacgtacgggtttccatctcctatttttctcggaatcggccagatggcagccaccattatgatcctctacgtgagtaagttgaataagatcattcattttcccgatttcgataagaagattcccgttaagttatttccactgcccctgctgtacgtcggaaaccatattagtggattgagtagtacttccaaactgagcctcccaatgtttactgtactccgcaaattcacaattcctcttaccctgttgcttgagactataatcctcggaaaacagtactcactgaatattatactctcagtgtttgctatcatcctcggcgctttcatcgccgctggatag

SEQ ID NO: 241496 - DNA, 750 bp, Artificial Sequence
  Description of Artificial Sequence: Synthetic coding sequence
atgacagctggtggacaggccgaggccgagggtgcgggtggcgagcctggcgctgccaggctgccttcacgggtggccagactactttctgccttattctatggaacgtgcagctttctcattgttctggttaacaaagccctgttgacaacatacggatttccaagtcctattttcctggggataggacaaatggctgccactattatgatcttgtacgtgtccaagcttaacaagataatccatttccctgacttcgataaaaaaataccggttaagctctttcctctgcccctgctgtacgtggggaatcatatctctggcctctcatccacaagcaagctatccttaccaatgtttactgtcctccgaaaattcacaattcctctgaccttgctgctcgaaactatcattctgggaaagcagtattccctgaacatcatcttgagcgtgtttgcaattattctaggagcttttattgctgccggttttttacttatgtattctacagtgttatgttcctattataattctgcattgaccaccgccgtcgtcggggctattaaaaatgttagcgtggcatatattggaattcttattggcggagattacatcttctcattgctgaactttgtgggccttaatatctgcatggcagggggactacgctactccttcttgacactgagttcccagctgaaaccaaagccagtaggtgaagagaacatctgcctcgacctgaagagctag

SEQ ID NO: 241497 - DNA, 1251 bp, Artificial Sequence
  Description of Artificial Sequence: Synthetic coding sequence
atgcgccagctgtgtaggggacgggtcctgggtatttctgtcgccatagcccatggagtgttctctggatctctgaatattctgctgaagttcctgattagccggtatcaatttagctttcttaccctggtgcagtgcctcacctcctccactgcagctctgagcttagaactgctgcgcagactgggcctgattgccgttccgcctttcggcctgtccctggcgagatcctttgcaggagtcgccgtgctgagcacactccagagctctttgacactgtggagtctgagggggctctctttgccgatgtacgtcgtctttaaaaggtgcttgccgcttgtcacaatgttaattggggttctggtgctcaagaatggagctcccagccctggtgtccttgctgcagttcttataactacttgcggagccgctctggctggagccggagacctcactggagacccaataggatacgtgacgggcgttttagcggtcctggtgcacgccgcttacctggtgctgatacagaaagcatcagccgacacagaacatgggccactcaccgcccaatatgtgattgctgtgagtgcgacacctctgttggtaatctgttccttcgccagtaccgacagcatccacgcctggacgtttccgggatggaaagaccctgccatggtctgcattttcgttgcttgcatcctgatcgggtgtgctatgaatttcaccacgctgcactgcacttatatcaattcagcagtgacaactagcttcgtgggagttgttaagtcgattgctactatcaccgttggaatggtggcattcagcgatgtggagcctactagtctgtttatagcaggagtggtggtgaatacgttggggtccattatatattgcgtggccaagttcatggagacaagaaagcaatccaattacgaagacctggaagcacagccacgcggtgaggaagctcagctttccggcgaccagcttccttttgtgatggaggaactcccgggtgaggggggtaacggcaggtcagaaggtggagaggccgctggtggacccgctcaggaaagccgccaggaagtgagaggatcaccaagaggggtacctcttgtggccggatctagcgaggaagggtctcgcaggtccctcaaggacgcctatctggaagtgtggagactagtgagaggaacacgctacatgaagaaagactacctgattgagaacgaggagctccccagtccttag

SEQ ID NO: 241498 - DNA, 1431 bp, Artificial Sequence
  Description of Artificial Sequence: Synthetic coding sequence
atgtccacccagcggctgagaaacgaggattaccatgattacagtagcacagacgtcagccctgaagagagcccttcagaaggactgaacaacctctcaagccctgggtcctatcagcgatttgggcagtctaactcaacaacctggtttcagacactcatccatctactcaaagggaacattggaacgggactcctagggctcccgctcgcagtgaagaatgctggcattgttatgggacccatcagcctgttgatcatagggatcgtggcagtccactgtatggggattcttgtgaagtgcgcccaccacttttgtaggagacttaataaatcattcgtcgattatggcgacaccgtcatgtacggcctggaaagcagtccctgcagctggcttcggaaccatgcacattggggacgccgtgttgtagacttctttttgattgtaacacagcttggattttgctgtgtgtatttcgtctttctggcagataacttcaaacaggtgatagaggcagccaacgggaccacaaacaactgccataacaacgagaccgtgattctcactcccacaatggatagccgcctctacatgttgagctttcttccctttcttgtgttgctggtgttcatcaggaatcttcgagcactgtccatctttagtctgctggccaacattacaatgctggtgagtctcgttatgatctaccagttcatcgtgcagcgtatccctgatccttcacacctccccctcgtcgctccttggaagacctaccccctgttcttcggcaccgccatcttttcctttgaagggataggcatggtgttaccactggagaataagatgaaggacccgagaaagtttcccttgattctctatcttgggatggtgattgtcaccattctttacatctctcttggctgccttggctatctgcagttcggcgcaaatatccagggatcaattactctcaacctccccaattgctggctgtaccagtccgtcaagcttctgtatagtataggcatcttcttcacctatgcccttcagttctatgtgcctgctgagatcataatccctttctttgtcagtagggctcccgaacattgcgaactagtggtagatctctttgtccggaccgtcctggtgtgtctgacgtgtatcctggcaatactcatccccagattagaccttgtgatatctttagtgggctccgtgtccagcagtgcactcgctcttatcattccgcctctccttgaggtgacaactttctatagcgaagggatgtcccctctcaccatattcaaggacgcactcatttcgatcctggggtttgtcggtttcgtcgtagggacttatgaagccttgtatgagctgatccagccttctaacgccccaatctttatcaacagtacttgtgccttcatttag

SEQ ID NO: 241499 - DNA, 1161 bp, Artificial Sequence
  Description of Artificial Sequence: Synthetic coding sequence
atgagcactcagaggctgagaaacgaagactaccacgattattccagcaccgatgtttcacctgaggagtctcctagcgagggtctgaacaacctctctagccccggaagctatcagcgttttggacagtccaattcaacaacatggttccagacactgatccacctacttaagggaaatattggcacaggcctgttgggtctgccgctcgcggtgaagaatgccggaatagtgatgggccctatcagtctactcatcatcgggattgttgcagtccattgtatggggatactggtgaagtgcgcacaccacttctgcagacgcctcaataaaagtttcgtggactatggagacaccgtgatgtatggccttgagtcatccccctgcagctggttgcgcaatcacgctcattggggaagacgcgtagtcgatttttttcttatcgtgacccagctgggtttctgctgcgtgtacttcgtgtttttagcagacaacttcaagcaggtcatcgaggctgccaacggaacaacaaacaattgccataataacgagacagttatccttaccccaacaatggactctcgactgtacatgttgtcctttttgccatttctggttctgttggtcttcataagaaatctgcgtgccctgagcatcttctcacttcttgcaaacatcaccatgctcgtgtctttggttatgatttaccagtttattgtgcagagaatccctgacccttcccatcttcctcttgtggcaccatggaagacgtatcccctatttttcggtacagccatctttagtttcgaggggatcggtatggtgctgcccttggagaataagatgaaagaccccagaaaatttcccctgatcctgtacttgggtatggtcatcgttacaatcctgtatataagcttaggctgcctcggttacctgcaatttggagcgaacatacaggggtctatcactctgaacctgcccaactgctggctttaccaatccgtcaagctgctgtacagcatcggaattttctttacctacgcactccagttctatgtgcccgcagaaattatcattccattctttgtgagccgagcacctgaacactgcgagttggtagtggacttgttcgtgcgtacagttctggtgtgccttacatag

SEQ ID NO: 241500 - DNA, 213 bp, Artificial Sequence
  Description of Artificial Sequence: Synthetic coding sequence
atgagcacccagcgactgcgcaacgaggattatcacgactattccagtaccgatgtctcccccgaggaatctcccagtgagggcttgaataacttatcttcccccggaagctatcaacggttcggacagtcaaattccacaacatggttccagaccttgattcacctcctgaagggaaacataggcacgggcttactgggcttaccactgtag

SEQ ID NO: 241501 - DNA, 219 bp, Artificial Sequence
  Description of Artificial Sequence: Synthetic coding sequence
atgagcacccagagacttcgcaacgaggactaccacgactactcctccaccgacgtgtcgcccgaagagagtccctctgagggccttaataacctgtctagtcctggtagctaccagcgatttggtcaatccaactcaaccacatggttccagacgttgattcacctgctcaaagggaatatagggaccggactgctcggattacccctggctgtgtag

SEQ ID NO: 241502 - DNA, 1431 bp, Artificial Sequence
  Description of Artificial Sequence: Synthetic coding sequence
atgtcaactcagcgactgaggaacgaagactatcatgattattcctccacagatgtctcacccgaagaaagtcctagcgaggggctgaataatctaagcagccctggctcataccagcgtttcggacaaagcaattcaaccacatggttccaaacattgattcaccttctgaaaggcaatatcggcactggtctgctcgggctccctctcgccgtgaagaacgctggaattgtcatgggtcctatttccctgcttatcatcggcatcgtggcggtgcactgtatgggaatcctcgtcaagtgtgctcaccacttctgccgaaggctcaacaaatcatttgttgattacggggacactgtcatgtacgggctggagtctagcccatgttcttggctgcgcaatcacgctcattgggggaggagggtggtggattttttcctgatagtgactcagctgggtttctgctgcgtctacttcgtgtttctggcggacaattttaagcaggtgattgaagcagctaacggaaccactaataactgtcacaacaatgaaacggttatcctcactcctaccatggactcccggctgtacatgttgagcttcctgccattccttgttctgctggtcttcatccgcaacttaagagccctgtccatctttagtctactcgcgaacattactatgctagtctcgttggtcatgatttatcaattcattgtccagcgcatccctgacccttcacatctgcctctggtcgcaccttggaaaacgtaccctctcttcttcggaaccgctatattctcgttcgagggcataggcatggtgctcccactggagaacaaaatgaaggaccccaggaaatttccacttatcctgtatcttgggatggtgatcgtgaccatcctgtatatatctctgggttgcctcggctatcttcagtttggcgcaaatatccaagggagcattaccttgaatctgccgaattgttggctttaccagtccgtgaaactgctttatagtattgggatattctttacatacgccctacaattctatgtgcctgccgaaattatcatccccttctttgtgagccgggctcctgagcactgcgaattggtggtggacttattcgttcgaaccgtacttgtttgccttacctgcatcttggccattcttatcccgcgactggacctggttatttccctcgtcggatccgtgtcttcttccgccttggcactcattattccacctttacttgaagtaacaaccttctactctgaggggatgtccccattgacgatttttaaggacgccctgatatccattctagggttcgtagggttcgttgtcggcacgtacgaggcgctttatgaactgatccagccatccaacgctccgatcttcatcaactcaacctgtgccttcatttag

SEQ ID NO: 241503 - DNA, 1167 bp, Artificial Sequence
  Description of Artificial Sequence: Synthetic coding sequence
atgagtacccaaaggctacgcaatgaggattaccacgactatagttctacagatgtgagccccgaggagagcccctcagaagggttaaacaatctgagctctcctggtagttatcaacgattcggccaatccaattccaccacgtggtttcagaccttaatacatctcctcaagggcaacattgggaccggcttgttaggcctaccactcgcagtgaagaacgccggaatcgtgatgggtcctatttcattattaatcattgggattgtggccgtgcactgcatgggcatattagtgaaatgcgcacaccatttctgccggaggctgaataagagcttcgtagactacggcgacacagtaatgtatggactggagagctctccatgttcctggctgcggaaccatgcacactgggggcgtcgggtggtcgacttttttctgatcgtgacccaactcgggttttgctgcgtgtacttcgtcttcctagcagataactttaagcaggtgatcgaagccgctaacggcacaacaaataattgtcacaataatgagaccgttatccttacacccaccatggatagcagactctacatgctctcttttctgccgttcctagtgctgctagtgttcatcagaaacctgagagccttgtctatcttttcactgctcgccaatataacgatgctcgtgtccctggtgatgatttaccagtttattgtgcaacgcatccccgatccctcgcatctccctctggtagctccttggaagacgtacccactgttcttcggcactgccatcttttcatttgaagggatagggatggttctgccactcgagaataagatgaaagaccccaggaaatttcccctgattctgtacctgggaatggtcatcgtgaccatattgtacatctctctcggctgtttggggtacctgcagtttggcgctaatatacagggttctattacccttaacctaccgaattgctggttgtaccagtccgtgaaattactttactcgattggtatcttcttcacttacgctttgcagttctacgtgcctgccgagattatcatcccctttttcgtaagtcgggcaccagaacactgcgaattggtggtggacttatttgtgcgaacggtcctggtatgtttgacatgtgagtag

SEQ ID NO: 241504 - DNA, 1452 bp, Artificial Sequence
  Description of Artificial Sequence: Synthetic coding sequence
atgtccgtgaccaaatccacagaaggaccccaaggcgcagtagccatcaagcttgacctgatgtccccaccagagtcagctaagaagcttgagaataaggactcaacttttctggatgagtctccctcagaatccgccggactgaagaaaactaagggaatcaccgtgttccaggccctcatacatctggttaagggaaatatgggcaccgggatccttggacttccactggcagttaaaaacgccggaatacttatgggacccctcagtctacttgtgatggggttcattgcgtgtcactgcatgcacatccttgtcaagtgcgcccaaagattttgcaaacgcttaaacaagcctttcatggattatggtgacactgtaatgcatgggttggaggctaatccaaatgcatggctccagaatcatgcgcactgggggcgacatatcgtttcattctttctgattattacccagctaggcttttgttgcgtatacattgtcttcctggcagacaacctcaagcaggtggtggaggccgttaacagcactactaataactgctacagtaacgaaaccgtcattctgacaccgacaatggactctagactctacatgctaagctttctgcccttcctggtcttgttggtgctgattagaaacctgaggatactgactatcttcagtatgttggcaaacataagcatgctggtgtcactggttatcataattcagtacatcacccaggagattcctgacccctccaggcttccactagtggcttcatggaaaacttatccgctcttcttcgggaccgcaatttttagcttcgagagcatcggcgtcgttctccccttggaaaataagatgaaaaacgcccgacattttcctgcaattttgagtctgggtatgagcatcgtgaccagcttgtacattggaatggccgctttgggctacttgcgtttcggcgacgacatcaaagcctctatttcactaaatctccctaattgctggctgtatcagagcgtgaagttgctgtatattgccggaattttgtgcacatatgccctgcagttttatgtacctgctgagattatcatcccttttgctatttcaagagtatctacgcgctgggccctaccattggacctctccattaggctcgtcatggtatgtctgacctgtctcctagccatcctgatcccccgactcgatctggtcatatcgctggtaggtagtgtgagcggaactgcactggccttgataatccctccccttcttgaagttaccacgttctacagtgagggaatgagccctctgacgattttcaaggacgccctgatttctatcctgggctttgtggggttcgttgttggcacataccaagccctcgacgagctgctgaaaagcgaagattctcacccattctctaactccaccacatttgtcaggtag

SEQ ID NO: 241505 - DNA, 624 bp, Artificial Sequence
  Description of Artificial Sequence: Synthetic coding sequence
atgaatgatactgctgtgctgcccttagagaacaagatgaaaaacgcccgtcacttcccagctatcctttccttggggatgagcatcgtgaccagtctgtatattggtatggccgctctcggatatttgaggtttggcgacgatattaaggctagcatttcattaaacttgcccaactgttggttgtaccagtcagtgaagctgctctacattgccggtattctctgtacctacgccctgcagttctacgtacctgccgagatcataatcccctttgccatatcccgcgtgagtacccgttgggcccttcccctggatctttcgatccggctagttatggtctgtctgacctgcctccttgcgatcctgattcccaggttagatttagtcatttctctggtggggagtgtgagtgggaccgccctcgctcttatcattccacccctgctggaagtcacaaccttttacagtgaaggcatgtcaccactgaccatctttaaggacgctcttatctcaatactgggtttcgtgggttttgttgtggggacataccaggccttggatgagctcctgaagagtgaggactcccaccctttcagcaacagcactaccttcgttcgctag

SEQ ID NO: 241506 - DNA, 1413 bp, Artificial Sequence
  Description of Artificial Sequence: Synthetic coding sequence
atgtccctgttgggacgggactataattcagaacttaacagcttggacaatggacctcagtccccaagcgagtcctcttccagcattacgagcgaaaacgtgcaccccgctggcgaggccggtctgtccatgatgcagaccctgatccacttgcttaagtgcaacatcgggaccggcttacttggtctgcccctggcgattaagaatgctggtctactggtgggcccagtgtctttgcttgcaattggcgtcctgacagtccactgcatggtgatacttcttaattgcgcccagcatctctcccagagactgcagaaaacattcgttaattatggtgaggccaccatgtatggactggaaacatgcccaaacacctggctgcgagctcacgccgtatgggggagatatactgtgtcctttttgctggtgattacccagctggggttctgttcagtttacttcatgttcatggccgataacttacagcagatggtggagaaagctcacgtgacgagtaatatctgccagcctagggagattctgacactcacccccattttagacattagattctatatgctgatcattttgccattcctgatcctgctggtgtttatacagaatctcaaggtgctcagcgtgtttagtacacttgctaatataacgacattaggtagcatggccctgatatttgagtatataatggaaggcatcccatacccctcaaacctgccacttatggccaactggaaaacctttctgctcttcttcggaacagccattttcacttttgaaggagtgggtatggtcttgccacttaagaatcaaatgaagcaccctcagcagttttccttcgtgctgtacttgggcatgtctatcgtgataatattatacattttgctagggaccctcgggtacatgaagtttggatcagacacacaagcttccattactttgaacctcccaaattgctggttatatcagtccgtgaagctaatgtattctattggaattttctttacctatgcactgcagtttcatgttccagcagagattattatcccttttgcaattagccaggtcagtgaaagttgggctctgttcgtggatctgagtgtgcggtcagcacttgtgtgcctcacttgcgtgagcgccattctcatacctaggttggatctagttatctcactggtaggcagtgtcagctcctcagctttagcactaataatcccggcacttctggagattgtgatattctacagtgaggacatgtcctgcgtgacaatcgctaaggatattatgatctccatcgtgggcctcctcggatgtatttttggaacctatcaagccctttacgagttgccacaacccatttcacattctatggctaacagcaccggggttcacgcatag

SEQ ID NO: 241507 - DNA, 1536 bp, Artificial Sequence
  Description of Artificial Sequence: Synthetic coding sequence
atgagcctcctggggagggactacaattcagagctgaatagcttggacaatggaccacagagtccgagcgaatcctcctcttctattacatccgaaaatgttcaccccgctggcgaggccggtctctcaatgatgcaaaccctgattcacctcctcaaatgcaatattggtaccggtctgcttgggctgccattagccattaagaatgctgggttactggtaggtcctgtttccctgctcgctattggcgtgcttaccgtgcactgtatggtgatcctcttgaactgcgcacagcacctgtcacagcgtttacagaaaactttcgtaaactatggtgaagccaccatgtacggcctggagacctgtcctaacacatggttgcgcgctcatgctgtgtgggggagatggaatctggctcttagtccacgattggagtgcagtggaaagatctctgctcactgcaatcctcacctacagggaagctccaactctcctgcccaggcttccagggtcgccggaatttatcgatacaccgtttccttccttttggtgatcacgcagctcgggttctgctctgtgtattttatgttcatggccgacaatcttcagcagatggtcgagaaagcccatgtcaccagcaatatatgccagccgcgagaaatcctaactctgacacccattctcgacatccgcttctacatgctgattattcttcctttcctgattctgttggtgttcatacagaacctgaaagtactctctgtatttagcaccctggccaatatcaccaccctggggagtatggccctaatttttgaatatatcatggagggaattccctatccgagtaacttacctcttatggccaactggaaaacctttctcctgtttttcggcactgccatcttcaccttcgaaggagtgggaatggtactccctcttaagaatcaaatgaaacaccctcagcagttctcctttgtgctttatctggggatgtcgattgtgattattctatacatcctgctgggaaccctcggatacatgaagttcgggagcgacacacaggccagcattactctgaatttgcccaactgctggttatatcaaagcgtgaaactgatgtatagcatcgggatcttcttcacctatgctctgcagttccatgtcccagccgagatcattatccccttcgccattagtcaggttagcgagtcatgggctctctttgtggatctgagcgtcagaagcgccctagtatgcctgacatgcgtctcagccatcctgatcccacgactggacctcgttatctccttggtaggaagtgtatcaagcagtgccctcgctctgatcatcccagcccttttggaaatagtgatcttctatagtgaagacatgtcatgcgtaactattgctaaggacataatgatcagcattgtgggcctcctgggttgcatatttggaacctaccaggctctgtacgaacttccccaacccatctctcacagcatggccaatagtactggcgtgcacgcctag

SEQ ID NO: 241508 - DNA, 1515 bp, Artificial Sequence
  Description of Artificial Sequence: Synthetic coding sequence
atggaagccgctgcaacccccgcagccgctggcgctgccagacgtgaggaactggatatggatgtgatgcgtcccttgataaatgaacaaaattttgacggcacatcagacgaagagcacgagcaggaactcctccctgtgcaaaagcattaccaactagacgaccaagaaggcatttcattcgtgcagaccctcatgcatttactcaaagggaatattggaaccggcctgctcggtctcccgctggcaatcaagaacgccggaattgtgctggggcctatctctctcgtgttcattgggattattagtgtgcattgtatgcacatcctggttagatgctctcatttcctttgcctacgattcaaaaaatcaactctcgggtactccgataccgtatcattcgcgatggaggtttccccctggtcatgtctgcagaagcaagccgcatgggggaggtctgttgtcgatttctttttagtcatcacccagcttggtttttgcagcgtctatatagtgtttctggccgaaaacgtgaaacaagtccacgaagggtttctggagtcaaaagtcttcattagcaactccaccaactcctctaatccatgcgagagacggtcagtcgatctgagaatttacatgctgtgcttcctcccgtttatcatcctgctcgtgtttattcgtgagctgaagaacctttttgtactgtcttttttagccaacgtgagcatggccgtttcacttgtcattatataccagtatgttgttagaaatatgccagaccctcacaatctccctatcgtggccggatggaaaaagtatcccctattcttcggaactgccgtgtttgcgtttgagggcattggcgttgtgctgcctttagagaatcagatgaaggagagcaagaggtttccccaggccttgaacatcggcatgggaattgtgactaccctgtacgtgacattagcgacgctcgggtatatgtgctttcatgacgagatcaaaggcagcataacattgaatcttcctcaggatgtgtggctctatcagtcggtcaagattctctactccttcggaatctttgtaacctacagcatccagttttacgtaccggctgagataatcattccgggaattacgtcgaagttccacacaaagtggaagcagatatgcgaatttggaattaggtcttttcttgttagtatcacctgcgccggagcaattttaatcccccgactggacattgtaatttcttttgtgggcgcagttagtagctccacactggctctgatcctgccgccactggttgaaatcctgactttctccaaagaacactacaacatctggatggttttaaagaacatcagcatcgcctttacaggtgttgtgggattcttacttggcacctacatcaccgtcgaagagatcatttacccaactcctaaggtggtcgcgggaacaccccagtccccatttcttaacctaaactcgacatgcctcacatcaggcctgaaatag

SEQ ID NO: 241509 - DNA, 1602 bp, Artificial Sequence
  Description of Artificial Sequence: Synthetic coding sequence
atggcacggcttcccgctgggatccgcttcattatttcctttagccgcgatcagtggtacagggcattcattttcatactgactttcctcctctacgccagcttccatctgtctcgtaaacccatctctattgtgaagggcgagctgcataagtattgcaccgcatgggacgaggccgatgttaggttcagctctcaaaatcggaagtccgggtctgccgctccacaccaactgcccgataacgaaactgattgcggatgggcgcctttcgacaagaacaactatcagcaactcctgggcgctctggactattcctttctgtgtgcatatgcagtaggcatgtatctgtccgggattatcggagagcggctgccaattcgatactatctaaccttcggcatgttagcctccggtgcctttacagccctctttggtctcggttatttttataacatacattccttcggcttttacgttgtgacccaggtcatcaatggcctcgtccagacaaccggctggccctctgtcgtgacttgtcttggcaattggtttggcaagggcagaaggggcttaatcatgggtgtttggaatagccacacaagcgtgggaaacatattgggttccctcattgccggatattgggtgagcacgtgctggggcctttcttttgtagtgccgggtgctattgtcgccgcaatgggaatagtttgcttcctctttttgatcgaacatcctaatgacgtcaggtgctctagcacactcgtgactcatagcaaagggtatgaaaatggtaccaaccgccttaggctgcaaaagcagatcctaaagagcgaaaaaaacaagccactggatccagagatgcagtgcctgctgttgtccgacgggaagggctccattcatcccaatcacgtcgtgattcttcctggtgacggaggcagtgggactgctgcaatctcttttacgggcgcactgaagatacctggggtcattgagttctctctatgcttactttttgccaagttggtgtcctacactttcctgttctggttacctctttatatcactaacgtggatcacctggacgccaagaaggcaggcgaactgtccacactgttcgacgtgggcggtatttttggtgggatattagcaggagtgattagtgaccgactggaaaagagagcctccacatgcggcctcatgttacttcttgccgctccaactctctatattttttcgacggtctccaagatgggtctggaagcaaccatcgcaatgctcctgttatccggggctctagtatctgggccttacaccctaatcacaaccgctgtgtcagcagacctggggacacataagtcacttaaaggcaatgcccacgccttgtccactgtcacagcaattatcgacgggaccggatccgtgggagccgctctggggcctctcctggccggtctgctctccccatccggctggtccaatgttttctatatgctcatgttcgctgacgcctgcgcactgcttttcctcatcagactgattcataaggagttgtcatgccccggaagcgcaactggtgatcaggtgccgtttaaggaacagtag

SEQ ID NO: 241510 - DNA, 1602 bp, Artificial Sequence
  Description of Artificial Sequence: Synthetic coding sequence
atggcccgactacctgccggtatccggttcatcatatctttctcccgcgaccagtggtatcgtgccttcattttcatacttaccttcctgttgtacgcgtcttttcacctgtctagaaaacctatctccattgtgaaaggggaactccacaaatattgcaccgcctgggacgaagccgacgtcagattcagtagccagaatcggaaaagtggctctgcggcacctcatcagctacccgacaatgagactgattgcggatgggctccgttcgataaaaacaattaccagcagctgcttggcgctttggactattctttcctgtgtgcatatgctgtaggaatgtacctatccggtatcattggcgagcgcctaccaattcgctactacctgaccttcggaatgctggctagtggagcctttacggcgttatttggtctcggctatttttataatatccacagttttggattttacgtggtgacacaggttatcaatgggcttgtgcagacaaccggatggccctctgtggtaacttgcctggggaactggtttggcaagggaagaaggggcctaatcatgggcgtctggaactctcacacctctgtgggtaacattctaggctcactgatcgcagggtattgggtgagcacttgttggggactgtcctttgtcgtgccaggagccattgttgctgccatgggtatcgtgtgctttctctttctcatcgaacatcccaacgacgtacgctgtagctcgacactggtgacacattccaaaggatatgagaatggtactaatcgactccggttacagaaacagatccttaagtcagaaaagaataagccccttgatcccgaaatgcagtgtctgctgctttctgatggaaagggatctattcacccgaaccacgtcgtcatcctgccgggagacggagggagcgggacagcagctataagtttcaccggcgcattaaagatccccggagtgattgagttttccctttgcttgctcttcgccaagcttgtgtcatacaccttccttttctggctgcccctgtacatcacaaatgtcgaccaccttgatgcgaagaaagccggagagctatcgactctgtttgatgtcggtgggatatttggcggaatcctggccggtgtcattagtgataggttagagaagagggcgtctacatgcggactgatgttgctgctcgccgctccaactctgtacattttttcaaccgtgtccaaaatgggactggaggccactatagctatgcttctcctgtctggtgcccttgtttccggaccttacaccttaatcaccacagcggtttccgcagatttgggcacccacaaatccctgaagggtaacgctcacgcgctgagtacggtcaccgcgattattgatggaaccggcagcgtgggcgctgccttgggcccacttcttgcaggcctgctgagtccgtccgggtggtcaaacgtattctatatgctgatgtttgccgatgcctgcgcactgctttttctgatacgtctgatccataaagagctgtcatgtcccggttccgcaacaggagaccaggtcccctttaaagagcaatag

SEQ ID NO: 241511 - DNA, 57 bp, Artificial Sequence
  Description of Artificial Sequence: Synthetic coding sequence
atggccagactccctgccggtatcaggttcatcattagttttagcagggaccaatag

SEQ ID NO: 241512 - DNA, 57 bp, Artificial Sequence
  Description of Artificial Sequence: Synthetic coding sequence
atggcacgcctgccggcaggaatcaggtttattatttctttcagccgagaccaatag

SEQ ID NO: 241513 - DNA, 1464 bp, Artificial Sequence
  Description of Artificial Sequence: Synthetic coding sequence
atgatgcatttcaaatctggtctggagttaacagagctgcagaacatgacggtacctgaggacgataatatatcgaacgatagtaatgactttacggaagtagaaaacggccaaatcaactccaaatttatatccgacagggagagtaggaggtctctgacaaactcacatttagagaagaagaaatgtgatgagtatattcctggaacgacaagcttggggatgagcgtcttcaatctcagtaacgccattatgggttccgggatcttagggctggcatttgctctggcaaacacagggatcctcttattcctggtcctgctaaccagcgtgacattactttccatctattccatcaatctgctactgatctgctccaaagagactgggtgtatggtatacgaaaagcttggagagcaggtcttcgggacaaccgggaagtttgtgattttcggtgccacttccctccagaacacgggcgcaatgctatcatacctgtttattgtaaaaaacgagctgcctagcgccatcaaattcctgatgggtaaagaagagactttctcggcctggtatgtcgatggcagagtcctggtcgtcattgtgacgttcggcataatcctgccattgtgcttgctgaaaaacctggggtacctgggctatacgagcggctttagtctctcatgtatggtcttttttttaatagttgtgatatataagaaattccagatcccttgcatagtgccagagctgaacagcacaatctcagccaattcaacaaatgcagatacttgtactcctaaatatgttactttcaattccaaaaccgtgtatgccctcccaactatcgccttcgcttttgtgtgccacccctctgtcctgcccatctacagtgagctgaaggatcgcagccaaaagaaaatgcagatggtatctaatatcagcttctttgctatgttcgtcatgtatttcctcaccgcaatttttggatacctcaccttttatgataacgttcagtccgacctgctccacaagtatcagagcaaagatgatatcctcatactgacggttcgcttagccgtcatcgttgccgtcattctgacagtcccggtcctattttttactgtgagaagctccctcttcgagctcgctaagaaaacaaaattcaatttatgccggcacactgtcgtgacttgtatcctgctggtagtcataaatctgctggtcatcttcatcccatcaatgaaggatatctttggcgtagtcggcgtcacctccgcgaatatgctgatatttatcttgccttcatcgctgtacctaaaaatcaccgatcaggatggcgacaaaggaacccagagaatctgggccgcactcttcctcggactcggggtgttgttcagccttgtatccattcccttagtgatctacgactgggcttgttctagtagcagcgacgaaggccattag

SEQ ID NO: 241514 - DNA, 1464 bp, Artificial Sequence
  Description of Artificial Sequence: Synthetic coding sequence
atgatgcacttcaagagtggactggagctgaccgagcttcagaatatgaccgtgccagaggatgacaatatttctaatgatagtaatgacttcactgaggtagagaatgggcagatcaacagcaaattcatctccgaccgcgaatcgcgtcggtctctcactaattcgcacttggagaaaaaaaaatgcgatgagtatatcccgggtaccaccagcttaggtatgtccgtgttcaacttgagtaacgccattatgggatctggcatcctgggcttagcctttgctctggcgaacacagggattctgctctttttggtgctattgactagcgttacactcctctctatctatagcattaatctattgctaatttgtagcaaggaaaccggatgtatggtctacgagaaattgggcgagcaagtttttgggaccacagggaagttcgtgatcttcggggctacatctttgcaaaatacaggagctatgctgagctatctgttcatcgtgaaaaatgaactgccatcggccatcaagttccttatgggcaaggaagaaactttctccgcctggtatgtggacggacgggtcctcgtcgtgattgtcacttttggcattatcctgcccctctgtctactgaagaacctgggttatctcggttatacatccggattcagcttatcctgcatggtttttttcctgattgtggtcatctataagaagttccagataccctgcatagtgcctgaactgaactcaactatatcagccaattctacaaatgccgacacctgcacacccaagtacgtgacttttaacagcaagaccgtctatgcgctgccaacgatcgctttcgcattcgtgtgtcatcctagtgttctcccaatctacagtgaactgaaagaccggtcacagaaaaagatgcagatggtgtctaatatcagttttttcgcaatgtttgtcatgtattttctgactgcaattttcggctacctgacattctatgataatgtgcagagcgatctgctgcacaaataccaatcgaaagacgatattttgatcctcactgttaggctagcagtgatagtcgccgttatactgactgtgcccgtcctgttttttacagtccgatcatccttattcgagctggcaaagaagactaagttcaacctttgtcgccatacagtcgtgacttgcatccttctcgtcgtgatcaacctgctggtgatatttatccccagtatgaaggatatattcggtgttgttggggtaacaagtgcaaatatgctgatatttattctgccttcaagcttgtacctgaaaatcactgaccaagatggggataaagggacacagaggatctgggcagccctattcctgggactgggcgtgctatttagcctggtgagtatccccctggttatctatgattgggcctgcagctcctcctcagacgagggacactag

SEQ ID NO: 241515 - DNA, 1464 bp, Artificial Sequence
  Description of Artificial Sequence: Synthetic coding sequence
atgatgcactttaagtccggactcgagctgaccgaattacaaaacatgacagtcccagaagacgacaacatctccaacgactctaatgattttactgaagtggagaacgggcagatcaactccaagttcatttcagaccgagaaagtcgccgaagcctcaccaactcgcacctcgaaaagaagaagtgtgacgagtacattcctggcactacgtcactgggcatgtcagtgtttaacctgagtaatgcgatcatgggaagtggcatattgggattggccttcgcgttggctaatacaggaattcttttatttttggtgctactgacatcagtcaccctactcagtatctatagtatcaatctgctgcttatctgcagcaaggaaaccggctgcatggtgtacgagaaactaggtgagcaggttttcgggacaaccggcaaattcgtcatctttggagcaacatcactgcagaataccggtgcgatgctatcctacctgttcatagtgaagaatgagctccctagcgcaatcaaatttttaatggggaaagaagaaaccttttccgcatggtacgtggacggtagggtgctggtggtgattgtcacctttggtataattcttcctttatgcttgctgaagaacctaggctacctcgggtacactagcggcttcagcttatcgtgcatggtattttttctgatcgtcgtcatttataaaaagtttcagattccctgtattgtgccagagctcaacagcactataagcgccaattctaccaacgctgacacatgtactccaaaatatgtgactttcaatagtaagacggtctacgcactgccgaccatcgccttcgcctttgtttgtcaccccagcgtgttgccaatatattccgagctgaaagaccgctctcaaaagaaaatgcaaatggtttctaatatctcattctttgccatgttcgtgatgtattttctaacggccatcttcggttacctgacattctacgataatgtgcagagcgaccttctacacaagtaccagagcaaagacgatattctcattctaactgtgcggcttgcagtaatcgtggccgtgattcttaccgtgcccgttctcttttttaccgtgaggtcttcactcttcgagctggccaaaaagacaaaatttaatctgtgccggcataccgtagttacatgtatcttacttgtagtgattaaccttcttgtcatctttattccgagcatgaaagatatattcggagtcgtgggagtcactagtgctaacatgctgatcttcatcctcccttccagtttgtatctgaagatcacagaccaggacggcgacaaagggacacagcgcatttgggcagccctctttctaggcttaggcgttcttttctcactagtgtctattcctctggtgatatatgattgggcatgctcgtccagtagcgatgaaggtcactag

SEQ ID NO: 241516 - DNA, 1464 bp, Artificial Sequence
  Description of Artificial Sequence: Synthetic coding sequence
atgatgcacttcaaatcgggattggagctgacagagttgcagaacatgaccgtgcccgaagatgataacatctccaacgatagtaatgacttcaccgaggtggaaaatggacagattaactccaagttcattagcgatcgggaaagccggagatccctaaccaattctcacttggaaaaaaagaagtgcgacgagtatatacctggcaccaccagcctcgggatgtcggtgttcaacctcagtaacgctatcatgggatccggtatcctagggctggccttcgctctggccaatactggaattctcttattccttgtcctgctcacaagtgtcacgcttctgtcaatctacagcatcaatctgctacttatatgttctaaggagaccgggtgcatggtttatgagaagctgggcgagcaggtgtttggaactaccggcaaatttgtgattttcggcgcaacaagtttgcagaacacgggagctatgctatcctacttgttcattgttaagaacgaactaccttcggcaattaaattccttatggggaaagaagagaccttcagcgcctggtatgttgatggacgcgttcttgtagtgatcgtaacatttggtattatcctgcccctctgtcttttgaagaacctcggttacctgggatacacctcaggtttctccctgtcctgcatggtgtttttcctaatagtcgtcatctataagaaattccagatcccttgcattgttccggaactgaattcgaccatatccgccaactccacgaatgcggacacatgcaccccgaaatacgtcacattcaatagcaaaacagtctacgccctgcctacaattgccttcgcattcgtttgtcacccatcagtgttaccaatatactccgagctgaaagacaggagtcagaaaaaaatgcaaatggtctctaatatctctttcttcgccatgtttgttatgtatttcctcaccgccatcttcgggtacctgactttttacgataacgtgcagtctgaccttctccacaagtaccagagcaaggatgatatattgatactgacagttcgcctggccgtgattgtagcagtcatcctgactgtgcctgtgctcttcttcacggtgaggagctccttgttcgagctggcgaagaaaactaagttcaacctatgcaggcacaccgtggtgacctgtatcctgctcgtcgtgataaacctgctggtcatctttatcccaagcatgaaggatattttcggagtggtgggcgtgaccagcgccaacatgctgatcttcattttgccctcaagcctgtaccttaaaattacggatcaggacggagacaaaggaacccagagaatatgggctgccctgttccttgggctcggggtgcttttttccctcgtatccatcccattagtcatttatgattgggcatgctccagcagtagtgatgaaggccattag

SEQ ID NO: 241517 - DNA, 1521 bp, Artificial Sequence
  Description of Artificial Sequence: Synthetic coding sequence
atgaagaaagctgaaatgggcaggtttagcatcagccccgatgaagatagctccagttactcatcaaactctgatttcaattactcttatcccaccaaacaggccgctctgaagagccactacgcagatgtggaccccgagaatcaaaattttctgctggagtctaacctcggtaaaaaaaagtacgagaccgaattccatccagggactactagcttcgggatgtcagtgttcaacctgtctaacgccatcgtgggctccggcattttgggattgtcttatgcaatggctaataccggcatagcactctttatcattctgctgaccttcgtgtcgattttctcactgtatagtgtccacctattactgaagaccgccaacgaaggagggtcactgctctacgagcagctcggctacaaggcgttcggcttagtggggaaactcgctgctagtgggtccatcaccatgcagaacatcggagccatgtcttcttacctgtttattgtgaaatatgagctgcccttagtcatccaagccctcaccaacatagaggacaaaacaggcctatggtaccttaacggcaactacctggtgctgcttgtgagccttgtcgtaattcttcctctgagtctcttccgtaacctaggctacctggggtacacaagcggattgagcttgctgtgtatggtgttttttctcattgtggttatctgtaagaaatttcaagtgccgtgtcccgtagaggccgcactcattatcaatgaaaccatcaatactaccctcacgcaacctactgccctggttcccgctctgtcccataacgttacagagaacgactcttgtcgtccacactatttcattttcaactcccagacagtttatgccgtgcctattctgatcttcagcttcgtgtgtcatcccgctgttctgccaatatatgaggagctcaaggaccggtcccgtcgcagaatgatgaatgtgtctaagatttcgttcttcgctatgtttctgatgtacctgttggcggctctattcggttacctgaccttttatgaacacgtcgaatccgagctcctccatacatacagcagcatcctcggcacagacatcttgctcctgatcgttagactcgcggtcctgatggccgtgaccctgaccgtgcccgtcgtcatctttcctattcgctcctctgtgacccacttgctgtgtgcttcgaaagatttctcttggtggcgacactcattgatcactgtgtctatccttgcattcaccaacctgctcgtgatattcgtgccaactatcagggacatttttggctttatcggcgctagtgctgcctccatgctgatcttcattctgccatccgcgttttacattaaactggtgaaaaaagagcccatgaaatctgtccagaaaatcggggcactgttcttcctgctgagtggcgttctagtcatgacggggagtatggccctgattgtcctggattgggtgcacaacgcaccgggagggggtcattag

SEQ ID NO: 241518 - DNA, 1644 bp, Artificial Sequence
  Description of Artificial Sequence: Synthetic coding sequence
atggacccgatggaactccgaaatgtcaacatcgagccggacgacgaatcatcctcaggcgagagtgcccctgattcatatattggtatcggcaacagtgaaaaagccgcaatgagcagtcagttcgccaatgaggataccgagtcccaaaagttccttacaaacggctttttggggaagaagaagctggcagattacgctgacgagcaccatccaggtacaacgtcatttgggatgagttccttcaatctatccaatgcaattatgggaagcggtatccttggcctgtcctatgccatggcaaatacaggcatcatcttgttcatcatcatgctccttgccgtggcaatcttgagtctctatagcgtccacttgctcttaaaaactgccaaggagggaggatcactcatctatgagaaactcggagagaaggcattcggatggcccggtaagatcggagcttttgttagtatcacgatgcagaacattggcgcaatgtcatcctatctctttatcatcaaatacgaactcccagaagttatccgcgctttcatgggcctggaggaaaataccggagaatggtatctgaacggcaattatctgatcatctttgtgtctgtaggcattatcttgcctctttcccttctcaagaatctgggctatctaggatatactagtggtttttcactgacctgtatggttttttttgttagcgtcgtcatttacaagaaattccaaattccttgtcctctccctgtgctagaccactccgtgggtaacctaagcttcaacaatacgctcccgatgcacgtggtgatgctgccgaataattcagaatctagcgacgtgaattttatgatggactacacacaccggaatcctgctggcctggacgagaaccaggccaagggatccctgcacgacagtggcgtggaatacgaagctcattcagacgacaagtgcgagccgaagtactttgtgttcaacagcaggactgcctatgcaatccctattctcgttttcgcctttgtgtgccacccagaggtgctgcccatctacagcgagctaaaggacagatcccgcagaaaaatgcagacggtgtctaacatctctatcacaggaatgcttgttatgtacctgttggccgctctgttcggttacctgactttttacggtgaggtggaggatgagctgcttcacgcctactcgaaggtctacaccctggacatcccacttctcatggtcaggttggcagtgctagtggccgtcacactgacggtgccaattgtgctcttccccatccggactagtgtcataaccctgctgttcccgaagcggcctttctcgtggattcggcatttcctgattgctgccgtgttgatcgctttgaataatgtcctggtgatactggtcccaactatcaagtacatctttggatttatcggcgcttcgagtgctaccatgctgatatttattctaccagcagttttttacctgaagctggtgaagaaagagacatttcggagtcctcagaaggttggcgctctaatatttcttgtcgtgggaatctttttcatgatcggctctatggccctgatcatcatcgactggatctacgatccccctaattccaaacaccattag

SEQ ID NO: 241519 - DNA, 780 bp, Artificial Sequence
  Description of Artificial Sequence: Synthetic coding sequence
atggacccaatggagctgaggaatgtcaatatcgaacccgacgacgagagtagtagtggtgagtccgcgcctgacagttacattggaataggtaacagcgagaaagccgctatgagtagtcaatttgcaaatgaggacaccgagagtcagaagttcctaactaatggtttcctggggaagaagaagcttgccgattacgccgatgagcaccaccccggaacgactagctttggcatgtcctccttcaatctttcaaacgcgataatgggctcagggatccttgggctgtcatacgccatggcgaacacggggattatcctgtttatcatcatgctactggccgtcgctattctaagtttgtactccgtgcatctactgctgaagacagccaaggaagggggatccctaatttacgaaaaacttggagaaaaggcatttggatggcccggaaagattggcgcattcgtgagcataacaatgcagaacataggagccatgtcctcttacctcttcatcattaagtatgaactgcccgaggtcatccgggctttcatgggcttagaagaaaacaccggtgagtggtacctgaacggaaactacctgatcatttttgtgtccgtcggaataattttgcccctgtctctgctaaaaaatctgggatacctcggatacacctcaggcttttccttaacatgcatggtattcttcgtaagcgtgatgatctacaagaaaatcagtttcttccttcagatcttcatcatactgaagctctttttttag

SEQ ID NO: 241520 - DNA, 1644 bp, Artificial Sequence
  Description of Artificial Sequence: Synthetic coding sequence
atggaccccatggagctgcggaatgtgaacatcgagccagacgacgagtctagttctggagagtcagcccctgactcctacatcggcatcgggaacagtgagaaggccgcaatgagctcgcagttcgcgaacgaagatactgagtcacagaaattcctaacaaacggatttctaggcaagaagaagctggctgattatgctgatgagcatcaccccggtacaacttccttcgggatgtcatcattcaatcttagtaacgcgattatgggctctggcatactgggtctgtcatatgctatggccaacactggcatcattctgtttatcataatgcttttagccgttgccatccttagtctgtattcggtccacctcttactgaaaaccgccaaggagggaggcagcctgatttatgagaaactgggtgaaaaggcttttggctggcccggaaagattggggcatttgtctccattacaatgcagaacatcggagctatgagctcttacttgtttattattaagtacgagctgcccgaagtgattagagccttcatgggtttggaagagaataccggcgagtggtacctgaacggcaattatctgatcattttcgtgtccgtgggcatcattctgccactctcgctgcttaagaatcttggatacctcggatatacaagcggcttctcattgacatgcatggtgttctttgtttcggtggtgatctataaaaagttccagatcccctgtcctctcccagtcctggatcactccgtgggcaacctgtcttttaacaacaccctccccatgcatgtcgtaatgttgccaaataactcagagtcttcagacgtcaattttatgatggactatactcacagaaacccagccggtttggatgagaaccaggccaaaggtagcttgcatgattccggcgtcgaatacgaagcgcacagtgacgacaagtgtgagccaaagtactttgtatttaattcccgaactgcgtacgccattcctattcttgtgtttgccttcgtctgtcaccccgaggtcctgccaatttattctgagctgaaggaccggagccgccgtaagatgcagaccgtcagcaatatctctatcaccggaatgctggtgatgtacttgcttgctgctctgtttggttatctgacattttacggggaggtggaggacgaactgctccacgcgtatagcaaagtttacacccttgatatcccactgttaatggtgagactcgctgttctggtggctgtgacactgactgtcccaattgtgttgttcccgatcaggacgtcagtgattactcttctgtttcccaaaaggccgttttcttggatccgtcattttctgatcgctgctgttttaatcgcactaaacaatgttctcgtaatactggtccctacaattaagtatatcttcggttttatcggagcaagtagcgccacaatgctgattttcatactccccgctgtcttttatctcaaactggtaaaaaaagagacattccgaagccctcagaaggtgggcgcactgatcttcttggtggtaggaattttctttatgatcggcagcatggcactaataattatagactggatttatgatccacccaactctaagcaccactag

SEQ ID NO: 241521 - DNA, 579 bp, Artificial Sequence
  Description of Artificial Sequence: Synthetic coding sequence
atggacccaatggagttgaggaacgtgaatattgagccagatgacgagagtagctccggcgaatccgctcctgacagctacattggcattggtaacagcgaaaaggctgccatgtcatcccagttcgctaatgaggataccgagagccagaaattcctcaccaatgggtttctgggcaaaaaaaaacttgcagactacgcggacgagcaccaccccggaaccacttctttcggaatgtcatcatttaacctgagcaatgcaatcatggggtccggaatcttgggtttaagctatgccatggccaacaccggcatcatactcttcataatcatgctcctggccgttgccattctatccctgtactcagtgcacctgctgttgaaaactgctaaggaggggggttcgttgatttatgagaagctcggggagaaagcattcggctggcccggaaagatcggcgcatttgtctccattaccatgcaaaacattggagctatgtcctcttacctgttcattattaaatacgaactgcctgaggtgattagagctttcatgggactcgaagagaacaccgggtag

SEQ ID NO: 241522 - DNA, 660 bp, Artificial Sequence
  Description of Artificial Sequence: Synthetic coding sequence
atggatcccatggaactgaggaatgtcaatatcgagcccgacgatgaatcatcttcgggcgaatcagcgcctgactcctacattggcattggcaattcagagaaggctgctatgagcagccagtttgctaacgaggatactgaaagccagaagttcttgactaacggattcttggggaagaagaagctggctgactacgctgatgagcatcatccaggaactacatcctttggaatgtccagttttaacctctccaatgccatcatgggatctggcattcttggactgtcctacgccatggctaacactggcataattttgttcatcatcatgctcttggccgtcgcgatcctgtcgctgtacagtgtgcatttgttgctgaagacagccaaggaagggggatcactcatctatgagaagctgggagaaaaggcctttggctggcctggtaagatcggcgcatttgtgagtataacaatgcaaaatattggagccatgtctagttatttgtttattataaagtacgagctgcccgaggtcattagggcttttatgggtctggaagagaacaccggtgagtggtacctgaatgggaattacctcattatctttgtcagtgtgggtatcatcttgccactgtcgctcctcaaaaatctgtag

SEQ ID NO: 241523 - DNA, 1419 bp, Artificial Sequence
  Description of Artificial Sequence: Synthetic coding sequence
atggaactccaggaccccaaaatgaacggagccctgccatctgatgccgtcggataccgccaggagcgggaaggctttttgccctcccgaggcccagccccagggtctaagcccgttcagttcatggactttgaagggaaaacatccttcggaatgtccgtctttaatctgtccaatgcaataatgggaagcggtatcctcgggctcgcatatgctatggcacacaccggtgttatttttttcctagctctgcttttgtgtatcgctctcctctccagctactccatccatcttctgctgacgtgtgctggtatcgcgggaataagagcttatgagcagttgggacaacgcgcattcggacctgccggaaaggtggtcgttgcgactgtgatctgcttacacaacgtgggggcaatgtcttcttacttattcatcatcaagtcggagctgccactggtgatcggaaccttcctgtatatggatccggagggcgattggtttctgaagggcaacctcctgattattatcgtgagcgtcctgatcatcctacccctggccctgatgaagcacctggggtatttaggctatacctcgggcctcagcttgacatgtatgctgtttttcctcgtttcagtcatctacaaaaagttccaactgggctgtgccattggccataacgaaactgcaatggaatcagaagctctggttggcctcccctcacaagggctgaattccagctgcgaggcacagatgttcactgttgattctcagatgtcatatacagttccgattatggcttttgcttttgtgtgccaccccgaggtgctacccatctataccgaactgtgccgacccagcaagcgtcgtatgcaggccgtagccaacgtgtccattggtgccatgttttgtatgtatggcctgacagcaactttcgggtatctgacattctattctagcgtcaaggcagagatgctccacatgtattctcaaaaagatcccctgatcttatgtgtccgcttggctgtgctactcgccgtcaccttaacagtgcctgtggtgctgttcccgattaggagggccctccagcaactccttttcccaggcaaggctttctcatggcctcggcacgtggccatcgcactcattctgctcgtgttagtcaatgttttagttatatgcgtgcccaccattcgcgatatttttggagtgattggtagcacctccgccccaagccttatattcattctgccgtcgattttctacttacgtatagtcccttctgaggtcgaacctttcctcagttggcctaagatccaggctctgtgcttcggagtgctcggggtcctgttcatggctgtgtccctagggttcatgtttgccaattgggctactggtcagtctcggatgagtggacattag

SEQ ID NO: 241524 - DNA, 1266 bp, Artificial Sequence
  Description of Artificial Sequence: Synthetic coding sequence
atgtccgtgttcaacctgtccaacgctattatgggatccggtattcttgggctagcctacgcaatggcacatacgggagtcatattctttttagccctgctgttatgtatcgcgctactcagctcctattctattcatctgctacttacatgtgccggaatcgcaggcattagggcctacgaacagcttggccagagagcattcggcccagcaggtaaggtggtggtggccaccgtcatttgcctgcacaacgttggagccatgtcttcatatctctttattatcaagtcggagctgccactggtgatcggcacgtttttatacatggatcctgagggagactggttccttaaaggaaatctgctcatcataattgtctctgtactgattattctgccattggcgttgatgaagcatctgggttacttgggctacacatctggattgtcgttgacatgtatgctcttcttcctggtcagcgttatctataagaagttccagctgggctgtgccatcgggcataatgagaccgccatggagtcagaggcactggtcgggcttccttcacaggggctcaactcatcttgcgaggcccagatgtttacagtcgacagtcagatgtcctatactgtacccatcatggccttcgcattcgtttgtcacccagaggtcctgcctatctacaccgagctctgtagacccagcaagcgacggatgcaggcggtggctaacgtgagtataggcgcaatgttctgtatgtacggtttgacggccacttttggctatctcactttctattcctcagttaaggccgaaatgcttcacatgtactcccaaaaggatcctttaattctgtgcgtgcgacttgcagtgttgctggctgtcacattgaccgtccccgtcgtgctgtttcccatccgcagggccctgcagcagctcttgttccccggaaaggcttttagctggcctcgacacgtggccatcgccctcatcctcctcgttctggtcaatgtactggtgatatgcgtaccaacgatccgcgacatattcggagttatcggatctaccagcgccccttctctgatctttatactaccttcgattttctaccttcggatcgtaccatcagaggtggaaccattcttgtcatggccgaagatccaggcgttgtgctttggcgtactgggcgtgctgtttatggctgtaagcttggggttcatgttcgctaattgggccacaggccagagccgaatgtcagggcactag

SEQ ID NO: 241525 - DNA, 1419 bp, Artificial Sequence
  Description of Artificial Sequence: Synthetic coding sequence
atggagctccaggatcctaaaatgaatggagccctaccgtccgatgctgtgggctataggcaggagcgagagggatttttaccctctcggggacccgctcctggtagcaaacctgtgcagttcatggactttgagggcaaaacatcatttggcatgtcagtattcaacctcagtaatgctatcatgggctctgggatcctcgggctggcttacgccatggcgcacacaggggtcattttctttctggccttgcttctttgcatcgctttgctctcctcttacagtatacacctcctccttacttgtgccggtatagcagggataagagcgtacgagcaactgggtcagagggcttttgggccagccggaaaggttgtggttgccaccgtgatttgcctgcacaacgtaggagcgatgtcttcttatctgttcataattaagagtgagctgcctctggtaatcggcacatttttgtatatggacccagagggcgattggttcttgaaaggcaaccttctgataattatagtgtctgtgctgatcattctgcctctggctctcatgaaacatttgggatatctgggttacacctcaggcttgtcattaacttgcatgctcttctttctggtctctgttatttataaaaagtttcagcttggatgtgcaattgggcataacgaaactgctatggaaagtgaggccttggttggtctgccatctcagggactcaattcatcttgcgaggcacagatgtttaccgtggactcacagatgtcctatacggtcccaatcatggccttcgcgttcgtgtgtcatcccgaggtgctgcccatctataccgaactgtgcaggcctagcaaacggagaatgcaggcggtggcaaacgtttccattggtgccatgttttgcatgtacggccttacagctacattcggatacctaactttttacagttctgtgaaagccgagatgctccacatgtacagccaaaaggacccgctaatcctatgcgtgaggttggccgtgctgttggctgtgacattaaccgtacccgtggttctatttccaattcgcagagccctacaacagcttttgttcccaggcaaggccttttcatggccgaggcacgtggccatcgctctgatcctgctggtcttggtgaacgtcctggtgatctgtgtgccaaccattcgcgacatttttggggttattggctccacatcagccccaagtctcatatttatattaccttccatcttctaccttcgcattgttccaagtgaggtcgagccatttctaagttggccaaaaatccaggcactatgtttcggcgtgttgggagtactttttatggcagtttctttaggctttatgtttgccaactgggccacaggccagtcacgcatgtcgggacattag

SEQ ID NO: 241526 - DNA, 660 bp, Artificial Sequence
  Description of Artificial Sequence: Synthetic coding sequence
atggagctccaagatccgaagatgaacggagcactgcctagtgacgcagtgggctataggcaggagcgggagggtttcctcccctcccgtggccctgctcctggttctaaaccagtgcagttcatggatttcgaaggtaaaactagctttggtatgtcagtattcaatctttctaacgccattatgggatctggtatccttgggctcgcctacgccatggctcatactggcgttatcttctttcttgcactgctgctctgtatcgcactgctgagctcatattcgatacatctgctgttaacgtgtgccggtattgccggaattcgcgcttatgagcaactcggtcagcgcgcatttggccctgcaggaaaggtcgtggtggcaactgtcatctgtctgcataatgttggggctatgtcaagctacctattcatcattaagtctgagcttccactggtaattggcacttttttatacatggatccagagggcgactggtttttaaagggtaatttactaatcataatcgtcagcgtgttgattatcctccccctcgctttgatgaaacatttgggttatctcggttacacctcggggctgtcacttacttgcatgctctttttccttgtgtctgtgatttataagaaatttcaattatag

SEQ ID NO: 241527 - DNA, 576 bp, Artificial Sequence
  Description of Artificial Sequence: Synthetic coding sequence
atggaactgcaggatccaaagatgaatggggcactaccgagtgacgccgtgggatatcggcaagagagagaaggctttctcccttctaggggaccagccccaggatccaaacccgtgcagttcatggacttcgaagggaaaacaagtttcggcatgagtgtgttcaacctctctaacgcaatcatggggtccggcattcttggcttggcatacgctatggctcatacgggagttattttctttttggctctgctgctgtgcattgcccttttatccagctactccatccacctgctcttgacgtgcgctggcatcgctgggataagggcgtacgagcagctgggccagagagcgttcggtcctgcaggaaaagttgttgtggccaccgtgatctgcctgcacaacgtaggcgctatgagttcttacctgtttattatcaaaagcgaacttccactagtcattgggacatttttatatatggatcctgaaggcgactggtttcttaagggaaacctactgattatcattgtgagcgtgctgataattctaccgctcgccctgatgaaacacctctag

SEQ ID NO: 241528 - DNA, 495 bp, Artificial Sequence
  Description of Artificial Sequence: Synthetic coding sequence
atggaactccaggacccaaagatgaacggggcacttccgtctgacgccgttgggtacagacaggagcgtgaggggtttctgccaagccgaggccctgctcccggatcaaagcctgtccagtttatggatttcgagggcaagacttcatttggcatgagcgtgtttaacctgagcaatgctatcatggggagcggaatcctgggtttggcatacgcaatggctcatacaggcgtgatcttttttctggccctgttgttgtgcatagctctgctgtcctcttactctatccatttgctgttgacctgcgccggaattgcgggaattcgagcatacgagcagctcggccagagggcgttcggaccagctgggaaggtggtggtggcaacagtgatctgcttacacaacgtgggggcaatgagctcctatctttttattattaaaagtgaactgccgcttgtcattggcacctttctgtacatggacccagagggatag

SEQ ID NO: 241529 - DNA, 840 bp, Artificial Sequence
  Description of Artificial Sequence: Synthetic coding sequence
atggagctccaagatccaaaaatgaacggtgccctgcccagtgatgctgttgggtatagacaggaaagggaaggcttcctcccttctcggggtcctgccccaggaagcaaacctgttcagtttatggactttgagggaaagacttcttttgggatgtccgtgtttaatctctccaatgccatcatgggctcaggcatcctgggactggcatatgctatggctcataccggagtaattttcttcttggccctcctactctgcattgcccttcttagcagttattctattcacctgctgctgacatgtgctggtattgcgggaatccgcgcatacgaacaactagggcaacgcgcttttggcccagccggtaaggtcgtggtggcgactgtcatttgcttacacaatgtcggcgctatgagctcctatctgttcattataaagagcgagctgccactagtaattgggaccttcctttatatggaccctgagggcgactggttcctgaaggggaatctcctcatcataattgtgtccgtgctcatcatcctgccactggccctgatgaagcacctcgggtatctcggttacacgagcggtctgagtctcacctgcatgctgttctttctggtgagcgtcatatacaagaagtttcagctcgggtgtgcaattggacataatgagaccgcgatggagtccgaggcgttggtgggcctgccctctcaggggttaaactcatcgtgtgaggcacagatgttcacagttgacagtcagatgtcctatacggtgcccataatggccttcgcctttgtgtgccatcccgaagttctcccaatttactag

SEQ ID NO: 241530 - DNA, 819 bp, Artificial Sequence
  Description of Artificial Sequence: Synthetic coding sequence
atggaactccaggatcccaagatgaatggcgctctcccatcggatgcggtgggataccgtcaagaacgtgaaggttttctgccctcacgcggacctgcaccaggttccaaacctgtgcagttcatggacttcgaaggtaagactagcttcggaatgtctgtttttaatctgtccaatgcgatcatgggcagtgggattttaggtctggcttacgccatggcccatacgggtgtgatcttctttctggccctcctgctatgcatagccttgctgagctcctactctatacatctgctgctgacctgcgccggtatcgcgggtattcgggcttatgaacagctgggccaacgcgcttttgggcctgctggaaaggtggtcgtcgctacagtgatctgcctacacaatgtgggagctatgtcatcatacctgttcattattaaaagcgaattaccactggtgattgggacttttctctacatggatcctgaaggcgactggttcctgaagggtaatctcctgattataatagtgtctgtgttaatcattctcccgttagctttaatgaaacatttaggctatctgggatatacatctggcctttcactgacatgtatgctttttttcctggtttctgttatctataagaaattccagctcgggtgtgcaatcggacacaacgagactgctatggaatcggaagccctagtggggctgccttcacaaggtctgaactcaagttgcgaggcacaaatgttcacagtggatagtcagatgtcatataccgttccaatcatggcatttgcctttgtgtgccactag

SEQ ID NO: 241531 - DNA, 1422 bp, Artificial Sequence
  Description of Artificial Sequence: Synthetic coding sequence
atggccacacaagcgaagcggcctcgagtggccggacctgtggatggcggagacctggacccagtggcctgtttcctgtcctggtgccgaagggttggattggaactgagtcctaaagtctctgagcgggctggcggtcgaaggacccgcggaggcgcacgggctgccctgacttctcctcctgcccaggttgccgtatcccgacagggaaccgttgctggatatggcatggtggctcgagagtcggtccaggcaggggagctccttttcgtggtgcctcgggcagcccttctgtctcaacacacatgcagcataggcggtctccttgaacgagaacgggtggcactccaaagccagtccggttgggttccactgctgcttgccctcttgcatgaactacaggcaccagccagcagatggcggccttattttgccctctggcctgaactgggacgtttggaacaccctatgttctggcccgaggaggaacgccgatgtctcttacaagggactggcgtccccgaggcagtggagaaagatcttgctaatattcgctctgagtaccagagtattgtgctgcctttcatggaagcgcatccagacctattctcattacgggttcggtcactggagttatatcatcagctggtcgcgctggtcatggcctattcatttcaggaacccctcgaggaagaagaagacgagaaagagcctaactctcccgttatggtacctgcagccgacatcttgaaccacttggcgaatcacaacgccaaccttgaatacagcgccaactgccttcgtatggtcgcaacccagccgatacctaaaggacatgaaatatttaacacctacgggcagatggccaactggcagctcatacacatgtatggcttcgttgagccctacccggataatactgatgacacagccgatattcagatggtgactgtccgggaggccgcattgcaaggtaccaagaccgaagccgaaaggcacctggtgtatgagaggtgggatttcctgtgcaagctggaaatggttggagaagaaggggcattcgtgattggaagggaggaggtgttgacagaggaggaactgacgactactctgaaggtgctgtgtatgcccgctgaagagttcagagaacttaaagaccaggatggaggaggggacgacaaacgagaggaggggagcctcaccattacaaatatccccaaactgaaggcatcttggagacagctcctgcagaactcagttcttctcaccctgcagacctacgcgacagatctcaagacagatcagggactcctgagcaacaaggaggtctacgccaagctctcgtggcgggagcagcaggctctgcaggtccggtatggacagaaaatgatcctacaccaactcttggagctgacatcctag

SEQ ID NO: 241532 - DNA, 975 bp, Artificial Sequence
  Description of Artificial Sequence: Synthetic coding sequence
atgggaccatggggtgagccagagctacttgtctggagacccgaagccgtagccagtgaacctcctgtcccagttgggttggaggttaaactgggcgcactggtcttgttgcttgtgcttactcttctgtgctccctcgtcccgatttgcgtgttgaggaggccaggggcaaaccacgagggttccgctagtcgtcagaaggctctctctctggtaagctgtttcgccggaggcgttttcctggcaacgtgcctgttagatttgctaccagattacctcgcagccatcgatgaagctctggccgcactgcatgtcacattgcaattccctctacaggaatttattcttgccatgggcttttttttggtcctggtgatggagcagatcactctggcatacaaggagcagagtgggccatctccgcttgaagagacgagggccctgctgggcacagtgaacggcggaccccagcactggcatgacggcccaggggtaccccaggcttctggcgctcccgcaactccttcagcactcagggcttgtgtcctcgttttctctctggccctgcattcagtgtttgagggactggcagtgggacttcagagagatcgagccagggcaatggaactgtgtctggcactgttactgcataagggtatcctggcagtgagcctgagtctcagactgctgcagtctcatctccgagcacaggtcgtagctggttgtggaatcctgttcagctgtatgacccccttgggtatagggctgggggcagccttggccgaatctgccggtcccctgcaccagttagcccaatccgtgctggagggcatggcagcaggcaccttcctctatatcacctttctcgaaatcctgccccaggaattggcatcatccgagcagcgtattctaaaagttatcctgctgttggctgggtttgcgctgcttacaggcctgctctttatccagatctag

SEQ ID NO: 241533 - DNA, 975 bp, Artificial Sequence
  Description of Artificial Sequence: Synthetic coding sequence
atgggcccatggggcgagccagagcttctcgtgtggcggccagaggccgtggccagcgaaccccctgtacccgttgggctggaggtcaagcttggtgccctggtgctgctcctggttctcacgctactttgtagtctggtccccatctgcgtgctgaggaggccaggagctaaccatgaaggctccgcatcccgccaaaaagcactcagcctggtgtcttgtttcgcagggggagtgtttctggccacctgtctcctagacctacttccagattatctggcagccatcgacgaagctctggcagcactgcatgtgacgctgcagttccccctgcaagagttcattttagccatgggtttttttctggtccttgtgatggaacaaataacactggcatataaagagcagagcggaccttctccactagaggagacccgggctcttctggggacagtgaacggcggaccacagcattggcacgatggccctggcgtgccccaagccagcggtgctccggcaacacctagtgctctgagagcctgcgttctggtcttctcgttagccctccattccgtgtttgaggggctggcagtcggcctacagagagatcgcgctagagcaatggagctgtgcctggcacttttgctgcacaaagggattcttgctgtgtcactgagtttacgcctccttcagtctcatctgcgagctcaagtggtcgccggatgcggtatactgttttcgtgtatgacacctctcggtatcggcctgggagcggctctcgcggagtccgccggaccccttcatcaactagcccagtccgttctggagggcatggccgcaggaactttcctgtatattacattcttagagattttgccccaagagctggccagttccgaacaacggattttgaaagtgatactccttttggcgggtttcgctctcctgaccggattactttttattcagatctag

SEQ ID NO: 241534 - DNA, 975 bp, Artificial Sequence
  Description of Artificial Sequence: Synthetic coding sequence
atgggcccttggggagagccagagctgttggtgtggaggccagaggctgtggccagcgagccccctgtaccggttggacttgaggtcaagttgggagctctggtactgttgctggtattgacactgctgtgctccttggttccaatctgcgtgctgaggcgtccaggtgcgaaccacgaaggcagtgcctccagacagaaggccctgtccttggtgtcctgtttcgctggtggggtctttttggctacctgtctgctagacttgctcccggattatctggctgcaattgatgaggcgctggctgctctgcatgtgaccctgcagtttcccctgcaggagttcatcctcgccatgggctttttcctcgtgctggttatggagcagatcactttggcgtacaaggagcagtccggccctagcccactggaagaaacaagggcacttctggggacagtcaacggaggacctcagcactggcatgacggacccggtgtgcctcaggcatccggcgctcccgctacaccctctgcactgcgggcttgcgtgctagtgttctctctcgcgctccatagcgtgttcgagggtctcgctgtggggctgcaacgagatagagcacgtgcaatggagctgtgtctggctctgctcctccataaagggatcctagccgtgtctctctccctcaggctgttgcagtcgcaccttagagcacaggtcgttgctggctgcgggattctgttctcttgtatgacaccgcttgggattggcttgggtgcggctctggcggagtccgctggccctttgcatcagctcgcccagagcgtgttagagggaatggccgctgggaccttcctgtatatcacttttctggagatcttgcctcaagagctagcttccagcgagcagaggattctgaaggtaatcttgctcctggccggttttgccttgctgactggactgcttttcatccagatatag

SEQ ID NO: 241535 - DNA, 975 bp, Artificial Sequence
  Description of Artificial Sequence: Synthetic coding sequence
atggggccatggggcgaacctgagctcctggtatggagacctgaggctgtggctagcgaacccccagtgcccgtagggctcgaagttaagttaggagcattggtgctgctgctggtacttactctgctctgctccctcgtaccaatttgtgtgctccgccgaccgggagccaatcacgagggcagtgcttcgcgccagaaagcgctatcactggtgagctgttttgcgggaggagtctttctggccacctgtcttctggatttactgccggactacctggctgcaatagatgaggctttggctgcgctgcatgtgaccctgcagttcccgctccaagaattcatccttgcgatgggatttttcctggtgctcgttatggagcaaatcactttggcttacaaagaacagtctgggccatcaccattagaggaaactagagctttgctggggacggtgaacgggggaccacagcattggcacgatggacccggtgtcccccaagcatcaggggctccggcaaccccttctgctcttcgcgcttgcgtgctcgtcttcagtctcgcactgcatagcgtgttcgagggcctcgctgttggactgcaacgagatcgggctcgcgcaatggagctgtgtttagctctgttactccataaggggattttggccgtgagccttagcttaaggttactgcagagccacctcagggctcaggtcgtggctggctgcgggatcttattttcttgcatgactcccctgggaattggactgggcgcagctctggctgagagtgctggtccactccaccagttggctcaaagtgtattggagggcatggctgccggaacctttctttacatcaccttcctggagatcttgccccaggagcttgcctcttcagaacagagaatcctgaaggtaatcctgctgcttgccggatttgctttgctcacaggcttactctttatccaaatctag

SEQ ID NO: 241536 - DNA, 723 bp, Artificial Sequence
  Description of Artificial Sequence: Synthetic coding sequence
atggggccatggggagagcctgagttactagtctggcggcctgaagctgttgcgtccgagccaccggtcccagttggactcgaggtgaagctgggtgccctggtgttgctgctggtgctcacccttctctgcagtttagtgcctatctgcgtgctgcggaggcctggcgcaaaccacgaaggttccgcatcacggcaaaaggctctgtcactagtatcttgcttcgctgggggagtatttctagcaacgtgtcttcttgacctactgccagactacctggcagccatcgacgaagcactagccgcacttcacgtgactctgcaattccccctccaagagtttattctggccatgggattttttctggtactggtgatggaacagattacccttgcatacaaggaacagtcaggaccctccccactggaggaaacccgggcactgctgggtaccgtcaatggaggccctcagcactggcacgatgggccaggtgtgcctcaggcctctggggcacccgctactccctccgcccttagggcctgcgtgttggttttctcgctcgccctgcactccgttttcgaaggcctggcggtgggcctgcagagggaccgggcacgtgccatggagctgtgtctggcactgctcttacacaagggcattctcgccgtaagcctatctctgcggcttctgcaatctcaccttagggcccaagtggtggcttag

SEQ ID NO: 241537 - DNA, 621 bp, Artificial Sequence
  Description of Artificial Sequence: Synthetic coding sequence
atgggaccctggggtgaacctgaattactcgtgtggaggccggaggccgtagcatctgagccccctgtccccgttgggctggaagtaaaactcggggctctggtgctgctgctggttttgacattactctgctccctcgtcccaatttgtgtgctgcgaagacctggagcgaaccatgaagggtccgctagtcggcagaaagctctgagtttggtctcgtgcttcgctggaggtgtgtttctggcgacctgcctgctcgatctgcttcctgattatctggccgcaattgacgaggcattggccgctctgcacgtcaccctccagttcccacttcaggagttcattcttgcgatgggcttctttctggtactcgttatggaacaaatcacactggcatacaaggagcagtctggaccaagcccccttgaggagacgagagctctgctaggcacagtcaacgggggaccccagcattggcatgatggaccgggagtgcctcaggcatccggggctcctgccacacccagtgctctgcgagcctgcgtcctggtgtttagcctggccctgcactcggtgttcgagggattggccgtcggtctgcagcgtgatcgggcacggtag

SEQ ID NO: 241538 - DNA, 966 bp, Artificial Sequence
  Description of Artificial Sequence: Synthetic coding sequence
atgggcccatggggggagcctgaactgttggtctggcggcctgaggcagttgccagcgaacccccagttccggttggtctggaggtgaaactgggcgctctggtcctgctactggtcttgactttactgtgttctctcgtgccgatctgcgtattgaggcggcctggcgcaaaccacgaaggatctgcctcaagacagaaggctttgtcccttgtcagctgcttcgccggtggagtatttttggccacttgtttgctggacctgctgcccgactacctcgccgctatcgacgaagcgctagctgctctccatgtgacacttcagttccccctgcaagagtttatcctggcgatgggtttttttctcgttctcgtaatggaacaaataactctggcctacaaggagcagtccggcccttcaccccttgaggagacacgggcactgctgggaacagtgaacggaggaccccagcactggcatgacggccctggggtaccgcaagcctctggagcaccggctacaccttccgcactgagagcctgcgtcctggtgttctccttggcactgcattccgtcttcgaaggcctcgcagtcggccttcagcgagatagggcaagggcaatggaactgtgtctggccctgctcctacacaaaggaattctcgctgtcagtctgtctttacgcctattacagtcccatctccgggcacaggttgtcgctggatgtggaatcctgttttcctgcatgacaccccttggtataggattgggtgctgcactggccgagtctgcaggaccactgcatcagctggcacagtccgtcttggagggcatggcggcaggcactttcctgtacataacttttctagagatcctgcctcaggagctcgcttcatccgagcagcgcatcctcaaggtcattttgctcctggccggatttgcactcttaactggattgcttttttag

SEQ ID NO: 241539 - DNA, 669 bp, Artificial Sequence
  Description of Artificial Sequence: Synthetic coding sequence
atgaaagcgcagctgcagttccccctacaggagtttattctggccatgggcttcttcttggtcctggtgatggaacagataacgcttgcctataaagagcagtccggaccaagccccctggaggaaaccagggcgctgcttggcaccgtgaatggaggcccacaacactggcacgatggccctggagtgccgcaggcttctggagctccggcaacaccgagcgcactgagagcatgcgtccttgtttttagtctggcactgcactccgtgttcgagggcttggctgtcgggcttcagagagacagagcaagggcgatggagctttgccttgcactactcctccacaagggcatattggccgtcagcctctctttaaggctgcttcaatctcacctgcgggctcaagtggtggctgggtgtggtatacttttctcgtgcatgacacccctgggcattggccttggggcagcccttgcagaatccgccggtccgctccatcaactggcacagagcgtgctagaaggcatggcagcaggaacgtttctctacattacctttctggaaattctgccacaggagctggccagcagtgagcaacgcatcctgaaggttatccttctcctggctggctttgccttactcactgggctgcttttcatccaaatatag

SEQ ID NO: 241540 - DNA, 942 bp, Artificial Sequence
  Description of Artificial Sequence: Synthetic coding sequence
atggggccatggggcgaacccgagctactggtgtggcgtcccgaggccgtcgctagcgagcctcccgtgccagtcggccttgtcctgacactcctgtgctctctcgtgcccatctgtgtcctgcgacgtccaggagctaatcacgagggatctgctagccggcagaaagccctgagcctcgtttcatgcttcgccggtggcgtcttccttgctacctgcttgcttgacctcttgccagattacctggctgctatcgatgaggcactcgccgcattgcatgtcacgttacaattcccattacaagagtttatcctagctatgggcttctttcttgtactggtcatggagcagataacactggcctacaaggaacagtccggacccagcccgctggaggagactcgtgcgctgctcggtactgtcaacggcggtccgcaacactggcatgatggtcctggtgtaccacaggcatctggcgcacctgcaaccccctcggctttacgggcttgtgtcctcgtgttctctctggcgctgcatagtgtgtttgaaggtctcgccgtgggcctgcaacgagatagagcaagagccatggaactctgtctggctctcctcttacacaaggggattctcgcggtgagcctcagcctgcgactactccagtctcacctgcgggcacaggtagtggcaggatgcggcatcttattttcttgtatgactcccttagggataggcctgggagccgcactcgccgagagcgccggaccactccaccagctggcccaatccgtattggaaggaatggcagccggaaccttcctgtacatcacctttctggagatcctgccgcaggaactcgcaagctcagaacagaggattttgaaagtcatattactattggcgggttttgcgctcctcactgggcttctgttcattcaaatctag

SEQ ID NO: 241541 - DNA, 1095 bp, Artificial Sequence
  Description of Artificial Sequence: Synthetic coding sequence
atgccaggttgtccttgtcctggttgtggtatggctggcccaagattgctgtttctcacagcactggctttggagcttctcgagagggctggtggcagccagcctgcactcaggagccgcggaacggcaacagcctgcagactcgacaacaaggagtccgaatcttggggtgcactgctgtcaggcgagcgtctggacacttggatctgcagtctgttggggtcactcatggtggggctgtccggcgtgttccctctcctggttatacctttggagatggggacaatgctcagaagtgaagccggagcctggcgactgaagcagcttctgagcttcgccttggggggactgttggggaatgtcttccttcacctgcttccagaggcttgggcatacacatgttctgcctctcccggaggcgaaggacagtccctccagcagcaacagcagcttgggctctgggtgatcgccggaattctaacttttttggcactcgaaaagatgttcttggatagtaaagaggaagggacctcacaggcacctaacaaggaccccaccgctgcagctgcagctctaaacggtggccactgtctcgctcagcccgctgcagaacccggactgggggcagtagttcgctccattaaagtgtccgggtacttgaatctcctagctaacactattgataacttcacccatggcctggctgtagctgcctccttcctggtctcaaaaaagattggcctcttgactaccatggccatcctgttgcatgaaatcccccacgaggtcggagacttcgcaattctgttgagagccggatttgatagatggtcagctgccaagctgcagctgtcaacagccttggggggtctcctgggggctggcttcgcaatctgtacccagagcccgaaaggagtggaagagactgctgcctgggtgctaccatttacctcaggtggcttcctatatattgcactggttaatgttcttcccgatctccttgaggaggaggacccctggcggtccctccagcagttattgcttctgtgtgctggcattgttgtcatggtcctgttttccttattcgtggactag

SEQ ID NO: 241542 - DNA, 1116 bp, Artificial Sequence
  Description of Artificial Sequence: Synthetic coding sequence
atgccaggctgtccttgtcccggttgcggtatggccggtcctagactactctttctaactgccctggccctagagctcctggagcgggcaggcggttcacaacccgctctacggtcaagggggaccgccacagcttgcaggcttgataataaggagagcgaatcgtggggagcacttctgagcggcgaacgtttggatacatggatttgctcattgctgggtagcttaatggtgggactgagtggggtcttcccactgctcgtgattcctctcgagatgggcaccatgctgagatctgaggccggtgcctggcggttaaaacagctcttatccttcgccctggggggtctattgggaaatgtattcttacacctacttcccgaggcgtgggcctacacatgtagcgcaagtccaggcggtgaaggccagtctctccaacagcaacagcagctgggtttgtgggtgatcgcgggaattctcacctttctcgcgctggaaaaaatgttcctcgattccaaagaagagggaaccagccaggcgccaaacaaagatccgaccgctgccgctgccgcattaaacggtgggcattgccttgctcagccagctgccgaacctgggctgggggctgtggtccgcagcatcaaggtgagcggctacctgaacctgctggccaacactatcgataattttactcacggcctggctgtggccgcaagtttcctggtgagtaagaagattgggcttcttacaactatggcgatcttactgcacgaaataccccacgaagtaggggattttgccatacttctgagagccggatttgacaggtggagcgccgctaagctccagctctctactgccttggggggactgctcggggcaggctttgcgatttgcacccaatcaccaaaaggtgtagtaggatgtagtccagcagcagaagaaactgccgcatgggtactgccttttaccagtggcggttttttatatattgcacttgtcaatgtgcttccggacctcctggaagaggaggatccctggcggtccttgcagcagctgctcttattatgcgctgggatagttgtcatggttttgttttccctctttgtggattag

SEQ ID NO: 241543 - DNA, 930 bp, Artificial Sequence
  Description of Artificial Sequence: Synthetic coding sequence
atggagcaactgctgggtataaagttgggttgccttttcgcgctcctagcgctgacccttggatgtggacttacacccatttgcttcaagtggttccagatcgacgcagctaggggccatcaccggttagttctgaggctgttgggctgtataagcgcaggggtgtttctcggtgccggttttatgcacatgacggcggaagctctcgaggagattgaatcccagatccagaagtttatggtccagaacagatccgcttctgaacgtaatagctcgggggacgccgatagcgctcatatggagtatccctatggtgagctaatcattagtttgggattcttcttcgtcttcttcctggagagcttggctttgcaatgttgcccgggagctgcgggaggtagcacagtgcaggatgaagaatgggggggagcacacatttttgagcttcattctcacggacacctcccttccccctcaaaggggcctctgcgggcactcgtactgcttttgagtctgagctttcattcagtgttcgagggactggctgtcggcctccagcctaccgtggccgctacagtacagttgtgtctggccgtgctcgcacataagggcttggtggtgttcggggtgggaatgcgcctcgtgcaccttgggacatctagtaggtgggctgtcttttcaattctgctgctggcccttatgtctcctctgggacttgcagtcggattggccgtgaccggcggagattccgaagggggtagaggccttgctcaggccgtgctagaaggcgtggctgcgggtacattcctctacgtgactttcctcgaaattctccctagagagctcgccagtccagaggctcccttagctaaatggtcctgcgtcgcagctgggtttgcatttatggcgttcattgcactgtgggcctag

SEQ ID NO: 241544 - DNA, 945 bp, Artificial Sequence
  Description of Artificial Sequence: Synthetic coding sequence
atggtgaaattgctggtcgctaaaatcttgtgcatggttggggtgttcttcttcatgctccttggaagcctgcttcccgtgaagatcattgagaccgatttcgagaaggcgcatcggtccaagaagatcctgagtctgtgcaacacattcggtggtggcgtattcctggccacttgtttcaacgctttattgcccgctgtgagagaaaagctgcaaaaggtcctgagcctcggacacatcagcaccgattaccccctggcggagactattctcctgctcggatttttcatgaccgtgtttttagagcagctgatcctcacttttagaaaagaaaaacccagcttcatcgacctcgagacttttaacgccggatcggacgtcgggtccgacagtgaatacgagagccccttcatgggcggagcaagaggccatgccctgtacgtggagccacatgggcacgggccaagcttgagtgttcagggcctgtctagggcctcccctgttagactgctctctttggctttcgcactgtccgcccactctgtttttgagggcctcgccctcgggctccaggaggaaggcgagaaagtggtcagcctttttgtgggagtcgcagtgcatgagactctggtggctgtggccttaggcatctcaatggcgaggtcggctatgcctctgcgggatgctgccaagttagccgtcacagtgagcgcaatgattcctctgggcatcggcctggggttgggcattgagagtgcccaaggtgtccccggatctgttgccagcgtgcttctgcagggtcttgcagggggaacgtttctcttcatcacttttctggagattctggctaaggagctggaggaaaagtcagatcgcctgctcaaagtgttgttcctggtcttaggctacacagtactagctgggatggtcttcctgaagtggtag

SEQ ID NO: 241545 - DNA, 318 bp, Artificial Sequence
  Description of Artificial Sequence: Synthetic coding sequence
atggtgaagctgctcgtggcgaaaatcctgtgcatggttggagtgttctttttcatgttgctgggctcgctgctgcctgtgaagattatcgagacagatttcgagaaagcacatcggtctaagaagatcctgtccctctgtaatacttttgggggaggggtgtttctggccacttgttttaatgcgcttcttccagcagtccgggagaaagtccgcgcaccgtgggctctcgccgctgctttggggacgctgtggccgagagattccgacgctttctcaactctaatgccctcaagcgtgaaagctctgatgttgtag

SEQ ID NO: 241546 - DNA, 972 bp, Artificial Sequence
  Description of Artificial Sequence: Synthetic coding sequence
atggtaaaattgctggttgctaagatcttgtgtatggtgggggtcttcttcttcatgctactgggtagcctgctgcctgtcaaaatcatcgagacagacttcgagaaagcacacaggtctaaaaagatccttagcctctgcaacaccttcgggggtggcgtttttctcgcaacatgttttaatgccctgctgccagctgtaagagaaaagctgcagaaggttctgagcctggggcatatatctaccgactatccattggccgaaaccatcctccttctgggcttctttatgacagtattcttggagcagttaatcctcacatttcgaaaagagaagccttctttcattgaccttgaaacattcaacgcaggcagcgacgtgggttcagattcggagtacgagagcccctttatgggtggcgctcgaggacacgccttgtatgtcgaaccccacggacacgggccatctctgagtgtccaggggttgtcccgtgccagcccagtgagactactgagcctggcctttgccctctcggcgcacagcgtctttgagggactggctttaggcctgcaggaggagggagagaaggtcgtgagcctttttgtcggcgtggctgtgcatgagacactggtggccgtggcacttggaatttctatggctcggagcgcgatgcccctgcgcgatgccgcaaagctggcagtcaccgtgtcagcaatgatccctttgggtatcggactggggctgggaatcgaatctgcacagggggtacctggcagcgttgcttcagtcttgctccaagggctggctggtgggacctttctttttatcacgtttctggagatccttgcaaaagaattagaggagaaatctgataggttgcttaaggtgctcttcctggtcctgggctataccgtactggctggaatggtgtttctgaaatggatctctccacctgaacccagggtgtcttag

SEQ ID NO: 241547 - DNA, 1869 bp, Artificial Sequence
  Description of Artificial Sequence: Synthetic coding sequence
atggtcgatgtggtcggccttgagagggagacaggaccgagaggctcgccgtggcccggtctgccacttccatccctggtgggcccagcccctcttctgacttgtctgtgccctcagtgtctgtctgtggaggatgcactggggctgggagagcctgaagggtcaggcctccccccaggcccagtactggaggccagatacgtggctcgcttgagcgcagctgccgtcctttatctatcaaatccagaaggtacatgtgaggatgcccgtgcaggattgtgggcctctcacgccgatcacctgctcgccctcctcgaatcacctaaagctctaacccctggcctgagctggctcttgcagagaatgcaagccagggctgctggacagacgcccaaaaccgcctgcgtggatataccacagctactggaggaggccgtaggtgcaggcgcaccaggatccgcgggaggagtgctcgctgcgctgctggatcacgtgaggagtgggagctgctttcacgcacttccaagtccacagtactttgtggacttcgtctttcagcaacattcttccgaggttccaatgactctagccgaactgtccgctctgatgcagcggctgggcgtaggacgggaggcacacagcgaccattcccatcgacaccgtggagctagctcctgggatcctgttcccctgatcagctcttccaatagtagctctgtgtgggatactgtttgcctatcagctcgcgatgtcatggcagcctatggactttcagagcaagccggtgttacaccagaggcttgggcacagctgagccctgctctgctgcagcagcagctctccggggcatgtacgtctcagtcacgccctcccgttcaagaccagctgtctcagtccgagcggtatctctacgggtccctcgccaccctgctgatttgtctttgcgccgttttcggattactgttgttaacgtgtacaggctgtcgcggtgtgacacactatatcctccagactttccttagtctggcggtcggcgcacttactggagacgctgtgctgcatttgacgcccaaggttttgggactgcacacccattccgaggaggggctgagcccacagccaacctggcggctgctggcaatgctggcgggattgtatgccttcttcctgtttgaaaacctgtttaatcttctgttaccccgagatccggaagacctcgaagatggtccctgtggacattcttcccactcacacggcggacactcccatggcgtgtctctacagctggctcccagcgagctccggcaacctaaacccccacatgaggggagtcgagcagacctggttgccgaggaatctccagaattactgaaccctgagcctaggagattgtctcccgagcttaggctactgccctacatgattacgctgggcgacgctgtccataatttcgcagatggcttagctgtcggggcagccttcgcttcttcgtggaagaccggcctagccactagcctggctgtgttttgccacgaactaccccacgagcttggagacttcgctgcgttgctgcatgccggtctgagtgttagacaggccctgctgcttaacctggcttccgcactaactgcgttcgccggactgtatgtggccctggccgtgggggtttccgaggaaagcgaagcttggattctcgccgtcgccaccgggttatttctgtatgtggctctatgtgatatgctgcctgccatgttaaaggtgagggacccccgaccttggctcttgtttttactccataatgtggggctgttgggcggttggacagtcctccttctgctgtctctctacgaggatgatatcaccttctag

SEQ ID NO: 241548 - DNA, 1944 bp, Artificial Sequence
  Description of Artificial Sequence: Synthetic coding sequence
atggctagtttggtgtcactcgagctggggcttctgttggctgtgctggtagtcacagctacggccagcccacctgcgggtttgctgtcactactcaccagcggacagggggctctggaccaagaggctctgggtggcctccttaacaccctcgccgaccgcgtgcactgcgctaacggcccatgtggtaagtgtttgtccgtggaggatgcactaggtctgggagaacctgaaggctccggtcttccaccgggaccagtactggaggctaggtacgttgcccgattgagtgctgctgccgtgctttacctgagcaatcctgaaggcacatgtgaagatgccagggccggactatgggcatcacacgctgatcatctacttgccttgctggagtcacctaaagcccttaccccgggactgtcatggctactgcaacggatgcaggcgagagccgctggtcaaactcctaagactgcgtgtgttgacataccccagctgctggaggaagccgtgggggctggcgcaccaggcagcgccggaggggttctcgccgctctgctggaccacgtcagatctggatcctgctttcacgccctcccttctccacagtatttcgtggatttcgtattccagcagcactcctccgaggtaccgatgacgttagctgaactgtctgccctgatgcaacggttaggtgttggccgtgaagcccattccgatcacagtcatcgccacaggggcgctagttcatgggatcccgttccacttatctcctccagtaacagtagcagcgtctgggacaccgtgtgcctatcagccagagacgttatggccgcttacggattgtctgagcaggctggtgttacgcctgaggcctgggctcaactctctccagctttactgcaacagcagttgtctggggcatgcaccagccaatccagacccccagtgcaagatcagctgtctcagagcgagcgttatctctatggctccctggcgacactgctcatttgcctgtgtgcagtctttggactattacttttaacatgcacgggctgtcggggtgtgacacactacattttacaaacgttcttgtctctggccgttggagcgctgaccggtgacgctgttctacaccttactccgaaggttctggggcttcacacacatagcgaagaaggcctttccccacaacccacatggaggttgttggccatgcttgcaggtctctatgcttttttcctgtttgagaatttgttcaatctgctgttacctcgggatcccgaagatctggaggatggcccatgtggccactcctctcatagccacgggggtcactctcatggggtcagcctgcagttggctccctcagagcttcgacagcccaagcccccacatgaaggcagccgcgctgatttggtcgcggaggaatcccccgagctgcttaacccagagccccgacggctcagtcccgaactgcgcctgctgccctacatgataacactgggcgacgctgtccacaactttgccgatggcctggccgtgggagctgcctttgcctcatcctggaagactggcctcgcgacgagtctggcagtgttctgccatgaactcccgcatgagttgggagattttgccgctctgttgcatgccggactgtccgtgaggcaggctctgctgctcaacctggcaagtgcactgacagctttcgcaggtttgtacgttgccctagccgttggcgtgtcggaagagtccgaggcctggatcctagccgttgccacaggcctttttctttacgtggctttgtgtgatatgctccctgcaatgctgaaagttagagatccacgtccatggctgctgttcctgctgcacaacgtggggctgctgggaggctggactgttctccttctgctgtctttgtacgaagacgatatcacgttttag

SEQ ID NO: 241549 - DNA, 1410 bp, Artificial Sequence
  Description of Artificial Sequence: Synthetic coding sequence
atggctcggggacttggggctccccactgggtggctgtgggcctgctgacatgggcgacccttggcctgctggtggcgggacttgggggtcacgacgatcttcatgatgacttgcaggaggacttccacggccacagtcacaggcattcccatgaagactttcatcacggtcattcccacgcacatggacatggacatacccacgaatcgatctggcacggccatactcacgaccacgatcatgggcacagtcacgaggaccttcaccacgggcattcccacgggtactcacatgagagtttgtaccatcgcggacacgggcatgaccacgagcacagtcacggcggatacggagagagcggagccccagggatcaagcaggatctcgacgccgtaacactgtgggcatacgccctcggcgctacggtgctaatatcagccgcacccttttttgtgctcttcttaattccggttgagtcaaacagtccaaggcatagatcgctgttgcaaatcctgttgtcctttgcaagcggcggactgcttggagacgccttcctgcacctaattcctcacgccctggagcctcatagccatcatactttagaacagcctggccatgggcactcacattccggccagggtcccatattgagtgtaggactttgggttctttctggtatcgtggcttttcttgtggtggagaagtttgtgagacatgtcaaaggcggacatggccactcccatgggcatggtcatgcccactcccatacacggggtagccatggtcacggcagacaggaacgcagtactaaagagaagcagagctctgaggaggaggagaaagagacgcggggagtccaaaagagacgcggaggctccaccgttccgaaggatggccctgtcagaccacaaaacgccgaggaggagaagcgaggactggatcttcgggtcagcggatacttgaacctagccgcagacctcgcacataatttcactgacggcttggccatcggcgctagtttccgcggaggcagaggattgggaatcctcacaaccatgaccgtgcttctacacgaggttccccatgaagtgggcgattttgccatccttgtgcagagtgggtgctccaagaagcaggcgatgcggctgcaactgctcacggccgtgggagctctggccggtaccgcttgtgctctcttaactgagggaggcgctgtggggtcggaaatcgcaggcggagccggacccggttgggttctcccctttacggctggcggatttatatatgtggcaactgtgagcgtgctgccagaactgctccgggaagcatcccctttgcagtcccttctggaagtcttggggttgcttggcggagtgatcatgatggtgcttatcgctcatcttgagtag

SEQ ID NO: 241550 - DNA, 1410 bp, Artificial Sequence
  Description of Artificial Sequence: Synthetic coding sequence
atggctcgaggactgggagcaccacactgggtcgccgtcggtttattaacctgggccacgcttggattactggtggcaggtttgggcggtcacgacgaccttcacgacgatcttcaagaagatttccacggccacagccaccggcattctcacgaggattttcaccatggccactcacatgctcatggacatggacacacgcacgaaagtatctggcatggccatacgcacgatcacgaccacgggcatagtcatgaggacctgcaccacggtcactctcacggatactcacatgagtctctgtaccacaggggccatggccacgaccatgagcactcacatgggggatatggggagtctggagcgcctggaattaaacaggatttagacgctgtgacgctgtgggcatacgcgctgggagcgacagtgctgattagcgccgcacccttttttgtgctcttcttgattcccgtcgagtccaacagtcccagacatcggagtctattacagattctcctaagcttcgccagcggcggattactcggagacgcatttctgcacctgatccctcatgccctcgagccccacagccaccatactctggagcagccgggacacggtcacagccattcaggccagggtcccatcctcagcgtggggctgtgggtgcttagcggaattgtcgcctttctggttgtggagaaatttgtccgccatgtaaaaggcggacacggtcatagccacggccacggtcacgctcattcgcacacccggggaagtcacggccatggcaggcaagaacggtcaaccaaagaaaagcagagcagcgaagaggaagagaaggaaacaagaggcgtccagaagagacgaggcggaagtaccgtgcccaaagatggcccagtgagacctcagaatgctgaggaggagaaaagaggactcgacctccgggtcagcggctacctcaacctggccgcagacttggcccacaattttactgacggcttggcgatcggcgcatccttcagaggaggaagagggctgggcattctgaccaccatgacagtcctgctccacgaagtgccacatgaagtcggtgacttcgctatcctggtccaatccggttgctctaagaaacaggctatgaggcttcagcttctcacagcggtcggcgcacttgccggaaccgcatgcgccctgctgacagaggggggtgctgtggggtcagagatcgctggaggcgctggtcccggatgggttttaccctttaccgccggtggctttatttacgttgcgaccgtgagtgttctccctgaattgctcagggaggcttcgccactgcagtccctgttagaagtattaggccttttgggcggagttatcatgatggttctgattgcccatctggaatag

SEQ ID NO: 241551 - DNA, 1410 bp, Artificial Sequence
  Description of Artificial Sequence: Synthetic coding sequence
atggctcgcggtcttggtgcccctcactgggtggccgtgggcttacttacctgggccaccctggggttgcttgtagcaggattgggcggacatgatgatctgcatgacgatctccaggaggattttcacggccactcccatcgtcattctcacgaagattttcaccatggtcattcccatgcccacggccacggacatactcatgagagcatttggcacggccacacgcatgatcatgaccatgggcactcgcacgaggatttgcatcatgggcattcacatggttatagccacgaatccctctatcataggggccacggccacgatcatgaacactctcacggcggatacggcgagtctggagctcctggcattaagcaggatctggacgccgtgactctgtgggcttatgccttgggagcgacggtgctcatctcagctgccccattttttgtgctattcttaattcctgtggagtctaatagtcccagacatcgctcactgttacagatcttacttagctttgcctctggcggattgctgggcgatgctttcctgcatctcatcccgcacgcattagaaccccactcccatcatacactggagcagcccggacatggccactctcacagtggccagggccctattctgtcagtggggctatgggtgctttcagggatagttgctttcttagttgtcgagaaattcgtgagacacgttaagggcggacacggacactcccatggacatgggcacgcacactcacataccaggggttcgcatggtcatggacgccaggaaaggtccacaaaagaaaagcagtccagcgaagaagaggaaaaagagacaaggggcgtgcagaaacgaagaggcggatccaccgtacctaaagatgggccagtgcgccctcagaacgctgaagaggagaaacggggtctggacttgcgggtgtccggctatctcaatctggctgccgacctagcccataatttcaccgacggccttgctatcggcgcatcctttcgaggcggtcgtggtctcggcatcctgacaaccatgactgtcctcctccacgaagtgccacacgaggtgggggacttcgcgatactcgttcaatcaggctgctctaagaaacaggcgatgcggctgcaattactgaccgctgtcggggcactggccggtacagcctgtgccttactcacagaagggggagctgtcggctccgagatcgccggtggcgctggcccaggatgggtgctcccatttaccgctggtggcttcatttatgtggccacagtgtccgtgcttccagagctgctgcgggaggcatcccctctgcaatcgctgctcgaggttcttggtctgcttgggggagtgattatgatggttttaattgcccaccttgagtag

SEQ ID NO: 241552 - DNA, 1410 bp, Artificial Sequence
  Description of Artificial Sequence: Synthetic coding sequence
atggccaggggcctcggtgcacctcactgggtggctgtaggactcctgacctgggccaccctcggcctgctcgtcgccggactgggcggacatgatgatcttcatgacgaccttcaagaggactttcacggccactcacaccggcatagccatgaggatttccaccacggtcacagtcatgcccacgggcacgggcacacacatgagagcatctggcatggccacactcacgatcacgaccacggacatagtcacgaggatctgcatcacggccatagccatggatacagtcacgaatccctgtaccatcgcggtcacggtcacgaccacgagcactctcacggcggatatggtgagtccggggctccagggatcaaacaggatctagacgcagtgactttgtgggcttatgccctgggagctacagtgctgattagtgcagcccctttttttgtactcttcctgatccctgtggaatcaaactcacctaggcaccgttcactgctgcagattctcctgtcctttgcatccgggggactccttggtgacgcctttctgcacctgatcccacacgccctggagccccactcacatcacacattggaacaacccggacacgggcactcacatagcggacagggccctatcctgagtgtgggcctctgggtattatccgggatcgtcgcctttctggtcgtcgagaagtttgtacggcacgtcaaagggggtcacggccattcacatggacatggtcacgctcattctcacacccgcggatcacacggacacggaagacaagagcggagcactaaggaaaagcaatcatccgaagaggaggaaaaagaaacgcgcggagtgcagaaaagacgaggcggatccacagtacccaaagacggacccgtgcgcccacagaacgcagaggaggagaagagaggcctggacctgagggtcagtggctacctaaaccttgctgctgatctcgcacacaattttacagacgggttggctatcggcgctagctttcgcggtggacgcggacttgggattctcaccacaatgacagtcctgctccacgaggttcctcatgaagttggggattttgccatcctggtgcagtctggttgttcaaaaaagcaggccatgaggctgcagctccttaccgctgttggcgcactggctggaacagcatgcgccctgttgactgaaggcggagccgtggggtctgagatcgccggaggcgcaggacctggttgggtccttcctttcacagccggagggttcatatatgtggccacagtctcagtgctcccagagctactgagagaagcttcgcctctacagtctctgctcgaggtactgggtcttctcggaggggtaatcatgatggttctgatcgcgcacctggagtag

SEQ ID NO: 241553 - DNA, 663 bp, Artificial Sequence
  Description of Artificial Sequence: Synthetic coding sequence
atggactcgtcgttgcctgaatgtcgccatattggcaaaggcatccgcgctaaagtcgagcggaactttctgttcagtcgggacctcaaggcaggacttcccagacctagtaagccaggaaaagaaaggatcccagagcctgcgctcggagccaccgtgctgatttctgcggcaccgtttttcgtgctgttcctgatccctgtagaatcgaactctccgagacacaggagcctgctccagatcctgctgagcttcgcctctggaggacttctgggtgatgcctttcttcatctcattccacacgctctggaaccccactctcaccataccttagaacagcctggccacggacacagccacagtggccaagggcctatcctgagcgtcggcctctgggttctttctgggatcgttgcttttttagttgtggaaaagtttgtaagacacgtaaaggggggacacggccactcccacggtcacggtcacgcacattctcacactcggggatcgcacggacacgggagacaggagcggtccactaaggaaaagcaatccagtgaagaggaagagaaagaaacccggggagtgcagaaacgcagaggaggctccaccgtccctaaggacggccctgttaggccgcagaacgcggaagaggagaagtag

SEQ ID NO: 241554 - DNA, 663 bp, Artificial Sequence
  Description of Artificial Sequence: Synthetic coding sequence
atggatagcagtctgcccgaatgcaggcatatcggaaaaggtataagggcgaaggtagagcgcaacttcttgttctcccgcgacctgaaggccggtctgcctcggccatctaagccaggcaaggaacgtatcccagagcccgctctgggcgcaacagtgcttatctctgcagctcctttttttgttcttttccttattccagtggaatccaatagtccacgccaccggtccctcctgcagatcctgctgagctttgccagcggaggcttactcggcgacgcattcttgcacctgatcccacacgccttggaacctcactcccatcacacccttgagcaacctggccacggccactctcacagtggacagggccctattctcagtgtcggcctatgggtgttatccgggatcgtggcgttcctggtcgttgaaaaattcgtgcggcacgttaaaggaggtcatgggcactcccatggccacggccacgcacactcgcatacaagaggatcacatggacacggaaggcaggagcggtctacaaaagagaagcagagcagcgaggaggaggaaaaagagacccgaggggtccagaagcggagagggggatctacagtcccgaaggacggcccagtccggcctcagaacgcagaggaagaaaagtag

SEQ ID NO: 241555 - DNA, 1410 bp, Artificial Sequence
  Description of Artificial Sequence: Synthetic coding sequence
atggcacggggactgggagcccctcactgggtcgccgtgggcctgctgacctgggcaactttggggctcctagtcgctggcctgggcggtcatgacgatctgcacgatgatctccaggaggacttccacggacattcacatcggcatagccacgaagacttccatcacggtcattcccacgcccatggccacgggcacacgcacgaaagcatttggcacggccacacccacgatcacgatcatggacactcgcatgaggacctgcaccatggacactctcacggctactcccatgagtctctgtaccacagaggacacggacatgaccacgagcattcccacggtggttatggcgaatctggcgctccaggaattaaacaggacctggacgccgttaccttgtgggcctatgctctgggcgcaacagtgctcatttccgctgccccattctttgtactgttcctcataccagtggagagcaattctcctcgacaccggtccctgctgcagattctgcttagcttcgcaagtggaggtctgctgggggacgcgtttcttcacttaattcctcatgccttagagcctcattctcaccacaccctcgaacaacctgggcacggccactcacacagcggccagggcccaatcctttctgtaggcctctgggtcctcagcggcatcgtggccttcttagtcgtggagaaatttgtccgccacgttaagggaggacacgggcactcacacgggcacggacacgcccattctcataccaggggtagtcatggccacgggcgacaagaacggtcaactaaagagaaacagtcttcagaggaggaagaaaaggaaactcgaggcgttcaaaaaagacggggaggaagcaccgtaccgaaggatgggccagtgaggccccagaatgccgaggaggagaagagaggtctggatctcagggtatcgggctacttaaacttggccgctgatctggcgcacaacttcacagatggactcgcaatcggagccagctttcgcggaggccgtgggctgggtattctgaccacgatgacagtgctgctacacgaagtgccccacgaggtgggagatttcgccattctggtccaaagtggctgctcgaaaaagcaagcgatgaggttacagctcttaacagctgtgggcgcactcgccggtactgcctgcgctcttctaactgaagggggtgcagtaggcagcgagatcgccggtggcgcagggccaggatgggttctgccctttactgccggtggtttcatctacgtggcaaccgtctccgtgttgcctgagctactacgagaggcttctcctctgcagtctttactagaggtgctcggcctccttggaggagtgatcatgatggttctaatagcacacctcgaatag

SEQ ID NO: 241556 - DNA, 1410 bp, Artificial Sequence
  Description of Artificial Sequence: Synthetic coding sequence
atggccagggggcttggagctccacactgggtggctgtcggtctgctgacttgggccacactgggcctgcttgttgcagggctgggcggacacgatgacctgcacgacgatctgcaggaggactttcacggccattcccatcgccattcccacgaagattttcaccacggccacagtcatgcccacggacatgggcatacgcacgagtccatctggcacggacacacccacgaccatgaccacggccattcccacgaagatctgcatcatggccatagtcatggttacagccacgaatctctataccaccggggtcatgggcacgatcacgaacattcacacggcggatatggcgaaagtggtgctcccggtattaaacaggacctggacgctgtgactctctgggcctatgccctgggagcaaccgttctgataagcgcagccccattctttgtcctgttcttgatccccgtggagtcaaactcacctcggcaccgtagcctcttacagatcttgctgagcttcgcctcgggtggcctgctcggagacgctttcttacaccttataccccatgctctcgagcctcactcccaccacacactggagcagcccggacacggccactcccatagcggccagggccctatcctttctgtcggtctatgggtgttaagtggtatcgtggctttcctcgtcgtggaaaagttcgtccgacacgtcaaaggtggccatggacatagccatgggcatggccatgcgcactctcacactagaggttcccatggacacggacgccaggagcgcagtactaaggagaagcaaagctccgaggaagaagaaaaggagactcggggtgtgcaaaaacggcgaggcggatctacagtccccaaggatggcccagttaggcctcagaacgctgaggaagagaagaggggcttggatttgcgcgtgtctgggtacctgaatctcgcagcagatttggcacacaatttcaccgacgggcttgcaatcggagcgagtttccgcggagggagggggcttggcatcctgaccacaatgaccgtattactgcacgaagtgccccacgaagttggagattttgctatcctggtccagtctgggtgtagcaagaagcaggccatgcgacttcagctgctgaccgctgtcggcgctcttgctggtacagcgtgtgctctcctcactgagggaggagctgtcggcagcgaaatcgccggaggcgcaggaccagggtgggtgctaccatttaccgctgggggattcatttatgtggcaacggtgtctgtactgccagagctgctgcgagaggctagcccactccagtctttgctggaggtgctgggcttattaggcggtgtaattatgatggtgctgatcgctcaccttgaatag

SEQ ID NO: 241557 - DNA, 1410 bp, Artificial Sequence
  Description of Artificial Sequence: Synthetic coding sequence
atggcgcgtggcttgggggcaccacattgggttgctgtcggactgctgacctgggctacgctgggtctgctggttgccggtctgggaggacacgacgaccttcatgacgatctccaagaagacttccatggacactctcaccgccactcccatgaagacttccaccatggccactcgcacgcgcatggccatggacacacgcatgagagtatctggcatgggcatacccacgatcacgaccatggacacagtcatgaagacctccaccacgggcacagccacggatactctcatgagagcctgtatcatcggggtcacgggcatgatcacgaacattctcacggaggatacggagaaagcggtgcccctggcattaagcaggacttagacgctgtgactctgtgggcctatgcgttgggagccacagtactcatctcagcagctcccttttttgtgctctttcttatacctgttgagtctaatagtcctcgacatcgcagcttgctacagatcctgctgtcatttgctagcggcggactcttaggcgatgccttcctgcaccttattccccacgccctcgagccccactctcaccacactctggagcagcctggtcacggccactcacatagcggtcaggggccaattctgagcgttgggctgtgggtcctcagcggaattgtggccttcctggtggtcgagaagttcgttagacacgtaaaaggcggacatggacacagccacggacacgggcatgcccactcacacaccaggggatctcacggtcacggcaggcaggagagatctaccaaagagaagcaaagttccgaggaggaagagaaggagacgcggggagtccagaaacgtaggggcggaagcaccgtgccaaaggatggcccagttagaccgcagaatgccgaagaggaaaagcgcggtctcgacctgcgagtgtctgggtatcttaatctggccgcagatctcgctcacaactttactgatggattggctatcggtgcatcctttcgcggaggtcggggactcggcatcctgacgaccatgacagtgctccttcacgaagtgccacacgaagtcggagactttgccatcctggtgcaatccggatgcagtaaaaagcaggccatgcgtctgcagctactaactgccgtcggcgcacttgccggtacggcttgcgctctactgaccgagggaggggctgtgggttccgagatagctggaggagcaggccctggttgggtgctaccatttaccgccggaggcttcatttatgttgcgactgtttcagtactgcctgagctcctgagagaagcaagtccgttgcagagcctattggaagtcctagggctgttgggcggtgtcataatgatggtgttgatagctcacttggagtag

SEQ ID NO: 241558 - DNA, 663 bp, Artificial Sequence
  Description of Artificial Sequence: Synthetic coding sequence
atggactccagccttccagagtgtcgccatatcggcaagggaatccgcgcaaaggtcgaaaggaactttctgttttcccgagatctgaaggctggcctgccaagacctagcaagcccggaaaggagcggatccccgagcctgctttaggcgctaccgtcctgatctctgctgccccattcttcgtcctgttccttatccccgtcgagtctaattcccccaggcacaggtccctgctccaaatcttgttgtcatttgccagcggaggcctcctcggagacgcatttctgcacctgatcccccacgcactagagccacatagtcaccacacattggaacagccaggacatggacattcacacagcgggcaggggccaatactgagtgtgggattatgggtgttgtccggaatagtggcgttcctggttgtcgagaagtttgttcgtcacgtgaaggggggacatgggcacagccacggccatggccacgcccactctcatacccggggatcacatggacatggcagacaagagcgtagcacaaaggaaaagcagagtagcgaagaagaagaaaaggaaacgcgcggagtgcagaaaagacggggaggaagtacagtaccaaaggatggccctgtgagacctcagaacgctgaagaggaaaaatag

SEQ ID NO: 241559 - DNA, 663 bp, Artificial Sequence
  Description of Artificial Sequence: Synthetic coding sequence
atggattcctcattgccagagtgccggcatattgggaaaggcattcgagcaaaagttgagcgtaatttcctgttctcgagggacctgaaagctggtctcccacgcccaagtaaacctggtaaggagagaattcctgagccagccctaggcgcaactgtcctgatcagtgcagcccctttcttcgttctctttctaattcccgttgagagtaactctcccaggcacaggtctctccttcagatcctgctcagttttgcttccggaggtctgttgggggacgctttcttacatttgataccccatgcgctggaaccccactctcaccataccctggagcaacctggtcacggccattctcattctggccagggtcctatcctgagcgtaggactgtgggtgctgagcggcatcgtggccttcctggttgtggaaaagttcgtccggcatgtgaagggcggtcatggtcactcacacggtcacgggcacgcccactcccatactaggggatcccatggtcacggacgccaggagcggagcacaaaagaaaagcagagcagcgaagaggaggagaaggaaaccagaggcgtgcagaaaagacgcggagggtccaccgtacctaaggatggacctgtaagaccccaaaacgccgaggaggagaaatag

SEQ ID NO: 241560 - DNA, 1410 bp, Artificial Sequence
  Description of Artificial Sequence: Synthetic coding sequence
atggctcgagggctgggtgcgccacactgggtggcagttggtttgctcacgtgggcgactctgggcctgctcgttgccggattaggcggtcacgacgacctacacgacgacttacaagaagatttccacggccacagccatcggcattcccacgaagattttcaccatggtcacagtcatgcgcatggccacgggcatacccatgaatccatttggcacggccacacccatgatcacgatcacggacacagtcacgaagatctccaccacggtcattcccatggatactctcatgagtcactgtatcacaggggacatgggcacgatcacgagcatagccatggcggatacggcgaatctggagctcctggcatcaaacaagacctcgatgctgtcactttgtgggcttacgcgctgggagccaccgtgcttattagcgccgcaccctttttcgttctgttccttatccccgtggagtccaatagcccaaggcataggtcactgctccagatactgctgtctttcgcctctggaggactcctgggcgacgcattcttacacctaattccccatgcactggaaccccactctcatcacacgctcgagcagcctggccacggccactcccacagcgggcagggtcctatcttgtccgtgggactgtgggtgcttagtggcatcgttgctttcctcgtggtcgagaagttcgtgagacatgtaaagggcggtcatgggcatagtcatgggcacggacacgcacactcccatacaagaggatcgcatggacacggtcgacaagagagatccaccaaggagaagcagtcgtccgaggaggaggagaaggaaacccgtggggtccagaagcgcagggggggatcaaccgtacccaaagatgggcctgtgcggcctcagaatgccgaggaagaaaaaagaggactagacctgcgggtcagcgggtacctgaatctggccgctgatttggcacacaatttcacagacgggctcgccattggcgcaagtttccggggtgggagaggactgggcattctcacaactatgacagtgttgctacatgaagtgcctcacgaggtcggagacttcgctatcctcgttcaaagcggatgttctaaaaaacaggccatgaggctacagttactgaccgccgtcggggctctggcgggaaccgcatgtgctctcctgaccgagggaggtgctgtgggttccgagattgcaggaggtgctgggcctgggtgggtgctgccattcaccgcaggtgggttcatatacgttgcaacagtaagcgttttgcctgagctcctccgggaggccagtccgctgcagtctctgctggaggtgcttgggctactgggcggagtcatcatgatggtcctgattgctcacctcgagtag

SEQ ID NO: 241561 - DNA, 1410 bp, Artificial Sequence
  Description of Artificial Sequence: Synthetic coding sequence
atggcacgcggtctgggcgcaccccattgggtggccgtaggactacttacctgggcaactcttggcctcctggtggcgggtctcggcggacacgacgatctccatgatgacctccaggaagattttcatgggcactcacatcggcactcccacgaagactttcatcacggtcactcccacgcccacgggcacggccacacacacgagtcaatctggcacggccatactcacgaccacgaccatgggcacagtcacgaggacttgcatcacgggcactcccacggctatagtcatgagagcctgtatcatcgtggccacggccatgaccatgagcattcccatggaggctacggggagtctggcgcacctggcataaagcaagacctggatgctgtgacactttgggcgtacgccctgggtgcaacagtcctgatttctgctgcgcctttctttgtattgttcctgataccagtcgaatctaacagccccagacacaggtccctcttacagattcttctgtcctttgcatccggtggcctgctaggcgacgcctttttacacttgatcccccacgcgctggagccacacagccatcatacgttggagcagcccggacacggtcacagtcactctggacagggccctatactttcagttggactgtgggtgctgtccggtatcgtggccttccttgttgtggagaagttcgtccgccacgtcaagggaggccacggccacagccatggccacggacacgcccatagccacacccgtggctctcatggccacgggcgacaagagaggtctactaaggagaagcagtccagtgaggaggaagaaaaggagactaggggggtgcaaaagagaagaggagggagcaccgtgcccaaagacggccctgtgcggccacaaaacgctgaagaggagaagcgtggtcttgatctgagggtgtccggctatttaaacctcgcagccgacttagctcataactttacggatggactggccataggcgcttcatttcgaggcggacggggtctgggaatactgacaacaatgaccgtcctcctgcatgaggtgccccacgaggtaggagattttgcaattctggtccaatctgggtgttctaagaaacaggccatgcggctgcagttgctcaccgctgtgggtgccctggcaggcactgcttgcgcactgctgaccgagggtggggctgtcgggagcgagatagctggtggggctggacccggatgggtgctaccatttaccgctggtggctttatatacgttgccaccgtgtccgtacttccagagctgctgagagaagcatccccactgcagagtctattagaagtcctgggacttcttggcggtgtaattatgatggtacttatcgcacaccttgaatag

SEQ ID NO: 241562 - DNA, 1410 bp, Artificial Sequence
  Description of Artificial Sequence: Synthetic coding sequence
atggcgagaggtctgggcgcacctcattgggtggctgtaggcctgttgacttgggccacactggggcttttggtggcagggctgggcggtcacgacgacctgcacgacgaccttcaggaggacttccacggccactcccacagacactcacacgaagatttccatcatggccactctcacgcccacggccatggacacacccacgaatccatctggcatgggcacactcacgatcacgaccatgggcacagccacgaggacctgcaccatggacactcccacggttactctcacgagtcactttaccatcgcggacacggccacgatcatgagcacagtcacgggggatacggcgaaagcggggctcctggaatcaagcaggacctagacgcagtcaccctttgggcctacgccttaggagctactgtcctgatatcggccgcacctttctttgtgctgtttttaattcccgttgaatccaattccccaaggcataggtcattgctccagatcttattaagttttgccagcggtggattgctgggagatgcctttctgcatctcatccctcacgcgcttgaaccccatagtcaccatacactcgagcagcctggccatggccattctcacagtgggcaaggtcctatactgtctgtaggcttgtgggtactctccggtatcgttgccttcctcgttgtggagaaatttgtcaggcatgtgaaaggcggacatggacactcacatgggcacgggcacgcccactcccacactcggggttctcacggacatggcagacaggagcgctctaccaaggaaaaacagtcctccgaagaagaagaaaaagaaaccaggggcgtacagaagcgtcgaggcggatcgaccgttcccaaagacgggccagtgcggcctcagaatgcagaggaggagaagaggggactcgacctgcgggtgagtggttacttaaacttggctgcagaccttgcccataacttcacagacgggctcgctattggggctagcttcagagggggacggggtctgggtatcctgacaacgatgaccgtgctgcttcacgaggtgccccacgaggtcggtgacttcgcaatcctcgtgcagtccggatgtagcaaaaaacaagcgatgcgccttcagctgctcaccgccgtgggggctttggccggaacagcttgcgcactgctcaccgagggcggtgcagtgggatctgagatcgccggtggggctggccctggatgggtgctgccctttactgcaggaggattcatctatgtcgcgactgtttctgttctcccagagttgctgagggaggccagccccttacaatctctgctagaagtacttggattgctgggcggtgtgatcatgatggtactcatagctcacttggaatag

SEQ ID NO: 241563 - DNA, 1410 bp, Artificial Sequence
  Description of Artificial Sequence: Synthetic coding sequence
atggcacgcggattgggcgctcctcattgggttgctgtcggtctgctaacgtgggcaactctgggattattggttgccggattggggggacatgacgacctgcatgacgaccttcaggaagattttcacggccacagccatcggcacagtcacgaagattttcaccacgggcactctcacgcccacggccatggtcacacacatgaaagcatctggcatgggcatactcatgatcacgaccatgggcactcccacgaagacctgcatcacggccattcacatgggtattcccacgaatctctataccacagaggacatggacatgatcatgagcactcccatgggggatatggggagagcggggcacctgggattaaacaggacctggatgctgtgacactttgggcctatgccctgggggcaaccgtgctgatcagcgcagccccattcttcgtcctctttctaatccctgttgagagcaatagtccacgccatcgttctctgttgcagatcctcctgtctttcgcatcaggcggtctgcttggcgatgcgtttctgcacctaattccccatgccctcgagcctcacagccatcatacactggagcagcctggccacggacactctcattccggccagggaccgatcctgtcagtagggctgtgggtgttgtccggtatcgtcgccttcttggtagttgagaagttcgtgcgccatgtgaagggtggccatggccattctcatgggcatggccatgcacacagccacaccagggggagccatggccatgggagacaggaacggagtacaaaggagaaacagtccagcgaggaggaagagaaagagactcgcggagttcagaagagacggggaggatcaacagttcctaaggatggcccagtgcgtccccagaacgccgaagaggaaaagcgcggtctggacctgagggtcagcggataccttaaccttgcagctgacctggcccacaatttcactgatggtctggccattggagcgtcttttagagggggaagagggctggggatcctgacaactatgaccgtcctgctgcacgaggtcccacacgaggtcggggactttgccattcttgtgcaaagcgggtgctccaagaagcaggctatgcgtctgcagctcctgaccgccgttggagcactggctggtacagcctgcgcactccttactgagggaggagcagtcgggagcgaaatcgccggtggggctggacccggatgggtgctgccctttactgccggaggatttatctacgtggctaccgtaagtgtattaccagagctactccgtgaggcttccccattgcagtccctcttagaggtgctgggtctccttgggggagtaattatgatggtcctgatcgcacacttggaatag

SEQ ID NO: 241564 - DNA, 663 bp, Artificial Sequence
  Description of Artificial Sequence: Synthetic coding sequence
atggatagctctttaccggagtgtcggcatatcgggaagggcataagggccaaggtagagcgaaattttcttttcagtcgtgatctcaaagcaggcctgccacgaccttctaagccaggcaaggaacggatccccgagccagccctgggagccaccgtcttgataagcgccgctccttttttcgttctctttctcattccagtagaatcgaatagtcccaggcaccgctctctgctgcaaatcttgcttagctttgcaagtggcggtctgctcggcgatgccttcctgcatctgatcccacatgcacttgagccacatagccaccacaccctggaacagccgggacatgggcattcccacagtggtcaggggcctatcctttcagtgggcctctgggttctgtctggtattgtggcctttctagttgttgaaaagttcgtcagacatgtgaagggtggccacggacactctcatggccacggacacgctcactctcacactaggggttctcatggccacggaaggcaagaacgcagtaccaaagagaaacaaagcagcgaagaagaggagaaggagactcgcggagtgcaaaagcggagaggcggttcaactgtaccaaaggatggtccagtgcggcctcagaacgctgaggaggagaagtag

SEQ ID NO: 241565 - DNA, 1125 bp, Artificial Sequence
  Description of Artificial Sequence: Synthetic coding sequence
atggcaagaggattgggcgcaccccattgggttgcggtgggcctgttgacatgggccacgcttggtctcctggtcgccggacttgggggacacgacgatctgcacgacgacttgcaagaggatttccacggtcactctcacagcgcagatctttcatcgtccattttctgcccactcccctatccaagaggcgtggagctgagccctgccagtctcagcacttcggatctcgcgcagttctgttttagatgggccccaggcagatgttttctgcacctgatcccacacgcgcttgagccccattcccaccacacacttgagcagccgggtcacgggcactctcacagcggccagggacccatccttagtgtgggtttgtgggtgctgagtgggatcgtggcattcctagtggtcgagaagttcgtgcgccacgtgaagggaggccacgggcactcacacggccatgggcacgcccactcgcacacgagaggtagtcacggacacggaaggcaggagagaagcactaaggagaagcaatcctccgaggaagaagaaaaggagacaaggggtgtccagaaaagaagaggagggagtacagtaccaaaggacggacccgtgaggcctcagaacgcagaagaggagaaacgaggcctcgatctgagagtgagcgggtacctaaacctggccgctgacctggcccacaacttcaccgacggattagctattggagccagcttccggggtggcagaggtctgggcatcctgactacaatgacagtgctgttgcacgaggtgcctcatgaggttggcgattttgcaatcttagtgcagtccgggtgtagcaagaaacaagctatgaggctgcagctgcttaccgccgtgggggctctggccggaactgcttgcgccctgctcacagaggggggtgctgtcggatcggaaattgccggaggcgctggaccaggatgggttctgccctttactgccggagggtttatctacgttgccacagtttcggtccttccagagttgttgagggaagcaagtcccctgcaatccctgctggaagttttagggctgttgggtggtgtcatcatgatggttctcatagcccacttggagtag

SEQ ID NO: 241566 - DNA, 1353 bp, Artificial Sequence
  Description of Artificial Sequence: Synthetic coding sequence
atggcacggggacttggtgcaccccattgggtggctgtgggtctcctcacgtgggctactctgggcttgctagtggcgggactcggcggacacgacgatctccatgacgatctgcaagaggactttcacggccacggacatacccatgaaagcatatggcatgggcacacacacgaccatgaccacggtcatagccacgaagatctgcaccacggacattcccacggctactcccatgagtctttgtatcacagaggccatggtcacgatcacgagcattcacatggcggttatggcgaaagcggggctccgggaatcaagcaagacctagacgccgtcaccctctgggcatatgccttgggggctaccgtactgatcagcgcagccccattcttcgttctgttcctaattccagtagagagtaacagtccaaggcataggagcttgctgcagattttactgtccttcgcgtccggaggtctccttggtgatgcattcttgcatttaatcccacacgctctcgaaccacacagccatcacacactcgaacagcctggacacggacactctcattcagggcagggcccaatactgagcgtgggactgtgggtgctatcaggcattgtcgccttcctcgttgtcgagaagtttgttcggcacgtaaagggcggtcacggtcatagtcatgggcatggacatgcccactcacacacaagaggatcgcacggacatggcagacaggaaagatcaactaaggagaagcagagcagcgaggaggaagagaaggaaacacgaggggtgcaaaaaaggaggggtggctccactgtacctaaagatggcccagtaagaccccagaatgccgaggaggagaaaagaggccttgatctgcgggtgtccggctatctcaatttggccgcagacttggcacacaacttcaccgatggacttgcgataggagccagcttccggggaggtaggggcttggggatattgaccaccatgactgtgctgctccacgaggttccccatgaggtgggtgacttcgctatcctggtgcagtctggttgcagtaagaagcaagcgatgcgcttgcaactgcttacagcagtaggtgccctggctgggaccgcctgcgcgctcctgaccgaaggcggagctgtcggatccgagatcgcaggcggtgcgggtcctgggtgggtattgcccttcactgccggtggatttatttatgtagctaccgtatccgtgctgcccgagctgctgagagaggccagtccactgcagtcattactcgaggtgctgggcttgctgggtggcgtcatcatgatggtgctgattgcccacttagaatag

SEQ ID NO: 241567 - DNA, 663 bp, Artificial Sequence
  Description of Artificial Sequence: Synthetic coding sequence
atggacagctcactccccgagtgtcggcacatcggcaagggcatacgggctaaggtggagcgcaattttcttttctctcgggatctcaaggcaggcctcccaaggccatccaagcctggcaaggagagaattccagagcctgcgctgggggctacagtacttattagtgccgctccttttttcgtgttgttcctaatcccagtcgaaagtaactctccacgccaccgaagcttgctccagattttgctaagcttcgcctccgggggtctgctgggagatgcattcctgcatttgataccacacgcactggagccacactctcaccacactctggagcagcccggtcatggtcatagtcattcgggacaggggccaatcttatcagtgggcttgtgggtactgtccggcattgtagcttttctagttgttgagaaatttgttaggcatgtcaaaggcggtcatgggcacagccatggccatgggcacgctcattctcatactagagggagtcatggacacggtcggcaggaacgaagcactaaagaaaagcagtcaagcgaagaggaggagaaggaaaccaggggggtccagaagcgacgaggcggaagtactgtgcccaaagacggccctgtgcgccctcagaatgcagaggaggaaaaatag

SEQ ID NO: 241568 - DNA, 1410 bp, Artificial Sequence
  Description of Artificial Sequence: Synthetic coding sequence
atggcacgcggactgggcgcacctcactgggtggccgtcggcttgttgacttgggccactctgggtctgctggtcgccggactggggggtcacgacgaccttcacgacgacctgcaagaagactttcacggacatagtcataggcactctcatgaggatttccaccatggtcattcccatgctcatggccacggtcatacccatgaaagcatctggcacgggcacacccacgaccacgaccacggacacagtcacgaagatttgcaccatggtcacagtcacggatatagtcacgagtccctgtatcacaggggccatgggcacgatcacgagcactcccatggtgggtacggggagagcggggctcctggaattaaacaggatctggacgccgtgactctctgggcctatgcactaggcgctaccgtcctgatctcagcagccccttttttcgttctctttctgatcccggtcgagtccaactcacccaggcatcggtccttgctgcagattttactgtcctttgcctccgggggactgctgggcgatgcttttctacatttgatccctcacgccctggaacctcactcacatcacactctggaacagccagggcacggacactcacacagcggccagggaccgatacttagcgtggggctctgggtcctgtcggggatcgtagcctttctggtagttgaaaaattcgtccgtcatgtcaagggcggacacggccatagccacgggcacggacatgctcactcacacacgaggggaagtcacggtcacggtaggcaagagcggtccacaaaagaaaaacagagttccgaggaggaagagaaagagactagaggtgttcagaaacggagaggcggttcaactgtgccaaaagatggtcctgttcgaccacagaacgccgaggaagagaaacgcggtctggacttaagagtcagtgggtatctcaacctcgccgctgatttggcccataatttcacagatggtctcgcaattggcgctagtttcagaggcggtagaggattggggatccttaccacaatgacggtcctcttgcatgaggtgccacacgaggtaggcgacttcgctatcttggtacagtctgggtgtagcaaaaaacaggccatgcgcctgcagctcctcacagccgtcggtgcgctcgcagggaccgcctgcgccctattaacggaaggcggtgcagtgggctcagagattgccggaggcgcagggccaggatgggtgttgccatttacggctggagggtttatctatgtagccactgtgtcggtgctgccggagctgctgcgtgaagcttcgcctctacagtctctgctggaagttctgggcctgttggggggtgtaataatgatggttctaatcgcccaccttgaatag

SEQ ID NO: 241569 - DNA, 1125 bp, Artificial Sequence
  Description of Artificial Sequence: Synthetic coding sequence
atggcgagaggcctgggcgctcctcactgggttgccgtcggactgctcacttgggctaccctgggcttgttagttgccggactgggaggtcatgatgatctgcatgacgacctacaggaggatttccacgggcactcacatagtgccgatcttagcagcagtatcttttgtcctctgccttacccaaggggggtagagctgtcccctgctagcttatccacctccgaccttgcgcagttttgctttcgctgggccccaggtagatgttttctgcacctgatccctcatgcactggaaccccactcccaccacactctggaacaacctggccacggccactcacacagcgggcagggcccaattctctcggtgggcctttgggttctgtcagggatcgtagcgttcctggtcgttgaaaaattcgttcgtcacgtcaaggggggacacggtcactctcacgggcatggccacgcccactcccacacgaggggctcccatggacatgggcgtcaggaaaggtcaacaaaagaaaagcaatcttctgaagaggaggagaaagagaccagaggagtgcaaaagcggagagggggtagtaccgttcccaaggacggtcccgtaaggcctcagaacgccgaggaggagaagagaggcctggacctaagggtgtctggttatctgaacctggctgctgatctggcacacaattttaccgacggactggcaatcggcgcttcatttcgcggaggtcggggtctcggcatcttgaccaccatgactgtgctgctgcatgaggtgccacacgaggtgggggacttcgcgatactcgtccagagtggctgctccaaaaagcaggccatgcgcttacagctgcttactgcagtgggagcccttgccggtaccgcttgcgctttactaacagagggtggggctgtggggtcagagatagcaggaggagcgggaccaggatgggtgctccccttcaccgccggaggctttatctacgttgcgactgttagtgtgctgcctgaacttcttcgcgaagcctctcctctgcagagtctgctggaggtgctaggattgcttgggggagttatcatgatggtgctgattgcccaccttgaatag

SEQ ID NO: 241570 - DNA, 1353 bp, Artificial Sequence
  Description of Artificial Sequence: Synthetic coding sequence
atggcaaggggacttggcgctccacactgggtggctgttgggctgctcacatgggccaccctgggactgctcgtggcgggactgggcggacacgacgacctgcatgatgacttgcaggaagatttccatggacatgggcatacccatgagtccatctggcacggtcatacccacgaccatgatcatggccattcccatgaggatctccatcacggccatagtcacggctacagtcatgagagcctgtaccacaggggccacgggcacgatcacgaacattcccacggaggatacggcgagtcaggggctcctggaatcaagcaggacctagacgcagtgacattatgggcctatgcactcggggcaactgttctgatctcagccgctcctttcttcgtcctcttcctgatcccagtggaaagcaactctcctcgacacagaagcttgctgcaaattctgctttccttcgcttccggcggattattaggggatgcctttcttcacctcatccctcacgcattggagcctcactcccatcatacactggagcaacccggtcatggccattctcattctgggcaggggccaattttgagcgtcggcctgtgggtgctcagcgggattgtggcatttctggtggttgagaagtttgtcaggcacgtgaaggggggacatggccattcacacggtcacggacacgctcacagccatacccgagggtcgcacggccatgggagacaggaaagatcaactaaagaaaagcagtcctccgaggaagaagagaaagagacgagaggtgtgcagaagcgcaggggaggttcgaccgtacccaaggacggacctgtcagacctcagaacgccgaggaagagaagcggggactcgatctcagagtcagcggttatctcaacctggctgccgacctcgctcacaatttcactgatggcctggctatcggggcttccttcagagggggtaggggactgggcatcctcactactatgaccgtgctgctacatgaggtgccacatgaggtgggagactttgctatcctcgtgcagagcgggtgctccaagaagcaagctatgaggctgcagctactgactgctgttggtgctctcgcaggaaccgcttgcgcgttactgaccgaggggggagccgtaggcagtgagattgcaggcggtgcgggaccaggctgggttcttccttttactgctggcggttttatctacgttgccaccgtgtccgtgctccccgagttactgcgcgaagcctccccactacagagtcttctagaggttttgggtttgctgggaggcgtgatcatgatggttctaattgcacacctggagtag

SEQ ID NO: 241571 - DNA, 1125 bp, Artificial Sequence
  Description of Artificial Sequence: Synthetic coding sequence
atggcacggggactgggtgcccctcactgggtggcagtcgggctgttgacatgggccacactgggtctcttggtcgccggactcgggggacatgacgatctgcacgatgacctgcaggaagacttccatggtcactcacacagtgccgacttaagtagtagtattttctgcccactgccatacccacgcggagtcgagcttagcccagcctccctttccacgtctgacttggcgcagttctgcttcagatgggccccaggtaggtgcttcctgcaccttatcccccacgctctggagcctcactctcaccatacactggagcagccaggtcacggacactcacactccggtcaggggcctatattgtccgtgggactttgggtgttgtccggaatcgttgcatttctggtcgtagagaagtttgtgagacatgtgaaaggcggacacggccattctcatggacatggccacgcccactctcacacccgtggctcgcacgggcatggaaggcaggagagatctactaaagaaaaacaatcctcagaagaagaagagaaggaaacacgaggtgtgcaaaagaggcgaggcggaagtaccgtccctaaagatggcccagtgcggcctcagaacgcggaagaagaaaagcgaggcttggacctgagagtgtccggatacctcaacctggcggcagatctcgcacacaacttcactgatggactagccataggtgcctcattccggggtggaaggggcctcggcatcttgaccacaatgaccgtgctgctgcacgaggtacctcacgaggtcggagactttgcaattctggtacagtctgggtgctccaaaaaacaggccatgcggcttcaacttctcaccgccgtgggcgctctagcaggcacggcttgtgctctcttgaccgaggggggtgcggtaggaagcgaaatcgccggtggcgctggcccaggatgggtactccctttcacggctgggggatttatctatgtggccactgtgagtgttctcccagagctgctacgtgaagcatctcccctgcagagccttctggaggttcttggattactcggcggtgttattatgatggtactcatcgcgcacctggagtag

SEQ ID NO: 241572 - DNA, 1125 bp, Artificial Sequence
  Description of Artificial Sequence: Synthetic coding sequence
atggctcgtggactgggcgctccacactgggtggccgtaggattgctcacttgggcaacactcggactccttgtggctggtttaggaggtcacgatgacctgcatgatgatctccaggaggactttcatggacactctcattcggctgacctgagtagctccatcttctgccctctgccttatcccaggggcgtcgaactctcccccgcatcactgtccacatctgacctggcccagttttgttttagatgggccccaggtcgatgcttcttgcatctcatcccacatgctctagaaccgcacagtcatcacaccctcgaacagccaggacatggccactcgcactcaggccagggacccatcctaagtgtcggattgtgggtgctctctgggatcgtggcattcctggtggtggaaaaatttgtacggcacgtcaagggcggacacggacattcgcatgggcatggacacgcccactctcacacccggggtagtcacggccacggacgccaagaaaggtctacgaaagaaaaacagagtagcgaggaggaggaaaaagaaacccggggagttcagaagcgccgagggggttccacagtgccgaaagacggacccgtgcggcctcagaatgcagaggaagagaaacggggactggatttgcgagtgagcggttatctgaacttggccgctgatttggctcacaattttacagatggtctcgccattggagccagcttcaggggtggtaggggtctgggtattctcaccactatgaccgtattgctccatgaggtcccacacgaggtaggcgactttgcaatcctcgtacagagcggatgtagtaaaaagcaagcaatgagattgcagcttctgactgcggtgggcgcattagctggcacagcctgtgcactgcttaccgaggggggagctgtaggaagcgaaattgcagggggtgccggacctggttgggttctgccattcaccgccggtggattcatctatgtggctacagtatccgtactgccagagctgctgcgcgaggcctcccctctccagagtttgctagaggtcttgggcctgttgggcggagtgatcatgatggtgctgatagcccacctcgagtag

SEQ ID NO: 241573 - DNA, 1353 bp, Artificial Sequence
  Description of Artificial Sequence: Synthetic coding sequence
atggcgaggggacttggcgctccccactgggtagctgtggggcttttaacttgggctactttgggtcttcttgtggccggactggggggacacgatgatctacacgatgatcttcaggaagactttcacgggcacgggcacacacatgagtctatatggcatggtcacacccatgaccacgatcatggacatagccatgaggaccttcaccatggccacagccatggctactcccatgaatctctgtatcataggggccatggacatgatcacgagcactctcatgggggttatggcgaaagcggggctcccggtattaagcaggacctggacgctgttactctgtgggcctatgccctgggcgctaccgtattgatatctgctgccccattctttgtgctgtttctgattcccgttgagtccaacagtccacgccatcgatccctgctgcagatcctcttgtcctttgctagtggcggactccttggagacgcctttttgcacttgattccacacgcgttggaacctcacagccaccacactcttgaacagcccggtcacggccactctcactctggccaggggccaatcctcagtgtgggtctgtgggtcctaagcgggatcgttgcttttctagtcgttgagaaattcgtccgacacgtcaaaggagggcacggtcatagtcatgggcacgggcatgctcactcccacactaggggaagccacggccatgggcgacaagagcggtccacaaaggaaaaacagagctcggaagaggaggagaaggagacgcgcggagttcaaaaacgcagagggggttccaccgtgccaaaagacggtcccgtcaggccgcaaaacgccgaggaagagaagaggggactggacttgagggtgtctgggtatttaaacctggctgctgacctcgcacataactttactgatggcttagccatcggcgcttcctttcgaggtggtaggggtctcgggattcttacaacgatgaccgtcctcctgcatgaggtgccccacgaggtgggagatttcgccatcctggtgcaatcaggatgctctaagaaacaagcgatgcgacttcaacttctcacggccgtcggtgccctggcgggtacggcgtgtgctctgctcaccgagggcggtgccgtcgggtcagagattgccggaggcgctggcccaggttgggtcctcccttttacagcaggtggattcatttacgtcgccaccgtcagtgtattgccagagttactgcgcgaagcttctcccttacagtcactgctggaggtgttgggtctcttgggcggagtgatcatgatggtactgatcgcccatctggagtag

SEQ ID NO: 241574 - DNA, 1353 bp, Artificial Sequence
  Description of Artificial Sequence: Synthetic coding sequence
atggctcgtggtctcggggctccacactgggtggccgtcggtctcttgacatgggccacattgggcctgcttgtggccggtcttgggggtcacgatgacctgcatgatgatctccaggaagactttcatggccatggtcatactcacgagtccatctggcacggccacacacacgaccatgaccacgggcacagccacgaagacctccaccacggccactctcatggatactcccacgaatcactgtatcatcggggtcatggtcatgaccacgaacacagtcacgggggttacggggagtccggggctcctggcattaagcaagatctcgatgccgtgactctttgggcatacgcgctgggtgctacagtactcatttcagccgctcccttctttgtcctgtttttaattcctgtggaaagcaacagtcctaggcataggagcctcctgcaaatcctgctgtctttcgccagcggagggctcctgggcgatgccttcctccatctgatccctcacgccctcgagccccactcgcatcatacactcgaacagccgggacacggccattcccattctggtcaggggccaatcctgtctgtgggcttgtgggtactgtccggcatcgttgctttcttagttgtagaaaagtttgtgcggcacgtgaagggtgggcatggacatagccatggccacggccatgcccacagccatacaagaggcagtcacggccacgggagacaagaacggtccaccaaggagaagcagtcttcggaagaggaagagaaggaaactagaggcgtgcagaaaagaagaggcggatccactgtgcctaaagacggaccagttcggccacagaacgctgaagaagaaaagcgtgggctggatctgcgggtcagtgggtatctgaaccttgccgcagacctggcgcacaacttcaccgacgggcttgcaatcggcgcttcatttcggggagggagggggctagggattctgaccacgatgaccgtgttgttacatgaagtgccacacgaagtgggcgattttgcaattctggtacagtctgggtgctctaagaagcaggcaatgcgtctgcagctcttgactgcagtcggtgccctcgccggaaccgcctgcgctcttctgactgaaggaggagccgttggctcggagatcgcgggaggcgcaggtccagggtgggttttaccattcacagccggaggctttatctatgtggcaacggtgtcagtcctcccagaacttctacgggaagctagccctctgcagtctctgcttgaagtcttaggcctgttgggcggagttataatgatggtgctgatagcccacctagagtag

SEQ ID NO: 241575 - DNA, 1125 bp, Artificial Sequence
  Description of Artificial Sequence: Synthetic coding sequence
atggccaggggcctgggcgcaccccattgggtcgctgtcggactgctgacttgggccacactcggactcctggtagctggcttaggtggccatgacgacctgcatgatgatctgcaggaagatttccacggccattcacattctgcagacttatcctcttccatattttgccctctcccttaccctagaggcgtcgaactatcccctgcttctctgagtacgtcagacctcgcccaattctgcttccgatgggcccctgggcgatgtttcttgcatctgattccccatgccctcgagccacactctcatcacactctggagcaaccgggtcacggtcattctcatagcggacaggggccaattctgtccgtcggcctctgggtcttgtccggaattgttgccttcctcgttgtggaaaaattcgtgagacatgtcaaagggggacacggacattcccatgggcacggacacgcccactctcatacaagagggtctcatggccatgggcgacaggagagaagcactaaggagaaacagagcagcgaagaggaagaaaaggaaacacgcggtgtccaaaagagacgcggagggagtaccgtacccaaagatggaccagtacgaccccagaacgctgaggaagagaagagaggcctggacctcagagtgtctgggtacctcaatctggctgcagacctggcgcataattttacagacggcctggctatcggagccagctttcgtggcggacgtggcctgggcatactcacaactatgacagttttgttacacgaggttccacatgaggtaggcgactttgccattttggtccagtctgggtgctctaaaaagcaggcgatgcgactgcagctcctcacagcagtcggggcactggccggtaccgcctgtgcgctgctgaccgaggggggtgccgtcgggagcgagatcgctggcggagccggtccgggatgggttctgcccttcaccgctggtggatttatatacgtggctacagtgtctgttctgcccgagcttctcagagaggcttccccactgcagagtctgctggaagttctgggacttttgggaggcgtcattatgatggtgttgatagcccacctggagtag

SEQ ID NO: 241576 - DNA, 1353 bp, Artificial Sequence
  Description of Artificial Sequence: Synthetic coding sequence
atggcccgaggtctaggggctcctcactgggtggccgtgggactgttgacctgggccacacttggactgctggtcgccggactgggcggacacgatgacctacacgacgacctccaagaggacttccatggacacgggcatactcacgagagcatttggcatggacacacccacgaccatgaccacggtcatagtcacgaggacctgcaccacggacactctcatggctactctcacgaatccctgtaccatcggggtcatggccatgatcacgagcattctcatgggggatatggcgagtccggagcacctggtattaagcaggatttagacgccgtgactttatgggcctatgctttaggcgctaccgtgttgatcagtgctgctccgttctttgtgctgttcctcattcccgtggagtctaactctcccagacataggtccctgctgcagatactactgagctttgcatcaggaggactgcttggcgatgccttcctccatctgatcccccatgctctcgaaccacattctcatcacactctggagcagccaggacatggccactcacactccggccaaggcccaatactgtcagtgggtctgtgggtgctctctggcatcgttgccttcctggtcgttgagaaatttgtgagacacgttaagggtgggcacggtcatagccatggtcacggtcacgctcacagccacactaggggatcacacggtcatggacgtcaagagagaagcaccaaggagaaacaaagctctgaggaagaggagaaggagactagaggagtccaaaagaggcggggagggagcacagttcctaaggatgggccagtgaggcctcagaatgcagaggaggaaaagcgtggcctggacctgagggttagcggctacctgaatctcgccgctgacctcgcgcacaactttacagacggactggcaatcggcgcttcttttcgcggtggccgtgggttggggatactgaccaccatgaccgtgttgctacacgaggtgccacatgaggtcggggacttcgcaattctagtccaatctgggtgttccaagaaacaggctatgcgactgcagcttttgacagccgtgggagcgttggctgggaccgcctgcgccctcctgacggaaggcggtgccgtcggttcagagattgcaggtggtgcaggcccagggtgggtcctcccctttaccgctggcggattcatctacgtggccactgtgtcagtgctccccgagctgctgcgagaggctagtccactgcaatcgcttctggaggtgctgggtttgctgggcggagtgatcatgatggtcttgatcgcacacctggagtag

SEQ ID NO: 241577 - DNA, 1353 bp, Artificial Sequence
  Description of Artificial Sequence: Synthetic coding sequence
atggctcgcggactaggtgctcctcattgggtggccgtgggtctccttacttgggctactcttggcctgctggtcgccggtctggggggacacgacgatctccacgatgacctgcaagaggacttccatgggcatgggcatactcatgaaagcatctggcatgggcatacccacgaccacgaccacggacactctcacgaagatctgcatcatggccatagtcatgggtattctcatgaatctttgtaccatcggggtcacggccatgaccatgagcactcccacgggggatacggcgaaagcggtgccccaggcattaaacaggatctggatgccgtcacgctgtgggcatacgccctcggcgctaccgtgcttatttctgctgctccgtttttcgttctgtttctcattccggtcgaaagcaattctcctaggcatcggtctcttcttcaaatcctgttgtccttcgctagcggcggtttgctgggagatgccttcctccaccttataccacatgctctggagccccactcccatcataccctcgagcagcccggtcacggacacagccattcaggtcagggacccatactgtccgtgggcctgtgggtgctctcaggcatagtggcatttctggttgtcgaaaaatttgtcagacatgttaagggtgggcacggtcactcacacggccatggccacgcgcacagtcacactcgcggaagtcatggccacgggaggcaggaaagatccacgaaagagaagcagtcgtctgaggaagaggagaaagaaacaagaggagtccagaaacggagaggcggttctaccgtgcctaaagatggcccagtccggcctcagaatgccgaagaggaaaaaagaggcctggatttgagagtgtctggatacctgaacctggcagcggatctggcccacaatttcactgacgggctggctataggcgctagctttaggggaggacggggactgggcattctgacaactatgacagttttgcttcacgaagtcccccacgaagtgggcgactttgcaattctcgttcagagcgggtgcagcaagaaacaggccatgagactgcagcttctgacggctgtgggagccctggcaggcacagcatgtgcccttctcaccgaggggggagctgtgggatctgagattgccggaggagctggcccaggctgggtgctccccttcaccgcaggtggattcatttacgttgccaccgtctctgtcctccccgaactgctgcgcgaggcgagtcccctgcagtcattactggaggtccttgggttattggggggagtgattatgatggtgctcattgcacacctggagtag

SEQ ID NO: 241578 - DNA, 1125 bp, Artificial Sequence
  Description of Artificial Sequence: Synthetic coding sequence
atggcccgtggactgggggcacctcattgggtcgccgtcggcctactcacatgggccacacttggacttctggtcgcaggactcggcggacatgatgacctgcatgatgacctgcaggaagactttcatggtcacagtcacagtgccgacctaagctcctctatcttctgcccactgccatatccacggggagtcgagctctcacccgcttccttgtcaacgtctgaccttgcccagttctgcttcaggtgggcacccggtagatgttttctccaccttattccgcacgccctagaaccgcatagtcaccacaccctggagcagcctggtcatgggcacagtcacagtggacaggggccaatccttagtgttggtctctgggtgctcagcggtattgtggcgtttctggttgtcgaaaagtttgtaagacatgttaaaggcggacatggccattcccatggacatggtcatgcccactcccatacgagaggctcccatggccatggccgtcaggagcgcagtacgaaagaaaagcagagtagcgaggaggaggaaaaggagacacggggagtacagaaacggcgaggcggatcaacagtgccgaaggatgggcctgtgcgtccccagaacgccgaagaagaaaagcgaggcctggacctgagggtcagtggttaccttaaccttgccgctgacctcgcacacaacttcaccgacggcctggcaattggcgctagctttcggggagggcgtggcctaggaatcctgaccacaatgaccgtcttgctacatgaggtccctcacgaagtcggcgactttgcgatccttgtgcaatcaggttgcagtaagaagcaagctatgagacttcagctactgaccgccgtcggcgctctcgccggaaccgcctgcgcactgctgaccgagggcggagcggtgggctctgagatcgctggcggagccggtcctggctgggtcctcccatttaccgcaggcggattcatttacgtcgccactgtctccgtcctgcctgagcttttgcgggaggcatctcccctgcagtccctcctggaagtgctgggactgctgggaggcgttatcatgatggtgctaatcgcccacctggagtag

SEQ ID NO: 241579 - DNA, 2391 bp, Artificial Sequence
  Description of Artificial Sequence: Synthetic coding sequence
atgctagcccctctgcgtaacgccccaggacgggaaggtgcgactagtccatcccctcctaccgatgctactgggagcctgggcgagtgggatgtggatagaaatgtgaagaccgagggttgggtgtccaaagagcgcatatctaaactgcacaggctccgcatggctgacatcctgagccagtccgaaaccttggcaagccaggatctctctggtgactttaaaaagcctgcactcccggtgagcccagctgcccgaagcaaggctcctgcttcttcatccagtaatcccgaggaggttcaaaaagaaggaccaactgccctccaggatagtaattccggagaaccagatatcccaccccctcagcctgactgtggagatttcaggagtctgcaagaagagcagagtcgtcctcctacagccgtgagcagtccaggcggacccgctcgggctccaccctaccaggagcctccttgggggggtcctgcaactgccccttatagcttagagaccctaaagggtggcactatcttgggcacacggtccctcaaaggcacatcctattgtctctttggcagactcagtggttgtgatgtttgtctggaacatccctctgtgtcaagatatcacgctgtccttcagcatcgagctagtggaccagatggtgaatgtgattcaaatggaccgggtttttatctttatgatctgggtagtactcatggcacttttttaaacaagaccagaatcccaccgagaacgtattgtagggtgcacgtgggccacgtggtaagattcgggggatcaacccgcctgtttatcctgcagggaccagaggaggatagggaggcggaatccgagctcacagtgacgcagctgaaggagctgcgtaagcagcaacagattctactagagaaaaaaatgctgggagaggatagtgatgaggaggaggagatggatacgtcagagaggaagattaatgcgggatcccaggacgacgagatgggatgtacatggggcatgggggaggatgccgtagaggacgacgctgaggagaatcctatcgttctggagtttcagcaggaaagagaagccttctatattaaggatcccaagaaggccctgcaggggtttttcgaccgggagggcgaagagctggagtacgagttcgacgagcagggacactctacttggctgtgcagagtaagattgcccgtcgacgacagtacggggaaacagctggtggctgaggctatccactccgggaaaaagaaagaagccatgattcagtgtagtctcgaggcatgccgcattcttgacaccctgggactcctcaggcaggaggcagtgtctcgcaagcgtaaggcaaagaattgggaagacgaagatttctacgacagcgatgatgacacttttttggataggactggcctgatcgagaaaaagagactaaatcggatgaagaaagccggtaaaatagacgaaaagcctgaaactttcgagtctcttgtggctaagctaaatgacgccgagcgggaactgtctgagattagcgagcggctgaaggcttctagccaggtattgtccgagtctcctagccaggacagcctcgacgcattcatgtctgagatgaagtcagggagcactctggacggggtcagcagaaaaaaactccacctcaggacgtttgagctgagaaaagaacaacagaggttaaaaggccttatcaagattgttaaacccgctgagatacctgagctcaaaaaaactgagacccagaccaccggggctgaaaacaaagctaaaaaactaacactcccgttatttggggcaatgaagggaggctctaagttcaagttgaagaccggtaccgtcggcaagcttccacccaagaggcctgaattacctccaactcttatgcgaatgaaggatgaacctgaagtcgaggaagaggaggaagaagaggaagaagaggagaaagaaaaagaggagcatgagaaaaaaaagctggaggacggatctctgtcccgcccacaaccagaaatagagcccgaggcggctgtgcaggaaatgagacctcctacagaccttacccactttaaggagacccagacgcacgaaaatatgtcacagctgagtgaagaagagcagaacaaggattatcaggactgtagcaaaacaacaagcctgtgtgccggtcccagcgcttcgaagaacgagtatgagaaaagccgtggggagctcaaaaaaaagaagactcccggacctgggaaactgccccctactctgtctagcaaatatccggaagatgatcccgattattgtgtgtgggtcccccctgagggccaatctggggatggacgtacgcacctcaatgataaatacggttattag

SEQ ID NO: 241580 - DNA, 3699 bp, Artificial Sequence
  Description of Artificial Sequence: Synthetic coding sequence
atggatttcttgctgcgacctcagcccgagcctgaatcactgggccctggtacccccggtttccctgagcaagaggaggacgaacttcatagaactctgggcgttgagcgttttgaagagatcttgcaggaagcgggtagccgcggaggggaagagcctggcaggagctacggagaagaagactttgagtaccatcgacagtcgtcacatcatattcaccatccactttccacacacctgccaccagacgccagacggaggaagaccccacaagggcctggaaggaagccacgaaggcggccaggagcatctcctaccggcgaaacaccaacaattgaagaaggtgaagaagacgaagatgaggcttcagaagctgagggggctagagctctgacgcagccaagcccagtatccactcccagctccgtgcagttttttctgcaggaggatgactcagccgatcggaaggcggaaaggactagtccctcctctcccgcaccactcccgcaccaggaagctactccacgggcttcaaagggtgcccaggccggtactcaggtcgaggaggccgaagcagaggccgtagccgtcgcctccggcacagccggtggggacgacggcggtgcatctggaaggcccttaccaaaggcccagcctggccaccgttcatacaaccttcaggaacgcaggcggattggcagcatgaccggcgcagagcaggctctcttgccgagggtccccacagatgagattgaagcacaaactcttgccactgccgatttggacctcatgaaaagccaccgatttgaggatgttcctggcgtcaggcggcatttagttcgcaagaatgccaaaggcagcacccagagtggacgggaaggcagagagcctgggcctacccctcgagctcggccacgagccccacacaaacctcacgaggtgttcgtagagcttaacgagctcctgcttgataagaaccaggagccgcagtggcgcgagactgccagatggattaaatttgaagaagatgttgaggaagaaaccgagaggtggggcaaaccccacgtcgcttcactgagcttccgctctttgcttgagttacggagaacactcgcccacggcgcagttctgttggatctggaccaacagacgctgccgggagtcgcgcaccaggtagtggaacagatggtgatttccgatcagatcaaagctgaagacagagctaatgttctcagggccttgctgctcaagcacagccacccatccgatgagaaggatttctcatttcctcgcaacatttctgctggatctctcgggtccctgctgggacaccaccacggccagggcgctgagtccgacccacatgtgacagaacctcttatgggcggagtcccagaaacccggctagaggtggagcgggaacgagagctccctcctccagccccacccgctggaataacgcgcagcaagtctaaacacgaattaaagctgctggagaaaattcccgagaacgcagaggctactgttgtgttagttggttgcgtggaatttctgagccgacctactatggctttcgttcgactgcgcgaagcggtggaacttgacgctgtcctggaagttcccgtgccagtgaggttccttttcctgctcctaggaccgtcatctgcaaacatggactatcacgaaattggacgatcaataagtactctcatgagcgataagcaattccacgaggccgcttatttggcggacgagcgcgaggatctgctaacggccattaatgcttttcttgactgtagtgtagtgctgccgccaagtgaggtgcaaggagaggagttgctgcgatctgtagcccactttcagcggcagatgctgaagaaacgggaagagcagggcaggttgctgcccaccggcgctggcctggagcctaaaagcgcccaagacaaggcgcttttacaaatggtggaagccgcaggggctgctgaggacgatcctctgagaagaacaggaagaccgtttggtggcctgatacgggatgtcagacgacgctacccccattatctgtctgactttcgggatgctcttgaccctcagtgtcttgcggctgtaatatttatttacttcgctgcgctgtctcccgcaattacttttggtggcctgctgggagaaaagactcaggacctaattggagtgtccgagctcattatgagcactgctcttcagggcgtcgttttctgcttgctgggggctcagcctctgctggtgatcggcttcagcggtccactgttggtattcgaggaagccttcttctccttttgtagctcaaatcatctagaatatttagtggggagagtgtggataggattttggctcgtcttcttagcgctgcttatggtggccctagaaggctctttcctggtgaggtttgtcagcaggtttacgcaggagatcttcgcatttctaatcagtctgatcttcatttacgaaacattctacaagctcgtcaagatattccaagaacaccccctacatggatgctccgcatccaacagttccgaagttgacgggggtgagaatatgacctgggccggagcaaggcctactctgggcccaggaaacaggtctctggcgggacagtccggccagggtaagcctagggggcagcccaacacagccctgctttccctggtacttatggccggaacattcttcattgcttttttcctgcggaagttcaaaaactctcggttttttcccggacgcattcggcgtgtcataggtgacttcggcgttcccattgcgattctcataatggttctggtggactatagtatcgaggatacatatacgcaaaaattgagtgtgccctcaggcttcagcgtgaccgcgccagagaagcggggttgggttatcaacccactgggtgaaaagtccccttttcccgtctggatgatggtagcttccctgctgccagctatcttagtctttattctcatctttatggaaacacaaataacaaccctcataatcagtaagaaagaacgaatgttgcaaaaagggtccgggttccatctggacctgttattaattgtggccatgggagggatttgcgccctcttcggcctgccctggcttgctgccgcaaccgttcggtcagtaacgcacgctaacgcactgacagtgatgtccaaagccgtagctcccggtgacaaacctaagattcaggaggtgaaagagcagcgcgtgactggcctcctggtggctcttctggtaggactttctatcgttattggggaccttctcagacaaattcccctggcagtgctgtttggcatcttcctgtatatgggtgtgacctctttgaatgggatccagttctacgagcgactgcacctgctgctaatgccaccaaagcatcatcccgatgtgacgtatgtgaagaaagtccgaaccctaaggatgcacctgttcaccgctctgcagctgctctgccttgctctcctatgggcggtcatgagcaccgccgcaagcctggccttcccgtttatcctcatcctgactgttcctctgaggatggttgtccttacaaggatctttactgatcgagagatgaaatgtcttgatgctaacgaagcagagcccgtgtttgacgaaagagaaggtgtggacgagtacaatgagatgcctatgccagtatag

SEQ ID NO: 241581 - DNA, 3684 bp, Artificial Sequence
  Description of Artificial Sequence: Synthetic coding sequence
atgactcagccagagcccgaatccctgggaccaggtacgcccggattccctgaacaagaggaggacgagttgcaccgaacattgggggtggaaagatttgaggagattctgcaagaagcagggtccaggggcggtgaagagcctggcagatcttacggggaagaggatttcgaataccacagacagagctcccatcatatccatcatccactaagcacccacctaccgcctgacgcacggagacggaaaacgccgcaggggccagggcgtaagcctagaaggaggcccggtgcctccccaacaggagaaaccccaactattgaggaaggggaggaggatgaagatgaagccagcgaagcagagggcgctcgcgctcttacacaaccttcgcccgtgtccacaccttccagtgtgcagttttttctgcaggaggatgatagtgcggataggaaggccgagcggacatcccccagcagcccagcaccattgccacaccaagaagctaccccgagggcttctaagggagcgcaggcagggacgcaagtggaggaagcagaagcagaagccgttgccgtggcctcgggcactgccggaggggacgacggcggagcctcaggcaggccgttgccaaaggcacagcccggacacagaagctataacctgcaggaacgtcgcaggatcggttccatgactggtgccgaacaggcccttctgccacgcgtgcccaccgacgagatagaagcccagacactggccacggccgacctggatctgatgaagtcccacaggttcgaagatgtcccaggagtgagacggcatctggtgcgaaagaacgccaagggatctactcaatctggccgagaaggtagggagccaggccctaccccccgagcccgaccacgggcacctcacaaaccgcatgaggtgtttgtggaactcaatgagctcttattggacaaaaaccaagaaccgcagtggcgggaaaccgctcgctggattaagttcgaggaggatgttgaggaggaaaccgagaggtggggaaaaccccacgtcgctagccttagcttcagatctctcctggagctgagacggacgctggcacatggggctgtgctgctggatctggaccagcagactctcccaggtgtcgcgcatcaggtggtggagcaaatggtgatctccgatcaaattaaggccgaagaccgtgcaaacgtgctgagggctctgcttttgaaacattcccacccgtctgacgaaaaggactttagtttccctcgaaacatcagcgcaggttctctggggtccctgcttggccatcaccacgggcaaggcgcagagagcgacccccatgtcaccgaacctctcatggggggtgtacccgaaacccggctggaagtggagcgtgagcgggaactccctcccccagcccctcccgctggcatcaccaggagtaagagtaagcacgagcttaagcttcttgagaaaatccctgagaatgcggaggctaccgtcgtgctcgtcggctgtgtggagttcctgtcccggccaacaatggccttcgtgaggctgcgggaggccgttgagttggatgcggtgctggaagttcctgtgcccgtcaggttcctgttcctgctgctcggaccctccagcgcgaatatggattaccacgaaattgggagatccatctcaacccttatgtctgacaagcagttccacgaggctgcttaccttgctgatgaaagggaggaccttctcactgcgattaacgcatttctcgattgctctgtggtgctccccccttctgaggtgcagggcgaagagttacttcggtcggtagctcacttccaaagacagatgttgaaaaagcgcgaggagcagggccgactgctgcctactggcgctgggttagaaccaaagagtgcacaagacaaggccctactccaaatggttgaggctgcgggtgcggctgaggatgacccacttcgcaggactggcagaccattcggtggcctaatccgcgatgtccgtcggagatatccacactacctgtccgattttcgcgacgctctggatccccaatgtttggctgctgtaatctttatctactttgccgcactgagtccagctattacttttgggggattattaggtgagaagacgcaagacctgattggcgtgtctgagctgattatgagcacagccctccagggcgtggtcttctgccttctgggagcccagcctttactcgtcatcggattcagcggcccattgctggtttttgaagaggccttttttagcttttgctccagcaatcatctggaatatctggttgggagagtgtggatcggcttttggctggtgttcctggcccttctgatggtggcacttgagggatccttcttagtacggttcgtcagccggttcacccaagagatatttgctttcctgatctcccttatcttcatttacgagacgttctacaaattagtaaagatattccaagagcatccactgcacggatgctccgcaagcaactcgtcagaagtggatggaggcgagaacatgacctgggccggtgccagacctactctggggcctggcaatagaagcttggcaggccagtctggccaagggaaaccacggggacagcctaatactgctctgctttctctggtgcttatggccggaactttcttcatagcattttttctaaggaagttcaagaattcaaggttctttccagggagaatccgcagagtcatcggggacttcggcgtgcctatagccatccttataatggtactcgtggattattcaatcgaagatacctatacacaaaagctctccgtacccagtggcttttccgtaaccgcccctgaaaagcgcggatgggtgatcaatcctcttggcgagaaaagtccgttccccgtgtggatgatggtggctagcttacttcccgctattctggtgtttatactgatttttatggagacacaaattaccaccttgattatcagcaaaaaggaacgcatgctgcagaaaggctccggctttcatttggacctgctcctgatcgtcgcaatggggggtatctgtgccctcttcggattaccgtggttggccgcagccaccgtgagatccgtgacccacgcaaatgctctgactgtgatgagcaaggccgtcgctcctggtgacaaaccgaaaatccaagaagtaaaggaacagcgcgtaactggcttgttggtcgctctgctggtaggactgagtatcgtgatcggcgatctgcttaggcaaataccactagccgttctctttggcatctttctctatatgggggtgacatcacttaacggaatccagttctatgagaggttgcatttactacttatgccccctaaacatcatcccgatgtgacctacgtcaaaaaggtccgcacgcttcggatgcatttgttcacggccctccagcttctatgtcttgctctcttgtgggccgtaatgtctaccgcagcttctcttgcatttccctttatcttgatcttaaccgtaccactcagaatggtggtacttactcgcatctttaccgacagggagatgaagtgcctcgacgcaaatgaggccgagccagtgtttgatgagcgggagggggtggatgagtacaacgagatgccgatgccagtctag

SEQ ID NO: 241582 - DNA, 2406 bp, Artificial Sequence
  Description of Artificial Sequence: Synthetic coding sequence
gtaatggaggtggtggaagcagagaaaatcgtcctgctaaccagcgctagatttcttttcctgttgctcgggccagccggtaaagcgcctcagtatcatgagatcggcagatccattgctaccttgatgactgacgagatctttcacgatgtcgcctacaaggctaaggaccgcaatgatttgctgtctggtattgacgaatttctcgaccaggttacagtgctgccacccggagagtgggacccatcaattcgaatcgaaccacctaagagtgtccctagtcaggaaaagcgcaagatccctgtgttccataatggaagcacacctacactgggagagactcctaaggaagccgcacaccacgcgggacccgaattgcagagaaccgggagactattcggcggactgatccttgacatcaagcgtaaagcgccatttttcttatctgacttcaaagacgctctttccctgcagtgcctagccagtatattgttcctgtattgtgcctgcatgtctccagtcattacatttggaggcctcctgggggaggcaacagagggcaggatttccgccattgagagtctgtttggcgcaagcctcaccggaatcgcgtacagcctcttcgccggacagcctctgactattcttggctctaccggaccagttctggttttcgagaagattctctataagttctgccgggattatcagctgtcatatctttcactgagaacaagtattgggctttggacctcctttctgtgcattgtcctcgttgcaaccgacgcctctagcttagtgtgttatataacccggtttacggaggaggcttttgccgctctaatatgtatcatctttatctatgaggcactggagaagttattcgatctgggagagacctacgctttcaatatgcacaacaacctggataagctcacctcgtactcttgcgtttgcaccgaaccaccaaatcccagcaatgaaacccttgcccagtggaagaaggacaacatcaccgcccacaatatctcatggagaaatcttaccgtttcggaatgtaagaagctgcgaggcgtattcctgggcagtgcctgcgggcaccacgggccttacattcccgacgtactgttttggtgcgtaatcctgttcttcactacattcttcttatcctcgtttcttaagcaattcaagacaaagcggtacttccccacgaaggtgagaagcaccatcagcgattttgccgtgttccttaccattgtcatcatggtaacaattgattatttggtaggagttcccagtcccaaacttcatgtgcccgagaagttcgagccaacacatcccgaaagagggtggatcatttcgccgttaggagataatccttggtggacccttctcatcgccgcaattccagccctgctgtgtacaatactgatcttcatggaccaacaaatcactgcggtaattattaaccgaaaggagcataaattgaagaaaggcgcaggttaccaccttgatctactgatggtgggggtgatgctcggtgtgtgcagcgtgatgggactcccatggtttgtggccgctacagtgctgtcaatcagtcacgtcaatagtcttaaggttgagtcggaatgctccgctcccggtgagcagcccaagtttcttgggattagggagcagagggtcacaggattgatgattttcatactgatggggctgtcagtcttcatgacctcggtgctgaaattcattcccatgcccgttctgtacggcgtctttctgtatatgggagtcagcagtctgaaggggatccagctgttcgaccggataaaactgtttgggatgccggctaagcaccagcctgacttaatctatcttcgctacgttcccttgtggaaagtgcatatcttcacagtcattcagctcacgtgcttagtactactttgggtaatcaaggttagcgcggctgcagtggttttccctatgatggtactggcgctggtgttcgttcgaaagctaatggacctttgttttaccaaacgagagctgtcctggctggatgacctaatgccagagtctaaaaaaaagaaggaggatgacaagaagaaaaaggagaaagaagaggccgaacgaatgcttcaggacgacgatgataccgtacacctgccattcgaaggtgggtcgctgttgcagatccccgtaaaggctctgaagtattcagttgatccctccatcgttaacatcagtgatgaaatggccaaaactgcacagtggaaggccttaagtatgaatactgaaaacgcaaaagttactagaagtaacatgtctcccgataagcctgtaagtgtgaaaatttcttttgaggatgaaccaagaaagaaatatgtggacgccgagacctcattatag

SEQ ID NO: 241583 - DNA, 2244 bp, Artificial Sequence
  Description of Artificial Sequence: Synthetic coding sequence
atgccactcggcaggcagagccatagacatcaccgcactcacggccagaaacaccgtcgcagaggccgtggaaaaggcgctagccagggcgaagagggccttgaagctttagcgcacgacacgccaagccagcgagtccaattcatcctgggtaccgaggaagacgaagagcatgtgccccacgagctatttacagaactggatgagatctgcatgaaggagggtgaggatgccgagtggaaagaaacagccaggtggttaaaatttgaagaagacgtggaggatgggggtgaacgttggtccaagccttacgtcgccacattatccctgcactctctgttcgaactaaggagctgcctcatcaacgggaccgtgctgctagacatgcatgctaattccatagaagagatctcggatctgatcctggaccagcaggaattgtcctctgacctcaacgactctatgagagtaaaggtgcgagaggcgctgctcaagaagcatcaccatcaaaacgaaaagaaaagaaataacctgatacctattgtccgcagcttcgccgaggtggggaagaaacagtccgatccgcaccttatggataagcacggccagactgtgtccccacaatcagttcctacaaccaatttagaagtgaaaaacggtgtaaactgcgaacatagtccagttgacctatccaaagtcgatctgcatttcatgaaaaaaattccaactggcgctgaagcctccaacgtcttagtgggcgaagtggatattttagaccggccaatcgtggcctttgtgcgcctgtccccagccgtgctgctctccggcctcaccgaggtcccaatcccgacccgttttcttttcattctactgggcccagtcgggaaggggcagcagtatcatgaaattggaaggtcaatggcgaccattatgaccgacgaaatattccacgacgtcgcatacaaggcaaaggagagagacgacctgctggcgggaatcgacgagttcctggaccaggtgaccgtgctgccgcctggtgagtgggatccatctatccgcattgaaccaccgaaaaatgtaccatcacaagaaaagagaaagatgcctggagtacccaatggaaacgtgtgtcacatcgagcaggagccacacggtggtcattccggcccagagctccaacgtactgggaggctgttcgggggactagtcctggatatcaagagaaaggccccatggtattggagcgactatcgcgacgccctcagtctgcagtgcctggcatccttcctgtttctctactgtgcctgcatgagtccagtgatcacatttggcggattgttaggagaggcaactgaaggaaggattagtgcaatcgaaagcctctttggagcatccatgacggggattgcctacagtctttttgcaggccaggcattaacaatcctcggttctacagggcctgtgctggtgttcgagaagatcttgtttaagttctgtaaagattatgcactctcatacttatcactgagggcttgcatcggactttggacggctttcctttgcattgtgttggtggccacagacgcgagctctttggtttgctacatcactcgttttacagaagaagcattcgcttcccttatttgcatcatcttcatctatgaggccatagagaaattaatccacctagccgaaacttatccgatccatatgcactcccaactggaccacctgtccctttactactgtcgctgtacactgccagagaacccaaataatcataccctgcagtattggaaagatcacaatatcgtgacggctgaggtgcattgggccaacctgaccgttagtgagtgtcaggagatgcacggtgaatttatggggagtgcctgcggtcaccacggcccttacacccccgatgtactgttttggtcctgcatcctcttcttcacaacattcatactctccagcactctcaaaacgtttaagacaagcaggtactttccaacccggatggagagctgctcggtggcctggcttgagtgcggcggagtgattttggcccattgtaacctgcggctgctccctagttcttgggactatcgccacgcgcctccacagccggcaaacttctgtattttttccagggatggagtgtctccctgctggcctggctggtcccagagtcttgatttggtgatatgcttgccacgcccaccaaagatgctagggctacaagcgtag

SEQ ID NO: 241584 - DNA, 3135 bp, Artificial Sequence
  Description of Artificial Sequence: Synthetic coding sequence
atgcctgccgctggcagcaacgagcccgacggcgttctgtcttatcagcgtccagatgaggaagccgttgtagaccagggaggaacatcaactattttaaacattcattacgagaaagaagagctagaagggcatcggacactgtatgtcggggtgcggatgcctctgggacgtcagagccatcggcaccataggactcatgggcaaaagcatcgaaggcgaggcagaggcaaaggggctagccagggcgaggagggcctggaagccctagcccacgacaccccctcacagagagtgcagtttattctgggtaccgaagaggacgaggaacacgtaccacacgaattgttcactgaactggatgagatatgtatgaaagagggagaagacgctgaatggaaggagacggcacgctggctgaagttcgaagaggatgttgaggatggcggagaacgttggtcgaagccatacgtggcgaccttgtccctccacagtttgttcgaactgagaagctgcctaatcaacggcacagttcttctggatatgcacgctaatagcattgaagagatttctgatcttatcctcgatcagcaggagctctctagcgacttaaacgactccatgcgggttaaggtgagggaggcactactcaagaagcatcatcaccagaacgagaagaagaggaacaatctaatcccaattgtaaggagtttcgctgaagtgggtaagaaacagtctgatccacacctgatggacaagcacggccagacagtctcaccccagagcgtgcccaccacgaatctagaagtaaagaatggcgtgaactgcgagcactcccctgtggacctgagcaaggttgatttgcacttcatgaaaaaaatcccgaccggtgccgaagcatccaacgtgctggttggtgaggttgatatccttgatcggcctatcgtggcattcgtgcgtttaagccctgcagtgctactcagtgggctgacagaagtaccaattcccactcgattcctgttcatattactaggaccggtgggcaaagggcagcagtaccacgaaatcggaagatcgatggccacaataatgaccgacgagatctttcacgacgtcgcttacaaagctaaagagagagacgatttgctcgctggaatcgacgagttcctggaccaagtcactgtgttacctcccggtgagtgggatccgagcatccgcattgaacccccaaagaacgttccttcccaggagaagcgcaaaatgcctggcgtccccaatggaaatgtctgccatatcgaacaggagccacacggcggacacagtggcccagagctgcagagaaccggcagactgtttggcggactggtgctggacatcaagcgaaaagcaccatggtactggtccgactatagggatgcactaagtctccagtgccttgcgagcttcctcttcctttattgtgcatgcatgtcacctgttatcacattcggcggactgcttggcgaagccacggaaggacgtataagtgcaatcgagtcacttttcggcgcatcgatgaccgggatcgcgtatagtttgttcgccggtcaggctctgacaattctcgggagtaccggacctgtcctggtattcgaaaagatcctcttcaagttttgcaaggattatgccctgagctatctgagcttacgcgcatgtatcggtctgtggactgccttcctgtgcatagtcctggtggccactgatgcaagttcgctggtctgctatattactagatttacagaggaagcgtttgccagcctgatttgtatcattttcatttacgaggctatcgaaaaactgatacatcttgccgagacttatccaatccacatgcactcacagctggaccatctgagcctctactattgtcgttgcaccctgcccgagaacccaaacaatcacactcttcagtactggaaggaccacaacattgtgactgccgaagttcactgggccaacctgaccgtgagcgagtgtcaggagatgcatggagagttcatgggaagcgcatgcggtcatcatggaccttataccccggatgtgctgttttggtcctgcatacttttctttaccaccttcattctatcctccactctgaaaaccttcaagaccagcagatattttcctaccagggtacgcagtatggtttccgatttcgcagtcttccttactatctttaccatggtcataattgacttcttaatcggcgtgccttctccgaagcttcaggtgccaagcgtgttcaagcccacaagggatgatcggggatggattattaatcctatcggtcccaacccctggtggaccgttattgcggctatcatacctgccctgctgtgcaccatcttaatctttatggaccagcagataaccgcagtgatcatcaaccgcaaggaacacaaactgaaaaaagggtgtgggtatcatttggacctgctgatggtcgcgataatgttgggagtgtgctcaattatgggcttaccctggttcgtggccgctactgttctgagtattactcatgttaactcgctgaaactggaatcagaatgcagtgcaccaggcgaacagccaaagttccttggcatacgggagcagagagtgactggtcttatgatctttgtcctcatggggtgtagtgtcttcatgacagcaatcctgaagttcattcctatgcccgtgttatatggagtcttcttatacatgggggtgtcctcactccaggggatccagttcttcgaccggctgaagctctttggaatgcctgccaaacatcaacccgatttcatttatctccggcatgtacctctccgcaaagtccatttgttcacccttattcagctgacctgcctggtcctgctctgggttatcaaagccagtcctgcggctattgtgtttccaatgatggtactggcactggtgtttgttaggaaggtaatggacctgtgtttctccaagcgggaactcagctggctcgacgacctaatgccagagtccaagaaaaagaagttagacgacgcgaagaaaaaggccaaagaggaggaagtcatcgttctcgcacccaccgtttacctcggcgcttcaaactacaggacctag

SEQ ID NO: 241585 - DNA, 2736 bp, Artificial Sequence
  Description of Artificial Sequence: Synthetic coding sequence
atggaggagctgcaggatgactatgaggatatgatggaggagaacctggaacaggaggagtacgaggaccctgacatcccagaatctcagatggaggaacccgcagctcacgatacagaggctacagccacagactatcatacaacctctcacccgggaacgcataaggtgtacgtggagctacaggaactcgtgatggacgaaaagaatcaggagttgcggtggatggaagctgctcgctgggtccaactggaagagaacttgggagaaaatggggcttgggggaggcctcacctcagccacctgactttttggagtctgttggagctgcgccgagtgtttaccaaagggaccgttctgctggaccttcaggagacatcactggctggagtggccaatcagttgttggaccggtttatctttgaagatcagatcagacctcaggatagagaggagttgctccgtgctttgcttctgaagcattcccatgccggagaactagaggcccttgggggagtcaaacccgctgtcctgaccaggtccggcgatccatcacaaccgttgctgccccagcactcaagcttggagacccagctcttctgtgagcagggcgatggaggcacggagggtcactccccaagcgggatcttagagaaaattcccccagactcagaggcaaccctggtgttggttgggagggccgattttctggaacagccagtcctgggattcgtccggttacaggaagctgctgaactcgaggcagtggagctgccagtgcctataaggttcctctttgtgcttctcggaccggaagctccacacatcgactacacccaacttggaagggcagccgctacactgatgagcgaacgcgtgtttcggattgacgcctatatggcgcagtctagaggtgagttgttgcattccctcgagggattcctcgattgcagtttagtgctgcctcctactgatgcgccaagcgaacaggccctattaagtttggtgcctgttcagagggaactcctccgcaggagataccaaagcagtcctgccaaaccagattcttccttctacaagggcctggatttgaatggtgggccagatgacccccttcaacagactggccagttgttcgggggattagttcgagatatcagaagaagatatccctattatctctcagacatcaccgatgcgttctccccgcaggtcttggcagctgtcatttttatttatttcgctgccttgtctccagccatcaccttcggagggttgttgggggagaagacacgaaaccagatgggcgtctccgaattgctgatcagcaccgccgtgcagggaatcctgttcgcgctgctcggcgctcagccactactggtagttggcttcagcggtcctcttttggtgtttgaagaagcattcttctccttctgcgagaccaacggcctagaatatatcgtgggcagagtgtggatcgggttttggctgattctgctcgtagtgctcgtcgtggcgtttgaggggagtttcctggtacggttcatctcccgatatacccaggagattttctcttttcttataagcctgatcttcatctacgagaccttctccaaactgatcaagatcttccaggatcatcctcttcagaaaacctacaactacaatgtgttaatggtgccgaaacctcaggggcctctgccaaatacagcacttctgtccctggtgctaatggccggtacctttttctttgctatgatgcttcgaaaatttaagaatagtagctattttcccggaaagctaagaagagtgatcggtgacttcggagtccctatctctattttgatcatggtactcgtcgacttttttattcaggacacctacacacaaaaactttctgtgcctgacgggttcaaagttagcaactcttccgccaggggatgggtgatccatccactgggcctgagatcggagttccccatttggatgatgttcgctagcgctctcccggcactgctggtgtttatcctgatcttcctggagagccagatcaccacgctgatcgtttctaagccagagcggaagatggtaaaaggctctgggttccatttagacctcctcctcgtggttgggatgggcggtgtggcagccctgttcgggatgccctggctgagcgccactacagtacggagtgtcacgcatgcgaatgctttaactgtaatggggaaggcgagcacccctggagccgctgcccagatccaggaagttaaggagcagcgcatttccggattgctggtggccgtcctggtggggctcagcatcctgatggagcccatcctgtctcggatccccctcgcagtgctgtttggaatctttctgtacatgggcgttacatccctgtccggcatccagttattcgatcgcattctcctgttatttaaacccccaaagtatcaccctgatgtgccttatgtgaaaagggtaaagacctggagaatgcaccttttcacaggcatacagataatttgtctggctgtactatgggtagtcaaaagtacccctgcctcattggcgctgccctttgtattaatcttgactgttcctctgcggagggtgttactcccccttatctttaggaatgtggagctgcagtgccttgatgccgacgacgcaaaggccaccttcgatgaggaggagggcagagacgaatacgacgaggttgccatgcccgtgtag

SEQ ID NO: 241586 - DNA, 3480 bp, Artificial Sequence
  Description of Artificial Sequence: Synthetic coding sequence
atgtcctcagctccacgtcggcctgccaagggtgctgattcattctgcactcctggcccaggccgaaagcccagaagacgcccaggggcatcgcccaccggtgaaacacctactatagaagaaggcgaggaggatgaagacgaggcatccgaggccgagggggctcgagctctgacgcaaccatcccctgtctcgacaccatcaagtgtccagttttttctgcaagaggacgactctgccgatcggaaagcagagagaacttctcctagcagtcctgctcccctcccacaccaggaggctacccccagggccagcaagggcgctcaggctggcactcaggtggaggaagccgaagctgaagccgttgccgtggccagcgggacagccggaggcgacgatggtggagcttcaggccgtccgcttcccaaagcgcaacctggccataggagctataaccttcaggagcgtcgtagaatcggttctatgacgggtgctgaacaggctttacttccccgagttcctaccgacgaaatcgaggcccagactcttgccactgcagacttagaccttatgaagtcacaccgttttgaagacgtgccaggtgttcgcagacatctcgttaggaaaaatgccaagggatctacacagagtgggcgtgaaggacgagaacccggaccaacgccccgagctcgcccaagggcaccacataaaccacacgaagtgttcgtggaacttaacgaactgctactggataaaaatcaggagcctcagtggagagagacagctcggtggattaagttcgaagaagatgtggaagaggaaacagagaggtgggggaaaccgcacgtggcctccctatcgttccgctcattactggagcttaggcggacgctcgcccatggggctgtcctcttagacctggatcagcagactctccctggcgtggctcatcaggtggtggaacagatggttatatcagatcagatcaaggctgaagatcgggctaacgtgcttcgcgctctgctacttaagcattctcacccttccgatgagaaggacttttccttcccgagaaacatttctgcaggctcacttggcagcctgcttggccaccatcacggccagggcgctgagtccgatcctcacgtgactgagcctctgatggggggtgttcccgagacccggctggaggtagagcgagagcgagagctcccaccgcctgcccctccagctggtattactcgcagtaagagcaaacatgagctgaaactactggagaaaattcctgagaatgccgaagcaactgtagtgctggtgggctgcgttgagttcctatcccgcccaaccatggcattcgtgaggctccgggaagcggtcgagttggacgccgtactcgaggttcccgttcctgtgcggttcctgttcctgctgctggggccttctagcgctaatatggattatcatgagattggtcgatctatcagtactttgatgtcagacaagcagttccacgaagctgcctatctcgcagacgaacgtgaagatctgttgactgccatcaatgcatttctagactgttccgtggttttgccccctagcgaggttcagggcgaggagctcctgcggtctgtcgcccactttcagcgacagatgctaaagaaacgcgaagaacagggacgccttctcccaaccggcgctggtttggaacctaagtccgcccaagataaagcactcctgcagatggtagaagcggctggagctgcagaagacgatcctctaagaagaaccgggcgacctttcgggggtctgatcagggatgtgagacggcgatacccacactatctgtcagactttagagatgcccttgatccacagtgcctagctgccgttattttcatctattttgccgcactgtcgcccgctatcaccttcggcggtttgttgggggagaagacccaggatctcataggcgtgagtgagttgatcatgtctaccgccctgcaaggagttgtgttctgccttctgggcgcacagcccctgctggtgatcggattctctgggcctctactcgtgtttgaggaggcatttttctcattctgtagtagcaatcatcttgaataccttgtgggacgtgtctggatcgggttctggcttgtgtttctggccctccttatggtcgctctggaaggcagcttcctcgtccgcttcgttagccggtttactcaggaaatcttcgcatttctgatcagtttaatttttatttatgagacattttacaaacttgtgaagatctttcaggaacaccctttgcatggctgttctgcctccaattcttcagaggtcgacggaggagaaaatatgacttgggcaggagcacggcctaccctaggtcctggcaacaggagcctcgcagggcaaagcggccagggcaagcctagaggccagcctaatacagctctattgtccctggtccttatggccggaacctttttcatcgccttttttttgcgcaagttcaagaactccaggttctttccaggcagaatacgaagagtgattggcgactttggggtacctatcgcaatcctgattatggtgctcgtggattatagcatagaggatacgtatacacagaaactgtcagtcccaagcggcttctccgtgacagcacctgagaaacgtgggtgggtcattaaccccttgggagagaagagtcccttccccgtatggatgatggtggcctccctccttcccgcaatcttggtgttcatccttatctttatggagacacagatcaccactcttataatctcaaaaaaggaacgcatgctgcaaaaagggtctgggtttcacctcgacctattgttgattgtcgctatgggcggtatttgcgctctgtttggactcccctggttggcggcagcgactgtcaggtcagtcacacacgccaatgccttgacagtgatgagcaaagccgttgcccctggagataagccgaagattcaagaggtgaaggagcagcgggtgaccgggttgttggtggcattgctggtcggattgtccatcgtgatcggcgacttactgagacaaattccactggccgtcttatttggtatcttcttatacatgggtgtgacaagcctaaatggaatacaattttacgagcgcctacaccttcttctgatgcccccaaagcatcatcccgatgtcacatacgttaagaaagtgagaacccttcggatgcacctcttcaccgccctgcagctgctttgcttggctctgctatgggccgtgatgtctaccgcagctagcctggcttttcctttcattctgatcctcaccgtacccctgcgcatggtagtcctgacgcgaatattcaccgaccgtgagatgaaatgcctggatgctaacgaggcagagcccgtcttcgatgaaagagagggggtggatgagtataatgaaatgcctatgcctgtgtag

SEQ ID NO: 241587 - DNA, 3726 bp, Artificial Sequence
  Description of Artificial Sequence: Synthetic coding sequence
atgtcttctgcgcctcgcagacccgcaaaaggcgcagatagcttttgtacgcccgagcctgagtccttggggcctggcacaccaggtttccctgagcaggaagaggacgagctccacagaacacttggtgttgaacgatttgaggaaatactgcaggaggccggttcacgtggtggggaggagcctgggaggtcctacggagaggaagactttgaataccaccggcagagttcccaccacatccatcacccattgtcgactcacctcccaccagacgccaggagaagaaagactccacagggcccaggcagaaagccacgaagaagacctggcgctagtcctacaggtgagacgcccacaatcgaggaaggggaggaagacgaagacgaggctagcgaggctgaaggagcccgagccctgactcaaccaagtccagtcagcactcccagttccgtgcagttcttcttacaggaagacgactccgccgataggaaagcagaacgcactagtccaagctcccctgccccactccctcaccaggaggctacacctagggcttcaaaaggagcacaggccggtacccaggtggaagaggcggaagcggaagcagttgcagtggccagcggaaccgccggaggcgatgacgggggtgcctcgggacgaccccttcccaaagcccaaccaggccataggagctataacctgcaagagcggagacgtattggaagcatgacaggggctgaacaagccctgctgccgagagtccctacagatgaaattgaagcacagactttggccacagccgacctggacctgatgaaaagtcaccgtttcgaagatgtccctggagtgaggcggcaccttgtgaggaagaatgccaaagggtccacacagagcggaagagaggggcgagagcctggacccactcctcgtgctcggccaagggctccacataaacctcacgaagtcttcgtagagctgaacgaactgttgttggataaaaaccaggaaccccaatggcgtgagactgcacggtggatcaagtttgaagaggacgtggaagaggagacagagaggtggggaaagccgcacgtagccagtctttcattcaggagtctgcttgaactacgcagaacattagctcatggcgctgtgttgctagatctggaccaacagactctcccaggtgtggcccaccaggtggtggagcagatggtgatttctgatcagataaaagccgaagatcgggcaaatgtccttagagcactgcttctgaaacatagtcacccaagtgacgagaaggacttttcctttccgaggaacatctctgcgggatccttaggttctctgctggggcaccatcatggccaaggcgcagaatctgatccacacgtcaccgaacccctcatgggaggagtacctgaaacccggcttgaggtcgagagagagcgcgaactgccgcctccagcccctcccgctggtatcacaaggtccaagtccaagcacgaactgaagttactcgaaaaaatcccagagaacgctgaggcaaccgtagtgctggttggctgcgtggaattcctaagtagaccgaccatggcattcgtgcgtcttagagaggcagtggagctggatgctgtgctcgaagtgcctgtgcccgtgcggttcctgttcctcctactgggaccatccagcgctaatatggactaccacgaaatcggaagatctattagcactctgatgtctgacaaacagtttcacgaggcggcatatctggccgatgagcgcgaggatttgctcaccgctataaacgctttcttggactgcagcgtggttcttcctccatcagaggtccagggcgaagaattgttgaggagcgtcgcccattttcagcgccaaatgctgaaaaaaagagaggaacaggggaggctgctgcccaccggagccggtctggagcccaaatctgcgcaggacaaagcactgctgcaaatggtggaagcagccggagccgctgaagacgacccgctgcgacggactggacggcctttcggaggtctgatccgggacgtgcggagacggtacccccactatctgagcgactttagggacgcacttgacccacagtgtttagcagccgtcatctttatctacttcgccgcacttagcccagccattacattcggcggtctgctgggagagaagacccaggacctaatcggcgtgagcgagctaattatgtctacggccctccaaggcgtcgtattctgcctcttgggagcacagccactattggttattgggttttccggccctctgctggtcttcgaggaggcattctttagtttttgctctagcaaccacctggaatatctggtgggtcgggtgtggattggattctggttagtgttcctagctcttctgatggtagctctcgagggatcttttctagtacgttttgttagtcgcttcacccaggagatttttgccttcctgatctcactgatatttatctacgagacattctacaaattggtgaagatttttcaagagcaccccctgcacggctgcagtgcctccaactcctctgaggtcgatggaggggagaacatgacctgggcgggagctcggccaacgctgggaccgggtaatcgatccctagcagggcagtccgggcagggaaaacctagagggcaaccgaacacagctctgctgagcctagtgctgatggcgggtacattctttattgcttttttcctgcgtaagtttaagaatagccgcttctttcctgggcgtatccgccgtgtcattggggacttcggagtgcctattgccatcctcattatggtcctggttgattattccatcgaggacacctatacacagaagctgagcgtacccagtggcttcagtgtgactgcccctgaaaagagggggtgggtcataaatccactcggcgagaaatcccccttcccggtctggatgatggtggcctcattgctccccgcaatcctggtattcatactgattttcatggagactcagattaccacccttattatctcaaagaaggagcgtatgctgcaaaagggcagtgggttccacctggacctgctgttgatcgtcgccatggggggaatctgcgctcttttcggccttccctggctggctgctgccaccgtgcgatctgtgacccatgcaaacgccctcaccgtgatgagcaaggccgtcgcacctggcgataagccaaagatccaggaagtgaaggagcaacgggtgacaggcctcctggttgctctcctagtgggactctccatagtgatcggcgaccttctgcgccagatccccctggctgtattatttggtatcttcttgtacatgggggtgacctccctgaacggcattcaattctatgaacgtctccatctgttattgatgcctcctaagcaccaccctgacgtcacgtacgttaagaaggtgcggactttaagaatgcacctttttacagccctgcagctgttgtgcctcgcattattgtgggctgttatgtcgactgcagcaagcctggccttccccttcatcttgatactaaccgttcctctgcggatggtagtgttgacacggatttttaccgatagagaaatgaagtgcctagatgccaacgaggctgagcctgtgttcgacgaaagggaaggcgtcgatgaatataacgagatgcccatgcccgtgtag

SEQ ID NO: 241588 - DNA, 456 bp, Artificial Sequence
  Description of Artificial Sequence: Synthetic coding sequence
atgtctagtgcgcctagaaggccagctaagggtgccgattctttttgtacacccgaacctgaaagcctgggcccaggaaccccaggctttccagagcaggaggaggatgagcttcatcgcactctgggcgtggaacggttcgaagagatcttgcaggaggccggatcacggggaggtgaagagccaggtcgctcttacggagaggaggacttcgagtaccatcggcagtcaagccaccacatccatcaccccctgagtacccatttgcctccagacgccagaaggaggaaaactccgcaagggccagggaggaaaccacggaggcgaccaggggctagtcccacaggcgaaacacccaccatcgaagagggagaggaggatgaggacgaggcttccgaggccgagggcgctagggccctaacacagccctctccggtaagcacccctagcagctag

SEQ ID NO: 241589 - DNA, 384 bp, Artificial Sequence
  Description of Artificial Sequence: Synthetic coding sequence
atgagctccgccccacggcgaccagctaagggtgctgattcgttctgtacccccgagccagaaagcctgggtcccggaacgccagggtttcccgagcaggaggaagatgaactccaccgaactctgggcgtggagaggtttgaggaaattttgcaggaagccggatctcgtgggggagaggaacctggaaggtcctatggggaggaagacttcgaatatcatagacagtcaagccaccatattcaccacccactttcaacccacctgcctcccgacgcgagacggaggaagactccccaagggccaggacgcaaaccaagaaggagacctggagctagtcccacaggggagacgcctaccattgaggagggagaggaggactag

SEQ ID NO: 241590 - DNA, 438 bp, Artificial Sequence
  Description of Artificial Sequence: Synthetic coding sequence
atgtctagtgcaccacgtaggcccgcaaagggcgcagatagcttttgcaccccagaacccgaatccttggggcctggaacaccaggcttccctgagcaggaggaggatgaactacacagaacgctgggtgtggaacggttcgaggagatattgcaagaagcaggctcccgcggaggcgaagaacccggtagaagctatggagaagaggactttgagtatcatagacagtcatctcaccatattcaccatccactgtcgacccacctgccacccgatgccaggaggaggaaaacacctcagggccctgggagaaagccacgcagaagaccaggcgcatctcccacaggtgaaacaccgaccattgaggagggcgaggaggatgaggacgaagccagcgaagctgaaggcgctcgggctcttacccagccaagtccatag

SEQ ID NO: 241591 - DNA, 3726 bp, Artificial Sequence
  Description of Artificial Sequence: Synthetic coding sequence
atgagcagcgctcctaggcgcccagccaaaggggcagacagcttttgcactccagagcctgaaagtctggggcctggcactcccggttttccagagcaagaggaggacgagctgcatagaacacttggagttgagcgattcgaagaaattctccaggaagccggttccagaggtggggaagagccagggaggagctatggcgaagaggactttgagtatcaccgtcaatcctcacaccacatccatcaccccctctccactcatttgccccctgatgcacgacgccgtaaaacccctcaagggcctggccgtaagcctagacgcaggccaggggcatctccaaccggcgaaacccccactatcgaggagggcgaagaggacgaggatgaggcgagtgaggccgagggcgcacgtgccctgacacagccgtccccggtatctaccccctctagcgtgcagttcttcttgcaagaggatgactcagcggatcgaaaagccgaacgtacctcccccagctcccccgcaccacttcctcaccaggaggctacgccacgggcttcaaagggggcacaagccggaacccaagtggaggaagctgaggccgaagccgttgcagttgcctcgggcactgcaggtggcgacgacggaggggctagcgggagaccactgcctaaagcacaacccggtcacaggtcctataatctgcaggaacggcgacgcataggcagcatgactggcgctgagcaggcccttctgccccgagtgccaacagatgagatagaagcgcaaacccttgcaacagccgacctggacctaatgaaatcccatagattcgaggacgtgcctggagtgagacggcatctcgtccgaaaaaacgccaaggggagcacccagtcagggagggaaggccgagaaccaggccctacccctcgggctcgccctagggcccctcacaagccacacgaggtctttgtggagttaaatgagctgctgctcgataagaatcaggagcctcagtggagggagaccgctcgctggatcaagtttgaggaggacgtggaagaggaaaccgaacgttgggggaagcctcatgtggcatcactatcatttcgcagcttgttggagctgcggaggaccctggcacacggtgcagtgctgttggacctcgaccagcagacgcttcctggagttgctcatcaggtcgtagaacaaatggtcatttcagaccaaatcaaggcagaggatcgcgctaacgtgctccgagccctactgcttaaacattctcacccatctgacgagaaggacttctctttccccaggaatatcagcgcaggctcgctcggcagcttgctggggcatcaccacgggcagggagctgagtccgacccccatgtgacggagcctttgatgggcggagtacccgaaaccagactggaggtcgaaagggagcgcgagctgccgccacctgcccctcccgcaggtattactcggtcgaaatcaaaacacgagctgaaactgctggagaagatccctgagaatgcagaagccacggtggtcctcgtcgggtgcgttgaatttttgagccgacccaccatggcctttgttcgcttgcgagaagccgtcgagctcgatgcggtgttggaagttcccgttccagtccggttcctgttcctcctgctggggcctagttcagctaatatggactatcacgaaataggacgaagcatctctaccctcatgagcgataagcagtttcatgaagccgcttacttggccgatgagcgggaagatctcttgaccgccatcaatgcattcctggactgctccgtcgttttacccccatccgaggtgcaaggcgaggagctgcttagatcagtggcgcatttccaaagacagatgttaaaaaagagagaagagcagggtcgtttgctccccacaggcgctggtcttgaacctaagtctgcccaggacaaagctctgctgcagatggtggaggctgctggagcagctgaggacgatccacttagacggactggacgaccattcggcggactgattcgcgacgtgcgaaggcgctatccgcattacctgtctgattttcgggacgctttggacccccagtgtcttgccgcagtcatcttcatttactttgcagccttatcaccggcaattacattcggcggactgttaggggaaaagacacaggacctgattggtgtcagtgaattgattatgagtacggccctccagggcgtggtcttctgcctgctgggcgcacaacctctgcttgttatcggcttctctgggccacttctggtattcgaggaggcttttttctccttttgcagttctaaccacctcgagtacctggtcgggcgtgtttggatcggtttctggctcgtgttcctagctctgttgatggtcgccttggaaggcagttttctggttcggttcgtcagtagatttacacaagagatttttgctttccttatctcactgatttttatttacgagaccttttacaaattggtgaagatattccaggaacatccccttcacggctgcagtgcgagcaatagtagcgaagtggatggaggagaaaatatgacatgggcaggagccagacccaccctcgggcctggcaaccgaagtctggccggacaaagcggccagggtaaaccaaggggacagcctaatacagcccttttatcgttggtcctaatggccggaaccttttttatcgctttttttctacgcaagttcaaaaacagtaggtttttcccgggacgaattagaagggtcatcggggacttcggagtcccaatcgccatcttaatcatggtgctggtggactacagtattgaagatacctatacacagaagcttagtgtgcccagcgggttctcagtgactgctccagaaaaaagaggctgggtcatcaacccgttgggtgagaagagcccttttcctgtatggatgatggttgcaagcctgctccccgcaattctggtgtttattctgatcttcatggaaacacagataaccactttaattatttccaaaaaagagcggatgcttcagaagggcagtggattccacctggacctgcttctgatagtggccatggggggtatttgcgcgctgtttgggctgccctggctggcagcagccaccgtgagaagtgtcacccatgctaacgcccttactgtgatgagtaaagcagtcgccccaggggataaacccaaaatccaggaagtaaaagagcagcgcgtaactggattgctggttgcccttctcgtgggcttgtctattgtgattggtgatctcctgcgtcagatccctcttgccgtgctattcgggatctttttgtacatgggagtaacctctttaaacggaatacaattttacgaaaggttgcatctgctcctgatgcctccaaaacatcaccccgatgtcacatacgtgaaaaaggtcagaaccctccgcatgcatctgttcacggccttacagttgctgtgcctggccctgctgtgggctgttatgtccacggctgctagcctagcgtttccattcattttgatcctgaccgtcccactgaggatggtagtactgaccaggatatttacagaccgcgagatgaagtgcctggacgccaacgaggctgagcctgttttcgacgagcgagagggcgtcgacgagtataacgagatgccaatgccagtttag

SEQ ID NO: 241592 - DNA, 213 bp, Artificial Sequence
  Description of Artificial Sequence: Synthetic coding sequence
atgtccagcgctcctcggcgacccgctaaaggcgctgacagcttttgtacgcctgaacctgagtcccttggacctggcaccccaggtttccctgagcaggaggaggatgagttgcatagaacgcttggcgtggaaagattcgaagagattctacaggaagccggttcacggggaggcgaagagcccggacggtcttacggagaggaggactag

SEQ ID NO: 241593 - DNA, 510 bp, Artificial Sequence
  Description of Artificial Sequence: Synthetic coding sequence
atgtcctccgccccacgtcgccctgcgaagggagccgactctttctgcacacccgaacctgagagcctgggacccggaacgccaggcttccccgaacaggaagaagatgagttgcacagaacacttggagttgaaaggtttgaggagattttacaggaggccggtagccggggtggggaagagccaggaaggtcttatggcgaagaggatttcgagtaccacagacagtcttcccatcacattcaccaccctttgagcacacacttgccccctgatgcaaggcggcgaaagacacctcaaggacctggacggaaacctcgtcgtaggcccggagccagccccactggagaaacgcctacaattgaggaaggggaagaagatgaagacgaggcttccgaagcagaaggtgcccgagcactgacccagccctcaccagtatctacgccctccagcgtgcagttcttccttcaggaagacgacagtgcagatcggaaggcggaacggacgtag

SEQ ID NO: 241594 - DNA, 3240 bp, Artificial Sequence
  Description of Artificial Sequence: Synthetic coding sequence
atggaagacgaggcagtgctagaccggggtgcctcttttctcaagcacgtgtgcgatgaagaggaagtggaggggcaccacacaatttatatcggagtccatgtgcccaagtcttatagacggaggaggagacataagcgcaaaactggacataaagagaaaaaggaaaaagagcggatatccgaaaactactctgacaagagtgatatcgagaatgccgacgagagcagtagtagtatcctgaaacctctcatttctccagcagccgagagaatccgctttatactgggagaggaggacgactctccagctcccccacagctgttcactgagttagacgaacttctggcggtagacgggcaggagatggagtggaaggagaccgcccgatggatcaagttcgaggaaaaagttgagcagggcggagagaggtggagtaaaccacacgtggctactctgagtctgcactcactgttcgaactacgcacctgtatggaaaaaggatccataatgcttgaccgcgaggcctccagcctcccccaactggttgaaatgatagtcgaccaccaaatcgagacaggtctgctgaagccagagttgaaggataaggtgacttatactctgctgaggaaacaccgtcaccagaccaaaaagagcaatctgcgaagcctggctgacatcgggaaaaccgttagctcagcctctaggatgtttaccaacccggataacgggagcccagcaatgactcatcgaaatctgacgtcatcttccctgaatgatatttcagataaacctgagaaggaccagctgaagaacaaatttatgaaaaagttacccagggacgctgaagcaagcaacgtcctcgtgggagaggtggactttctggatacgccgttcatagctttcgtgcgcctgcaacaggcagtgatgttaggcgctttgacggaggtgcctgttcctaccagattcctatttatcctccttggccctaaaggcaaggccaagtcctatcatgagatcggcagggcaatcgctactctgatgagcgacgaagtgtttcatgatattgcttacaaggctaaggatagacatgatttgattgccggtatagatgaattcctcgacgaggttattgtccttcctcccggagagtgggacccagccatacgaatagagccgcctaaatccctgccgtctagcgacaagagaaagaacatgtatagtggtggtgagaacgtgcaaatgaacggggacaccccccacgatggcggacatggcggaggcggacacggcgattgtgaggagcttcaaagaacaggtcgtttttgcgggggtctcattaaggatatcaaaagaaaggccccattttttgcatccgacttctacgacgcgctaaacattcaggcccttagtgccatactgttcatctatttagcgactgtaactaatgctataacgtttggcggtctgctgggcgatgctaccgataatatgcagggtgtcctcgagtcattcctgggaactgcggtcagcggcgctatattctgcctgtttgccggacaaccactcaccattctctcatctactggcccagtactggtcttcgagcgattgctgttcaacttttccaaagacaacaactttgactacctcgagttcaggctttggattggactgtggtccgcgtttttatgtctgatcctggtggccacggacgctagttttttggtgcagtatttcacaagattcacagaagaagggtttagcagtctgatatctttcatctttatctatgacgcctttaagaaaatgattaaactggcagattactaccccatcaacagtaatttcaaagtgggctacaacactctattctcttgcacttgtgtacctccagacccagccaatataagtatcagtaatgacacaactctagctcccgagtacctccccactatgtcatccaccgatatgtaccacaatacaacgtttgactgggccttcctaagcaagaaggagtgtagcaagtacggcggtaacctcgtggggaacaactgtaacttcgtgcccgacattacactgatgtctttcattctgttcctgggcacttacaccagtagcatggccctgaaaaagttcaaaacctcaccatactttcccactaccgctcggaagctcatttcagatttcgccataatcttatctattttgatattttgcgtgatagacgccctggtcggagtcgacactcccaaactcattgtcccaagcgagtttaaaccaacatctccgaatcgcggttggtttgtacctccctttggagaaaatccttggtgggtctgcctggccgcagccatcccagccctcctggttactatcctgatcttcatggatcagcaaatcacagcagtgatcgtcaaccgaaaggaacacaagcttaagaagggggcagggtaccatcttgacctcttttgggtggccatcctcatggtgatatgctccctgatggccctcccttggtatgtggccgcaactgtgattagcattgcccatatcgactctcttaaaatggaaactgagacctcagcgcctggcgagcagcccaagtttttgggcgttcgggaacagcgcgtgaccggcacactggtgttcatcctaactggtctctctgtgtttatggccccaattctgaagtttatccccatgcctgtactgtatggagtgttcttatatatgggcgtcgcatccctcaacggggttcagttcatggaccgtcttaaacttttgctcatgcctttaaagcaccagccggatttcatttatcttcgacacgtgccgctccgaagggttcatctctttacgttcctccaggtactgtgcctggctctgctgtggatcctgaaaagtaccgtggctgccatcatcttccccgtgatgattctagccttggtggctgttcggaagggcatggattatctgttttctcagcacgatctcagctttctagatgacgttatcccagagaaggataagaaaaaaaaggaggatgagaagaaaaaaaaaaagaagaaagggtctcttgactctgacaatgacgactcagactgcccatactctgaaaaagtcccgtcaattaaaatccccatggacattatggagcagcaaccattcctgagcgacagtaaaccatccgatcgagaacggtccccaacttttctggaaagacacacaagctgttag

SEQ ID NO: 241595 - DNA, 3108 bp, Artificial Sequence
  Description of Artificial Sequence: Synthetic coding sequence
atgtcaactgagaacgtggagggtaagccgagtaacttgggagagaggggaagagcgcgttcatccaccttcttacgagtagtgcagcctatgtttaaccactctatttttacgagtgctgtaagtccagccgcagagaggatccgattcatccttggggaggaggacgattcccccgctccaccccaacttttcacagagctagatgagctcctggccgtagacggccaggaaatggaatggaaggaaacggccagatggataaaattcgaggagaaggtggagcaaggaggggaacggtggtccaagccacacgtcgccaccttaagcctacattcactgtttgagctccgaacctgcatggaaaaggggtctattatgttggacagagaagccagctctctgccccaactggttgagatgattgtggatcatcaaatcgaaacaggtctcctgaaacctgaactcaaagacaaagtgacatacacccttcttcggaagcaccgacatcagactaagaagtctaacctcaggtctctggccgatattggaaagacagtgtctagcgcatcacggatgttcactaatcccgacaacgggtccccggctatgacccaccgcaacctaactagcagctcgttaaacgacatatccgacaaacccgagaaggatcagttgaaaaataagtttatgaagaaactcccacgggatgctgaagcctccaatgtgctggtgggagaggtggattttctggacacgccgtttatagcatttgtgcggctgcaacaagccgttatgctgggagcactgaccgaggtgcctgtgcctactagattcctctttattctcctcggcccaaaggggaaggctaagtcctaccacgaaatcggccgagcaatcgcaacactgatgagcgatgaggtcttccacgatatagcttataaggccaaagacaggcacgatctgattgcaggcattgacgagttcctagacgaggtcatcgtgctccctccgggtgagtgggatccagctatccgcatcgaacctcctaagtccctgccatctagtgacaagcggaaaaatatgtactctggaggagagaatgtccagatgaacggcgacacgccccatgacggcggacacggcggtggaggacacggggactgcgaggagctccagcgcactgggagattctgcggcggtctcattaaagatattaaaaggaaagcccctttttttgcatccgacttctacgatgccctcaacatccaggcactatccgccattctgtttatctacctggccactgtgaccaacgcgatcacatttgggggactgcttggtgatgccactgacaatatgcagggtgtccttgaaagctttctcgggacagccgtgtccggcgcaattttctgtttgtttgccggacagccacttactatactgagttccaccggtcccgtgctcgtcttcgagcggctgctttttaacttttctaaggacaacaactttgattacctcgagttccgcttgtggatcgggttatggagcgccttcctgtgcttaatcctggtggccaccgatgcctctttcctggtccaatacttcaccaggtttacagaagagggcttttcatcacttatatcttttatttttatatacgatgctttcaagaagatgattaagctcgccgattattacccaattaacagtaatttcaaggtaggctacaacactctgttttcttgcacatgtgttcctcctgacccagccaatatctccatctccaatgatactactctagcaccagaatacctgcctaccatgagctccaccgacatgtatcataatacaacgttcgattgggcattcctgtcaaagaaagaatgctctaaatatggtggcaacttagtggggaataattgtaattttgtgcctgacatcacattgatgagttttatactgttcctgggaacatacaccagcagcatggccctcaaaaagttcaagacatcaccttattttcccaccaccgccagaaagctgatcagcgactttgccattattctgtccatcctgatcttttgtgtgatcgacgccttggtcggcgttgacacccctaagttaatcgtcccgagcgaattcaaaccaacgtcgcctaacagaggttggttcgttcctccttttggcgaaaatccttggtgggtttgccttgcagccgctataccagcgctgctggttacaattctgatatttatggaccagcagatcaccgctgtcattgtcaaccgaaaggagcataaactgaagaaaggtgctgggtatcacttagaccttttttgggttgccatcctgatggtgatttgttcacttatggcgttgccgtggtatgtcgccgctacagtgatcagtatcgcacacatcgatagtctaaagatggagaccgagacttctgcccctggggagcagccaaaatttctgggcgtccgggaacagcgtgtcacaggcacactggttttcattttaacaggattatctgttttcatggcgcctatcctgaaattcatccccatgccagtgttatacggagtgtttctgtatatgggcgtggcatccctcaacggtgtgcagtttatggacaggctgaagctgctacttatgcctctaaagcatcagcctgacttcatttacctcagacacgtgccactgcgtcgcgtgcacctgtttacatttttgcaggtgctgtgtctagccctgctgtggatcctcaagagtacggtagctgcgataattttccccgtcatgatcttagcactggtggccgtgcggaagggaatggattacttatttagtcaacacgatctgagtttcctggatgatgtgatacccgagaaagacaaaaagaaaaaagaggatgaaaagaagaaaaaaaagaagaaagggtctttagactccgataatgacgacagcgactgtccttactctgaaaaagtcccaagtatcaaaatccccatggatatcatggaacagcaaccatttttgtctgattccaagcccagtgatcgtgagagatcgcccaccttcttagaaagacataccagctgctag

SEQ ID NO: 241596 - DNA, 2988 bp, Artificial Sequence
  Description of Artificial Sequence: Synthetic coding sequence
atggaagacgaagcagtgctggatagaggcgctagcttccttaagcatgtctgcgacgaggaggaggtggaaggacatcatactatttacatcggtgttcacgtgccaaagagctatagaagacgcaggcgacacaaaagaaagacagggcataaagaaaagaaggaaaaagagcgaattagcgagaattactcagataagagcgacatcgaaaacgccgatgagtcttcatcaagcatcctgaaacctctgatcagtcccgcagcagagaggattaggtttattctaggggaggaggacgactccccagcaccccctcagcttttcacagagctggatgagctcctggccgtcgatggacaagaaatggagtggaaagagacagcccgatggattaagtttgaggaaaaagtggagcagggcggtgagagatggtcgaaacctcatgtggctacactgtccctccactcgctgtttgaattgagaacatgtatggagaaaggatcgatcatgctggatagggaagcctcctccctgcctcaactggtggaaatgattgtggaccatcagatagagaccggcctcctcaaaccagaactgaaagacaaagttacctacaccctgctgaggaagcacaggcaccagacaaaaaagagtaatttacgatctctcgccgatattggcaagacagtcagtagcgcatcccgtatgttcacgaacccagataatggttctcctgcgatgacacataggaatctgacctcatcttctttgaacgatataagcgataaacctgagaaggatcagttgaagaacaaattcatgaaaaaactccctagggacgctgaagcctcgaatgtgcttgttggcgaggtcgacttcctggacactccctttatagcttttgtgcgtttacagcaggctgtgatgctgggagctctgactgaagtgcctgttccaacaaggttcctgtttatattactcggcccaaagggaaaggccaagtcatatcacgaaataggtcgcgcaatcgcaaccctgatgagtgacgaagttttccacgatatcgcatataaggcgaaggatcgacacgacctcatagcaggcatagacgagtttctagatgaggttattgttctcccccctggcgaatgggaccccgctattagaattgaacccccaaaaagtctccccagctccgacaaaagaaaaaacatgtactcaggaggtgagaacgtgcaaatgaatggagataccccccatgacgggggtcatggaggtggcggacatggtgattgtgaagagcttcagagaacaggtcggttctgcggcggactcattaaggacatcaagcgaaaggccccattttttgcaagcgacttctacgacgctctcaatatccaggcgctcagtgcaatcctgtttatctacctggccaccgtaaccaacgccataaccttcggtggactcctaggcgacgctaccgacaacatgcaaggggttttggaaagctttttggggacagccgtgtccggggctatcttttgcctgtttgcaggacagcccctgacaattcttagttctaccggaccagtgctggtctttgagcggctactctttaactttagtaaggacaataactttgactacttggaattccggctttggattggactttggtctgccttcctatgtctcattctcgtcgcaaccgatgcctcttttttggtgcaatactttacccgttttacagaggagggatttagctcccttatctccttcatattcatctacgacgcattcaaaaaaatgatcaaactggcggattactatccgatcaactctaatttcaaggttggctataatacactgttttcctgtacttgcgttccgcctgatcccgctaacatctctatttccaacgacacgactttagcacctgagtacctgccaactatgtcatcgaccgatatgtaccataatacgacctttgactgggctttcctttctaagaaagagtgcagcaagtacggaggaaacctggtcggcaacaattgcaatttcgtcccagatatcacactgatgagcttcatcttgttccttgggacctacacatctagcatggcactgaaaaaattcaagacatctccatattttcctaccaccgccagaaagctcatcagcgactttgcgatcatcttgtctattctgatcttctgtgttattgacgcactggtcggggtggatacacctaaacttatcgtgccgagcgagtttaagccaacctctcccaatagaggctggtttgtccctccctttggcgagaatccatggtgggtctgcctggcagccgctattcctgctctgctggtgacgatactgatcttcatggatcagcaaatcaccgcagtgattgttaatcgcaaggagcacaagttgaagttcatcccaatgcccgtactgtatggagtgttcctgtatatgggagtggctagtttaaacggcgtgcagttcatggataggttaaagcttctgcttatgccccttaaacaccagcccgacttcatctatctgaggcatgtgcccctgaggcgtgtgcacttgtttacatttcttcaagtgctgtgcctggcactcctgtggatcctgaagtcaaccgtagccgcaatcatttttcccgtaatgatcctggccctagttgccgtccgtaagggtatggattacctgttctctcagcacgacttatccttcctggacgatgtcataccggaaaaggataagaagaagaaagaggatgaaaaaaaaaaaaagaaaaagaagggctccctcgactccgataacgacgactctgactgcccgtacagcgagaaagtgccttccattaagattcctatggatattatggaacaacagccctttcttagcgatagtaaaccaagcgatcgagagcgaagcccaactttcttagagcgtcatacgagctgctag

SEQ ID NO: 241597 - DNA, 3285 bp, Artificial Sequence
  Description of Artificial Sequence: Synthetic coding sequence
atggaggacgaagcagtgctcgatcgcggagcaagctttctcaagcatgtctgcgatgaggaagaggtcgagggtcaccatacaatctacattggggtgcacgtgcctaaaagctacaggcggagacgtagacataagcgcaaaacaggccacaaggagaaaaaggagaaggagagaataagcgagaattacagcgataaatccgatatcgagaatgctgacgaatcctcatcctctatcttgaagcctttgatcagcccagcagctgagcggatccgtttcatcctgggggaagaagacgattcaccagcaccccctcagcttttcaccgagctggacgagctccttgccgttgatggacaggagatggaatggaaggagacagccagatggatcaaattcgaggagaaagtcgaacaggggggtgagcgctggagtaaacctcacgtagccacccttagcctgcacagcttatttgagttgcggacctgtatggagaagggttcaatcatgctggaccgcgaggcatcctcactgccccagcttgtggagatgattgtcgatcatcagattgaaaccggattgcttaaacccgaactcaaagacaaggtgacatatacattgcttagaaagcatcggcaccagactaaaaagagtaacttgcgcagcctggcagatatcgggaagaccgttagttctgctagtcggatgtttactaatcctgacaatgggagccctgcgatgacccacaggaatctgacctcttcatcactgaacgacatcagtgataagccggaaaaagatcagcttaagaataagttcatgaagaaactgccgagagacgccgaggcgtccaatgtgctggttggcgaagtggattttctggataccccctttatcgcctttgtgaggctgcagcaagcagtgatgttgggggctttaaccgaggttcctgtgcctacccgcttcctttttattctacttggcccaaaaggcaaagccaagtcttatcacgaaatcgggcgtgcaatagcaactctgatgtccgatgaagtgttccatgacatcgcatataaggcgaaggaccgacacgatctgatcgctggcattgatgagtttctcgatgaagtgatcgtgcttcccccaggagagtgggacccggctatccgcattgagccacccaaaagcctacccagttcggataagaggaaaaatatgtattccggaggagagaatgtgcagatgaatggtgacaccccccatgatggcggacacggcggaggcggacatggtgattgcgaagaactgcaaaggactgggagattttgtggaggcctgattaaggacattaaaaggaaagcgcctttttttgcatccgatttttacgacgcactgaacatacaggcgctgagcgcaattctgtttatctacctagcgacagttactaatgcaattaccttcgggggtttgttgggggacgcgacagacaatatgcagggagttctagagagttttctgggcactgccgtgagcggtgctatcttctgtctctttgccggacagccactcacaattctcagctccacgggcccagtcctcgtgttcgagagactgctgttcaatttctccaaggataataacttcgactacttggagttccggctgtggataggattatggagtgcattcttgtgcttgattctcgtcgccactgacgcaagttttctggtgcagtacttcacccgcttcacagaagaaggcttttcttctctgatctcattcattttcatctatgatgcctttaaaaagatgattaagctcgcggactactaccccatcaacagtaacttcaaagtcggttacaataccctgttctcctgcacgtgcgtgcccccagacccagctaacatcagcatatctaatgataccacacttgcccctgaatatctgccgaccatgtcttcaactgatatgtatcacaatacaaccttcgactgggctttcctgtctaaaaaggagtgctcaaagtacgggggaaatctcgttggaaataattgtaatttcgtgcccgatatcaccctgatgtccttcatcctgtttctgggcacctatacttcgtcaatggctcttaagaaatttaaaacttctccctatttcccaacaacagcccgtaaactcatatctgattttgctatcattcttagtatcctgatcttttgtgttattgatgcactggtgggcgttgacacccccaagcttattgtcccttccgagttcaagccaacaagcccaaaccggggatggttcgttcccccattcggggagaacccatggtgggtttgtttggcagcagccattccagcgttgcttgttaccatattaatctttatggaccagcagataactgctgtgatcgtgaaccgcaaggagcacaagctgaagaagggcgcagggtaccaccttgacctgttctgggttgcgattctgatggtaatctgctcgctgatggccctgccttggtacgtagccgcaactgtcatctcaatcgcccatatcgactccctcaaaatggagactgagacatctgccccaggggagcaacccaagttcctcggggttagggagcagcgtgtgacaggtacactggtcttcatactcaccgggctgagcgtcttcatggcaccaattctcaagtttatcccgatgccagttttgtatggcgtgtttctgtacatgggggtagcatctctcaacggcgtgcagttcatggaccgcttgaagctgctgcttatgccattaaagcaccaacctgacttcatctatctgaggcacgttcccctgagacgcgtgcacctgtttaccttcctgcaggtgctgtgtctagcactcttgtggatcctgaagtctactgtggccgcaattatcttccctgttatgatcctggctctggtagctgtgagaaaggggatggattatctgttcagccagcatgatctgtctttcttggacgatgtgattcctgagaaagacaaaaagaagaaagaggatgaaaaaaaaaagaagaagaaaaaaggatccttggattccgataacgacgacgaaaaggaccatcagcatagtctgaatgccactcaccacgcagacaaaattccatttttgcagagtctaggaatgccatccccacccaggaccccagtcaaggtggtgccacagatccggattgagctcgaacctgaagacaatgactacttttggcgctcgaaggggaccgagaccacactgtag

SEQ ID NO: 241598 - DNA, 3123 bp, Artificial Sequence
  Description of Artificial Sequence: Synthetic coding sequence
atgaaggtaaaagaggagaaggcgggagtgggtaagcttgatcacacgaatcaccggagacgattccccgatcagaaagaatgtccccctatacatattggcctgccagtgcccacatatccgcagaggaagacagatcaaaagggccacttgagcgggcttcagaaagttcattggggattgaggcccgatcaaccacaacaagaactaactgggccagggtccggggcttcgtcccaggactcatctatggatttgatctcccggactcgctcacctgcagctgagcagctgcaagacatactgggggaagaagatgaggcccctaaccctaccctgttcactgagatggatactttgcaacatgatggagaccagatggagtggaaagagagtgcgcgatggatcaagttcgaggagaaggttgaagagggaggcgagagatggagcaagccacatgtgtccaccttgagcctgcacagcttattcgagctgaggacatgcctgcagacgggcaccgtattgttagacctcgacagcggatccctcccccaaatcattgatgatgtgatcgagaagcagatcgaggatggcctgttgcgacccgaactgagagagcgcgttagctacgtgctgttgagacgccataggcatcagaccaagaagccaattcaccgcagcctggctgatattggtaagtctgtttcgactaccaaccggtcccccgctagaagccccggagccggtcctagtttacatcactctactgaggatctgcggatgagacagagcgccaactacggacgactctgtcacgctcagtcaaggagtatgaatgacatcagccttaccccaaataccgatcagcgtaaaaacaagttcatgaaaaagatccccaaggattcggaggctagtaacgtcctggtcggcgaggttgatttcttagaccagccttttatagcattcgtgaggctgattcagtcagctatgctgggtggtgttacagaagtgccagtaccaactcggtttttatttatcctgctcggaccctcggggagggccaaatcatataacgaaatcggtcgcgcaattgccaccctgatggttgacgatctgttttccgatgtggcatacaaagctcgcaaccgagaagatctcattgcaggcatcgacgaatttctggatgaagtgatcgtgctgcctcccggagaatgggacccaaatatcaggatcgagccacctaagaaggttcccagcgcagacaagagaaagtccgtgttcagcctggcggaactaggccaaatgaacggctccgtgggcggtggaggcggagcgcctgggggaggaaacggaggcggaggtggaggaggcagtggcggtggggctggtagtgggggagccggtggaacttcttctggagatgatggcgagatgccagctatgcatgagataggagaggagctgatctggacagggaggttcttcggaggattgtgtctcgacattaagcgtaagcttccttggttccctagcgatttttatgacgggtttcatatacagtctatttcggctatcctgtttatctacttaggatgcatcacaaatgctattacatttggaggcttgctgggcgacgccacagacaattatcaaggcgtcatggaaagctttctcgggacggcaatggccggaagtctgttctgcctgttctccggccagccattaatcatcctgagctcaactggccctattctgattttcgaaaagttgctgtttgatttttccaagggtaacggactggactacatggaatttcgcctttggatcggcctccactctgcagttcagtgtctgattctggtggccacagatgcatcatttataatcaaatacatcactcgctttactgaggaaggcttctccacattgatttcctttatcttcatttatgatgcaattaagaaaatgattggagctttcaaatattaccccatcaatatggatttcaagccaaatttcattacaacctataaatgcgagtgtgtcgccccagacaccgttaacactaccgtgttcaacgccagcgccccattagccccagatactaatgcaagtttgtacaacttactcaatctgacagcgctcgattggagtctgctcagcaagaaggaatgcctttcttatggaggccgtctgttgggcaactcctgtaagttcatcccagatttggccttgatgtcatttatcctgttttttggcacctacagcatgaccctgaccctgaagaagttcaaattcagtcggtatttcccaacaaaggtccgagctctcgtagcagacttttccatcgtcttttcgatcctcatgttttgtggcatcgatgcatgttttgggttggaaacgcccaagctgcacgttccatcagtgatcaaacccaccaggcctgatcgaggatggttcgttgctccttttggaaagaacccgtggtgggtgtaccccgcttcgattttgccagccctactcgtcactattctcatcttcatggatcaacaaatcaccgccgttattgtgaatcggaaggagaacaagcttaagaaagcagctgggtatcacctcgatttgttttgggtcgggatcctaatggccctatgttctttcatgggccttccatggtacgtggccgcaactgtgatcagtattgcacatattgacagcctgaaaatggagactgagacctccgccccaggggaacagccacaattccttggcgtgcgtgagcagagagttacaggaataattgtgttcatccttacaggtatcagtgtttttctagcacccatcctaaagatcctgggactgatcatcgtccggaggctgctggactttattttctcgcagcacgatcttgcctggatagataacattctgcccgagaaagaaaaaaaggagaccgataaaaagagaaagaggaagaaaggagcccatgaggactgcgacgaagaacctcagttccctccgccaagtgtgattaagattcctatggaatcagtccagtccgacccacagaatgggatccactgtatcgccagaaagcgatcatcatcctggtcatacagcctatag

SEQ ID NO: 241599 - DNA, 3414 bp, Artificial Sequence
  Description of Artificial Sequence: Synthetic coding sequence
atgaaagtgaaagaggagaaggctggagtcggcaagttggatcataccaatcaccgcagaagattccccgatcagaaggaatgcccacctattcacatcgggctgcctgtgcccacttacccgcagcggaaaaccgatcagaaaggacacctgtcaggtctgcagaaggtgcattggggcctgaggcccgatcaaccgcaacaggagttaacagggcctggctcaggagcaagctcacaagacagctccatggacctcatctcaagaacaaggagcccagcagctgagcaactgcaggatatactcggcgaggaagacgaagcacctaatccgacactctttaccgaaatggataccttgcaacatgacggtgaccaaatggaatggaaagagtccgcaagatggatcaagtttgaggaaaaagttgaggagggcggagagcgctggtctaagcctcatgttagtaccctcagcttgcactcattgtttgaacttcgtacttgtctgcagaccggcaccgtactactagacctcgattccggaagcctcccacagataatcgacgatgttatcgaaaagcaaattgaggatggactcctgcggcctgagttacgggaaagagtgagctacgtgcttttgcgccgacacaggcaccagaccaagaaacccatccataggtccctggcggatatcgggaaatcggtgtctacaacgaatcggtcccccgcacgttcccctggggcaggccctagtctgcaccactctaccgaggatttaagaatgcggcagtctgccaattacgggcgtctgtgccatgcacagtcccgcagtatgaatgatattagcctgacccctaatacagaccagcgcaaaaacaagttcatgaaaaagatccctaaggactctgaggcttcaaacgtcctggtcggcgaggtggacttcctggaccagccttttattgcctttgtgagacttattcaatccgctatgctcggtggtgtgactgaggtgccggtgccaacccgtttcctgttcatcctgctgggaccctctgggagagctaagagctataacgaaatcggtcgcgctatcgccacccttatggttgatgaccttttcagtgacgttgcttacaaagccagaaatcgggaggacctgatcgctggaatcgatgagttcctggatgaagttattgtgctgccgccaggcgagtgggaccctaatataagaatcgagcccccaaaaaaagtgccctctgccgacaagagaaaaagtgtgttctccctggcagagttaggacaaatgaacggtagtgtcggagggggaggaggcgcacccggtggcggtaacggaggcggaggcggaggaggctccggtggcggagcagggtctggtggcgctgggggtacatcgtcaggtgacgatggggagatgccagctatgcacgaaatcggcgaggagttgatatggaccggacgctttttcgggggactctgtctcgacatcaaaagaaaactgccctggttccccagcgacttctatgacggattccacatccaatctatctccgctatcctgtttatatacttgggatgcattacaaacgcaattaccttcgggggtttgttgggcgatgcgactgataactatcagggtgtgatggagtcattcctcgggaccgccatggccggatccttattctgtctgttcagcggccaacccctgataattctgagtagtaccggacctatcctgattttcgaaaagctcctgtttgatttctcgaaaggcaacgggctcgattacatggagttcagactttggataggcctgcatagcgccgtgcagtgcctgattctagtagctacagatgcctctttcataattaagtacatcacacgctttaccgaagaaggattttcgacattgatcagcttcatcttcatttacgacgcaattaaaaagatgatcggggctttcaaatactacccgattaacatggacttcaaacccaatttcatcacaacttacaaatgcgagtgtgtagccccagatactgtgaataccaccgtgtttaacgcctctgcaccgctggccccagacaccaacgcttcactgtacaatctactgaatctgacggccctggattggtctctgctatctaagaaggagtgcctctcttatgggggtcgcttactcgggaatagctgtaagttcattcctgaccttgcactaatgagtttcatcctctttttcggcacctatagcatgacactgaccctcaagaagttcaaattctcgcgctacttccctaccaaggtgcgggcactggttgccgatttttccattgtgttctccatcctgatgttctgtggcatcgacgcctgcttcgggctggaaactccaaagctccacgtgccatccgtcattaagcccaccaggccggatcgcggatggttcgtggcccctttcggcaagaatccatggtgggtttatcctgcatctattctgcctgccctgctagtgaccattctcattttcatggatcagcagatcactgccgtcattgtaaaccgaaaagagaataagctgaaaaaagccgcagggtaccacctggacctcttctgggtcggaatcctcatggccctctgctctttcatgggcttaccctggtatgtggccgctacagtgatctcgatcgcccacatcgatagtctgaagatggagaccgagacctctgctccaggcgagcagcctcagttcctcggagtccgggagcagcgcgtgaccgggataatagtctttatccttaccggaatcagcgtgttcctcgctcctattctcaaatgtatccccttgccagtgttgtacggggtatttctctatatgggtgtagcctccctcaacggcatacagatgggaacggggggttcagagtttaagatccagaagaaattgacaccattttgggagagatgtaagctgtttctaatgccggcaaaacatcagcccgaccatgccttcctccggcatgtcccactgcgcaggatacatctttttactctggtgcaaatcctgtgccttgcagtgctgtggattctgaaatccacagtagccgctataatctttcccgtgatgatactgggcctcatcatcgtcaggcgcctcctggactttatcttctctcaacacgacctcgcatggatcgacaatatccttccagagaaagaaaaaaaggagacagataagaaaagaaagaggaagaagggggctcacgaggattgcgatgaagaaccacagttcccccctccttcagtcatcaagatccctatggagagcgtccagagcgacccgcaaaatggcatacactgcatcgcacggaagcgctcttcttcctggagctattccctgtag

SEQ ID NO: 241600 - DNA, 3060 bp, Artificial Sequence
  Description of Artificial Sequence: Synthetic coding sequence
atgaaggtaaaagaggagaaagccggagtcggaaagctcgaccacactaaccatcgcaggcgatttccagatcagaaaggctcccccgctgctgaacaactgcaggatattctgggagaggaagacgaagcccctaatcccaccttgttcaccgagatggacactctgcagcatgatggagatcaaatggaatggaaagagtccgcacggtggattaaattcgaagaaaaagtggaagaaggaggtgagcggtggagcaagccacatgtgagcaccctgtcgctccattcactcttcgagcttagaacttgtctgcagacaggaaccgtcttactggacctggacagtggcagtctgccccagatcatcgatgatgttattgagaaacagatcgaggatggacttctgcgacctgagctccgagagagagtgtcctatgtgctcctgagacgccacaggcatcagactaagaaacctattcataggtctctcgccgatatcgggaagtccgtaagcaccaccaacaggtccccagcacggagccctggcgcaggcccttctctacaccactctaccgaggatttgaggatgcgacagtcagcaaattatggacgcctctgccacgcgcagtcgcggtctatgaacgacatcagccttacccctaacacggaccagaggaaaaacaaattcatgaaaaagatccctaaagacagcgaagctagcaacgtgctggtgggagaagtggattttttggatcagccttttatcgcgttcgtgaggcttattcaatcggccatgctgggtggggtcactgaagtccctgtgcctacgcgtttcctcttcatactgttagggccatccggtagggccaaaagttacaatgaaatcggacgggctatcgccacattgatggttgacgacctgttctccgatgtggcttataaggctaggaacagagaagatttaatcgccggtattgatgaatttctcgatgaggtgatagtgctgccgccaggcgaatgggaccccaatattcgtattgaacctcctaagaaagtaccaagtgctgacaagagaaaatcggttttctctctggcagagctcggccagatgaatggatccgttggcggtggagggggagcgccaggtggtggcaacggtggaggaggcggtggtggtagcggtggaggagccggatcaggcggagccggtggcacaagcagcggcgacgacggcgagatgccagcgatgcacgagatcggggaagagctgatatggaccggcaggtttttcggaggcctatgtctggatataaaacgcaaactcccatggtttccctccgatttctatgatggattccatattcagtctatttccgctatcctgttcatttatttgggctgcatcaccaacgccattacttttggcggtctgctgggcgacgcaacagacaactaccagggagttatggaatctttcttgggaaccgccatggccggaagcctgttttgccttttttctggtcagcctctcattattctctcctctaccggacccatccttatttttgaaaagctgctgttcgacttctctaaaggaaacggactagactatatggaattccgcttgtggattggactccattcagcagttcaatgcctcattctcgtggcgaccgacgccagttttattataaagtacatcactcgatttacagaagaaggtttttccaccctcatctcattcatcttcatctatgacgccatcaagaagatgatcggagcgttcaaatactaccccattaacatggactttaagccaaatttcatcactacctacaagtgtgagtgtgtggctcccgataccgtcaataccactgtatttaatgcgtctgctccgcttgccccagatactaatgcttcactctataatttactgaatcttactgccctcgattggtcacttttgagcaagaaagaatgtcttagctacgggggaaggctccttgggaactcttgtaaatttattcccgacctcgccctgatgagtttcattctttttttcggaacctacagcatgactcttacccttaaaaaattcaagtttagcagatatttccccaccaagcccacccggccagatcgaggctggtttgtcgcacccttcggaaagaatccttggtgggtgtacccagcctctatcctccctgcactgctagtaaccattctgatttttatggatcagcagataaccgctgtcattgtgaatcgcaaagaaaacaagctcaaaaaagccgctggctatcacctggacctgttctgggttggcattctcatggcactgtgttccttcatgggactgccttggtacgtggccgcaactgtaatctcaatcgcgcacatagacagcttgaaaatggagactgaaacctccgcacctggggagcagccacagttcctcggggtccgtgagcaaagggtcacagggatcatcgtatttattctaaccggcatttccgtgttcctagcgccaatccttaaatgtatccccctgccggtgctgtacggagtgttcctgtacatgggggttgcctctctaaacggaatccagttttgggagcgctgtaaattgttcctgatgcctgccaagcaccagccggaccacgcatttctgagacatgtgcctctaaggaggatccacctatttacgcttgtccagatattatgcctcgcggtactttggatcctcaagtcgaccgtggccgctatcatctttcctgtcatgatcctcgggttgattatcgtgagaagactactcgatttcattttcagtcagcatgacttggcatggatagacaacatcctacccgaaaaggagaaaaaagagacggataaaaagaggaaacgtaaaaagggagctcatgaagattgtgatgaggaaccccagtttccacccccaagcgtgattaaaatccctatggaatcggtgcaatcagacccccagaacgggattcattgtatagcaagaaaaagaagcagctcatggagctattcactctag

SEQ ID NO: 241601 - DNA, 3060 bp, Artificial Sequence
  Description of Artificial Sequence: Synthetic coding sequence
atgaaggtgaaagaggagaaggccggtgtcggcaaactggaccacactaaccaccggagaagattccccgaccagaaaggctctcctgctgctgaacagttacaggacatccttggagaggaagatgaggctcctaaccccactctcttcactgaaatggacacgctccagcatgatggagatcaaatggaatggaaagaatctgcgcgatggattaaattcgaagagaaagttgaagaggggggagaaaggtggtctaagccgcacgtgagtactctcagcctacacagcctattcgagctgcgtacctgtctgcagaccgggactgtcttgctggatttggatagcggctcactgccacagatcatagatgatgtcattgagaagcagattgaagacggcttgttgcgcccagaattgcgcgagcgggttagttatgttctgcttcgacgccatcggcaccaaacaaagaagcccatacatagatctttagctgatatcggaaaaagcgtgagcaccaccaataggtcacccgcaaggtcaccgggtgccggtccatccctgcaccactctacagaagacctccggatgagacagagcgccaattacggcaggttgtgccatgcacagagccggagcatgaacgacatttccctaacacctaacacagatcagcgaaaaaataagttcatgaaaaagatccctaaggactccgaagcttcaaatgtgctggtgggtgaggtagacttcctcgatcaacctttcatcgcattcgtgcggctgatccagagcgcaatgctgggtggcgtgaccgaggtcccagtgcctacccggttcctgtttatattattgggaccaagtgggagagccaaatcttataacgagattgggcgagctatcgccactcttatggtggatgatctgttttcggacgtagcctataaagctcgtaatagagaagatctcatcgctggcatcgatgaattcctcgacgaagttatagtgctacctcccggtgagtgggaccctaacatccgcatcgagccacctaagaaagtgcctagtgccgataagcgaaagagcgtgttcagtctggcagaactggggcagatgaacggctctgtaggcggtggtgggggagcacctggtggaggtaacggcggagggggtggtgggggatcagggggaggcgcaggatcgggcggagctggcggaaccagctctggtgatgacggcgagatgccagcgatgcacgagatcggggaagaactgatctggactgggagattctttgggggactatgcctggatattaaaagaaagttaccctggtttccatcagatttttacgatggcttccacatccagagcatcagcgccattcttttcatctatctaggatgtatcacaaatgctattacctttggaggcctgctcggagatgccacggataactaccagggggttatggagagttttttaggcacggcaatggccggttcattattttgcctcttcagtgggcagcctctaattatcctgtctagtaccggacccattctcattttcgagaagctattgttcgatttttctaaaggcaatgggctggactacatggaattccgcctgtggatcgggctacattcggccgtgcagtgcctgattttggttgcaaccgatgcctcttttattattaagtatattacgaggttcactgaagagggctttagcacccttatctccttcattttcatctacgacgccattaaaaagatgatcggcgcatttaagtattaccccatcaacatggactttaaacctaactttatcactacttacaagtgcgagtgcgtggccccagacacagtgaacaccaccgttttcaacgcttccgcacctcttgcgcctgataccaatgcctctctctataacttgctgaatttaaccgccctggattggtctctactgtccaagaaagagtgtctgagttatgggggacgcctcctaggaaacagttgtaaatttatcccggatctggccttaatgtcctttattctgtttttcggaacttattcgatgaccctcactttgaagaagttcaagttttccagatattttccgacaaagcctactagacctgataggggatggtttgtcgcccctttcgggaagaacccctggtgggtgtaccccgcatccatcctgccagctttgttggtgaccatcctgatttttatggatcagcaaatcaccgctgtgatcgtaaatcggaaggaaaataagctgaagaaagcggcagggtatcatctcgacctgttttgggtcgggatcctaatggccctgtgtagctttatgggactaccgtggtatgtggcagctaccgtcatttccattgctcacattgattctctgaagatggaaaccgaaacctccgcccctggagaacagccccaatttctgggggtcagagaacagcgagtgactgggatcatagttttcattctaactggaatctctgtgttcttagctcccattctgaaatgtattcccttaccagttttgtatggggtttttttatatatgggcgtggcttcgctgaacggcattcagttctgggagcgttgcaaactctttcttatgcccgctaagcaccagcccgaccacgctttcctgaggcacgttccacttaggcgtatacatctctttactctggtgcaaatactgtgcttagccgtgttatggattctgaagtctacagtggccgcaatcattttccctgtgatgatactcgggttgatcattgttcggcgtctccttgatttcatcttcagtcaacacgacctagcatggatcgataacatattgccagaaaaagaaaagaaggaaaccgataaaaaaaggaagaggaagaaaggggcacacgaagactgtgacgaggagccgcagtttcctcctccctcagttattaaaatcccgatggaaagtgttcaaagcgatccacaaaacggaatacattgcatcgcaaggaagagaagtagcagctggagttattctttgtag

SEQ ID NO: 241602 - DNA, 3123 bp, Artificial Sequence
  Description of Artificial Sequence: Synthetic coding sequence
atgaaggtaaaagaagagaaagccggtgtgggaaaacttgaccacacaaatcaccggagacgtttccctgatcagaaggagtgtcccccaatacacatcgggttaccagtacctacgtacccccagaggaagacagatcagaaggggcacctgtcaggcttacagaaagtccattgggggctgaggcccgatcagccccagcaggagcttaccggacctggatccggagcatcctcccaagactcatctatggatctgatatctcgtactaggtcacctgctgcagagcaactgcaggatattttaggtgaggaggacgaggcccctaatccgacactgttcaccgagatggacaccctgcaacacgacggcgaccagatggaatggaaggaatcagctaggtggattaagttcgaagagaaagtggaagaaggcggtgagcgttggtctaaacctcacgtgagcacactctcacttcactctttgtttgagctccgcacttgcctccagacagggactgtgttactggatttagatagtggcagtctgccacagattatcgacgacgtaattgagaagcagattgaagatgggctgcttcgtcccgagttgcgggagcgcgtatcctacgtactgctacgccgacatagacatcagaccaagaagcccattcatcgctctctcgctgacatcgggaagtctgtgagtaccactaaccggagtccagcgagatcacccggagccggtcctagcttacatcattcaacagaagacttgagaatgcggcagtccgcaaattacggtcgactctgccatgcccagagccggagcatgaacgacatttcattaacgcccaacactgaccagagaaagaacaagttcatgaaaaaaatcccgaaggattcggaagcctcgaatgttctcgtgggtgaggtggattttctggaccagcctttcatcgcattcgtcaggctcatccagtctgcaatgttggggggagtgacagaggtccctgtcccaacccggtttctgttcatcctgttggggccaagtggcagggcaaagtcatataatgaaatcggacgggcaatcgcaacgttgatggtggatgacctgttctctgacgtggcatacaaggctcggaatcgggaggacctcattgccggaattgacgagttcttggatgaagtcatcgtcctgcctccgggagaatgggatcccaacatccgcattgagcccccaaagaaggtgccctcggccgacaagaggaaaagcgtgttttctctcgccgaactcggccagatgaacggatctgtgggcggtggtggaggcgctcctggaggcggtaacggtggcggtggcggtggaggctcaggcggaggcgcagggagcgggggtgctggtggtactagctccggtgacgatggcgagatgccggcaatgcacgagatcggggaggagttgatttggactggaagatttttcgggggactttgcctcgatatcaagaggaaactaccttggttcccatccgacttctacgacggtttccacatccagtccatctccgcaatcctgttcatctacctgggctgcattaccaacgcaataaccttcgggggactcctgggcgacgccaccgacaactatcaaggggttatggaaagctttctgggtacagcaatggcaggctctctgttctgtctcttctccggtcagcccttgattatactgtcaagcactggacccattctgatttttgagaaacttctgtttgacttctctaagggtaatggcttagattacatggaattccgcttgtggattgggctccatagtgccgttcagtgcctgattttagtagctacagatgccagcttcatcatcaagtatatcactcgatttaccgaggagggcttttccacgctgatatccttcatatttatttatgatgcaattaaaaagatgatcggagccttcaaatattacccgatcaacatggatttcaagcccaactttatcactacttacaagtgcgagtgcgtagccccagacacggtgaacacaacggtcttcaatgcctccgctcctctggcacccgacacgaatgccagtttatataacttgctaaacctgacagctttggactggtcgcttttgtccaagaaagaatgtctatcctatggaggccgactattagggaattcctgcaagtttattcctgacctggccctgatgagctttattttgttctttggcacgtacagcatgaccctgactctcaagaagtttaaattcagccgatatttcccgactaaggttagggcactggtggcagatttttcgatcgtgtttagcatactaatgttctgcggcatcgatgcttgtttcggactggagacccccaagttgcatgtgccctccgtgattaagccaactcggcctgatagaggatggttcgttgcccctttcgggaaaaatccttggtgggtctacccagcatcgatactgcccgcactactggtcactatactgatcttcatggaccagcagataacagcagtgatcgtgaaccggaaagagaataagcttaagaaggctgccggttatcatctggacttgttctgggtggggattctcatggctctgtgcagttttatgggcctgccatggtatgtggccgcaaccgtgatttctatcgcacacatcgattccctcaagatggaaacggagacctccgctccgggagagcagccacaatttctgggagttcgggagcaacgcgtcaccggcatcatagtttttatcctgacggggatcagcgtttttctggctccaatccttaagatactgggacttatcatcgtgaggaggctcctcgatttcatcttctctcaacacgatttggcctggatcgacaacatcctcccagaaaaagagaaaaaagagacagataaaaagagaaagcggaagaagggcgcacacgaggattgtgacgaggagccacagtttccccctccttcagtcattaaaatacctatggagagcgtgcagtccgacccacaaaacggaatacactgcattgctcggaaaagatctagctcatggtcatactcattgtag

SEQ ID NO: 241603 - DNA, 3414 bp, Artificial Sequence
  Description of Artificial Sequence: Synthetic coding sequence
atgaaagtgaaagaggagaaggctggggtaggcaagctagaccacacaaatcacaggcgtcggttcccggaccagaaggagtgtccccctatacatatcgggctgcctgtgccgacataccctcagcgcaagacagatcagaagggccacctgtcaggtctccagaaggtccattgggggctccgacctgaccaaccgcagcaggagttaacaggccctgggtccggcgcttcttctcaggactcctctatggatctaataagtcgaacccggtctcctgctgctgagcagctccaggacatcctgggcgaggaggatgaggctcctaacccgactctgtttaccgaaatggacactctccagcacgacggggaccagatggagtggaaagagtctgcccgttggattaaatttgaggagaaggtagaggagggtggagagcgctggtctaaaccacacgtgagtactctaagtttgcacagtctatttgagctgcgcacttgtttacagaccggcactgtactcctggatttagatagtggctcattgcctcaaatcatagatgacgtaattgagaagcagattgaggacggactgcttaggcccgagctgcgagaacgcgttagctatgtgctattgcgaaggcatcgccaccaaaccaagaagcccattcaccgctccctggccgacattgggaaaagcgtcagcactacgaacagatctcccgcaaggtcacccggtgcaggacccagcctgcaccatagcactgaagatctccgcatgagacaatcggctaattacggcagattgtgtcatgctcagagtcgatctatgaacgatatttcccttacacccaatacggatcaacgcaaaaataagttcatgaaaaagatacccaaggactctgaagcctccaacgttcttgtgggcgaggtcgactttctggaccaacctttcattgcattcgtgcgattgattcaatccgctatgctgggaggggtgaccgaagtgccagtccccacaagatttctgtttatcctcctcggaccctcaggaagagccaaaagttacaacgagattggtcgcgctatcgcgacactgatggtcgacgatctgtttagtgatgtggcatataaggccagaaaccgggaggacctgatcgcgggaatcgatgagttcctggatgaggtcatcgtactaccccctggagagtgggacccaaacatccgcattgagccgcctaagaaggttcccagcgcagacaaaaggaaaagtgtcttctccttagccgagctgggtcagatgaatggatcagtgggcggaggaggaggggctccgggaggcggaaacgggggaggcggtggagggggatccggaggaggagccggtagcggtggcgctggagggacctcctcaggcgacgacggcgaaatgcctgcgatgcacgaaattggagaggaacttatatggacaggtagattctttggaggtctgtgccttgacatcaaaaggaagctgccttggttcccatcagacttctatgacgggttccatatacagtccatttcggccattctgttcatctaccttggatgtatcacaaacgctattacctttggaggcctgctcggggatgccaccgacaattatcagggcgtcatggaatcctttctgggcaccgccatggcgggtagcctgttctgcctcttcagcggccagccactgatcatcttgtcatctactgggcctattctcatttttgagaaactgttattcgatttcagtaagggaaacgggcttgactacatggaatttcgactttggattggtctccacagcgccgttcagtgtctgattcttgtggctactgacgcatcgttcataatcaaatacataaccaggttcaccgaggaaggcttttcaactctcatatcatttatctttatctacgatgcgataaagaagatgataggcgctttcaaatactaccctattaacatggattttaaacctaactttatcaccacctataagtgcgagtgtgtggccccagatactgtgaacactactgttttcaatgccagcgcccctctcgccccagacactaatgccagcctctacaatttgctgaacctgactgcactggactggtcattgctgagtaaaaaagaatgtttatcatatggtggccgactgctgggtaattcttgtaagtttattccagacctggctctcatgagcttcattttgttcttcggcacctactcaatgaccctaactttgaaaaaatttaagttctcacgctatttccccacgaaggtcagggccctggtagcggacttttctattgtattctcaattctgatgttttgcggaatagatgcatgtttcggactcgagactcccaaactgcacgttccatctgtgatcaaacccacgaggccagacagaggctggttcgtggcaccctttggtaagaatccatggtgggtgtacccggcatcgattttgcccgcactgttagtgaccatccttatcttcatggatcagcagatcactgccgtgattgtgaacagaaaagagaacaaattgaaaaaagcagcaggctaccacctggacctgttctgggtgggaattctcatggctctgtgcagcttcatgggcctcccttggtacgttgcggctacggtaatttcaatcgctcatatagatagtctgaagatggagaccgagacatcggcaccaggggagcaaccacaatttctcggtgtacgagagcagagggttaccggtattatagtttttatactaactggtatctcagtgtttttagccccaatactgaaatgtatccccctgcccgtcctgtatggcgtgttcctctatatgggagtagcttctcttaacggaattcagatgggcactggtggctccgaattcaaaatccagaaaaagctcacacccttttgggagcgctgtaaattattcctaatgcccgcaaaacatcaacctgaccacgcgttcttgagacatgtgcctctccgtcgaatccatctattcacgctggtgcaaatcctgtgtttggccgtgttgtggatactgaaatctaccgtagctgcgataatttttcctgtgatgattctcgggcttattatcgtccggagactgcttgactttatcttcagccagcacgacctggcctggatcgacaatatcttaccggagaaagaaaagaaggaaaccgataagaaaaggaaaagaaagaagggagctcacgaggactgtgacgaggagcctcagttccccccacccagcgtcatcaaaatccccatggagagcgtacaatctgacccacaaaatggaatccactgtatcgccaggaagcgctcaagctcatggtcttatagtttgtag

SEQ ID NO: 241604 - DNA, 3366 bp, Artificial Sequence
  Description of Artificial Sequence: Synthetic coding sequence
atgaaggtaaaagaagagaaggctggggtgggtaagctggaccacactaaccatcgaagacgctttcccgatcagaaggagtgcccgccaatacatattgggctccccgtgcccacttatcctcaacgcaaaaccgaccagaaaggacacctctctgggctgcagaaagtgcactggggattgagacctgatcagcctcagcaggagcttacgggtcccggatctggggcttcttcccaagactcatcaatggacctcatctcaagaactcggtcgcccgcagccgaacagttgcaggatattctgggggaagaggacgaagcacctaatcccactctgttcactgagatggacaccttgcagcatgacggcgaccagatggaatggaaagagtccgcacggtggatcaaattcgaggagaaagtggaagagggcggagaaagatggagtaaaccgcacgtcagtaccctgagtctgcactctctctttgaactcagaacttgcctgcagacaggaacagtgctgctggacctggactccggttcattgcctcagattatcgatgatgtgatcgagaagcagatcgaggacggacttctgcgcccagagctgagggaacgcgttagctacgtgctccttcgtcggcaccggcatcagacaaagaaaccaattcatcgcagcctggccgatatcggcaagagtgtgtcaacgaccaaccgatcacccgctcggtcgcctggcgctgggccatcacttcaccattccactgaggacctgagaatgagacagagcgctaactacggtaggctctgccacgcacaaagccggagcatgaatgatatcagtctcacaccaaataccgatcagaggaagaacaaatttatgaagaagatcccaaaagacagcgaggcctcaaatgtcttggtgggcgaagttgattttttggatcaaccctttatagcctttgtaaggcttatccagtctgccatgcttgggggagtgaccgaagtcccggtgccaacaagattcctgttcattctactggggccaagtggaagagccaaatcctacaacgaaatcggtcgggcaatcgcaacgctgatggtggatgaccttttctcagacgtcgcttataaagccaggaaccgggaagatttaatcgccggtatcgacgagtttttagacgaggttattgttttgccaccgggagaatgggaccccaacatacgaattgaaccgcctaagaaggtgccgtcagctgacaagagaaagtccgtgtttagtctggccgaattaggccagatgaatgggagcgtggggggtgggggaggggcacccggaggtggcaacggcggtgggggtggcggaggctccggtggtggggctgggagcggcggagccggaggtacctcatctggtgacgacggtgaaatgcctgccatgcacgagatcggggaggagctcatctggacagggcgattcttcgggggtctgtgcctagatatcaaacgaaaattgccatggtttccctcagatttctatgatggctttcatattcagagcatctccgctatcctattcatatatctgggctgcatcacaaacgccattacctttgggggactcctgggcgatgctacggataactatcaaggggttatggagtcgttcctcggtaccgccatggccggaagtctgttttgccttttcagtggccagccacttataatcttgtcgtccacagggcctatcctgattttcgagaaactgctgttcgactttagtaaaggaaacggcctggattatatggagtttcgcttatggattggattgcacagcgcagtgcagtgccttatcctcgtggcaaccgacgcaagctttatcattaagtacattacacggtttaccgaggaagggttcagcacattgatctcctttattttcatctacgatgcaatcaagaaaatgatcggagcgtttaaatattaccctattaacatggactttaagccaaacttcatcaccacttataagtgcgaatgcgtggcgccagataccgtcaataccacggtatttaacgcgagtgctcccctggcacctgacacaaatgcatccctgtataaccttctaaacctcacggccctagactggtccttactcagtaagaaggaatgcctgtcttatggaggccgactcctagggaattcttgcaagtttattcccgatctagcgctgatgtctttcatcctgttctttggtacctactcgatgaccctgacactgaagaagttcaagttttcgcgctacttcccaactaaggtgcgagcattagtagctgattttagcatagtgttctctatcttgatgttttgtggcatcgacgcctgcttcggcctagagacacctaagctgcatgtgccatctgtaataaaacctacaaggccagataggggatggttcgtcgcacctttcggaaagaacccttggtgggtataccctgcctctatcctgcctgcccttctggtgaccatcctcatctttatggaccagcagataacagccgtcatcgtgaacagaaaggagaataaactgaagaaagctgccggttaccatctggacctcttttgggtcggtatcttaatggctctctgttccttcatgggcctcccatggtacgtggctgccactgtgatatctatagcccacatcgattcgctcaaaatggagacagagacctcggcacccggagaacaaccgcagttcctcggggtccgggagcagcgggtgactggcattatagtgttcatcctgaccggcatcagtgtgttcttagccccaatattgaagtgtatcccgctgcccgtgctgtacggtgtcttcctgtatatgggcgtggcttcactgaacggaatccagttttgggaacgctgtaaattgtttctaatgccagccaagcatcagcccgaccacgcattcctccggcacgttcccctccgaagaatccatttgttcaccctggtccagattctgtgtttggccgtcctgtggatccttaagagcactgtcgcagcgatcatatttcctgtcatgatactgggactgattatcgtccgacggctgcttgacttcatcttctcacagcatgatttggcctggattgacaacatcttgcccgaaaaggagaagaaagaaaccgataagaagcggaagcgcaagaagggcgcacatgaagactgtgacgaggagccccagtttccacccccaagcgtaatcaagatccccatggaatccgtccagtccgacccccagaacggaattcattgtattgccaggaagcgatcctcaagctggtcatactctctttag

SEQ ID NO: 241605 - DNA, 2982 bp, Artificial Sequence
  Description of Artificial Sequence: Synthetic coding sequence
atgaaggttaaagaggagaaagcaggagttggaaaactggatcacacaaatcatagacggaggtttcccgaccagaaggagtgccccccaatacacataggtctccccgtgccaacatatcctcagcgcaagaccgaccaaaagggccacctgagtggcctgcagaaagttcactgggggctgcgccctgaccaaccccagcaggagctgacaggtcctgggagtggggctagtagccaggatagttcaatggatctgatctccaggactcgaagtcctgctgccgaacagcttcaggacattcttggagaggaggacgaagcaccaaaccctacccttttcacagaaatggacaccttgcaacatgatggggatcagatggagtggaaagaaagtgcaagatggattaaatttgaagagaaggtggaggaggggggagagagatggtccaagcctcatgtgagcacactgtccctgcactccttgttcgaactgaggacttgtctgcagactgggaccgtcctcctagatctggactctggttccctcccccagatcatcgatgacgtgatagaaaaacagatcgaggatggactcctgaggcctgagctccgagagcgcgtttcctatgtactcctgaggcggcaccgacaccagaccaagaagcccatccatcgctctctggccgacattggaaaatcagtgagtacaaccaaccggagtcctgcccgttcacccggagcaggaccttctttgcaccatagcacagaggatctgaggatgcgtcagagtgcgaactacgggcgattgtgccacgctcaaagccggtcgatgaacgatatctcccttactccaaacacagaccagcggaagaacaagtttatgaaaaaaattcccaaagacagcgaggcctccaatgtgctggttggtgaggtggacttcctcgatcagccgttcattgcctttgtgcggttgattcagagtgccatgctgggcggagtgaccgaagtgccggtgccgacacggtttctgtttattctactgggtccatcaggacgagctaagtcttataatgagatcggcagggccattgccactctcatggttgatgacttattctccgacgttgcctataaagccaggaatcgcgaggatttaatcgctgggattgacgagttcctggacgaagtgatcgtccttcctccaggggagtgggatcccaatatcaggatcgagcctcctaaaaaagtgcctagtgccgataaaaggaaaagcgtcttcagcctggctgagcttggtcaaatgaacggaagcgtgggcggaggtggcggagcgcctgggggtggcaatggcggtggtggcggaggcggttctggcggaggcgcaggaagcggcggagccggaggaacctcctctggagatgatggcgaaatgcccgctatgcatgagatcggtgaagagctcatttggaccggcaggttttttgggggattatgcctagatatcaagaggaagctgccatggttccccagtgatttctacgatggctttcacattcagagtatatccgccatcctgttcatctacctcgggtgcattacgaacgcaattacctttggaggtttgctcggagacgccactgataattatcaaggcgtcatggagtcattcttaggaacagctatggcaggatcactgttttgcctcttttccgggcagccgctcatcatactgtcttctaccggtcccatcctgatattcgaaaagctgctgtttgacttcagtaaggggaacggacttgattatatggagtttcgactgtggattgggctccactccgccgtgcagtgcttaattctggtcgccacagatgccagtttcatcatcaaatatatcaccagatttactgaggaaggcttcagcactctgatctctttcatcttcatctatgacgccattaagaagatgattggcgcttttaaatattacccgatcaatatggattttaagcctaacttcatcactacctataagtgcgagtgtgtggcccctgacacagtgaatactactgtctttaatgcatctgctcctctggctccagataccaatgctagcttatacaatctcttgaacctgaccgctctcgactggtcgctgctgtcaaaaaaagagtgtctcagttatggcggtcggttgctcgggaactcctgcaagtttatcccagacttagctcttatgtctttcatcctgttctttggcacgtacagcatgaccctgaccctaaagaaattcaaattctcccgctatttccctacaaaggtacgagccctggtcgctgattttagtattgttttctccatccttatgttctgcggaattgacgcgtgctttggcctggaaacgccaaaactgcacgtgccgagcgtgattaagccaacacgacccgaccgcggttggtttgtcgccccttttgggaaaaatccttggtgggtgtaccccgcttctattctacccgcactcctggtcaccatccttattttcatggatcaacagataactgccgtaatagttaatcgcaaagaaaacaaactcaagggcaccgagtcaaacaggcaccataggctccaccccgatgggaacttgtgcctgccaggctcccacccgaaagtgtacccgccagccggagctgtaagatcccttccactccatggaagaggtctgccagagtggcacccagtgctgggcaccctacaggccctgcccgacgcttcccaggcacccgctggcccatgcctgcctgccgcaagggctgcagcacctgaccctccgcttcaccctggggctgaccccctgccaggaggagcattggacccccagatccatggcggatgccatcacttgccaggccacgacccaggtccacatcacagatccaaggcatctggatttcatctgttccctgcacgacctgggctggattag

SEQ ID NO: 241606 - DNA, 2895 bp, Artificial Sequence
  Description of Artificial Sequence: Synthetic coding sequence
atgaaggtgaaggaggagaaagccggagtcggcaaattagaccacacaaaccatagacgcagattcccggaccaaaaagagtgtcccccaatccacattgggctgccagttcctacctaccctcagcggaagacggatcagaagggccacctgtctggactccagaaagttcactggggactccgtcctgatcagccacagcaggagctcaccggacccggatccggcgcatctagtcaggacagcagcatggatttgattagtcggacccggtcaccggcagcagagcagctacaggacatcctgggagaagaggatgaagcccctaaccctactctgtttaccgagatggacaccctgcaacacgacggcgaccagatggagtggaaagaaagcgccagatggattaagttcgaggagaaggtggaggagggcggagagcggtggtcaaagccgcatgtctctacattgtcactgcacagccttttcgagctgcgaacatgcctccagaccggtactgtgctgcttgatctggacagtgggagtctcccgcaaataattgatgatgtaatagaaaaacaaattgaggatggattgctcagacccgagttgagggaaagggtttcttatgtcctgcttaggcgccataggcatcagacaaagaaacctatccaccgcagtctggctgacatcggcaagtccgtgtcgactactaataggagcccggcacgctcacccggagcaggcccttccctccaccattctacagaagatctacgtatgcggcaatcagcgaactacggtcgcctgtgccacgcgcagtcaaggtcaatgaacgatatctcgctaactcctaatacagatcagcgtaagaataaattcatgaaaaaaatccctaaagacagcgaagcaagcaatgtgctggtgggagaagtcgattttttagaccagccattcatagctttcgttaggctcattcagagtgccatgcttggaggcgtgactgaggtgcctgttcctacaagatttctgttcatacttctgggtcccagtggccgagccaaatcttacaatgaaataggacgcgcaatagccacacttatggtggacgacttgtttagcgatgtggcatataaagctagaaacagggaggacctgattgcaggtatagatgagttcctggacgaagtgatcgtcctaccgccaggcgaatgggatccaaatattagaatcgagcccccaaagaaagtgcctagcgcagacaagcggaaatccgtgttttcacttgccgagctcggacagatgaatgggtcagtcgggggtgggggtggcgcaccagggggtggaaatggagggggtggaggaggcggttcaggaggcggagcaggtagcggaggagctgggggaacatcatcaggagatgacggggaaatgcccgctatgcatgaaattggcgaggagctaatctggacagggcgattctttggcggactgtgcctcgacatcaagcggaaacttccttggtttccgtcagatttctatgacggattccacattcagtcgattagcgccatcctgttcatttatctcggttgcataaccaatgctatcacctttggcggtttgctaggtgatgccactgataactaccagggcgtaatggaaagttttctcggaaccgctatggcaggctcactcttttgcctttttagcgggcagcctttaattattttatcttctacggggccaatactgatcttcgagaaacttctcttcgatttcagtaaaggaaacgggctggactacatggaattccggttgtggataggcctgcactcagccgtgcagtgcttgatcctggttgctactgatgcctccttcatcataaaatatatcacccgctttaccgaagaagggttcagcaccctgatttccttcatcttcatttacgacgctatcaagaaaatgataggggctttcaagtattatcccatcaatatggacttcaagcctaatttcataaccacctacaagtgtgagtgcgtggctcctgacacagtgaataccacggtctttaacgcttccgctccactagccccagacacgaacgcttccctctataatctgctcaacttaactgcccttgactggagcctcctcagcaaaaaggagtgtttatcttacgggggtaggctgttggggaactcctgtaagttcattcccgacttagccttgatgagttttatccttttttttggcacctacagtatgacactgacacttaaaaaatttaaattctcaaggtactttcccacaaaaccgacaagacctgatcgcggatggtttgtggccccatttgggaagaacccatggtgggtttacccagcttcaatcctgccagccctgcttgtcactatcctgatcttcatggaccaacagatcactgccgtcattgtgaacaggaaagaaaacaaattgaaaggtacggagtcgaatcggcatcaccgtttgcaccccgatggcaacctctgcctaccaggctctcaccccaaggtttatcctcctgcaggcgcagtcagaagcctccctctgcacgggagaggactgcctgaatggcaccctgtgctgggtactctgcaggctcttcccgatgcgtcacaagcccctgctgggccatgtctcccggctgcccgtgcagctgctcctgaccctccactgcatcctggagcagatccactgccaggaggagctctggacccccagatccatggtggttgtcaccatcttcccggtcatgtgtccctccatcacagaagctgggctagctcctcgttcgaggggttctggatcagtagctttccttctaccacatggcctggactcaccacttcgtag

SEQ ID NO: 241607 - DNA, 390 bp, Artificial Sequence
  Description of Artificial Sequence: Synthetic coding sequence
atgaaagtgaaggaagaaaaggccggagtaggaaagcttgaccataccaatcatcggagaagattccccgaccaaaaggaatgccccccaattcacatagggctcccggttccaacatatccccagcgtaagacagatcagaaggggcacttgagcggactccagaaggtccactggggcttaagaccggatcagcctcaacaagaactgactggacccggtagcggtgcaagttctcaagatagttctatggacctgatttcgaggacacgctcacccgcagcagagcagctgcaggatatcctgggtgaggaggacgaagcccctaatcctacactctttaccgagatggacacgctacaacacgacggagaccagatggaatggtag

SEQ ID NO: 241608 - DNA, 438 bp, Artificial Sequence
  Description of Artificial Sequence: Synthetic coding sequence
atgaaagtcaaagaagaaaaggccggtgttggcaaattggatcataccaaccaccgtcggaggtttcctgaccagaaagagtgcccccctattcatataggcttacccgtacccacatatcctcagcggaaaactgaccaaaagggccatctgagcggtctgcagaaggtgcattgggggctgagacctgatcagccgcaacaggagctcaccgggccagggtctggcgcatcttcacaggattcttctatggacctgatttcaaggacacggagtcccgctgccgagcaactgcaagatattcttggggaggaagacgaggcacccaaccccactctgtttacagagatggataccctgcagcacgatggcgaccaaatggaatggaaagagtctgcaagatggatcaaatttgaggagaaagtcgaggaaggttag

SEQ ID NO: 241609 - DNA, 3429 bp, Artificial Sequence
  Description of Artificial Sequence: Synthetic coding sequence
atgaaggtgaaggaggagaaagctggcgtaggaaagctggaccacactaaccatcggaggcgtttccccgaccaaaaggaatgccctcccatccacatagggttaccagttcctacttatccacagcgaaagaccgatcagaagggacatctgagcggactgcagaaagtacattggggcctccggcctgaccagcctcagcaggaactaacagggcctggtagcggggcatcatcacaagatagcagcatggacctcatcagcaggacccgctctcctgccgctgaacagctgcaagatattttgggggaggaggacgaggcccctaaccctactctgtttactgaaatggatacgctgcagcatgatggggatcaaatggaatggaaagagtcagcccgatggattaagttcgaggaaaaagtagaggaaggcggagaaagatggtccaagccacacgtgtccaccttatccctacacagcctgtttgaactgagaacctgtctgcagacaggaactgtgctgctggacctagactcgggctctctgccccaaataattgatgacgtgattgaaaaacaaatcgaagacggcttacttagaccagagctccgcgagcgggtgtcatacgtgctcctgcgcaggcacagacatcagacgaagaagccaattcatcggtcattggccgatatcggaaagtccgtgtctactaccaatcggagccccgcacgctctccaggcgcaggcccatccttacaccattcaaccgaggacctgcgcatgcggcagtcagctaattacggtcgcttatgtcacgctcaatcccgaagtatgaacgatatctcattgactcccaacacggatcagagaaagaataaattcatgaagaaaatccccaaagactcagaggcatccaatgtgcttgtgggcgaagtggactttctggaccagccctttatcgcatttgtgcggctgatacagtctgcgatgcttgggggagtgaccgaggtgcctgttcctaccaggtttctttttattttgctcggtccctctggtcgggctaagtcatacaatgagattgggagggccatcgctacgctcatggttgacgacctattttcagacgtcgcttataaagcacgcaatagagaagacttgatcgccggtatcgacgaatttttggatgaagttatcgtactccccccaggggagtgggacccgaacatacgcatcgaacccccaaaaaaggttccatccgccgataaaagaaaaagtgtgttttcactggcagaactgggtcaaatgaacggcagcgtcggaggtggaggtggggcacccggtggaggaaatggaggcggtggaggtggagggagcgggggtggggctgggtccggcggagcaggaggcacttcgagtggggatgacggcgaaatgcccgcaatgcacgagatcggggaagaattgatttggactggaaggtttttcggtggcctctgcttggatataaagcgtaagctgccatggttcccctctgacttctacgacggatttcacatccagagtatttcagctattctgttcatatacctaggctgtatcactaatgcaatcactttcggaggcttgctgggcgacgccaccgacaactatcagggcgtgatggagagctttctggggactgccatggcgggttcgcttttttgtctctttagcggtcaacccctgattatactcagctctacaggccctatcctgatcttcgaaaagcttcttttcgacttctctaaagggaatggactcgactatatggagttcagactctggatcggccttcattctgccgttcagtgtctaatcctcgtggccacagatgcaagcttcatcattaagtacattacacgcttcacagaagaagggttctctacactgatcagctttatcttcatatatgacgctataaagaagatgatcggagccttcaagtactacccgatcaacatggacttcaagcccaacttcattaccacatataagtgcgaatgtgtcgccccagacacagtgaacacgacggtcttcaacgcttcagcccctcttgcacctgacaccaacgcatccctgtataacctattaaaccttacagctctggactggtcattgctgagcaagaaggagtgcctcagttacggaggccgattattggggaactcgtgcaaatttattccggacctcgccctcatgagctttatcctgttttttggtacctactccatgaccctcactctcaagaagttcaagttttctaggtactttcctaccaaagtcagggctctggtagcagacttctccatagtcttctctatccttatgttctgcggcatcgatgcctgctttggcctggagactccgaagctgcacgtaccatcagtgattaagcctactagacctgacagaggttggttcgtcgcgccatttggtaaaaacccttggtgggtgtatcctgcaagtatcctgccggcactgttagttaccatccttatcttcatggaccagcagattacagcagttatagtgaatcgtaaggagaacaaacttaagaaagctgccggataccacctcgatctcttttgggtaggcattctgatggcactttgctcctttatggggttgccttggtacgtggctgcaacagtaattagcattgcacatatcgacagcttgaaaatggaaactgaaactagtgcccctggcgagcagccgcagttcctgggcgtaagagagcagagggtgactggtattattgtcttcatcctgactggcattagtgtgtttctggctcccatcctgaagtgcatccccctccctgttctgtacggcgtttttctgtatatgggagtggcgagtcttaatggaatccagatgggtaccggagggtccgagtttaaaattcagaaaaagctaaccccattctgggagagatgtaagctgttcctgatgcccgctaagcaccagccagaccatgccttcctgagacacgtcccattgcgtcgcattcacctctttacactcgttcagattctctgcctggccgtgctctggattttgaagtctactgtcgctgcaattatctttcctgtgatgtcactgtccaccaccgatctgggactgatcattgtccgcagactgctggactttatcttctctcaacatgatctggcctggattgataatattctacccgagaaagaaaaaaaagagaccgataaaaagcgtaaaaggaaaaaaggagcccacgaggactgcgacgaagagccacaattcccacccccttccgttatcaagatccccatggaatctgtccagtctgaccctcagaatggaatccactgtatagcaagaaaaaggtcatcttcttggtcctactccctgtag

SEQ ID NO: 241610 - DNA, 3645 bp, Artificial Sequence
  Description of Artificial Sequence: Synthetic coding sequence
atggaaaggtttcgcttagagaaaaaactgccgggaccagatgaagaggccgtggtggatcttgggaaaaccagctctactgttaatacaaagttcgagaaagaggagctggaatctcatagagctgtgtatattggcgtccacgtgccgttttcgaaggagtcccggcgaagacatcggcaccgtggccataagcatcaccatcgaagacgcaaggataaagagtctgataaagaggatggtcgtgaaagcccatcctatgatactccctctcaacgcgtgcagttcattctgggaacagaagacgacgacgaggagcacattccacatgatcttttcactgagatggatgaattatgttatagggatggggaagagtacgaatggaaagaaaccgcccgatggttgaaattcgaagaagatgtggaggacggcggtgaccgttggagcaagccctatgtggcaaccctatcactgcactctttgttcgaactgaggtcatgtatcctgaacggtaccgtcatgctggacatgagagcatccactttggacgagattgctgatatggtgctcgacaacatgattgctagtggtcagctagatgaaagtatacgggagaatgtaagggaggctctgctcaaaagacaccatcaccagaatgaaaagcgctttacctcgcgcatccctctggtgagatcattcgccgacattggcaagaagcactccgacccacatctgctcgaaagaaatggcgaaggactctctgccagccgccattccctccggactggtctctcagcatctaatctgagcttgaggggcgaatcccccttatcgctcctccttgggcacttattgccttcctctcgagctgggacccccgctggttcacgttgtaccacacctgtccccacaccacaaaattcgccaccgtcctcaccctcaatcagcagactcacttcccgttcatcacaggaatctcaacggcaggccccagagctactcgtgtcccctgcctccgatgacatcccgaccgtggtgattcacccgccagaggaagatcttgaggccgctctaaaaggcgaagaacagaagaacgaggaaaatgtggacctgacccctggcatcttagcctctcctcagagtgcccctgggaatcttgataatagcaaaagcggagagataaaaggtaacgggtctggtggaagccgggaaaacagcactgtggacttctctaaggttgacatgaacttcatgagaaaaatcccaacgggagctgaggcatcaaatgtgctggtaggcgaagtggattttctggagcgccctataatcgcgttcgtgaggctggcccctgctgtactgttgacagggctgactgaagtccctgtccctacacggttcctttttctactgcttggcccagccggtaaggccccacagtatcacgagattggccgatccatcgctaccctgatgacagacgaaattttccatgacgtggcatataaagcaaaagacaggaacgatctgctgtccggaatcgacgagttcctggatcaagtcacagttctaccccctggggaatgggatccctccataagaattgaaccccctaagagcgttccctcacaggaaaagagaaagataccagtgttccacaatgggagtaccccaactctgggagaaaccccaaaagaagctgcacatcatgccggaccagaactccaaagaacaggtcgcctgtttggcggacttatcctggacatcaagaggaaggcacctttctttctgtccgactttaaagacgccttaagcctacaatgtcttgcatctatcctgttcctctactgcgcttgtatgagccctgtgattacatttggcggactgttgggcgaggccacagaagggagaatctcagctattgagagcctgttcggcgctagtctgacaggtatcgcttatagtttgttcgcaggccagcctctgactattctcggcagtaccggtcccgttctcgtttttgagaaaatcctgtataaattctgtcgggactatcagctatcttacctgtcactccggaccagtattggcttgtggacttccttcctctgtatcgtgctggtcgccactgacgcttcatcactggtctgctacatcacacggttcacggaggaggcctttgcagcactcatttgcatcatctttatctacgaggccctcgagaagctttttgacttgggagaaacgtatgcgtttaatatgcacaacaatctcgacaagctgacttcatatagctgcgtttgtactgagccccctaaccccagcaacgagactctcgcacagtggaaaaaagacaatattactgcccataatattagttggaggaacctaactgtatccgaatgcaaaaagctgcgtggcgtcttcctagggtccgcctgcgggcaccatggtccttacatccctgacgtcctcttttggtgcgtgattctcttcttcaccacattttttttatcctcattcctgaagcagttcaagaccaagagatatttcccaactaaagtacgctctacaatctctgattttgctgtatttctgacaatcgtaataatggtgacaatcgattacctggtaggcgtgcccagccccaaactgcacgtaccagagaaatttgaacccacgcatcccgagcgagggtggatcatttctcctcttggagataatccctggtggacactgttgattgcagccatccctgcccttttgtgcacaattctgatctttatggaccagcagatcacagccgtaatcataaacagaaaggaacataagctgaagaagggggcaggataccacctcgatttgctgatggtaggagtaatgttgggcgtctgcagcgtgatgggcctgccttggtttgtggcagcgaccgtgctgtccatctctcatgttaattccctgaaagtggagagtgaatgcagcgctccgggagaacagccaaagttcttgggcatccgcgaacagcgagtgactggcttgatgatctttatcttgatgggcttgtcagtgtttatgaccagcgtgttgaagtttattccaatgcctgttctgtacggcgtcttcctgtacatgggggtgtcttcccttaagggaatacagctgttcgaccgtataaaattatttggaatgccggctaagcaccagcctgatctgatctaccttcgatatgtgcccctgtggaaagtccatatctttactgtgattcagctcacatgcttggtgctgctgtgggtcattaaagtgtctgcagcagccgtggtatttcctatgatggttctggccctggtctttgtgcgcaaactcatggatctgtgcttcaccaaacgcgagctttcctggcttgacgacctcatgcccgagtcgaagaaaaagaaggaagacgataagaaaaagaaagaaaaagaagaggcggaaagaatgctgcaggatgatgatgatactgtccacctgccattcgagggagggtctctgctccagatccctgtcaaagcactaaagtactcgcctgataaacctgtgtcagtgaagatctcctttgaggacgagccccgaaagaagtacgttgatgccgaaacgagcctttag

SEQ ID NO: 241611 - DNA, 2403 bp, Artificial Sequence
  Description of Artificial Sequence: Synthetic coding sequence
atggaagtggtggaagcagagaagatcgtcctgttaaccagcgctaggtttctgttcctgctacttggccctgctggaaaggcacctcagtaccacgaaatcggaaggtctattgctactctgatgacagatgagattttccacgacgtggcttataaggctaaggatagaaacgatttactgtccggcatagacgaattcttagatcaggtaacggttctcccacctggtgagtgggatcctagcattcggatagaaccgccaaagagcgtgccaagccaggagaaaaggaaaatccccgtgtttcataatggatccacccccaccctgggcgaaacacctaaggaggccgctcatcacgccggtcctgaactgcagcggaccgggaggctgtttggtggcctgatcctggatattaagagaaaggcaccctttttcttgtcagacttcaaggatgccctcagccttcaatgcttggctagtatcctattcctgtactgcgcttgtatgagccctgtgatcacgttcggtggactgctcggcgaggctacagaaggcagaataagcgccatagaatcactgtttggggctagcctgactgggatcgcctattctctgtttgcagggcagccacttactattctcggctcaaccggccctgtcttggtcttcgagaaaattttgtacaagttctgccgcgactatcagctcagctatctgtctctgcgcacttccatcggtctatggaccagcttcctgtgtatcgtgctagtggcaaccgacgcctctagccttgtttgctacatcactaggttcactgaagaagcttttgcagccctgatctgtatcatcttcatctacgaggccctcgagaagctgttcgacctgggcgagacatacgcgttcaacatgcacaacaacctggataagctgacttcatactcttgcgtttgcaccgaacctcccaacccctccaatgaaaccttggcccagtggaagaaggacaatatcacggcccacaatatcagttggcgtaacttaaccgtttcggagtgcaaaaaattacgaggcgtgtttttaggctccgcgtgtggccatcatgggccttatattcccgatgtgctcttctggtgcgtgatactcttttttacaacgttttttctgtctagctttcttaaacagtttaaaaccaagcggtatttccctacgaaggtccggagcacaattagcgacttcgctgtctttctgacgattgtgattatggttactatagactatcttgtcggcgtaccgagcccaaaactgcacgtacctgagaagtttgagcctacacacccagagagaggctggattataagccctctgggcgataacccctggtggactctgttgatcgcagccatccccgctctgctgtgcaccatcctaatttttatggaccagcagatcactgctgtgattattaatcgcaaggagcacaagctgaagaagggagccggataccacctggacctgctcatggtaggagttatgctcggggtgtgttccgttatgggcctaccctggttcgtcgcagccactgtactgagcatctctcacgttaacagcctaaaggttgaaagtgaatgtagcgcgccaggagaacagcctaagttcctgggtattagggaacagcgtgtgaccgggctgatgatcttcattctaatggggctgtcggtgttcatgacaagtgttctgaaatttatccccatgcccgttctgtacggtgtattcctgtatatgggagtgtctagcctaaaggggatccagttattcgatcgcattaaactctttggcatgccagctaagcatcaacctgatctgatctatctgagatatgtccctctgtggaaagtgcatattttcacggtgatacagctgacttgcttagtcctactgtgggtgatcaaggtgtcagccgcagcagtggtcttcccaatgatggtgttagctcttgttttcgtgcggaagctcatggacctctgcttcactaaacgtgagttatcttggctggacgacctgatgcccgagagtaagaagaagaaagaagatgataagaaaaagaaggagaaggaagaggctgaacgcatgctgcaagacgacgatgatactgtgcatcttccatttgaagggggatctcttttacagattcccgtcaaggctctcaagtattccgtcgacccaagtatcgtgaacatttccgatgagatggcaaaaaccgcgcagtggaaggcattgtccatgaataccgaaaatgccaaggtgacaagatctaacatgtcccctgataaaccggtgagtgtgaaaatctcattcgaggatgagcccaggaaaaagtacgtcgatgcggagacctcactctag

SEQ ID NO: 241612 - DNA, 1725 bp, Artificial Sequence
  Description of Artificial Sequence: Synthetic coding sequence
atggaggctgacggcgcaggagagcagatgaggcccctcttgacaaggggtcctgacgaagaagctgttgtggacctggggaaaactagtagtacggtgaatacgaaattcgaaaaagaggagcttgagagtcacagggcggtgtacattggcgtgcatgtcccattctctaaggagagccgcaggcggcacaggcacagaggacataaacaccaccacagaaggcggaaggacaaggaatctgataaggaggacggccgtgagtctccgagttatgatactccttcccaacgcgtccaatttatcctcgggacagaggatgacgatgaagaacacatcccacacgatttgttcacggaaatggatgagctgtgctatcgtgacggcgaagagtacgagtggaaggagactgcacgatggcttaagtttgaggaggatgtcgaagacggcggtgacaggtggagcaagccctacgtcgcaactctgtcccttcactcgctcttcgaactcaggtcctgcattctcaacggtacggttatgctcgatatgagagcgtctaccctcgatgaaatcgccgacatggtcctcgacaacatgattgccagtggacagttagatgagtcaattagagaaaacgtgcgcgaagccctgctaaagcgccatcaccatcaaaacgagaagcggttcacaagtcgcatccccctagtacgcagttttgccgatatcggagaaggactgagcgcaagcagacactcgctgaggaccggcctgtccgcaagtaacctgtccttaagaggcgagagtccactgtctctgctgctgggtcatcttttgccttctagcagagcaggcaccccagccggtagtaggtgtacgaccccagtccccacaccacagaattccccaccctcttcgcctagcatcagtcgattaacctccagaagctctcaggagtcccagagacaagctccagagctcttggtgagccccgcatccgatgatatccctaccgtggtcatccaccctcccgaagaggatctggaggccgcattaaaaggggaggaacagaagaatgaggagaacgtggacctcacacccggtattctggcatcaccccaaagcgctcccggtaacctggacaatagcaaatccggagagataaagggaaacggctctggcggatccagagagaatagtaccgtggacttctccaaggtggacatgaattttatgcggaaaattcctaccggcgctgaagcatcaaatgtcttagtcggcgaggtggactttctggaacgccctattattgctttcgtacgcttagccccagccgttctcttaacggggctaactgaagtaccagtccccaccagatttctgtttctgctcttgggtccagccggaaaggcaccgcaatatcacgaaattggtagatcaattgcaacactgatgacggatgagatatttcacgacgtggcttataaggctaaagatcgcaatgatctcctttcaggcattgatgaattcttagaccaggtcactgtgctcccgcctggcgaatgggatccaagcatccggatcgagcccccaaaatctgtccccagtcaagaaaagcgtaagatccctgtcttccataatgggtccaccccaaccctgggcgagactcctaaggaggctgcacatcatgctggaccagagcttcagcggacgggcagggtgcagtag

SEQ ID NO: 241613 - DNA, 3273 bp, Artificial Sequence
  Description of Artificial Sequence: Synthetic coding sequence
atggagcggttccgtctggaaaaaaaattgcccggtccggatgaggaagccgtggtggacctggggaagacctcatccaccgtgaatacaaagttcgagaaagaagagctggagtcccaccgcgctgtgtacatcggcgttcacgtccctttcagcaaggaaagtcgcagacgacataggcacagagggcacaaacatcatcacaggagacgcaaggacaaagaatcagacaaggaggacggcagggaaagtccaagttacgacactccatctcagcgcgtgcagttcatcctaggcaccgaggatgatgatgaggagcatatcccccacgacttatttactgaaatggatgagctgtgctatcgtgatggagaagagtacgagtggaaggaaactgctaggtggctgaagttcgaggaggatgtagaggatgggggagaccggtggtctaaaccttacgtggctacactttcgctgcacagcctgttcgagctgaggagctgcattctgaatggcactgtcatgctggacatgagagcttcgacgctggatgaaattgcagacatggtcctggacaacatgattgcctctggacagctcgacgagtctattagggagaatgtgagggaggcccttctgaagcgccatcatcaccaaaatgagaagcgctttacctctcgtattcctctcgtgcggagcttcgcggatatcggtaagaagcatagtgacccacaccttctggaacgaaacggtatcctggcatccccccagagcgcccctggtaacctggacaactcaaaatcaggtgaaatcaaaggtaacggaagcgggggatcgagggaaaattctacggtcgatttctcaaaagtggacatgaattttatgaggaaaattccaactggggcagaggcaagtaacgtgctggtgggagaagtggactttctagagagacctatcatcgccttcgtgcgtctggcgccagccgttctgttgacgggtctgacggaggtccctgtaccaacacgcttcctattcttgctgctgggcccagcagggaaggctccccagtatcatgagatcggcagaagtatcgctacgctcatgaccgatgagatttttcacgatgttgcttacaaagccaaagacaggaatgacctgctgtctggaattgacgaattcctggaccaagtgaccgttcttcccccaggtgagtgggacccaagtatcaggatcgagccacctaagtccgtcccctcacaggagaagcggaaaatcccagtgttccacaatggctcaacgccaacactgggagaaacgcccaaggaagcagcccatcacgccggaccagagctacaacggaccggcaggttgtttggcggactgatcctcgacattaagaggaaggcgcctttctttttgtccgattttaaggatgcgctttccctgcagtgcctcgcatcaattctcttcctgtactgcgcttgtatgagtcccgtcattaccttcggaggactcctgggagaggccactgagggtaggatctctgccatcgaaagcctgtttggagcatcactcacgggcatcgcctattcgttgttcgccggtcagccgctgactattctgggcagtaccgggcctgtgctggtgtttgaaaaaattctgtataagttctgcagagactaccagcttagttaccttagtctgcggacgtcgataggactgtggaccagtttcttgtgcatcgtacttgtggccaccgatgctagcagcctggtttgctatattaccagattcaccgaggaggctttcgctgcactcatctgcattatatttatctatgaagctttggaaaagctctttgatctgggggagacttacgcttttaacatgcacaataatctggacaagctgacctcttattcctgcgtgtgcacagaacccccaaaccctagcaatgaaacactagcgcagtggaagaaagacaacatcacggcacacaacatctcctggcggaacttgacggttagcgaatgtaaaaagctacgcggagtgttcctcggctctgcctgcgggcaccacggcccttacattccagatgtgttgttctggtgcgtcattctgttctttaccaccttctttctgtcctctttcctgaagcagttcaagaccaagagatattttccaacaaaagtgcgctcaaccattagcgatttcgccgtgtttctcacaatcgtgatcatggttaccatcgattacctcgtgggcgttcctagtcccaaattgcacgtccccgagaaatttgaacctactcatcccgaaaggggctggattatctcgcctctgggcgataacccttggtggacactgcttatagctgccatcccagcactactgtgtacaattctgatctttatggaccagcagatcactgctgtgattatcaaccgcaaagagcataagttaaaaaagggagctggctaccacctcgacctcttgatggtgggtgtcatgctgggcgtgtgtagtgtgatggggctgccgtggtttgtggcagctactgtcttgtccatatcacacgtcaactccctcaaggtggaatcagagtgtagcgctccaggcgagcagcctaagttcctcgggattagagagcagcgggtgacaggtcttatgattttcatcctgatgggtctctctgtctttatgacttccgtactaaaatttatccccatgcctgtcctctacggtgtgttcctatacatgggcgtaagtagcctgaagggaatccagctgtttgatagaatcaagctcttcggaatgccagctaaacatcagcccgatctgatatatctgcggtatgtgcctctatggaaggtacatattttcacagtgattcagctaacttgcttggtgcttttatgggtgataaaggtgagcgctgcggcagtggttttccccatgatggtgcttgctctcgtgttcgtgcgaaagttgatggatttgtgcttcaccaagcgggagttgtcttggctggatgatctgatgcccgaatcaaaaaagaagaaggaagacgataagaagaagaaggaaaaggaggaggctgagcgcatgttgcaggacgacgatgacactgtgcacctgccatttgaaggtggaagccttctccagatcccagtaaaggcgttgaagtatagcccggataaaccagtgtctgttaagatctcttttgaagacgagcccagaaaaaagtatgttgacgccgaaaccagcctctag

SEQ ID NO: 241614 - DNA, 3408 bp, Artificial Sequence
  Description of Artificial Sequence: Synthetic coding sequence
atggaggccgatggggcaggagaacaaatgcgcccactgctcacccgcgtgacctccaggggacccgacgaggaggctgtcgtagacctgggcaaaacatcttctactgtgaacactaaatttgaaaaagaggaactggagagccaccgcgctgtgtatattggggtgcatgtgcccttcagcaaagaatccagacggcgtcaccgtcatcggggacacaaacatcatcatcggcgtcgtaaggataaggaaagtgataaggaggacggaagagagtcccccagctatgacaccccatcgcagcgggtgcagtttattctcgggacagaggatgatgatgaggagcatattccccacgatctttttaccgaaatggacgagctttgctacagagacggcgaagaatacgagtggaaagagaccgccaggtggctgaaattcgaggaagatgtggaggatggaggcgatagatggtccaagccatatgtggccaccctatccttgcactccctgttcgagctgcgctcgtgtatcctcaacgggaccgtcatgttagacatgagagcttccacactggatgagatcgcagacatggtgctggataatatgatcgcctctgggcagctggacgaatcaatccgagaaaatgtcagggaggcgttactaaaaagacaccatcaccagaatgaaaaacgtttcacttcacgcatcccccttgttcggtcatttgctgacattggaaagaagcattccgacccacacctcttggaaaggaatgggatactggccagtcctcagtcagccccaggcaacctggacaactctaaaagcggagaaattaaaggtaacggatctgggggttccagagagaacagcaccgtggatttttccaaggttgatatgaattttatgaggaaaatcccaaccggagcagaggcctccaacgtgctcgttggagaagtggacttcctggaaaggccgatcattgcatttgtgcggctcgcccctgcagtcctgcttaccggcctgacagaagtgccggtgccaacccgattcctctttctcctgctgggtccagccggtaaggcgccacagtatcatgagatcggcaggagcatagcaacccttatgactgatgagatcttccacgacgtagcctacaaggccaaggaccggaacgacttattatctgggattgacgagttcctggatcaagtgacggttctgcctcccggtgaatgggacccttcaatccgtatcgagcccccaaagtctgtacccagccaagaaaagaggaagataccagttttccataacggaagtactccaacacttggcgaaactcccaaggaagctgcgcaccacgccggtcccgaacttcaaaggacaggcaggctgttcggtggtctgatcctggatatcaagagaaaagctccctttttcctgagcgacttcaaggacgcactgtcattgcaatgccttgcaagtatcttgtttctgtactgcgcttgcatgtcaccagtcattacattcggtggccttttgggtgaagccactgaggggcgtatatctgctattgaatccttattcggcgcttcacttacagggatcgcttacagtctttttgcaggccaaccactgaccatcctgggatccactggacctgtcttagttttcgaaaagattttatacaagttctgtagggactaccagctgagctatttgtcattgagaacaagcattgggttgtggacgtcatttctgtgtattgtcctggtcgctaccgacgcaagtagcttagtatgctacattacccgctttacagaggaggcctttgctgcactgatttgtattatttttatttacgaagccctggagaaactgttcgatcttggggagacctatgccttcaacatgcataacaatctggacaagctaactagctatagctgtgtctgcaccgagccccctaatcctagcaatgagactctggcccaatggaagaaggacaacatcactgcgcataatatctcctggcgcaacctcacagtgagcgaatgtaaaaagctccgcggagtctttcttgggtctgcatgcggccaccacggtccctatatcccggacgttttgttctggtgcgtcatcctcttcttcactacattctttcttagttcttttttaaagcagttcaaaactaaacgatatttcccaactaaggtcaggtccaccatatctgacttcgcggtattccttactatagtgatcatggtgacaatcgattacctggtgggcgtccctagccccaaacttcacgttccagaaaagttcgaaccaacgcatccagaacgcggatggatcatttcaccactgggcgacaatccctggtggacactgctcatcgccgctatccctgccctgctgtgcacgattctgattttcatggatcagcagatcacagccgtcatcatcaaccggaaagagcacaagctgaaaaaaggtgctggctaccacttggacctactgatggtgggcgtgatgctgggcgtatgctccgtgatgggactgccatggttcgttgccgctacagtcctctcgatatcacatgtcaattcgttaaaagtcgaaagcgagtgttcagccccaggagaacagccgaagtttttgggtataagagaacagagagtgaccggacttatgattttcatattgatgggactgtctgtgtttatgaccagcgtgctcaaattcatccccatgccagtcctgtacggagtttttctgtatatgggcgtttcaagcttaaagggtatccagctgttcgacagaattaagctttttgggatgccggcaaagcaccagcccgatttgatatatctgcgatatgttcctctatggaaggtgcacatttttacagttattcagttgacttgcttagtgcttctgtgggtgataaaggttagcgcagccgctgttgtgttcccaatgatggtactcgcgctcgtgtttgtgcgcaagctgatggacttatgttttacaaagcgggagctgagctggctggacgatctgatgcccgaatctaagaaaaagaaggaggacgataaaaagaagaaggagaaggaggaagccgaaaggatgctgcaggatgatgatgatacggtgcaccttccctttgaaggtggcagtctcttacaaataccggtgaaggcactgaaatactcagtcgacccatccatcgtgaatatctcagacgaaatggccaagacggcccagtggaaagctttatccatgaataccgaaaacgcaaaagttacccgctctaacatgagtcccgataagccagtgagcgtgaaaatcagcttcgaagatgaacctcggaaaaagtatgtggacgcggagacaagtctgtag

SEQ ID NO: 241615 - DNA, 3288 bp, Artificial Sequence
  Description of Artificial Sequence: Synthetic coding sequence
atggaggccgatggcgcaggggagcagatgagaccacttctgaccaggggcccagacgaggaggccgtcgtcgatttgggaaaaacctcgagcactgtgaacacaaagtttgagaaagaggaacttgagagccatcgcgctgtgtatatcggagttcatgtccccttttcaaaagagtcgcggaggcggcacaggcacaggggccataagcaccaccacaggagacgaaaagacaaagagtctgataaggaggacgggagagagtctccttcctacgacaccccaagtcagcgagtgcagttcattctggggacagaagacgacgacgaagagcatatcccacatgacctattcacagagatggatgagctttgttacagagacggcgaagaatacgagtggaaggagacagccaggtggcttaagtttgaggaggacgtggaggatggcggtgatcggtggagtaaaccttatgtggctactctgtcactgcactccctgttcgagctgaggagttgcatcttaaatggaaccgtgatgctggatatgcgcgcttctacactggacgaaatagctgacatggtgctcgataatatgatcgcctccggtcagctggacgagtctatcagggagaatgttagagaggcccttctcaagcgccaccatcatcagaatgagaagaggtttacaagtcgcatcccactagttagaagttttgcagatatcgggaaaaaacattccgatccacacttattggaacggaacggaattctcgcatcaccgcagtccgcacccggaaacttggacaattccaagagcggggaaatcaagggcaacgggagcggcggttccagggagaatagtacagtcgatttctcgaaagttgatatgaatttcatgcggaaaattccaacaggcgctgaggcttccaatgtgctggtgggcgaggtcgattttctggagagaccaatcattgcctttgtgcgtctggctcctgctgttctgctcaccgggctgaccgaagtcccagttcctacgcgtttcctcttcctgctcctgggccctgctgggaaggcaccccagtatcacgagattggcagaagcattgccactttaatgactgatgaaattttccacgacgtggcatacaaagccaaagaccgcaatgatctgctctccggcattgacgagtttcttgaccaggtgacagtcctgcccccaggggagtgggaccctagcattaggatcgagccccctaagagtgtgccgtcccaagaaaaacgaaaaatcccggtattccataacggctctacaccgaccttgggagagacacctaaagaagctgcccaccacgccggacctgaactgcaacgcaccgggagattgttcgggggtttgattcttgacatcaagcgcaaagcgccatttttcttatccgacttcaaagatgccctgtcactgcaatgcctggccagcatattgttcttgtactgtgcctgtatgtctcccgtgatcacattcggtggccttcttggcgaggctaccgagggtcggatatccgctattgagagcctgttcggcgcatccctgactggaatcgcgtactctctctttgccggacagccacttacaatcttggggtccactggacctgtgttagtttttgagaagattctttataaattctgccgggactaccagctgagctatttgagtttacggacttccattgggctttggacttccttcttgtgcatcgtgctcgtagcaacggatgcctcttccctcgtctgctacatcacaaggttcaccgaggaagcatttgccgcactgatttgcatcatcttcatctacgaagccctggaaaaactcttcgatctgggcgagacatacgcgttcaacatgcacaataatctcgacaaactcactagctacagctgcgtgtgcaccgaacctcctaatcctagtaatgaaaccctcgcccaatggaagaaggacaatatcacggcccacaatatctcatggcgcaatctgaccgtctctgaatgtaagaaactgagaggggtgtttctgggctcagcatgtggacatcacgggccttatatccctgatgtcctcttctggtgcgtgatactgttttttactacttttttcttgtcatcattcctcaagcagttcaagaccaagcgatattttcccaccaaggttcggagcacaattagcgattttgcagtgttcctgacaattgtaatcatggtgaccatagactacctggtcggtgtcccctcccctaagctccacgtaccagaaaaatttgagcccacccatcccgagcgtggctggattatctcccccttgggagataatccttggtggacactcctgatcgccgcaattcccgcattactgtgcacaatcctgattttcatggatcagcagatcactgccgtcatcattaaccgaaaggagcacaagctgaaaaagggagctgggtaccacctagacctccttatggtgggcgtgatgctgggggtttgtagcgtaatgggccttccttggttcgtggcagccactgtacttagcatctctcatgttaactccctgaaggtcgagtccgagtgtagcgccccaggggagcaacctaaatttctgggcatacgggaacaacgagtcaccggcctcatgatcttcattctcatgggcttatccgtctttatgacatctgtgctgaagtttatccctatgcccgtgctgtatggtgtcttcctctacatgggcgtgtcatctctgaagggcatccaactattcgacagaattaagctctttggtatgccggctaaacaccagcccgacttgatctatcttcgatatgtgccactttggaaggtccatattttcaccgtgattcagcttacctgcctggttctgctttgggttattaaagtcagcgccgcagcagtcgttttcccaatgatggtcttggcgctggtattcgtccggaaactgatggacctgtgctttacgaaacgtgagctttcatggctcgacgatctcatgccggagtcaaaaaagaagaaggaagatgacaagaaaaagaaggagaaagaagaagcggaacgtatgttgcaggacgacgatgacacagtccatttaccatttgaaggtggatctttgttgcaaattccagtaaaggctctcaagtacagtccggacaaacccgtgagtgttaagattagttttgaggatgaaccaagaaagaagtacgtagacgctgaaacctcactttag

SEQ ID NO: 241616 - DNA, 1392 bp, Artificial Sequence
  Description of Artificial Sequence: Synthetic coding sequence
atggaggcagatggggcaggcgagcagatgcggcctttactgacgcgcggaccggatgaggaggcagtggtcgacctgggcaaaaccagttcaactgtgaacaccaagtttgaaaaagaggagctggaaagtcaccgtgccgtgtacatcggtgttcatgtgccttttagtaaagagagtcgcaggcgccaccggcatagaggacataagcaccaccacagaaggaggaaagacaaggagtctgataaggaggacggacgagaaagcccttcctacgacaccccttcacagcgagttcaatttattctcggaaccgaagatgacgacgaggagcacattcctcacgacttgttcaccgagatggacgagctgtgctacagagacggcgaagaatacgagtggaaggagactgccaggtggctcaaattcgaggaggacgtcgaggatggtggagacaggtggagtaaaccatatgtggcgacactcagcctacactcactctttgagctccgctcttgcatcctcaacggcaccgtaatgttggacatgagggcatcaaccctggacgaaatcgctgatatggtgcttgacaatatgattgcctctggtcagctggatgagtcaatccgcgagaacgttagggaagctctgctgaagcgccaccatcaccagaacgaaaagaggttcacttcacggattcctcttgtccggtccttcgccgacataggcaagaagcattcagatccccacctgcttgaacgcaatggcatcctcgcttccccgcagtccgcaccaggaaatctggacaactcaaagtccggggagatcaaaggaaacggatccggtggatctagagagaactccactgtagacttttctaaggtggatatgaatttcatgcgaaagattcccacaggcgctgaggcctccaatgtgcttgtgggagaggtggatttcctggagaggcccataatagcatttgtgagacttgccccagcagtgctcctgacagggttgaccgaggtccctgtgcctacccgtttccttttcctgctgctgggccctgctggcaaggcccctcaataccacgagataggtaggtcaattgcgacactcatgacagatgagatctttcacgatgttgcctacaaggctaaagataggaatgacctgctttcagggatcgacgaatttttggatcaagtcacggtcctcccccctggcgagtgggaccccagcatccggatcgaaccgcctaagagcgttccttcacaggagaaaaggaaaatacctgtttttcacaacggttctacaccaaccctgggcgaaaccccgaaagaggccgcacaccacgctgggcctgaattgcagcgcacaggtcgggtgcagtag

SEQ ID NO: 241617 - DNA, 1725 bp, Artificial Sequence
  Description of Artificial Sequence: Synthetic coding sequence
atggaagctgacggagcaggtgagcagatgcgcccactactcacaagaggtccagacgaagaagctgtagtagatctggggaaaacctcatctacagtgaatactaagtttgagaaggaagagctcgagtcgcacagagccgtatatataggggtacacgtaccattctctaaggagtcgcggcgacgtcatagacacagggggcataaacatcatcaccggaggcgcaaagacaaggaatccgataaagaagacgggagggagtctccatcgtacgacactccatctcagagggttcagttcatcctgggaaccgaggacgacgacgaagaacatattccccatgatctctttacggaaatggatgagctctgctatagggatggagaagaatatgagtggaaggagacagccagatggctcaagtttgaagaagacgtggaggacggtggcgatcggtggagcaagccttatgttgccaccctcagcctgcactcattgttcgagttacggagctgtattttgaacggtactgtgatgcttgacatgagagcctcaactctggacgagatagctgatatggtgcttgataacatgatcgcttccggccaactagatgagtccattcgagaaaatgtgagagaagcacttctgaaacgacatcatcaccaaaacgaaaagcgatttactagtagaattccactcgtccgctcgtttgccgacataggtgagggcctctcagctagtagacacagtctgcgtactggcctctccgcttccaacctctcactgcgcggagagtcccctctgtccttactgctcggccacctactgccaagctctagggcaggcactcctgcaggttcccgatgcacaacccctgttcccacgcctcaaaattctcctccttcctcgccctcaattagtaggttaacaagccgatcttcccaggaaagccagaggcaggccccagagctgctggtgtcccccgcaagcgatgacattccgaccgtggtgatccacccccctgaggaggacctggaagctgcccttaagggcgaagagcagaagaacgaagaaaatgtggacctgacacccggtatactggcatcaccacagtctgctcccggaaatcttgataactcaaagtccggagaaatcaagggcaatggctccgggggaagcagagagaattccactgtcgacttcagcaaagtcgacatgaattttatgagaaagatccctacgggggcagaggcgagcaatgttcttgtgggcgaagtggactttctggaacggcctattatagctttcgttcggctggcaccggcagtgttgttgactggactgaccgaggtaccagtcccgaccaggttcctcttcttacttctgggtccagctggcaaggcacctcagtatcatgaaatcggcaggtctatcgccaccttaatgaccgacgaaatctttcatgacgttgcctacaaagctaaagatcgaaatgacctcctatccggaatcgacgagttccttgatcaggtgaccgtgctaccacccggagagtgggacccctccattaggatcgagcccccaaaatccgttcccagtcaagagaaacggaagattcccgtgttccacaatggttctactcctacactgggcgagacccccaaggaggcggctcaccatgccggtcccgagctccagaggacagggagggtgcaatag

SEQ ID NO: 241618 - DNA, 3741 bp, Artificial Sequence
  Description of Artificial Sequence: Synthetic coding sequence
atggaggcggatggtgctggtgagcagatgcgccctctactcacccgagtcaccagcagaggcccagacgaggaagcagttgtggaccttggaaaaacatcaagcacagtcaacacaaaatttgaaaaggaagaactcgaatctcatcgtgccgtctacattggagtccacgtccccttctctaaagagtctaggagaagacatcgccatcgcggacataaacaccatcacaggcgcagaaaagataaggagagcgataaggaagacgggcgtgaatctccatcatacgatacccctagccagagagtgcagttcatccttggaacagaagatgatgatgaagagcacattccacatgacctgttcaccgagatggatgaactgtgttacagggatggagaagagtatgagtggaaggaaacagcacgatggctcaaatttgaggaggacgttgaggacggaggagaccgctggtccaagccctatgtggcaacactgtcccttcacagtctctttgagttgagaagctgcatcctgaatggcaccgtcatgctggatatgagagcctcaactcttgacgagatcgcagacatggtgctggacaacatgatagcaagcggacaactagacgaatctatacgggaaaacgttcgcgaggcattactgaaaaggcatcaccaccagaatgagaagagatttaccagtaggattccccttgtgcgaagttttgctgacattggagaggggctgtctgcttcccggcatagcctccggaccggactttctgcatcaaatcttagcctcaggggggagtccccattaagtttgctgctcgggcacctgctgccttcttcccgagccggtacgcccgcaggcagtagatgtacaactcctgtgcctactccacagaacagcccgccttctagcccatcaatcagtcggctgactagcaggagctcccaggaatctcaacggcaggcccctgaactcctggtgagtccagcaagtgacgacatccccactgtggttatccacccaccagaagaggatctcgaggcagcactgaaaggagaagagcagaagaatgaggaaaacgtcgacctcactccgggtattctggcctccccccagagcgcacctggtaatctggataactccaaatccggtgagattaaaggtaatggctccggcggatctcgcgaaaactcaactgtcgacttttcaaaggtcgatatgaatttcatgcgtaaaattccaaccggagctgaggcgtccaacgtacttgtgggtgaagtggatttcctcgagagaccgattatagcctttgtgagactggcacccgcagttttgctgaccgggctgaccgaagtcccagtacccacgcggtttttgttcctacttcttggacctgccggaaaggcaccccagtatcacgagataggtcgttccatcgcgaccctcatgacagacgagatttttcacgacgtggcatacaaggcaaaagatcgtaacgacttattgtccgggattgatgaattcctggatcaggttacggtgctgccacccggagaatgggacccgagcatcaggatagagccacccaagtccgtgccatcccaggagaaaaggaagattcccgttttccacaacggcagcacccccaccttgggggagactcccaaagaagccgctcaccatgcgggtcccgaattgcagcgcaccggcaggctcttcggcggtttgatcttggacattaagagaaaagctccattcttccttagtgacttcaaggacgctctgagcctgcagtgtctcgcatctatcctgttcctctattgcgcctgtatgtctccagtgattacttttggcggtctccttggggaggcaactgaaggtagaatctcagcaattgaaagtttgtttggggcttccctcaccggcatcgcatattctctcttcgcaggtcagccactcacgattctcggatctactggcccagtcctcgtgttcgagaagatcctctataagttctgtcgcgactaccagttaagctatttgagtctgagaacctccattggactctggaccagttttctgtgcatcgtgcttgtggccacggacgcctcttctttagtgtgttatatcacaagattcacagaggaggcatttgctgcactcatctgcataatcttcatctatgaagctcttgagaaactttttgacctgggggagacctatgctttcaacatgcacaacaacctagacaagctgacatcatatagttgtgtgtgcactgagccccctaatccctccaatgagactctcgctcagtggaagaaagacaatatcactgcgcataacatctcgtggaggaatctcaccgtgtcagagtgcaagaaattgcggggagtcttcttgggatccgcatgtgggcaccacggaccttacatccctgatgttcttttctggtgtgtcatcctttttttcactactttcttcctgtcatcctttctcaaacagttcaagacaaagcggtattttcccaccaaagtgaggagcaccataagtgacttcgcggtcttccttaccatcgtgattatggtcaccattgattacctcgtgggcgtgccatcaccgaaattgcacgtgcccgagaaattcgagcctacacaccccgagcgcggttggattataagtcctctcggggacaatccctggtggacactgcttattgcagccatccccgctctattgtgcaccatccttatctttatggaccagcagataacagctgtcataattaataggaaagaacataagctcaagaagggagccggatatcatcttgacctactgatggtgggggttatgctgggggtgtgcagtgtcatgggattaccttggtttgtggccgcaaccgtgttaagcataagtcatgtcaacagcctcaaggtggaatctgaatgttccgcccctggcgagcaacccaagttcctcggcatccgagagcagagggtaaccggcttaatgatattcatcctgatgggactttcagtgtttatgacatctgtgctgaagtttattccaatgccagtcctgtacggggtctttttgtacatgggggtcagtagtctgaaaggaattcagcttttcgaccgaatcaaactattcggaatgcctgccaagcatcagcctgatctcatctatttaagatacgtgccactgtggaaagtccatatcttcacagtgatccagctgacttgcttggtgctgctgtgggttatcaaggtgtctgcagcggctgtggtatttcccatgatggtgcttgcgctcgttttcgtacgcaagctgatggatctgtgctttaccaagcgcgaactttcttggctggatgacctgatgcctgaaagcaagaaaaagaaggaagatgacaaaaaaaaaaaggaaaaggaggaggccgagcgaatgctgcaggatgacgacgatactgtccacctgcccttcgaggggggaagtctattgcagatcccagtcaaggcactgaagtatagcgttgacccatcgatcgtaaatataagtgacgagatggccaagacagctcaatggaaggccctatccatgaacacagaaaatgcaaaggtgactcggtccaacatgtctcccgataaacctgtgtcagtgaaaatttcctttgaagatgaaccgcgaaaaaagtatgtggatgccgagactagtctgtag

SEQ ID NO: 241619 - DNA, 3780 bp, Artificial Sequence
  Description of Artificial Sequence: Synthetic coding sequence
atggaagctgacggcgctggcgaacagatgcgcccattgttgactcgggtgactagtcgcggacccgacgaggaagccgtagtggatcttggtaagaccagctctacggtgaacacaaaatttgaaaaagaggaactggagagccatcgcgcagtatacataggggtgcacgttcctttttccaaggagtcgagacgcagacatagacaccgaggacataaacaccatcatcgacgtagaaaggataaggaatccgataaagaggacggcagagaatcgccttcctatgatactccatcccagagggtgcaattcatcctaggaacagaggacgatgatgaggaacacatcccacacgatctgttcaccgaaatggatgaactttgctaccgcgacggagaggaatatgaatggaaagagacagcacgctggcttaagttcgaagaagatgtggaggatggtggtgaccggtggagcaagccttacgtagccactctgtctctccattcattgttcgaactgagaagctgcatcctcaacggaacagtcatgctcgatatgcgtgcatccactctggacgaaatcgctgacatggtgctagacaatatgatcgcctctgggcaactggatgagagcatccgggagaacgttcgtgaagccctgctgaagcgccaccatcatcagaacgagaagaggtttacgtcgagaatcccactggtcaggagttttgccgacattggcaagaagcacagcgatccgcacttgctggaaagaaacggggaggggctgtccgcatcacggcacagtcttcgcacgggcctctctgctagtaacctcagcttgcgcggagaaagccctctctctttacttctgggccacctgctgccatctagtagagctggaactccagccggatcccgctgtacgaccccagttccgaccccacagaactcaccgccaagtagtcccagtatctccagactgacctctcggagctctcaggaatcacagcgccaggcgcctgagttactagtgtcccctgctagcgacgacatccctactgtggtgatccatccgccagaggaagacttggaggccgcactcaaaggagaggaacagaagaatgaggagaatgtcgacctgacccctggcattctcgcatccccgcagtctgcccctggaaaccttgataactccaaatcaggcgagatcaagggaaacggttccggcggtagccgggaaaactctacagtagacttctccaaagtggacatgaactttatgcggaagatccctactggagccgaggcctccaacgttctggtgggcgaggttgacttcctggaacgccctattatcgcttttgttcggctggctcccgctgtcttactgaccggccttaccgaggtgccggtgccgaccagattcttgtttctgctcctggggccagctgggaaggcaccccagtaccatgaaataggcaggagtatcgcaacactcatgactgatgaaatttttcacgatgtggcctacaaggccaaggatcggaacgacctgctttccggtatagacgagttccttgatcaggtgacggtcttaccccctggtgaatgggacccttccattcggatcgaaccgccaaagtcggtgccatcacaggaaaagcggaaaattcccgtgttccataatgggagtacccctacgttgggcgagacccccaaggaggccgcacaccacgcgggtcccgagctccagcgaacggggagattatttggcggtcttatccttgacattaagaggaaggccccattctttctatccgatttcaaagacgctctctcacttcaatgtctggcatctatcctgttcctttactgcgcttgtatgagtcccgtgattacctttggtggactgttgggtgaagccactgaggggagaatttctgcaattgaatccctgtttggcgctagcttgacgggaatcgcctacagtttattcgctggtcagcctctgacaatcctgggtagtacgggtcctgtgttggtatttgaaaagatcctctacaagttttgccgggactaccagctgtcgtatttatccctgcggacgtcaatcggactttggactagcttcctgtgtattgtgttagtcgcaacagacgctagtagcctggtctgctacatcactcgattcaccgaagaggcatttgcagccttgatatgcataattttcatttacgaagccctggaaaagcttttcgatctgggtgagacttacgcattcaacatgcacaataatttggataagctgacatcctactcttgtgtctgtaccgaaccccctaacccttccaacgagacacttgcccagtggaaaaaggataacatcacagcccacaacattagctggcggaatctcacagtgagcgagtgcaagaaactgagaggggtgttcctgggctctgcctgtggtcaccatggcccttacatccctgacgtgcttttctggtgcgtcatcttgttctttacaacattcttcctgtcttccttcctcaaacaatttaagacaaaacgctattttcccaccaaagttcggagcacaatttctgactttgccgtttttctgactatagtgataatggtgacaatcgattatctcgtgggcgtgccctcaccgaaactgcatgtgcctgaaaagtttgagccgacccacccagagagaggttggattatctctccactgggggacaatccatggtggacccttcttatagctgccatccccgcactgctgtgcacaatcctgatcttcatggaccagcagatcactgctgtcatcataaaccgaaaggagcacaaactcaaaaaaggagcgggttaccatttagatctcttaatggtaggggtcatgttgggagtgtgttccgtcatgggcctaccttggttcgtagccgctacagtcctgagcatttcccatgtgaacagtttaaaagtggaatcagagtgctcggcccctggcgagcaacctaagttcctcggcatacgcgagcagagagttaccggcctgatgatcttcattctcatgggactttccgtgtttatgacatctgtcctgaaattcatccccatgccagtcctgtacggtgtgttcctttacatgggggtgtcatctcttaagggaattcagctgttcgatcggatcaagctgttcggcatgccggcaaagcatcagcctgatctcatttatttaaggtacgtacctctgtggaaagtgcacattttcacagtaattcagcttacatgcctggtccttctttgggttattaaggtgagcgctgccgcagtggtatttcctatgatggtgctagccctggtgtttgtaaggaaacttatggacctgtgttttacaaagcgcgagcttagttggttggacgatctcatgcctgagtctaagaagaagaaggaggacgataaaaaaaagaaggagaaggaagaggccgagcggatgttgcaggacgatgacgatacagtgcacttacccttcgaaggtggcagcctattacagattccggtgaaggccctgaagtactcagttgacccgtctatcgtgaatattagcgatgaaatggcgaagactgcccaatggaaggcccttagcatgaatactgagaatgctaaagttactaggtcaaacatgagtcccgataagcccgtttccgttaagatttctttcgaggatgagccaaggaaaaaatatgttgatgccgaaacctcactgtag

SEQ ID NO: 241620 - DNA, 3396 bp, Artificial Sequence
  Description of Artificial Sequence: Synthetic coding sequence
atggaggctgacggagcgggtgaacagatgcggccacttctgacaagggggccagatgaagaggcagttgtggacctcggtaaaacctccagtaccgtgaataccaaattcgagaaggaggagctcgaaagtcatcgcgctgtgtatatcggggtgcacgtccctttcagcaaggaaagcagacgccgacatcgtcaccggggtcacaagcatcaccacaggagacgtaaggataaagagtctgacaaggaggatggccgagagtccccaagctacgacaccccttcccagagagtgcagttcatcttaggcacagaagacgacgatgaggagcatattccccacgacttgtttactgaaatggatgaattgtgttatcgggatggggaggaatatgaatggaaggaaacagctcggtggctgaaatttgaagaggacgtagaggacggaggagataggtggtcaaagccttacgtggccaccctaagtctccatagcctgttcgagctgcgatcctgtatcctgaacggtaccgtaatgctggatatgcgagcttctacgcttgacgaaattgcagacatggtgctagacaacatgatcgccagtgggcagttggatgaatccatcagagaaaacgtaagggaagctctcctgaaaaggcatcaccatcaaaacgaaaaacgattcaccagcaggatccctctggtacgtagcttcgctgatatcgggaaaaagcatagtgatccccacctactggaacggaatggtatactcgcatcccctcagagtgcccctgggaacctggataactccaagtcaggagagataaagggcaacggatccgggggatcccgggaaaactccaccgtggatttttctaaggttgacatgaatttcatgagaaaaattcctaccggggctgaggcctcaaacgtgctagtaggcgaggtagatttcctggagcgtcccatcatagcctttgtacggctggctcctgctgtgcttctgacaggactgaccgaagtcccagtgcctaccagatttctgtttctgcttctgggcccagccggaaaggcccctcagtatcacgagatcggcagatcaatagcaacactgatgacagatgaaatttttcatgatgtggcttacaaagcaaaggacaggaacgatctcctgagtgggatcgacgaatttcttgaccaggtgacagtgctgcctccgggagagtgggacccaagcatccgcatcgaacctcccaaatctgtaccttctcaagaaaaaagaaagatacccgtgttccacaatggctcaacacctactttgggcgaaacccccaaagaagccgcacaccacgcaggacccgagctacagcgaaccggcagactgttcggaggcttgattttagatattaaaaggaaggcacccttctttctgtctgattttaaagatgccctaagcctacaatgcctcgcttctatcctttttctgtactgcgcctgtatgtcccctgttatcacgtttgggggtctgttgggtgaggcaacagagggcaggataagtgctatcgagtctctgttcggcgcatcactgacgggcatagcttacagcctgtttgccggtcagcctctgacgattctgggaagtaccggacccgtgctagtcttcgaaaagatcctttataagttttgtagagattaccagctgtcatacctgtctttgcgtacatcaatcgggttgtggaccagctttctgtgcatagtcctcgtcgcaaccgatgcttcttcccttgtatgttatattacacgcttcacagaggaagcttttgccgcacttatatgcatcatctttatatacgaggccttggaaaagttgttcgacctgggtgaaacctacgcatttaacatgcataataacctggacaagctcacctcctattcctgcgtctgtacagaacctccaaatccctctaatgagaccctcgcacagtggaagaaagataatatcacagctcacaatatatcctggaggaatctgacagtgagcgaatgcaagaaattgcggggagttttcttaggttctgcctgcggtcaccacggtccgtacattccagatgtgttattctggtgtgtcatcctattttttactacctttttcttgagctccttcctcaaacagtttaaaacaaaacgatattttccgacgaaggtgcgcagcacaattagcgatttcgccgtgttcctgactattgttatcatggtcacaattgactatctcgttggtgtgcctagtcccaaactgcacgtgcccgaaaaattcgaaccgacacacccggaacggggatggatcatttcgcctctgggggataacccgtggtggacactgctcattgccgctattcctgccctactgtgtactattctgatctttatggaccaacagattacggcagtgattatcaacaggaaggagcataagttaaaaaaaggagccggataccacttggatctgttgatggttggagtgatgttaggtgtgtgctctgtgatgggactgccctggtttgttgccgcaactgtgctgtctattagtcatgtgaattccctcaaggtggagtctgaatgcagcgcacctggcgaacagccaaaatttctgggcattcgggaacagagggttaccgggcttatgatatttatccttatgggtctgtctgtgttcatgaccagcgtgctcaagttcattcctatgcccgtactgtatggagtgttcttatatatgggggtgtcaagcttgaaggggattcagctcttcgaccggatcaaactcttcggtatgcccgcaaagcatcagcctgatctgatatacctccgttatgtgccactgtggaaagtacatatttttacagtcattcagctgacgtgcctggtgctgctgtgggtcattaaggtctctgcagcagcggtggtgttcccaatgatggtcttagcgctggttttcgtgaggaagctgatggatctctgttttactaaaagggaactcagctggcttgatgacctgatgcccgagagcaaaaagaagaaggaagacgataagaaaaagaaggaaaaagaagaagctgaacgaatgcttcaggatgacgatgacaccgtccatttaccttttgagggtggttctcttcttcagattccagtgaaggctcttaaatattccgttgatccctccattgtgaacatatctgacgagatggcgaaaactgctcagtggaaggctcttagtatgaacactgaaaacgcaaaggtaactcggtccaatatgagtccggataaacctgtgtcggtcaagatttcatttgaagatgagcccagaaagaaatacgtggatgccgaaacttcactgtag

SEQ ID NO: 241621 - DNA, 1392 bp, Artificial Sequence
  Description of Artificial Sequence: Synthetic coding sequence
atggaagccgatggcgcaggagagcagatgaggcctctcttgactcgcggtcccgacgaagaggctgtggtcgatctgggaaaaacatctagcactgtcaatacgaagttcgaaaaagaggagctggagtcccatagggccgtgtacatcggcgtgcacgtgccctttagtaaagagtctcggagaagacatagacacaggggacataagcaccaccacagacgtagaaaagacaaagaaagcgataaggaagatggcagggaatccccttcctacgataccccctcgcagcgcgtgcagttcattctggggaccgaggatgacgatgaagagcatatccctcatgatctattcacagaaatggatgaactttgttaccgcgacggagaagaatatgagtggaaagagacagctagatggcttaaatttgaagaggatgtggaagatggtggcgatcggtggtctaagccttacgtggcgacactcagcctccatagcctgtttgagttaaggtcatgtatactgaacggtaccgtcatgctggacatgcgagccagcacacttgatgaaatcgctgatatggtcctcgacaatatgattgctagcggccagctcgatgaaagcatccgggagaatgtacgggaagccctcctcaagcgccaccaccaccagaacgagaagcggttcacgagccgaatcccacttgtaaggtcttttgccgacatagggaaaaaacacagcgacccccatttattggaacgaaacggcatcttggccagtccacagtccgctcccggaaacctggacaactctaaatccggggagataaaagggaacgggagcggcggatcacgggagaacagcacagtggacttctcaaaggtggatatgaatttcatgcggaaaataccaaccggggctgaagctagcaatgttctggttggcgaagttgatttcctggaaagaccaatcatcgcattcgtccgactggcccctgccgtgctcttaaccggcttgactgaggtgcctgtacctacgcggttcctgttcctgcttctcgggcctgccggaaaagctcctcaataccacgagattggtcggtccatcgctactctcatgactgacgaaatctttcatgatgtggcctataaagccaaggataggaacgacctgcttagtggaatcgatgaatttctggatcaagttactgttctccccccaggtgagtgggatccttcaattcgtatcgaaccaccgaagtctgtgcccagccaggagaaaagaaaaattcctgtgtttcataacgggtccacgcctactttgggtgaaaccccgaaggaagccgctcaccatgcgggtcccgagctacagagaacgggacgtgtgcaatag

SEQ ID NO: 241622 - DNA, 3135 bp, Artificial Sequence
  Description of Artificial Sequence: Synthetic coding sequence
atgccagccgctgggagcaatgagccagacggagtactgagctatcaaagacctgatgaagaggctgtcgtggatcaaggaggaacatcaaccatcctgaacatccactatgagaaggaggagttagagggacatagaaccctgtacgtcggcgtgaggatgccactggggagacagtcacatcgacaccacaggactcatggccagaagcacagacggagaggccgaggcaagggcgcttcacaaggcgaagaaggactagaggctctagcccatgatacgccatcgcagagagtgcagtttattctgggcacggaagaagacgaggaacacgtgccccacgaactgtttaccgagttagatgagatatgcatgaaagagggcgaggatgcagagtggaaagaaactgcaagatggctgaaattcgaagaggatgtggaggacgggggtgagaggtggagcaaaccttatgtggctaccttatcgctgcactcactgttcgagctgcgctcttgtttgataaacggcaccgtcctgctggacatgcatgctaacagcatcgaagagatttcagacctgatcctggaccagcaggagctgagttccgacctgaatgatagtatgcgggtgaaggtgagagaggcgttgttgaagaagcaccatcaccagaacgaaaagaagagaaataacctcattcccattgtgcggtctttcgctgaagtaggaaagaagcagtccgatcctcatcttatggacaagcatgggcaaaccgtgtcacctcagtcagtgcccactactaatttagaggtcaaaaacggggttaattgtgagcactcgccagtggacttgtccaaggtggacctgcactttatgaaaaaaatacctaccggggcagaggccagcaacgtcctagtgggagaggtggatattttggaccgcccaatcgtcgcgtttgtgagattatcccctgcggtcctcctgtcaggtctgactgaggtgccaatcccaacccgcttcctcttcattctgctaggccctgtgggaaagggccagcagtatcacgaaattggcagatccatggcaaccattatgacagatgaaatatttcacgacgttgcctataaggcaaaagaacgcgacgacctactggccggtattgatgaattcttagatcaggtcacagtgcttccaccgggtgaatgggatccctccatcaggattgaaccacctaaaaacgtccccagccaagaaaagcggaagatgcccggagtgcctaacggaaatgtttgtcacatcgagcaggagcctcatggaggtcactctggaccagagctccagcggaccggcaggctgtttggcggtttggtgttagatatcaagagaaaagctccttggtactggtcagactatcgtgacgccctgagcctccagtgtctcgcttccttcctatttctatactgtgcatgcatgagcccggtgatcactttcggcggactcctgggagaggcaacagaaggcagaatctctgccattgaatccctgttcggagcttctatgacaggaattgcttattctctgttcgccggacaggctctcaccatattaggcagcactggacccgttctcgtgttcgagaaaatcttgttcaaattctgtaaagactacgcccttagctacctgagcctgcgcgcatgtattgggctgtggacggcttttctgtgcattgtgcttgtggctaccgatgcttcttcccttgtgtgctatatcactagattcactgaagaggccttcgcaagtttgatctgtatcatcttcatttacgaagcaattgaaaaactgatccaccttgccgagacatatccaatacatatgcacagccagctggatcacctctccctgtattattgccgatgcactctccccgaaaatcctaataaccatacacttcaatattggaaggatcataacatcgtgacagccgaagttcactgggcaaacctgaccgttagtgaatgccaagagatgcacggcgaattcatggggagcgcgtgtggacatcatggcccatatacaccagacgtgctcttttggagttgtatactgttctttacgacctttatcctcagctccactttgaaaactttcaagacaagcagatacttcccaactcgagtgcggtccatggtctccgattttgctgtattcctgaccatctttacaatggtgatcatcgatttcctgatcggcgtcccctcaccgaagcttcaggtgccctcagttttcaaacccacccgggatgataggggatggatcatcaacccgatcggccctaatccttggtggacggttatagccgcaataatccccgctctgctgtgcaccatattgatcttcatggatcagcaaattaccgcagtgatcataaaccgcaaggagcacaagctgaagaaaggatgtggctatcacctagacctcttgatggtggccattatgttgggggtgtgcagtattatgggtctgccttggtttgtagccgcaacggtgctgtccattacacatgtcaattctctcaaactggaatctgagtgttccgctcccggagagcaacccaaatttcttggcattcgggagcagcgcgttacgggcttgatgatttttgtgctcatgggctgctctgtgtttatgacagctatcttaaagttcatacccatgccagttctctatggtgtatttttgtacatgggagtgagcagcctgcagggtattcagttttttgacagactgaaactctttggtatgcccgcaaagcaccagcccgacttcatctatcttcggcacgtgcccctcagaaaagtgcacctgttcaccctcatacaactgacctgtctggtcctgctgtgggtaatcaaagcctcgcctgcggctatcgtcttccccatgatggtactagcactggtctttgtgcgaaaggtgatggatctctgtttcagtaaaagagagctgagctggctcgatgacctgatgccagaaagcaagaagaagaagttagatgacgcaaagaagaaggctaaagaggaagaagtcattgttctggctccaacggtgtacctcggggcatcaaactataggacctag

SEQ ID NO: 241623 - DNA, 3216 bp, Artificial Sequence
  Description of Artificial Sequence: Synthetic coding sequence
atgtttaacaaaaacaacagcaacaagctccgctccacacctagataccggcgaggggaccctgggtacttgaatttcaccgagctagggcctctgaagcctgagcaaaaagaccaatggagccagcaccgtcctgacgaggaggctgtggtggatcaagggggaacctccacgatattaaacattcactacgagaaagaagagctcgaggggcacaggacactttatgtgggcgttagaatgcctttgggcagacagagccataggcaccaccgcacccacggccagaagcacaggaggcgcggtcggggtaaaggagccagccagggtgaagagggcttggaggccctggcacacgacactccgtctcagagggttcaatttatccttggaaccgaggaggacgaagagcatgtcccacacgaactgttcactgaactggacgagatttgtatgaaggaaggcgaggacgccgaatggaaagaaactgcgagatggctgaagttcgaagaggatgttgaagatggcggtgagcggtggtcaaaaccttatgtggctaccttaagtttgcatagtttgttcgagctgcgctcctgtcttattaacgggactgtgctgctggacatgcacgcaaattctatcgaggaaattagcgaccttatactggatcagcaggaactcagctcagacttaaacgattctatgcgggtcaaggtgcgcgaggccctcctcaagaaacaccaccaccaaaacgagaaaaaacgtaacaatctcattccaatcgtccggtccttcgctgaagtcggtaagaaacagtccgacccacatcttatggacaagcacggtcagaccgtgtctccacagtcagtgccaacaacgaacttggaagtcaaaaatggagttaactgcgaacatagccccgtcgacctgtccaaggtagatctacatttcatgaaaaagattcctactggcgctgaggcatcaaacgtactggtgggcgaggtcgatatcttggataggccaattgtggcgttcgttcgcctttctcctgccgtgctcttgtcaggacttactgaggtccctatccccacacggtttcttttcatactgctgggcccagtcggtaagggccagcagtatcacgagatcggtagatccatggcaactatcatgacggatgagatatttcacgacgtcgcgtataaagccaaagaaagggacgacctgttagccggaattgatgagtttctagaccaagtcacagtcctcccacccggagaatgggacccctctatacgaatcgagcctccgaaaaacgttccaagccaggagaagcgcaagatgccaggagtccccaacgggaacgtgtgccacatcgagcaggagccccacgggggtcactccggccctgagcttcagcggacagggagactgttcggcggtctcgtgctggacattaagcgaaaggcgccttggtattggtctgactacagagatgcgctatccctgcagtgccttgcctccttcctctttctgtattgcgcctgtatgagccccgtgattacattcggtgggcttttgggcgaggcgactgaggggagaattagcgcaatcgaatcgctgttcggggcatccatgacaggcattgcttattctctctttgctggacaagccctgacgatcctcgggtctacaggccctgtgctagtgttcgagaaaatactgtttaagttttgcaaggattatgctctctcatatctgtcactgcgcgcttgcataggcctctggacggcattcctgtgtatcgtcctagtggctaccgacgctagcagcttagtgtgttacatcactcgttttacagaggaggcattcgcctccttgatctgcatcatcttcatatacgaggcaatcgagaagttgatccacttggcagaaacctaccccattcatatgcactcccagttggaccacctttcgctttattactgccgatgtactctccctgaaaatcctaataatcacacactgcagtattggaaagaccataacattgtgaccgcggaagtccattgggcaaatctcacagttagcgaatgtcaggagatgcacggtgaattcatgggcagtgcctgtgggcaccacggaccttacacgcccgacgtgctcttttggagttgcatactctttttcacaacattcatcctgtcgagcactctcaaaacttttaagactagccgttattttcccaccagagtaaggtccatggtaagcgatttcgcggtgttcttgacaatctttactatggtgatcattgactttctgataggagtaccttctcccaagctgcaagtgcccagcgtttttaagcccaccagggacgatcggggatggataatcaaccctatcggtcccaatccatggtggaccgtcattgccgctataatccccgctcttctatgcaccatcctgattttcatggaccagcaaataacagctgtcattataaaccgcaaggaacacaagttaaaaaaaggctgtgggtatcatctggatttgttgatggtggcaataatgctgggcgtttgctccattatgggtttaccatggttcgtggccgctacagtcctttccataacgcatgtgaactctctgaagctcgagtctgagtgttctgcacccggagaacaacccaagttcctggggattcgggagcagagggttaccgggctcatgattttcgtgctaatggggtgctcggtgtttatgactgcaatactgaagtttatccctatgcccgtattgtacggtgtgtttctttacatgggagtgagctccctacagggcatacaatttttcgaccgcttaaaactcttcggcatgcccgcaaagcaccagccggattttatctacctcaggcatgtgcctctccgcaaggtgcatctctttaccctcatccagttaacctgccttgtgttactctgggtgatcaaagctagccccgctgctattgtgtttcccatgatggtgctcgccctcgttttcgtcagaaaggttatggacctgtgcttttcgaagagggagctatcctggctagacgatctgatgcccgaaagcaagaagaaaaagttggatgatgcgaagaagaaggctaaagaggaggaggtgattgtattggcccctaccgtttacctcggcgcaagcaactacaggacgtag

SEQ ID NO: 241624 - DNA, 2244 bp, Artificial Sequence
  Description of Artificial Sequence: Synthetic coding sequence
atgcctctcggcaggcagtcccacagacaccaccgtacacacgggcagaagcacaggcgccgtggccgtggtaagggtgcctcccagggcgaagaaggtctcgaggcgctggcccacgacactcctagtcagcgagtccagtttattttgggtacggaggaggacgaggaacacgtgccacacgagctgttcacggagctggacgaaatctgtatgaaagaaggagaagatgctgaatggaaggaaacggcccgatggctcaagtttgaagaggatgtcgaagacggaggagaacgatggtccaagccttacgtggctaccctcagcttgcactctctttttgaactgagaagttgccttatcaatggcacggtcctccttgacatgcacgccaacagcatagaggagatttccgatttgatcctcgatcaacaagagctttctagcgacctgaatgactcgatgagggtgaaggtgcgggaggctctgctgaagaagcaccatcaccagaacgagaagaaaagaaataacctcattccgatcgtcaggtcgttcgccgaggtaggaaagaagcagtccgacccccacctcatggataaacacgggcaaactgtttctccccagtcagtgcccaccaccaatctggaggtgaaaaatggagtgaattgtgaacatagtcccgtggacctgtccaaggtggatctccacttcatgaaaaaaatcccaactggggcagaagcctctaatgtactagtcggggaggtggatattcttgacaggccaatagtcgccttcgttcgcctgtcacccgctgtactgctgagtggtctgaccgaggtgcccatacctacacgcttcctgttcatactgctgggccctgtgggtaaggggcagcagtatcatgaaattggtagaagtatggccaccataatgactgatgagatctttcacgacgtggcttataaggccaaggagcgggacgatctgctggccggaattgacgagtttctggatcaggtcactgtgctgcccccaggggaatgggatccttctatccgtatagaacctccaaaaaacgtgccttcccaggaaaagaggaagatgccaggtgtccctaatggcaacgtgtgccacattgaacaggaaccccatggaggtcatagcggcccagagctgcagcgcacgggccgtctcttcgggggtttggtgcttgacattaaacggaaggcgccttggtactggagcgattaccgggacgcgctctccctgcagtgtctcgcaagttttctcttcctctattgcgcctgtatgtcacccgtcatcacattcggcggactgctgggggaggctactgaaggaaggataagcgccatcgaaagcttgttcggagcctccatgaccggtattgcctattccttattcgcaggccaggcgcttaccatactgggctccacaggaccagttctggtgttcgagaagattctgtttaagttttgtaaggactacgccctgtcatacctctcacttcgcgcttgcatcggtctgtggaccgccttcctgtgcatcgtccttgtcgctactgacgctagctctttggtttgttatataactagatttacagaagaagccttcgcctcactgatctgcatcatcttcatctacgaggccatcgagaaattgatacacctcgctgagacttatcccatccatatgcattcgcaactcgatcatttgtccctgtactactgcagatgtactttaccagaaaaccctaacaaccatacgttgcagtattggaaagatcacaacatcgttactgccgaggtgcactgggctaatttgaccgtatccgagtgccaggagatgcatggtgaattcatgggcagcgcctgtggccaccacggcccatacacgccagatgtgttattttggtcatgcatactgttcttcactacattcatactatctagcaccctaaaaacctttaaaacaagcaggtactttcctacccggatggaatcatgcagtgtggcgtggctagaatgtggcggagtgatccttgctcactgtaacctgcggttactgcccagttcctgggactatagacatgcccctccgcagcccgcaaacttctgcattttcagcagggacggcgtgagtccgtgttggcctggatggagtcagagccttgatctggtcatctgtctgcccagaccccctaagatgctgggtctccaggcttag

SEQ ID NO: 241625 - DNA, 3282 bp, Artificial Sequence
  Description of Artificial Sequence: Synthetic coding sequence
atgccagcggctggcagcaacgagcccgacggcgtgctgagttaccaaagaccggacgaggaggccgtagtcgatcaaggaggaacttcaactatactcaacatccactacgagaaagaggagttggagggccacaggacactgtacgtcggtgttagaatgcctttgggaaggcagtcacataggcaccatcgcacacatggccagaagcatcgcaggcggggtcgcggtaaaggcgcatcacagggcgaagaggggctcgaagcgctcgcccatgacacaccttcacagagggtccagttcatcctgggaacagaagaagatgaggaacacgtgccccacgaactgtttaccgagctagatgaaatttgcatgaaggagggcgaggatgcagagtggaaggagactgccaggtggctgaagttcgaggaggacgtggaggatggtggtgaacgctggtctaagccctacgtggctaccttgtcactccactctctgttcgaactgaggtcatgtttgattaatggaactgtgctgttagacatgcacgctaacagcatcgaggaaatttccgatctgatcttggaccagcaggagctcagcagtgacctcaatgacagtatgagagtcaaggttcgagaggccctacttaagaaacaccatcatcaaaacgagaagaagaggaataatctgatccctatagtccgttcttttgctgaggtcggtaaaaaacagtctgatccacacctcatggacaaacacggccagaccgtcagtccacagagcgtgccaactacgaacctggaggtaaaaaacggagtgaattgtgagcattcccctgtagatctctcaaaggtcgatttgcactttatgaaaaagatccctaccggcgctgaagccagcaatgtgctagtgggtgaagtggatatactcgaccgcccaattgtggccttcgtccggctttcacctgctgtgttgctgtcaggattaaccgaggtgcccatccctactagattcctgttcatcctgttgggaccagtggggaagggccagcagtatcacgagatcgggaggtctatggccaccatcatgaccgatgagatcttccatgacgtggcttataaagccaaagaaagggatgaccttctcgcaggaatcgacgaattccttgatcaggttactgtactgccgcctggcgaatgggatcctagcattcgcattgagcctccaaagaacgtcccgagccaggagaaacgcaagatgcctggggttccaaatggtaatgtctgtcacattgaacaggagccacacggcggacattccggcccagagctacagaggacagggaggttattcggaggcctagtgctggatataaagagaaaggcaccatggtactggagcgattacagagacgcgctgtctttacagtgcctagcaagttttctttttctctattgcgcatgtatgagccccgtcattacgttcggaggcttgctgggagaagcaaccgagggcagaatcagcgcaatcgagtctttgtttggggcttctatgacagggatcgcatattcactcttcgccggtcaggccctcaccattctggggagcacaggacctgtcttggtctttgagaagatcctgttcaagttctgtaaagactacgctctctcctatttatctttgcgagcatgcatcgggctctggactgcctttctttgtattgtcctggtagccaccgatgcttcctcgctggtctgctacataactcggtttacagaggaggcgtttgcttctctcatttgcattatcttcatatacgaggcaatagagaagttgattcacctggccgaaacctatccaattcacatgcactctcagttggaccatctgtctctctactactgtcggtgcactctgccagagaatcctaacaaccacacccttcagtattggaaagaccacaatatcgtcaccgctgaagtccattgggcgaatctgacagtgagcgagtgccaggagatgcacggagaatttatggggtccgcgtgcggacatcacggcccatataccccagatgttctgttttggtcctgtatcctgttctttactactttcattttgtcaagtacccttaaaacatttaagacatcccggtatttccctactagagttcgtagcatggtgagtgatttcgccgtattcttaacgatctttacgatggtgattatcgacttcctgatcggggtccccagcccaaagctgcaagtgccctctgtattcaagcctaccagagacgacaggggctggatcattaatcccatcggtcctaatccctggtggactgttattgccgctattatacctgccctgctgtgtacaatcctgatttttatggaccagcagatcaccgcagtgatcatcaaccgcaaggagcacaagctaaagaagggatgcgggtaccacttagacttgctgatggtagctattatgttaggagtctgctccattatggggctgccctggtttgtcgcagctactgttctatccattacacatgtcaattcactgaaacttgagtcagagtgctcggcacctggagaacagcccaagttcttagggattcgggagcagcgggtgactgggcttatgatatttgtgctaatgggctgtagtgtatttatgacagccattcttaaatttatcccaatgcctgtgctgtatggcgtcttcttgtacatgggggtgtcctccctacaggggatccagttctttgacaggctgaagttgtttggaatgcctgccaaacatcagccagattttatttatcttcgacatgtgccccttcgtaaggtgcacctgttcacactgatacagctgacttgtttggtccttctctgggttattaaagcctccccagctgcaatagtattccctatgatggtgctagcactcgtgttcgtgagaaaagttatggacttgtgcttctcgaaaagagagctcagttggcttgatgatttaatgccagagagcaaaaaaaagaagctggatgacgccaagaagaaggcaaaagaggaggaggaagcagaaaagatgctcgaaatcgggggagacaagtttccactcgagtcacggaaattgctgtcatctcccggaaaaaatatctcatgtcggtgtgatccgtcagagattaatatcagcgatgagatgcccaagaccactgtatggaaggccttaagtatgaacagcggcaatgcaaaggagaaatcactatttaattag

SEQ ID NO: 241626 - DNA, 1917 bp, Artificial Sequence
  Description of Artificial Sequence: Synthetic coding sequence
atgcctctcggaagacagtctcaccgacaccatagaactcacggccagaaacaccggcgtcgcggaaggggtaaaggtgccagccagggggaggagggtttagaagccctggctcacgacactccatctcaacgagttcagtttatcctgggcacagaagaagacgaggaacatgtgccccacgagcttttcacggaacttgacgaaatctgtatgaaggaaggcgaggacgccgagtggaaggagaccgctaggtggctgaagtttgaggaagacgtggaagatggcggtgagaggtggtcaaagccatacgttgcaaccctgtccctgcactctctgtttgagctgcgatcatgtcttatcaatggcaccgtgctgcttgacatgcacgccaatagcatcgaggaaatttccgatttaatcctggatcagcaagagctgtcaagcgatcttaacgacagtatgagagtaaaggtacgggaagcactcctgaagaaacaccaccaccagaacgagaaaaagcggaacaatctcatccccatagtccgaagttttgccgaggtggggaaaaaacagagcgacccgcacttaatggataaacatggccaaacagtgtcacctcagtccgttcctacaactaatttagaggtgaaaaatggcgtgaattgtgagcatagccctgtagacctgtccaaagtggatctgcattttatgaaaaaaatccctaccggtgccgaggcttccaatgtcctggtgggcgaagtggatattctcgatcgaccaatcgtcgccttcgtgcgcctgagccctgctgtgctcttgagcggactgactgaggtgcccattcccaccaggttcctttttatccttttaggcccagtgggaaaaggacagcaatatcacgaaatcggcagatcaatggctaccatcatgaccgatgagattttccatgatgttgcttataaggcaaaagagagagacgatttactcgcagggattgacgagttcctggaccaagtcactgtcctgccccctggagaatgggacccttccataagaatagagcctccgaaaaacgtgccgtctcaggaaaaacggaagatgccaggtgtaccaaacggaaacgtttgtcacatcgaacaggaaccccacggcggacattccgggccagagctgcagcggactggacgtctgttcggaggccttgtgctcgatatcaaaaggaaagcaccttggtactggagcgactatagggacgcattgagcttacagtgtctcgcctcattcttattcctgtattgcgcttgcatgtcaccagtgatcaccttcggcggactgcttggcgaggccactgaaggcaggatctcagccatcgagtccctgtttggcgctagtatgaccggcatagcatactccctgttcgccggacaggcactgactatcttggggtctactggtcccgtgctagtgtttgagaaaatcttgttcaagttttgtaaggactatgcactttcctacttatccctgagggcatgcatcggactgtggaccgccttcctgtgtattgtattggtcgcaacggatgcctcctcactggtatgttatatcacgcgtttcaccgaggaagcttttgcatcattgatctgtattatcttcatctacgaggctattgagaaactaattcatctcgccgaaacctatcctattcacatgcactcacaactcgatcacctgtcactgtattattgtcgttgcacactcccagaaaatcctaacaaccatacactccaatattggaaggaccataacatcgttaccgctgaagttcactgggccaacctgacagttagcgtctcgttgggcgctgcccgttgccccagcatagttactactggcctcggcggtacctccaagtag

SEQ ID NO: 241627 - DNA, 2976 bp, Artificial Sequence
  Description of Artificial Sequence: Synthetic coding sequence
atgcccttaggcagacaaagccatcgccaccaccgcacacatggtcagaagcaccgccgacggggacgcggaaagggagcgtctcaaggtgaggaaggacttgaggcccttgctcatgataccccctcacaaagagtccagtttatcctcggcaccgaggaagatgaggagcacgttccacacgaactgttcactgagttagacgagatatgtatgaaggagggagaagacgcagaatggaaggagactgctcgctggctgaagtttgaggaagatgttgaggatgggggtgaacgttggtccaagccatatgtggccacactctcactgcattccctgttcgaactcagatcctgtttgattaacggcactgtactgcttgatatgcacgcaaacagcattgaggaaatttccgacctgatcctagaccagcaggaactgagttctgacctgaatgattccatgcgagtgaaggttcgtgaagcactcttgaagaagcatcaccaccagaatgaaaagaagcgaaataatctgatcccaattgttcgcagcttcgctgaggtgggcaaaaagcagtctgatccccacctgatggacaagcatggccagacagtttctccccagtcagtccctacgaccaaccttgaggtaaagaatggcgtgaattgtgagcactcccctgtggacctgagcaaggttgatctacatttcatgaaaaaaattccgacaggagccgaggctagcaacgttctggtcggtgaagtcgacatactcgacaggccgatcgttgctttcgtccgtcttagcccggcagttcttctgtccgggctcaccgaggtcccaattccaacgagattcttattcatcctccttgggccagtaggcaagggccaacagtatcatgagatcggccgatcgatggctaccatcatgaccgacgaaatctttcatgatgtcgcctataaggctaaagaaagggacgacctcctcgcgggaatcgacgagtttctcgaccaggtgaccgtgctcccacctggagagtgggacccttctatcaggatagaaccacccaaaaacgtcccctcccaggaaaagcgtaagatgccaggcgttcctaacggaaacgtctgtcacatagagcaggaacctcacggtggtcattctggcccagagctgcaaaggacaggtagactgttcggtggcttggtgttagatattaagcgtaaggctccctggtattggagtgactatcgcgacgccctgagcctacagtgcttagcatcttttctgttcctgtattgcgcttgcatgtcacccgtaattacatttgggggactgctgggagaagccacagaaggacggatatccgccattgaaagcctctttggtgcgtctatgacaggtatcgcctattcgctcttcgctggccaggccctcacaatacttgggtcaacggggcctgtattggtgtttgagaagatcctcttcaagttctgtaaggactacgccctctcatatctgtctctgcgcgcttgtatcggattatggaccgctttcctatgcatcgtgctggtcgctaccgatgcatcctctcttgtttgctacatcactaggttcactgaagaagccttcgcttcacttatctgcatcatatttatatatgaagccattgaaaagctgatccacctcgccgaaacttaccctatacatatgcattcccagctggaccacctttcgctctattattgtaggtgcactctcccagagaaccccaacaatcatacactgcagtattggaaagatcataacatcgtcactgccgaggtccactgggccaacttaacggtcagtgaatgccaggagatgcacggcgagtttatgggcagcgcctgcggacaccatgggccttacacccctgatgtgctgttctggtcttgcattcttttcttcaccacatttatactttctagcacactcaagaccttcaaaacatccagatatttccctactagggttcgttcgatggtgtccgattttgctgtctttctgactatctttaccatggttattatagatttcctgattggtgtcccgagcccaaaactgcaagttccaagcgtgtttaagcctacaagagatgaccgagggtggattatcaacccaatcggacctaacccatggtggacagtgattgcggcaatcatccccgctcttttgtgtaccatcctgatcttcatggatcagcagatcacagccgtgatcattaaccgcaaggagcacaaactcaagaaagggtgtggataccatctggatttgctgatggtagccatcatgctgggagtatgcagcattatgggattgccatggttcgtggctgctactgtgctgtcaatcacccacgtcaattctctgaaactcgagtctgaatgtagcgcccctggcgaacagcccaagttcctcgggattcgggaacagcgggtgactggacttatgatctttgtgctgatgggctgttccgtctttatgaccgccattctgaaatttattcccatgcccgttctgtacggggtgttcctgtacatgggagtgtcctcccttcaaggcattcagttctttgaccgtctgaaactgtttggtatgcccgcaaagcaccaacccgacttcatctatttacggcacgtcccactgcgaaaggtgcacttattcacgctgattcagctaacgtgcctggtactgctctgggtgatcaaagcaagtccagccgctattgtgtttcccatgatggtcttagccctcgtattcgtgcgaaaagtcatggatctctgttttagtaaaagggaactttcctggcttgatgacctgatgccggaatctaagaaaaagaagctggatgacgccaaaaagaaagctaaggaggaggaggtaatcgtgctggcaccaacagtctatctcggggcatccaactaccgtacctag

SEQ ID NO: 241628 - DNA, 3321 bp, Artificial Sequence
  Description of Artificial Sequence: Synthetic coding sequence
atggagataaaagatcagggggctcagatggaaccactcctgcctacgcgcaatgacgaggaagccgtggtggatcggggaggcacccgcagcatactcaaaacacactttgagaaagaagatcttgaagggcataggacgctgtttataggcgtccacgtgcctttaggcggaaggaagtcgcatcggcgtcatagacatcgcggacataaacatcgcaagcgggacagggaacgggactctggactcgaggatggcagggagtctccttcgttcgataccccctctcagagagttcaatttatcctgggaaccgaggacgacgatgaagaacacatacctcacgatctgttcaccgaattggacgaaatctgctggagagagggggaagacgcggagtggagggagactgcccgatggttgaagtttgaagaagacgtggaggacgggggagagcggtggagcaagccctacgttgcaaccctttccctgcattcactctttgaacttagaagttgcattttaaacggcacagtcctgttggacatgcatgcaaatacattggaggaaatagccgacatggtgctggatcagcaggtctccagcggccagcttaacgaagatgtccggcacagggtgcacgaagcactcatgaaacagcatcatcaccaaaaccagaaaaaattgacgaatcgaattcctattgtccgcagctttgccgacatcggtaagaaacagagtgaaccaaacagcatggacaagaacgcaggacaagtcgtatctccccagtctgcccctgcgtgtgtggagaacaaaaatgatgtctcccgggaaaactcaaccgttgacttcagtaaggtggatctacatttcatgaaaaaaatcccacccggagctgaagcctccaatatacttgtgggcgagctcgagtttctcgatcgtacagtggtggcgtttgtccggctgtcacccgctgtcctgctgcaaggacttgcggaagttcccataccaaccaggttcctcttcattttactcggaccacttgggaagggccaacaataccacgagatcggcagatctatcgccacactcatgacggacgaagtgtttcacgacgtggcctacaaagcaaaagaccggaatgacctggtttctggaattgacgagtttctggatcaggttacggtgttacctcctggggagtgggatcctagcattaggattgaacctcctaagaacgtcccatcacaggagaagcgtaaaatcccagccgtgcctaacggtacggccgcacatggcgaagctgaaccacatggtgggcatagcggtcccgagctccaacggaccggcaggatatttgggggacttatcctggacataaaaaggaaagccccatatttttggtcagatttcagggatgcatttagcttacagtgtttagcatcgtttctgttcctttattgcgcttgtatgtctccggtgatcacgtttggtggccttctcggtgaggcaacggaggggcgaatctcagcaatcgagtccttattcggcgcttcaatgaccgggatcgcatatagcctgttcggcggtcaacccttaacaatactgggtagtaccggccctgtgttagtgttcgagaagattctcttcaagttttgtaaggagtacggcctgtcctacctatccttgcgggcatccattggcctttggacagcgaccctgtgcattatcttggtggcgaccgatgcttcttcactcgtgtgctacatcaccaggtttaccgaagaggcctttgcaagcctgatttgcattatcttcatatacgaagccctcgaaaaactgtttgaattgagtgaagcttatccgatcaacatgcataatgatctcgaattattgacccagtacagctgtaactgtgttgaacctcataatcccagcaatggcacactgaaggagtggagggaaagcaatatttctgcttccgatatcatctgggagaatttgactgtgtcagagtgtaagagtttacacggagagtacgtcgggagagcctgcggacacgaccacccttatgtacccgatgtgctcttctggtcagtcatactatttttctcaaccgtgacattgtccgccacattaaagcagtttaagacatcccgctactttccgaccaaagttagaagcatcgtgtctgacttcgccgtcttcttaaccattctgtgcatggtgctgatcgattatgccatcgggattcctagtcccaagcttcaggtcccaagtgtgtttaagccaaccagggatgatagaggatggtttgtgacacctctcggccctaatccctggtggactgtgattgcggcaatcatacctgccctcctttgtaccattttaattttcatggaccaacagatcacagccgttattatcaaccgcaaagaacacaagttaaagaaaggctgcggttatcatctcgatctcctgatggttgctgtcatgctgggcgtctgctcaatcatgggacttccctggtttgtagccgctactgttctctccattacccatgtgaacagtttgaaactggaaagcgagtgcagcgcccctggggaacagcccaaatttctaggaattcgagagcagagagtgaccgggctcatgatcttcattttgatgggaagctccgtctttatgacgtctattctgaaattcattcctatgccagtgctttacggcgtgtttctgtacatgggagcttcttctctcaagggcatccaattcttcgataggataaaactgttctggatgccagccaaacaccagcctgacttcatctatctgcggcacgtccccctgcgcaaagtccatctattcaccataatccagatgagctgtttggggctcttatggataattaaagtctcacgggctgctatagttttcccaatgatggtcctcgctttagtctttgtgcggaaactgatggatcttctcttcacaaaacgagagctttcctggctggacgacttaatgcctgaatccaaaaagaaaaaactggaggatgctgaaaaggaggaggaacagtcaatgcttgccatggaggacgagggcaccgtgcaacttccgctagaggggcactatcgagacgacccaagcgtgatcaacatcagtgatgaaatgtcaaaaaccgcattgtggcggaatctattaatcaccgcggataactcgaaggacaaggaaagctcctttccttcaaagagcattgaaagtagaaaggaaaaaaaggctgacagtggaaagggagtggacagggagacatgcctgtag

SEQ ID NO: 241629 - DNA, 3300 bp, Artificial Sequence
  Description of Artificial Sequence: Synthetic coding sequence
atgcagagtctgggagtgtctggaaaccgtaaggtcatgcagagcggcacatgcgaaccctttcaatctctgagccaccagagaaatgatgaggaggcagtggttgacagaggaggaacgcgctcgattttaaaaacacatttcgagaaagaggacctggagggccatagaactttgttcattggagtgcacgtgcctcttgggggacgcaaatcgcaccgtcggcataggcatagagggcataagcacagaaaaagggaccgagagagggactccggcttagaagacggtagggaatcaccatctttcgacaccccctcccagcgcgttcagttcatcctagggacggaggacgacgatgaagagcacatcccgcacgacctgtttactgagctggatgagatatgctggagggaaggagaagatgctgaatggcgtgagacagcgagatggctcaagtttgaggaagacgtggaggatgggggagagaggtggtcaaagccctacgtggccaccttatcgttgcattcactgttcgagttgcgcagctgcatccttaacggaacggtgcttttagacatgcacgctaacacacttgaagagattgccgacatggtgctggaccagcaggtttcatccggacagcttaatgaggatgtcagacatcgggtgcacgaagcccttatgaaacagcatcaccatcaaaatcagaagaaactgactaacagaatcccaattgtccggagctttgccgatatcggaaagaagcaaagcgaacccaactccatggacaagaacgccggtcaagtggtgtctccgcagagtgcaccagcatgtgtcgagaataaaaatgatgtctctcgcgaaaatagcacagtggactttagcaaagttgacctccacttcatgaagaagatccccccaggtgccgaggcctcaaatattctcgtgggcgaacttgagttccttgatcgaactgtggttgctttcgtgagactatcccctgcagtgctgctgcagggactcgctgaagttcccattcccaccaggtttctctttatcctgttaggaccactgggcaagggacagcagtaccacgaaattggcaggagtatagccactctgatgaccgacgaagtctttcatgatgtggcttataaagccaaggaccgcaatgatctggtatctgggatcgatgagtttttagaccaggtgactgtgctccctcctggtgagtgggatcccagcatccgcatcgagccgccaaaaaatgtccccagccaggaaaaaagaaagattccagccgtgccgaacggcaccgccgctcacggtgaagctgagccacatggagggcacagcggacccgaactgcagcggacgggcagaattttcgggggattgattctcgacattaaaaggaaagcaccatatttttggagtgacttccgggacgccttctcgctgcagtgtttggccagctttctgtttctgtactgtgcctgtatgtctcctgtgatcactttcgggggactacttggggaagccacagaagggagaatcagcgcaattgaatcgttgtttggagcttccatgactggcattgcgtacagccttttcggcggacagccccttacaattctgggctctacaggcccagtgttggtctttgagaagatactgttcaaattctgcaaagaatatggcctgtcctacctctccttacgcgcatcaatcggcctgtggacggcaactctctgcattattctggtcgcaaccgacgcctcttcacttgtgtgttacattacccgcttcaccgaagaggctttcgcctctttgatctgcattatttttatttatgaggccctcgaaaagttgttcgaactcagcgaggcttatccaatcaacatgcacaatgacctcgagctgcttacccagtacagctgcaattgtgttgagccccacaacccaagcaatggcactctgaaggagtggagggagagcaatataagcgcttctgacatcatctgggaaaaccttaccgtgtccgagtgtaaatctctgcacggcgaatacgtgggtagggcctgtggccacgatcacccctacgtgcctgatgttcttttctggagcgttatcctctttttttctacagtgacactgtcggcgacgctcaaacagtttaaaacctctaggtacttccctacaaaggtacgctcaattgtgagcgattttgccgtattccttactatcctgtgtatggtgctgatcgattacgccattgggataccttctccgaaactccaggtaccatccgtgttcaaaccaactagggatgaccgcggttggttcgtcacacctctgggacccaacccttggtggaccgtgattgctgcgattataccagccctcctttgtaccattttgatcttcatggatcagcaaataactgcagtgatcatcaacagaaaggaacataaactgaagaaaggctgcggctaccatttagacctgcttatggtggctgtaatgctcggcgtatgttcgattatgggtcttccttggtttgtggccgcaacagtcctgtccattactcacgtgaatagtctgaagcttgagtcggaatgctccgcgccaggcgagcagccaaagttcttgggaataagagaacagagggtcactgggttgatgatatttattttgatgggatcttctgttttcatgacatccatcctgaagttcatccctatgcccgtactttacggagtcttcttgtacatgggagcatcatctctcaagggtatccaattttttgaccggattaagctgttctggatgccagcgaagcaccagccagatttcatctatctgcgacatgtccccctcaggaaggtgcatttgtttacaattatccaaatgagctgcctcggtttgctctggattatcaaggtcagccgtgccgcaatcgtgttcccaatgatggtcctcgcactggtgtttgtgagaaaacttatggatttactttttactaagcgggaattatcttggcttgatgatctcatgcctgaatctaagaaaaagaagctggaggatgcggagaaggaggaggaacaatccatgctggcgatggaggacgaagggacggttcagttgcctttggaggggcactatcgcgatgaccccagcgtgattaatatttccgacgaaatgagtaagacagcactgtggaggaacttgctgataacagctgataatagcaaggacaaggagtcgtcgttcccgtctaaaagcagcccttcctag

SEQ ID NO: 241630 - DNA, 3354 bp, Artificial Sequence
  Description of Artificial Sequence: Synthetic coding sequence
atggaaattaaagaccagggcgcacagatggagcccctgctgccgaccagaaatgatgaagaggccgtcgtggatagaggaggcaccaggtcaatccttaaaactcattttgagaaagaggaccttgaaggccacaggaccctcttcattggggtgcatgttcctctgggcggtaggaagtcccaccgcaggcataggcatcggggacataagcataggaagcgcgatcgggaaagggacagcggcttggaagatgggagagaatcgccttctttcgacaccccttcacaacgggtccagttcatcctcggtacagaagatgatgacgaggagcacatcccacacgacctcttcacagaactggacgagatttgttggcgagagggagaggacgccgagtggcgagagactgccagatggctgaagttcgaagaggatgtggaggacggaggcgaacgatggtctaaaccttacgtggcgaccttaagcctgcactccctgttcgagctcaggagctgtatcctgaacgggaccgtgctgttggacatgcacgccaacacccttgaggaaattgctgatatggtcttggaccagcaggtgagctccggccaactgaacgaagatgtccggcatagggtccatgaggctctgatgaagcagcaccatcaccaaaatcagaaaaaactcacaaacaggattcctatcgtaaggtcattcgcagacatcggcaagaaacagtcagagccaaactccatggacaaaaatggacaggtggtgagcccacagtcagcacccgcatgtgtggaaaacaaaaacgacgtctcccgtgaaaactccactgttgacttctcaaagggcctcggcggacagcagaaggggcacactagcccatgtgggatgaagcagaggcacgagaaaggtcctcctcaccaacaggaaagagaggtggacttacactttatgaaaaaaatacctcctggcgctgaagcttcgaatattctagttggcgagctcgagtttcttgaccgtaccgttgtggcattcgtgagactctctcctgcagtgttgttgcaaggcttggcggaggtgcctattccaactagattcctctttatcctgttaggcccactgggcaagggccagcagtatcacgagattgggaggtctatcgccactctaatgacggatgaggttttccacgacgtggcttataaggccaaggacaggaacgaccttgtgtctggaattgacgaattcctggaccaagtgaccgtcctacccccaggcgaatgggatcctagcatacgtattgagcccccaaagaacgtcccctcgcaggagaaacgcaagatcccagctgtgcctaatgggactgccgctcacggggaggctgagccccacggtggtcattccgggcctgagttgcaacgcactggaagaattttcggcggtctcatcctggatattaaacggaaggctccctatttttggagtgacttcagagacgctttcagtttacaatgcctcgcgagctttttgtttctgtactgcgcctgcatgtctcccgtgattacatttggaggcctcttaggcgaggctaccgaaggtcgcatctccgcgatagagtctctattcggggctagcatgactgggatagcatattctctgtttggtggacagcctttaacaattctgggtagtaccggcccagtgcttgtgttcgagaagatcctgttcaaattttgcaaggagtacggtctcagctacctctcactgagggccagcattggtctgtggacggcaaccttgtgcatcatcctggtggccacggacgcaagttccttggtctgctacattacccgcttcacggaggaggcttttgcctcccttatttgtattatcttcatctacgaagctctcgagaagctgtttgagctctccgaggcctatcctattaacatgcataatgatctggagttgctgacacagtacagctgcaattgcgtcgagccacacaatccctcaaatggcacgctgaaagaatggagagagagtaatatctcggcaagcgacattatctgggagaatctcacagtgtccgaatgtaaaagcctgcacggagagtatgtcggaagggcttgcgggcatgaccacccctacgttcctgacgtgcttttttggagcgtgattctgttcttttcgaccgtgacgcttagcgcgacactgaaacagttcaaaacatctaggtattttcctacaaaagtgaggtctatagtgagcgattttgccgtctttctgaccatcctctgcatggtgctaattgattatgctattggcataccctctcccaagttgcaggtgccatcagttttcaaacctactagggatgatcgcggttggtttgttacacctctgggccctaatccctggtggactgttatcgcagcaatcattcccgcattgttgtgcactattctgatcttcatggatcagcagattaccgctgtgattataaatagaaaagagcacaaactgaaaaagggatgtggctaccatctcgacctcctaatggtggccgtgatgttgggcgtctgctcaattatgggtctaccttggtttgtagcagccacagtactgtctattacacacgttaacagcctgaagctcgaatctgaatgttccgctcctggagaacagcccaagttcttaggaattcgcgagcagagggtcacaggcctgatgatattcattctaatgggtagttctgtcttcatgacttcaattctgaagttcattccaatgccagtgctctacggagtcttcctctatatgggggcaagttcccttaaggggatacaattttttgacagaatcaaactcttctggatgccagccaaacaccagcccgacttcatctacctgaggcatgtcccactgcggaaggtgcacctgttcacaatcatacaaatgtcgtgcttgggtctgctgtggatcatcaaagtatcccgagcagccatagtgttccctatgatggtgttagctctggtatttgtgcggaagttaatggacctgctgtttactaaaagggaattgtcttggctggatgacctcatgcctgaaagtaaaaaaaaaaaacttgaggatgcggaaaaggaggaggaacagagtatgttggctatggaagacgagggcacagttcagttaccattagaggggcactaccgggacgaccctagcgttataaacatctcggatgagatgtctaagacagcactgtggcggaatctgctaatcactgccgataacagtaaagataaagaaagttccttccccagtaagagctctccttcttag

SEQ ID NO: 241631 - DNA, 3267 bp, Artificial Sequence
  Description of Artificial Sequence: Synthetic coding sequence
atggaaataaaagatcaaggagcccagatggagcccttattaccgactcggaacgacgaagaggctgtcgtggaccgtggcggaacccgttctattcttaaaacccattttgaaaaggaagatctcgagggccataggacgctctttatcggggtccatgtacccttaggagggagaaagtcccacaggagacaccggcacaggggacacaagcataggaagagagacagggagcgcgattcaggactcgaagatggccgtgaatcaccctccttcgatacaccttctcagcgtgtacaatttatactgggaaccgaggacgatgacgaggagcatatcccacatgacctgttcaccgagctggatgagatctgctggcgagaaggagaagacgcagagtggagggagactgctcgatggctgaaattcgaagaagacgtggaggacggtggagagagatggagtaaaccgtatgtcgcaacattaagcctgcacagcttatttgaactccgaagttgcatcttgaacggtacagtgctccttgacatgcatgccaacaccctcgaggaaatcgcagacatggttctggaccagcaggtgagttctggtcagctgaacgaggacgtacggcatagagtccacgaggccctgatgaagcagcaccaccatcagaatcagaaaaaattgacaaatagaattcccattgtccgaagctttgctgacattggcaagaagcagtctgaacccaactcaatggacaagaacgctgggcaagtcgtttcacctcagagcgctccagcgtgtgtggagaacaagaatgatgtgtcacgcgagaactcaacggtcgattttagcaaggtcgatctgcactttatgaaaaaaatcccccctggcgctgaggcgtcaaacatcctcgtgggcgaactcgagttcctggacaggacagttgtcgcttttgtgcgcctctctccagcagtgctcctgcagggactcgcagaggttccaattccaaccaggttcctgtttattttgcttggtcccctgggcaaagggcagcagtatcatgaaattggaaggtctatagccactttaatgaccgacgaggtgttccacgacgtcgcttacaaggcgaaggatagaaacgatctagtgtcaggtattgatgaatttctggaccaggtgactgtcctgcccccaggtgagtgggacccctctatcagaatcgagccgccaaaaaacgtcccatcgcaggagaagaggaagatacctgccgtccctaacggaacggccgcacacggggaagcagagccccatggtgggcattccggtccggagctgcagcggacagggcgaatattcgggggtctcattctcgatattaagcgcaaggccccatacttctggagcgattttcgggacgctttctcactgcaatgtctggctagtttcctgtttctgtactgtgcctgtatgtccccagtgataacctttgggggactcctcggggaagccacagaagggcgaatcagtgctatcgaaagtctatttggtgcaagtatgacaggcatcgcatattctctgttcggtggacaacctctgacgatcctcggctcaaccgggcctgtactcgtattcgagaagatcttgttcaaattctgtaaagagtatgggttgagttacctcagtttacgtgcctccataggactttggacggccactttatgcatcatcctggtggccactgatgctagcagccttgtgtgctatattacacggttcaccgaagaggcctttgcgtcactgatctgtattatctttatatacgaggctttggaaaaactttttgagcttagtgaggcctaccctatcaacatgcacaatgaccttgagctgctcacccagtacagttgtaactgtgtggaacctcataatccttctaacggcacacttaaggagtggagggaaagcaacatcagtgcgtctgatattatttgggagaacctaactgtttctgaatgtaagtcactacacggagaatatgttggaagagcctgcgggcacgatcatccctacgtgcccgacgtccttttttggtccgtcatactcttcttttctactgtaactttgtcagcaacgctgaaacagttcaagacatccaggtattttcccactaaggtccggagcatcgtatcagacttcgcagtgtttctgactatcctctgcatggttcttattgattatgctattggcatcccctcacccaagcttcaagttccctctgtttttaagcctactagggacgatcgcggatggtttgtgacacctcttggcccaaacccctggtggactgtgattgccgcaattattccagcgttgctctgtacaatcctgatttttatggatcagcagatcaccgccgtaatcattaacagaaaagagcacaaattgaaaaaaggctgtggttatcacctcgacctcctgatggttgccgtcatgctcggagtgtgcagcatcatggggctaccttggtttgtggccgctactgtgctttccattactcatgtaaattctctcaagctagagagcgagtgctctgctcccggagagcagccaaagttcctgggaatcagggaacagagggttacaggcctgatgatcttcatactgatggggagcagcgtgtttatgacaagcatcctgaaattcattcccatgccagtgctttatggggtgttcttgtatatgggcgcttcgtctctgaagggcattcaattctttgacagaataaagttgttctggatgcccgctaagcaccagccagatttcatttacctgaggcatgttccactacgcaaggtccaccttttcactataatccagatgagctgcttaggactactctggattattaaggtgagccgagccgctatcgtttttcccatgatggtgctcgctcttgtgttcgtgcggaagctcatggatttgttattcacgaagagggagctctcttggctagacgaccttatgcctgagtccaagaaaaagaaactagaagacgctgagaaagaggaggagcagtccatgcttgccatggaagatgaagggactgtgcagctccccctcgaagggcattaccgagacgatccttccgtaattaatattagtgacgaaatgtccaaaacagcgctctggcggaatctgctcatcaccgccgataattccaaggataaagagagctctttcccctccaagtctagtccgtcgtag

SEQ ID NO: 241632 - DNA, 3165 bp, Artificial Sequence
  Description of Artificial Sequence: Synthetic coding sequence
atggagattaaggatcagggcgctcagatggagcctctcctgccaacccgaaacgacgaggaggccgtggtggaccggggagggacccggtccatcctgaaaacgcacttcgaaaaggaagatctcgaagggcacagaacgctctttattggtgttcatgtgccgcttggagggagaaagtcccatcgcaggcatcgccatagagggcacaaacatcgcaagagggatagggagcgcgacagcgggctggaagacggaagagagagcccatcattcgataccccctcacagagagtacagttcatcctcgggaccgaagacgacgatgaagaacatataccccacgacttgttcactgagctggacgaaatctgttggcgtgaaggagaagacgcagagtggcgggagaccgcgaggtggctcaagttcgaggaagacgttgaagacggcggagagcgctggtctaaaccctacgttgctacattatctctgcattccctgttcgagctgaggagctgcattctaaatggaaccgtactgctggacatgcacgccaacaccctggaggaaattgctgacatggtgctcgatcagcaggtgtcctctggccagctaaacgaagacgtgaggcaccgcgtgcacgaggctttaatgaagcagcatcaccatcagaaccagaagaaactgaccaatagaatccctatagtgcgaagttttgctgacataggtaagaaacagtcagagccaaacagcatggacaaaaacgcaggacaagtggtgagcccacagtccgctcccgcatgtgtggagaataaaaacgatgtgtctcgcgagaatagcacagtcgatttttctaagggccttggtggacaacaaaaggggcacacaagtccctgcggaatgaagcagcggcacgagaaaggtccgccacaccaacaggagcgagaagtagacctgcatttcatgaaaaaaatcccaccaggagcggaggcctcgaatatactggttggagaactggagtttctggataggactgtggtggccttcgtccgcctgagtcctgcagtactgctccaggggctggccgaggttcctatacccactcgtttcctgttcattctgctgggcccactggggaaaggccagcagtaccacgagatagggagaagcatcgctaccttgatgactgacgaggtgtttcacgacgtggcttacaaggctaaggataggaatgatctagtatctggtatcgatgaattcctcgatcaggtcacggtactgccccctggcgaatgggatcctagcatcaggattgaaccacccaagaatgttccctctcaggagaagcgaaagatacctgccgtgcccaatggcacagctgctcatggagaagctgaacctcacggcggtcatagcggtccggagctgcagaggaccgggaggatttttgggggacttattctggacatcaagcggaaagcaccatatttctggagcgactttcgggatgctttttcgttgcagtgtctcgcatcatttctctttctttactgcgcgtgcatgtctccagtgatcacctttggcggacttctgggtgaggccactgagggcagaatctccgccatcgagtcactctttggggctagcatgaccggtattgcctacagcctctttggagggcagcccctgaccattctgggctccacaggccctgtgctggtcttcgagaaaatcctgttcaagttctgtaaagaatatggcctttcctacctgtcactccgggcttctataggcttatggacagccacgctctgtattatccttgtcgcaacagacgcctcgagcctggtgtgttacataactcgtttcacagaggaagcctttgcaagtttaatatgcattatcttcatctatgaggccctggagaagctatttgaactgagcgaagcctacccaatcaacatgcataacgatctcgagctgttgacacagtactcttgcaattgcgtcgaacctcataacccctctaatggcacactgaaagaatggcgcgagtctaatataagcgcctcagatattatttgggaaaacctaacagtgagcgaatgcaagtctcttcacggggagtacgtgggaagggcatgcggacatgatcacccttacgttccagacgtactgttctggtctgtgatcctcttttttagtacagtcacgctgtcagccactcttaaacagttcaagaccagcaggtacttcccgacaaaagtccgaagcattgtctcagactttgcggtctttctgaccattctatgcatggttcttatcgactatgcgatcggtattccttccccaaaactgcaagtgcctagtgtgtttaagcctacgcgagatgaccgcggatggtttgtgacccccctggggcctaatccttggtggacagtcatcgcagccataatccctgctctgctctgtacgatcctaatttttatggaccagcagatcactgctgtgattataaataggaaggagcacaaactgaagaaaggttgtgggtaccatttggatctactcatggtggcagtgatgctcggcgtgtgctcaataatgggactcccgtggtttgtggccgcaactgttctttctattacccacgtgaactcacttaaactcgagagcgagtgcagtgccccaggcgagcagcctaaattcttggggattcgggagcaaagagtcacgggcctaatgatctttatccttatggggtctagtgtattcatgactagcatcctgaagtttataccgatgcccgtgttatatggagtgtttctatacatgggagccagcagcttaaagggcatccagttttttgatagaattaaacttttttggatgcccgctaagcatcagcccgatttcatttatttaagacacgtaccacttagaaaggttcatctgtttacgattatacaaatgagctgtctggggcttctgtggattatcaaggtttctcgagctgctattgtgttccccatgatggtgctggctctggtctttgtgaggaagctcatggatctgcttttcactaagcgagagctatcttggttagacgacctgatgcctgagagcaaaaaaaaaaagctggaagatgccgaaaaggaacactag

SEQ ID NO: 241633 - DNA, 3357 bp, Artificial Sequence
  Description of Artificial Sequence: Synthetic coding sequence
atggagattaaggatcagggcgcacagatggagccactcctacccactaggaacgacgaggaggctgtggtggacaggggtggtacaagatctatactgaaaacgcacttcgagaaggaagatctggaggggcatcggacgctgtttattggcgttcacgtaccgctcggagggcgtaaatcccaccggaggcatagacatagaggccataagcacaggaagcgcgatcgcgaacgagatagcggactggaggatgggagggagagcccttcctttgataccccctcccaacgggtgcagtttatactgggtaccgaggatgacgatgaggagcacattccacacgatctatttactgagctggatgagatctgttggcgggagggggaggacgctgagtggcgcgaaactgcgagatggttgaagttcgaggaggacgttgaggatggtggggaacggtggagcaagccttatgtggctaccttgtccctgcacagcctgttcgaacttcgatcttgtatacttaatggcactgtgctcctggatatgcatgccaacactttagaggagattgcagatatggtattggatcaacaggtgtcatcagggcagcttaatgaggatgtgagacacagagtgcatgaagcattaatgaagcaacatcatcaccaaaaccagaagaagctgacaaaccggatcccaattgttcgctcatttgcagatatcggcaagaagcagagcgaacctaatagcatggataaaaacgcgggacaggtcgtttcccctcagtccgccccagcatgtgttgagaacaagaacgacgtgagcagagagaattccaccgtcgacttcagtaaggggctggggggtcagcaaaaagggcatacctccccgtgcggcatgaagcagcggcatgagaaaggaccaccccaccagcaagagcgtgaagtcgatctccattttatgaagaagatacctcccggagccgaggccagcaatattcttgtgggagagctggagttcttggaccggacagtcgtcgcattcgtacgcctgtctccagccgtcctgctccaggggctcgcagaagtccctataccgacacgattcctatttatcctcctaggaccgctcgggaaaggacaacaataccacgaaattggcaggagtatcgcgacactgatgacggatgaggtgttccacgacgtggcctataaggccaaggacagaaacgatctggtgtccggtattgatgagttcttggatcaggtgacagtgttgccgccaggggaatgggaccccagtatccgtatagaacctcctaaaaacgttccatctcaggagaaaagaaaaattcctgctgtgccaaacggcacagccgcacacggcgaagccgagccccacgggggacattcaggccctgaacttcaaagaacagggagaatttttggcggattgatcctggacatcaagcggaaggccccatacttttggagtgacttccgcgatgccttctcactgcagtgcctcgcatcttttttgtttctgtactgcgcctgcatgtcccccgtaatcactttcggcggtttactgggggaggccacagaaggaaggatctcggcaattgagtccctttttggtgctagtatgaccggcatcgcttattctttgtttggaggccagccacttacaattctgggcagcacaggccctgtattagtgttcgagaagatccttttcaaattctgcaaggagtacggtctgtcctatctaagtttgcgtgccagtatcggattatggactgccacgctgtgtataatactggttgctactgatgcatcaagtctggtttgctacattaccagatttactgaagaggccttcgcctctctcatttgtatcatcttcatctatgaggctcttgagaagctgtttgagctgtcagaagcttaccctattaatatgcacaatgacctggagctgcttacacaatactcttgtaactgcgtcgaaccccataacccctccaatggtacactgaaagagtggagagagagcaacattagtgccagcgacattatctgggaaaatctgaccgtttccgagtgtaaatcgctgcacggagagtatgtggggagggcgtgcggtcatgaccatccctacgttccggatgtcctgttttggagcgtgattctgtttttcagcaccgtaacactgtctgctactctcaagcagtttaaaacatctcgttactttccaactaaggtgcgatcaattgtgtctgattttgccgtcttcctgacaattttatgcatggtgctcattgactatgcaattggaatcccgtcccctaagctccaggtcccgagcgtttttaagcccacacgggacgatcggggttggtttgtcacgccactgggcccaaatccctggtggactgtaatcgcagcaataatccccgcattgctgtgcactatcctgatttttatggaccagcagattaccgctgtgattattaataggaaggagcataaactgaaaaaagggtgtggctaccaccttgatctgctgatggtggccgtgatgctcggcgtgtgctccattatgggactcccctggttcgtggccgctactgtactctcgatcactcacgtgaacagcttaaaattggagagtgaatgctctgccccaggtgagcaaccaaagttcctgggcatcagagagcagcgagtgactgggttgatgatattcatcctgatgggttcctcagtctttatgactagcatactgaagtttatcccaatgccagtcctgtacggagtgttcctatacatgggagcctcttctctcaaggggattcagttcttcgatcgaattaaactgttctggatgcctgctaaacaccagccagactttatctatctgagacacgttcccctgagaaaagttcatctcttcaccatcattcagatgagttgtctgggcctgctttggatcattaaggtcagccgtgccgctattgtgttccctatgatggtgttagcactggtctttgtcagaaaactcatggatcttctgttcaccaagcgcgagctctcgtggctggatgatctaatgccagaatcgaagaaaaagaagctcgaagatgcggagaaggaggaggagcagagtatgctggctatggaggatgaaggcaccgttcagttgcccctggagggccattacagggacgaccccagcgtgatcaatataagcgacgagatgagtaaaacagccctgtggaggaacctgctcatcaccgcagataatagcaaggataaggaaagtagctttccatcgaagtcttcgcccagctag

SEQ ID NO: 241634 - DNA, 3318 bp, Artificial Sequence
  Description of Artificial Sequence: Synthetic coding sequence
atggagatcaaggaccagggagctcagatggaaccactcctgcctactcgaaacgatgaggaggccgtggtggacaggggaggtacccgttcaatccttaaaacacattttgagaaagaggatctcgagggtcatcggaccctgttcattggggtccacgtgccgcttgggggaagaaaaagccacagacgacaccggcacagaggtcacaagcatagaaagagagatcgcgagcgcgactcagggttagaggacggccgagagtccccctcctttgacactccctcacagagagtgcagttcattctgggcacagaggacgacgatgaagagcacataccccacgatttgtttacagagttggacgaaatctgctggagggaaggggaagacgcggaatggcgggaaactgcccgatggctcaaatttgaagaggatgtggaagacggaggcgaaaggtggtcgaagccatatgtagctactctttctctgcactccctgttcgaattgcgaagttgcatactgaacggaaccgttctgctcgacatgcacgcgaacaccttggaggaaattgcagatatggtcctcgaccagcaggtgagtagcggacagctcaatgaggacgtgcggcaccgagtgcacgaggccctgatgaaacaacaccatcaccaaaaccagaagaagctgactaatcgcattccaatcgtgaggtcctttgcagacatcggaaagaagcagtccgaacccaactctatggacaaaaatggacaggtcgtcagtcctcagagtgcccctgcctgcgtggagaataagaatgacgtgagtagggaaaatagtactgtggatttctctaaagtcgacctgcactttatgaaaaagatcccaccgggagcagaggcttccaatatactagtcggggagttagagtttcttgatcgcacagttgtcgctttcgtacggctttctcctgcagtcttattacagggactggcggaagtccccataccaactcgattcttgttcatcctgctgggaccattggggaaggggcagcagtatcacgaaataggaagaagcatcgctactctgatgaccgacgaggtctttcatgacgtcgcctataaagcaaaagatcggaacgatctggtgtccggcattgatgaattcctggaccaagtaaccgtgctgccccctggggagtgggacccatcaatcaggatcgagcccccaaagaacgtcccatctcaggagaagcgaaagattccagccgttcccaatggcactgccgcacacggtgaagccgaacctcacggtggtcattccggcccagagctgcagcggacgggacggatctttggcggactgatcttggacattaagcggaaagccccatacttttggtccgactttagagacgcatttagcctccaatgtctagcatctttcctctttctgtattgcgcctgcatgagccccgtcatcaccttcgggggacttctcggggaggctaccgagggtcggatctcagccattgagtcactctttggtgcctcaatgacggggatcgcctattcactgtttggaggacagcccctgaccattctcgggagcacaggccctgtcttggtcttcgagaaaattctgtttaaattttgtaaagaatacggcttaagttacttgtctctccgtgcctctattggactatggaccgcgacactgtgtatcatccttgtcgcaactgacgcttccagtctagtgtgctacattacaaggtttactgaggaagcttttgcctcactgatttgcatcatcttcatctacgaggccctagaaaagttatttgagctgtccgaagcctaccccatcaatatgcacaacgacctggagctactgacacagtacagctgtaactgcgtggaaccacacaacccctctaatggcaccctaaaagagtggagggaatccaatatcagcgcatctgacatcatctgggagaatttgacagtcagcgaatgcaagtctctgcacggcgaatacgtcggtagggcttgtggacacgaccacccttacgttccggatgtgctgttctggtcggtgattttattcttctctacggtcacattgagcgctacattaaagcagttcaaaaccagcaggtatttcccaacaaaggttagaagtatcgtctccgatttcgccgtctttttgaccattctgtgcatggtgttaatcgactacgcaattgggatcccttcacctaagctccaagttccctccgtgttcaagcctactcgggatgacagagggtggtttgtcacccctttaggccctaacccatggtggactgttattgccgcaatcatacctgcgcttctgtgcacaatccttatcttcatggaccagcagattaccgccgtgatcatcaaccgtaaagagcacaaactgaagaaggggtgcggctaccatttggatcttctgatggtggctgtgatgctgggtgtttgttccatcatgggtctgccctggttcgtagcagccacagtgttgagcataacgcacgtcaacagtttaaagctggaaagcgagtgttcagctcccggtgagcaacctaaattcttggggattcgcgagcagcgcgtgacaggcctaatgatattcatactgatgggaagttccgtgtttatgaccagcatcctgaaattcattccaatgccagtcctgtatggggtgtttctgtacatgggggcatcctcactgaaaggaatccagttctttgacagaatcaagctcttctggatgcctgccaagcatcaaccagattttatttacctgcggcacgtccccttgaggaaggtccatctgtttaccatcatccagatgagttgtttaggcctgttatggatcattaaggtatcgcgcgctgcaatcgtattcccaatgatggttctggcccttgtgtttgtgcgcaaacttatggaccttttatttacaaagcgggagctgtcctggcttgatgacctgatgcctgaatctaagaaaaagaaactggaggacgcggagaaggaagaagagcagtctatgctggccatggaggatgaaggcacagtgcaattgccactggagggacactaccgggatgacccttcagttatcaacatcagcgatgagatgagtaagactgccctgtggagaaacctccttataaccgccgacaacagtaaggacaaagagagtagctttcctagcaagtccatcgaatctcgcaaagaaaagaaggcggactctggcaaaggtgtggatcgagagacctgcctgtag

SEQ ID NO: 241635 - DNA, 1227 bp, Artificial Sequence
  Description of Artificial Sequence: Synthetic coding sequence
atggagattaaggaccagggggcacaaatggagcctctgctccccactaggaatgatgaggaagctgtcgtcgacagaggaggaacacgctctatcctgaagacgcactttgagaaggaggacttagagggacataggaccttgttcatcggtgtgcacgtgcctctcggaggccgtaagtctcatcgtaggcataggcacaggggccataaacatcggaaaagggaccgcgagcgcgactccggcctggaggacgggagggagtctccctcatttgacacaccttctcagcgggtgcagttcattttgggtaccgaggacgacgacgaggaacacattccacacgatctgttcactgaattggatgaaatatgctggagggagggcgaggacgccgagtggagggagaccgcccgatggctgaaatttgaagaagatgttgaagacgggggagagaggtggagcaagccttatgtggccactctctctctacattctctgttcgaattgaggtcttgcattctgaacggaacagttctgctggacatgcacgccaataccctggaggagattgccgacatggtcctggaccagcaggtgtctagtgggcagctcaatgaggatgtccgtcacagggttcacgaggccttaatgaagcagcaccatcatcagaaccagaagaaactaaccaataggatcccgatcgtgcgatcgtttgcagatatcggtaaaaaacagtcagaacccaatagtatggataagaacgctggtcaagtggtcagcccccaaagcgccccagcgtgcgttgaaaacaagaacgatgtgtcgcgagagaatagcaccgtggacttcagcaaggggctggggggacagcaaaagggccacaccagtccatgcggcatgaagcagagacatgagaaaggacctccccaccagcaggaacgtgaggttgatttacacttcatgaagaagatcccacctggggcagaggcgtcaaatattctggtgggcgagctggagtttctcgatcgcaccgtggttgcgtttgttcgattgtctccagccgttctcttgcagggcctggcagaagtgccgatacccacgagatactttatgatgctgcctattaagttgaaaattgtcatgacttggtatcaggaactgatgagtttctggatacgactgcttttctcacttctcgaaaatgggatacaagcttttgaatag

SEQ ID NO: 241636 - DNA, 2676 bp, Artificial Sequence
  Description of Artificial Sequence: Synthetic coding sequence
atgtctcaggtaggaggtagaggagatcgttgtacccaggaggtgcaggggctggtgcatggcgctggcgatttgtcggcatctcttgctgagaacagtcctaccatgtctcagaatggctattttgaagattccagttattataaatgtgatacagatgatacatttgaagccagagaagaaattttgggcgacgaagcctttgacaccgccaattctagtattgtttctggggagtccatcagattcttcgtcaatgtgaatctggaaatgcaagcaacaaataccgagaacgaagccaccagcggagggtgtgtccttctacacacatcccggaagtatcttaagctaaagaacttcaaggaagagatcagggcacaccgagacctcgatggttttctggcgcaggcctccattgtcctgaatgaaacagctacttctctggataacgtcttacgcacaatgctgcgccgattcgcacgggaccccgacaacaatgaacccaactgtaatctggacctattgatggcgatgctgttcacagacgctggggcacctatgcgtggaaaggtccatctgttgtcagacactattcagggtgtaactgccactgtgaccggagtcagataccagcagagttggttgtgcataatttgcaccatgaaggcgctgcagaagcgccacgtgtgtatcagccggctcgtcaggccacaaaattggggggagaactcctgtgaagttcgctttgtcattctggtgctggcccctcctaaaatgaagtccaccaaaacagcaatggaagtcgcacggacattcgcaactatgttttcggatattgccttccggcagaagctgctcgagacccgaacggaagaggaatttaaggaggcactcgtccaccagcgacaacttctgacgatggtctcacatggaccagtcgcgcctcgcaccaaggagcgatctactgtgtctctgccagctcatcggcatcccgagccccctaagtgtaaagactttgtgccttttggaaaagggataagagaagatattgccaggaggtttccattgtaccccctggactttacagacggcatcattggcaagaacaaagcagtcggcaaatatattaccacaactttattcctgtatttcgcctgtttgctgccaactatagctttcggaagtctcaacgacgaaaataccgacggagcgatcgacgttcagaaaaccatagccggtcaatctatcgggggactcctttacgcactattctccggccagccactcgtgatactgcttacaaccgcccctctagcgctgtacatccaagtcatacgcgtgatatgtgacgattacgaccttgatttcaacagtttttacgcatggactggtctgtggaattctttttttctcgcgctttatgcatttttcaacctgagtctggttatgtcactgttcaaacgctctaccgaggaaataatcgcgctatttatctcaattacgtttgtcctggatgcggtgaagggcaccgtgaagatcttttggaaatattattatgggcattatctggacgactaccacacaaaacgcacatcctccctcgtctcactgagcggattaggtgcttccctgaacgccagtctccatacagccctgaacgcatcctttctggccagcccaactgagctgccctccgccacacattctggacaagccaccgctgtgctgtctctactgattatgctgggcaccctttggttgggctatactctgtatcagttcaaaaagtctccttacctgcatccttgcgtccgagaaatcctgagcgactgtgctttgccgattgccgtgcttgctttcagcctgatttctagccacggattcagggaaatcgagatgtcaaagttccgctacaatccatccgagagcccattcgcaatggcacagatccagtccctcagtctgagggccgtaagcggcgcaatggggctgggctttctgctaagcatgctgttctttatcgaacagaatctcgtcgccgcacttgtcaacgcgccagagaacaggctggttaaaggcaccgcataccattgggatctcctgctcttggcgattattaacacagggctgtctctatttggattgccgtggattcacgctgcatacccacatagcccactccatgtacgggctctcgcgttggtggaggagcgggttgagaacggccatatctacgataccatcgtgaacgtcaaagagacccgcttaactagtttaggcgctagcgttctggtgggcctatcactgcttcttctgcccgtccctctgcagtggattccaaaacctgtgctgtatggtttgttcctctacattgctctcacatcactcgacggcaaccagctggtacagcgtgtggcactactacttaaggagcaaaccgcttatcctccaacacattacatacgcagagtcccacaaagaaaaatacactactttacagggttacaggttttacagctattacttttgtgtgcatttggcatgagctcactgccatatatgaagatgatctttcccctgatcatgatcgccatgatcccaattcggtatatacttctcccgaggattattgaggccaagtacttggacgtgatggatgccgagcatcgtccttag

SEQ ID NO: 241637 - DNA, 2757 bp, Artificial Sequence
  Description of Artificial Sequence: Synthetic coding sequence
atgggtgtctacgggccacaggatagatccgagtcggaaaaaagagacgtgcagcgtgatcctccaccatggcaccctcgacgtgagggagagagacctgctcgtgctaggagcctccccctggctgctgcagggcaggggttcttgaggaagacttggattagcgaacatgagaacagccccactatgagtcagaatggatattttgaggactcttcttactacaaatgtgacactgacgatacctttgaggctagggaggaaattctgggtgacgaagccttcgataccgcaaattccagtattgtctccggcgagagcatccggttcttcgtcaatgtcaacctagagatgcaggcgacaaacaccgagaatgaggcgacgtccggcggttgcgtcctcttgcatacgagcagaaaatacctgaaactcaaaaactttaaggaagagatccgcgctcaccgcgaccttgacgggttcctcgcccaggcctctatcgtactcaacgaaacagcaacatctttggacaatgtcttacgcactatgctgaggcggttcgctcgcgatccggataataatgaaccgaactgtaatctggatctgctaatggccatgctcttcactgacgcgggtgccccaatgagaggcaaggtgcaccttctgagcgacacaatccagggagtcactgcaactgtcaccggagtgcggtatcagcaaagctggttgtgcatcatatgtaccatgaaggcactgcaaaaaagacatgtatgtatctctagattggtgcggcctcagaactggggggagaatagctgcgaggtgcgcttcgtcatcctcgttctcgcacccccaaagatgaagagcaccaagacagccatggaggtggcccgaaccttcgccaccatgttctcagacatagccttccggcagaaacttttggagacccgaactgaggaagagttcaaagaggcgctggtacatcagagacagctgcttaccatggtctcccatggtcctgtagctcctcgcacaaaagagaggtccaccgtcagcctgcccgcacatagacaccctgaaccacccaagtgcaaggacttcgtgcctttcggaaagggtatacgggaggatatcgcaagaagatttcccttgtatcccctggatttcacagatggcataatcggtaaaaacaaagcagttgggaagtatatcacaacgactctgtttctgtattttgcctgcttactgcccacgatagcgtttggatcactgaacgatgagaacaccgacggagccattgacgtgcagaagacaatagccggacaatctattgggggactgctctacgctctcttttcaggccagcctctggtcatacttctcacgaccgcacctctcgcgctttacatccaggtgattcgtgtgatatgtgacgactacgaccttgacttcaacagcttctatgcatggacaggactgtggaactctttctttttggctttgtacgctttctttaacttgagcctggtcatgtctttgtttaaaaggtctaccgaggagatcatcgccctctttatatccattacctttgtgctggacgccgtgaaggggacagtgaagatcttttggaagtattactacggacattatctggatgattatcacactaagcggacgtctagtctggtgagtctctctggcctaggagcctcgctgaacgcgagtctccacactgccctaaacgcctcctttctggcctcccccacagagctcccaagcgcgacccactctggacaggccactgcggtgctgtcgctcctgataatgttaggtaccctctggcttgggtacacactctaccagttcaagaaatcgccataccttcatccatgtgtacgcgaaatcttgtctgattgtgccctccccattgctgttctggctttctccctcatctcttcccacggttttcgggaaatcgagatgagcaagttcaggtataacccctctgaatcgccttttgctatggcccagatccagagtctgtccttgagggctgtctctggtgcgatgggcctgggatttctgctgtcaatgctcttttttattgagcagaacctggtggctgctctggtgaacgctccagagaacaggctggtgaaaggaacggcatatcactgggatctcctcctcttggccatcatcaacacaggcctctcactgttcggtcttccttggatccacgccgcttacccgcactcccccttgcacgtacgggctctagccctcgtcgaagagcgagtggagaatggacacatttatgataccattgtgaatgtcaaggagaccaggctgaccagccttggggctagtgtactggttggtctgtctctgctgctactgcctgtaccactgcagtggattccaaaacccgtgctgtacggcctgtttctgtacattgccctaacatcactggacggaaatcagttagtccaacgtgtggcacttctcctgaaagagcagaccgcttacccacccacccattacattcgcagagtcccacagaggaagatacactatttcaccggcctgcaagtgctccagctgctcctcctttgcgcatttggcatgtcttcactcccctacatgaagatgatattccctcttatcatgattgccatgatacccatcaggtatattttacttcctagaattattgaggccaagtatctggacgtgatggacgctgagcatcgcccatag

SEQ ID NO: 241638 - DNA, 951 bp, Artificial Sequence
  Description of Artificial Sequence: Synthetic coding sequence
atggcagccgctacccgcagggtgttccacttacagccttgtgaaaatagccctaccatgtcccaaaatggctattttgaagacagttcctactacaaatgcgataccgacgacacctttgaagcacgagaagaaatcctcggggacgaagctttcgacaccgccaatagcagcatcgtctcaggggagagtattcgtttttttgttaacgtcaatttagagatgcaggctactaacaccgagaatgaggcaacatctgggggatgcgttctgctgcacacgtcaaggaaataccttaagctgaagaatttcaaggaggagattcgggctcaccgcgatttggatggcttcctcgcccaggcctcaattgtactgaatgagaccgccacctccctggataatgtcctgcgtacaatgcttagaagattcgcgagagacccagacaacaatgaaccgaattgcaatctggatctgcttatggctatgcttttcactgacgctggcgctcctatgaggggaaaggtccatctgctttccgatactatccagggagtaaccgcaacggtcaccggggtgcggtaccaacagtcctggttgtgcattatctgcacaatgaaggcgctccagaagcggcacgtttgtatttctcggttggtgcggcctcagaattggggcgaaaactcttgcgaggtgcggttcgttatcttagttctggcacccccaaagatgaagagtacaaagacagcgatggaagtggcaagaacattcgcgacaatgttttccgacatagcattccgccaaaagttgctggaaactaggactgaagaagagttcaaagaggcactggttcaccagcggcagctgctgaccatggtcagccatggtcctgtcgcacccagaaccaaggaacgatcaaccgtgtccctccccgctcacagacatcccgagtag

SEQ ID NO: 241639 - DNA, 2628 bp, Artificial Sequence
  Description of Artificial Sequence: Synthetic coding sequence
atggcagctgcaaccaggcgggtcttccacttgcaaccgtgcgagaactcccctaccatgtcccagaatggatacttcgaggatagctcttactataaatgtgacacggacgatacttttgaggcacgggaggagatcctaggggacgaggcgttcgatactgccaactccagcatagtcagtggagagtcgattcgattcttcgtgaatgtcaatttagaaatgcaggcaactaacacggaaaatgaggctacaagtgggggatgcgttctcctccatactagtcgtaagtacctcaagttaaaaaatttcaaggaggaaatccgggcacaccgggacctcgatggattcttggcgcaagccagcatagtcctcaacgagacagcaactagtcttgacaacgtgctgagaactatgcttcgcagattcgctcgagatccagacaacaatgagccaaactgcaacctggacctactcatggctatgttatttaccgatgccggtgcacctatgaggggtaaggtgcatctattgtccgacaccatccagggagttacagctacggtgaccggagtgagatatcagcagagctggctgtgtataatttgtacgatgaaggccctacaaaaaagacatgtgtgcattagccgcttggtacgaccacagaactggggggaaaactcttgcgaagtacggttcgttatccttgttctggcgcctccaaagatgaagagcaccaagacggcgatggaggtggccagaaccttcgcaaccatgtttagcgatattgcctttaggcaaaagctcctggagacaagaacagaggaggagtttaaagaggcattagtacaccagcgacaactgctgactatggtgagccacggacccgtcgccccacgcaccaaagaaaggtctacagttagcctgcccgctcatcgtcatccagagcctcctaagtgcaaagattttgtgccattcggcaagggaatccgcgaggatatagcacggcgtttccctctctacccgctcgactttacagacggaatcattggcaagaataaagctgtcggaaaatacatcacaaccacgctattcctttatttcgcgtgccttctccccaccattgcttttggctcccttaacgacgagaacaccgatggagccatcgacgttcagaagaccatcgctgggcagtctattgggggtctgctgtatgccctattcagtggacagcctcttgtcattcttctaacgaccgcccctctggctttgtacattcaagtgataagggttatctgtgacgactacgaccttgatttcaactctttttatgcctggaccggtctctggaatagcttttttctagcgctgtatgccttcttcaacttatccctggtaatgtccctatttaagcggtccacagaggagataatcgccctcttcattagtattactttcgtcctcgatgccgtgaagggaacagtcaaaatattctggaaatattattacggccattacctggatgattatcacactaaaaggacaagctccctggtctcattaagtggactgggtgccagcctgaacgcaagcctgcatacggctctgaacgccagttttctggccagtccgacagaacttccctcggccacgcacagtgggcaagcaaccgcagtgttgtctcttctcattatgttgggtactctctggctcggatacacactgtatcagtttaaaaagtccccttatttgcacccatgcgttcgagaaatcttgagtgactgcgctctgccaattgcagtgttggcgttctcacttatctcttcccatggcttccgggagatcgaaatgtctaagtttaggtataatccaagcgaaagcccttttgcaatggctcagattcagagcctgagcctccgcgcagtatctggggctatggggctcggtttcctgctgtcaatgctcttctttattgagcagaatctggtggccgctcttgtaaatgcccctgaaaacagattggtgaaaggcactgcctatcattgggacttgctgctgctagccatcataaatactgggctttctctgtttggccttccatggattcacgccgcatacccacatagtcccctgcatgtacgagctctcgccctggtcgaagagagagtggagaacggacatatctacgacactatcgttaatgtgaaggagaccaggttaacgagtctcggagcatccgtcctcgtcggcctctccttacttctgttgccagtccctctgcagtggattccgaagccggttctatacggcctgtttctatacattgccctcacaagtcttgacggcaaccaattggttcagagagttgctctgctgctgaaagagcagacagcctatccacctactcactatatccggagggtgccgcagcggaagattcattatttcaccgggctgcaggtcttgcagctgcttctgctgtgcgctttcggcatgagcagcttgccatacatgaagatgatttttcccctgatcatgattgccatgatcccaattagatacatcctgctaccccgtattatcgaggcaaagtacctggatgtaatggatgcggagcacaggccctag

SEQ ID NO: 241640 - DNA, 1113 bp, Artificial Sequence
  Description of Artificial Sequence: Synthetic coding sequence
atgaccctggcgtccaggctatcgactgcagccaacacgggtcagatagacgatccccaagaacaacaccgagttatctcttctaacctggcactaatacaggtgcaagccactgtagtcggcctccttgcggctgtagccgctttactgctgggcgtagttagccgagaggaggtggacgtggctaaagtcgaattgctctgtgcaagttcagtgctcaccgctttcctggctgctttcgccctgggggtgctaatggtgtgcattgtgatcggcgctcggaaactgggggttaatcctgacaacattgctaccccaattgctgcaagccttggtgacctcattaccttgtccattctggccctggtgtcctccttcttctaccggcataaagatagcaggtacttgactcccctcgtatgcctttcgtttgccgctctgacacccgtttgggtgttgatcgccaaacaatcacctcctattgtgaagatccttaagtttgggtggtttccgatcattctagccatggtcatatcatcctttggcggactgatcctgtccaagaccgttagcaaacagcagtacaaaggaatggcaatctttacgccagtaatatgcggagttggtggaaatctggtcgcaattcagacatctcgaataagcacatatctccacatgtggtcggccccaggggtgctgccactgcagatgaaaaaattctggccaaatccgtgttcaaccttttgcacctccgagataaattctatgagcgcacgcgtgctgctgctattggtggtgccagggcacctgatattcttctatatcatctacttggtcgaaggccagtctgttatcaattcccagactttcgtggtcctataccttcttgccggactgattcaggtgactatcctgctttaccttgctgaggtgatggtgaggctcacctggcaccaggcactagaccccgacaatcactgcatcccttacctgactggccttggggacttgctgggcacaggccttctggccctatgtttcttcacggattggttgttgaagagcaaggctgaactaggcggaatctctgagcttgcgtctggcccaccttag

SEQ ID NO: 241641 - DNA, 1542 bp, Artificial Sequence
  Description of Artificial Sequence: Synthetic coding sequence
atgtccagtaagcctgagcccaaggacgtgcaccagttaaatggtactggcccaagcgccagtccgtgttcctcagatggccctggccgtgaaccccttgcaggaacatccgaatttttaggtccagacggagcaggcgtggaagtcgttattgaatctcgagccaacgccaaaggagttcgcgaggaggatgcgctactggaaaacggcagtcagtcaaacgagagcgacgacgtgagcacggatcgcggtcccgcacccccttccccactgaaggagacctctttcagtatcggcctgcaggttctgttcccatttctcctggccggatttgggaccgtggccgcaggtatggtgttagacattgtgcagcactgggaggtatttcaaaaggtaactgaagtgtttatcctagttccagccctgctcggactgaaaggcaacctagagatgaccctggcttcccggctgagtactgccgctaatatcggccacatggataccccgaaagaactatggagaatgatcaccggaaatatggctctgatacaagtgcaggcgacagtcgtcggatttctggcatctatcgctgctgtggtcttcggctggataccagatggacatttttctattccacacgcattcctgttatgcgcctctagcgttgcaacagccttcattgcatccctggtgttgggcatgattatgatcggagttatcatagggtccagaaaaattgggataaatcccgataacgtggcgacgcccatcgctgccagcttaggagatctcatcaccttagccctccttagtggtatctcttggggattatacctggaacttaaccactggaggtacatttatccccttgtctgtgccttcttcgtggccctgctgccagtgtgggtggtcctggccagaaggtcacctgctactcgtgaagttctgtacagtggctgggaacccgtgattatcgcaatggctatctcgagcgtgggaggactgatcctggacaagactgtttccgatcccaattttgctggtatggccgtcttcacccccgtaataaacggagtgggaggcaacctggtcgccgtacaagcatctaggattagcactttcttacacatgaacggaatgcccggtgaaaacagtgagcaggccccacgcagatgtccaagtccttgtaccaccttctttagtcctgacgtcaattctagatctgcacgcgtgctttttctgcttgtagtcccgggtcatctggtattcctatacactataagctgcatgcaaggaggccatacaaccctgaccttaatcttcattattttctatatgaccgccgctcttttgcaggtgcttatcttgctttatattgccgattggatggtacattggatgtggggtcggggactagacccagacaatttttctattccctatctcactgcattaggggacctgctgggcactgggctgctagccctgagctttcacgtactgtggcttatcggggatcgggacactgacgttggcgattag

SEQ ID NO: 241642 - DNA, 1722 bp, Artificial Sequence
  Description of Artificial Sequence: Synthetic coding sequence
atgactaattccaaaggtcgttcaattaccgacaaaacaagcggcggtccgagctccgggggtggatttgtagattggactctccgactcaataccatccagtcagataagtttctgaaccttttgctgtccatggtgccagtcatttatcagaagaatcaggaagacagacataagaaagcgaatggcatctggcaggatgggttatccactgccgtgcagaccttctctaatcgatctgagcagcacatggaataccattccttctctgagcagtcctttcacgccaataatggccatgcctcctcttcttgctcacagaagtacgatgattacgcaaactataattactgtgacgggcgtgaaaccagcgagacaactgcgatgctgcaagatgaggatatttcttccgacggtgatgaggatgctatcgtcgaggtgactccgaaactacccaaggaatccagtggcattatggccctgcaaattctcgttcctttcttgctggccggttttggtaccgtgtctgcgggaatggttctcgacattgtccaacactgggaggtgtttaggaaagttacggaggtgtttattctggtcccggcactgcttggcctcaagggcaatctggagatgacattggcctccagactgtccaccgctgtgaatattgggaagatggattcaccaattgagaaatggaatctgataattgggaacctcgctctgaaacaggtccaggctactgtggtgggatttctggctgctgttgcagctattattctggggtggattccggagggtaaatattatctggaccactctatcctcctgtgttctagtagcgtggccacggcctttatagcctccctcctgcaggggattatcatggtcggcgtcatagttggctccaagaagaccgggatcaaccctgataatgtggccacacctattgccgcaagctttggagatttgatcacattggcaattcttgcctggattagtcaggggttgtattcctgcctggagacctactactacatctctccactggtgggtgtattcttcctagctctcacccctatatggatcatcattgccgctaaacatcctgccactaggactgtgctgcacagcggatgggaacccgtgatcaccgccatggttatcagtagcatcggcggattgattttggataccacagtatcagaccctaacctggtggggatcgttgtgtacacccccgtcattaatggtatcggcggtaacctggtcgccattcaggctagccgcatctcaacttatctgcatctgcattcaattccgggagagctgcccgacgagcctaaggggtgctactaccctttccgcacgttctttgggcctggcgtgaataacaaatcagcccaagtgctgctcctgctggtaattccagggcacctcatctttctgtacactattcacctgatgaagagtggtcacacgtccctaaccataatcttcatcgtcgtgtatctgtttggagccgttctccaggtgttcacactgctgtggatagccgactggatggttcaccatttctggcgtaaaggcaaggatcccgatagtttcagcataccctatctcactgctctgggcgacttactgggcaccgcactcctggcactgtcatttcactttctttggctcattggagacagggatggcgatgtaggcgactag

SEQ ID NO: 241643 - DNA, 369 bp, Artificial Sequence
  Description of Artificial Sequence: Synthetic coding sequence
atgaccaattctaagggacgtagcataactgacaaaacttcaggaggcccttctagcgggggaggatttgtggactggactctgcggttgaataccattcagagtgataaatttttaaacttgttactttctatggttcccgtgatctatcagaaaaaccaagaggaccgacataaaaaagcaaacgggatatggcaggatggtttaagcaccgccgtgcaaacattttctaacagatcagaacagcatatggaataccacagcttcagcgagcagagtttccatgccaacaacggacacgcctcatccagttgctctcagaagtacgacgattacgccaactataattattgtgatggccgagaatag

SEQ ID NO: 241644 - DNA, 432 bp, Artificial Sequence
  Description of Artificial Sequence: Synthetic coding sequence
atgaccaacagcaagggccgatccatcaccgacaaaacctctgggggtccaagttccgggggaggatttgtggactggaccctccgacttaacactattcaaagcgacaagtttttgaatttgctactctccatggtccctgtcatctatcagaagaaccaggaagacagacacaagaaggccaacggtatttggcaggacgggctttccaccgccgtgcagacgttttctaatcgctctgagcaacacatggaatatcacagtttctccgaacaaagttttcacgctaataacgggcacgcttcatcttcctgcagccagaagtatgacgactacgcgaactacaattactgtgacggccgagaaacatcagaaacaacagctatgctgcaggacgaggatatctcctctgatggggatgaagacgcatag

SEQ ID NO: 241645 - DNA, 141 bp, Artificial Sequence
  Description of Artificial Sequence: Synthetic coding sequence
atgactaacagcaaagggaggagcattacggataagaccagcggcggaccctcttccggcggagggttcgtagactggaccttacgattgaataccatacaatcagacaagtttctgaacttattgttgtctatggtgtag

SEQ ID NO: 241646 - DNA, 219 bp, Artificial Sequence
  Description of Artificial Sequence: Synthetic coding sequence
atgactaatagcaaaggaaggagcattacagacaagacttcaggcggaccatccagcggaggcggattcgtcgactggaccctgaggctgaacactatacagagcgacaagttcctcaatttactcctgagcatggttcctgttatctatcagaaaaatcaagaagatcgccataaaaaagctaatgggatctggcaggacggtctttcaaccgcctag

SEQ ID NO: 241647 - DNA, 39 bp, Artificial Sequence
  Description of Artificial Sequence: Synthetic coding sequence
atgacaaactcaaagggtcggtctattacagataagtag

SEQ ID NO: 241648 - DNA, 231 bp, Artificial Sequence
  Description of Artificial Sequence: Synthetic coding sequence
atgaccaacagtaaaggccgtagtatcaccgacaaaaccagtgggggaccatcttcaggaggtgggtttgtggattggacgctcaggctcaacaccatccagtcagataaattcttaaacctgcttctttcaatggttcccgtgatctaccaaaagaaccaggaagaccgacataaaaaggcaaacggcatctggcaggacggcctgtctactgccgtgcagacattttag

SEQ ID NO: 241649 - DNA, 285 bp, Artificial Sequence
  Description of Artificial Sequence: Synthetic coding sequence
atgaccaatagcaagggacgctccatcaccgacaaaacttccggcggtccctccagcggtggtggcttcgtagactggacgctaagactgaacacaatccagagtgacaaattcctgaacctgctcttatcgatggtccccgtaatttatcaaaaaaatcaggaagaccgacacaagaaggctaacggcatttggcaggacggtctttctaccgcagttcagacattctctaacagaagcgaacagcatatggagtaccattctttctctgaacaaagcttctag

SEQ ID NO: 241650 - DNA, 1524 bp, Artificial Sequence
  Description of Artificial Sequence: Synthetic coding sequence
atggacggtactgaaaccaggcagcggcgtctggactcctgtgggaaacccggtgaactgggtctcccccaccccctgtctacagggggactacccgtcgcatcagaagacggcgctttgcgagccccagaaagtcaatcggttactccaaaaccactcgagaccgagccatcgcgcgagaccacgtggtccattggcttgcaagtgacggtgccttttatgtttgccggactcggactgtcttgggccggtatgcttctagattacttccaacactggccggttttcgtggaggtgaaggaccttctgactttagtcccgccacttgtgggtctgaagggtaaccttgagatgacactggcatcacgactttctaccgccgcaaacacaggccagatcgatgatcctcaggagcagcatagagtcattagctcaaatttggctcttatccaagtgcaagctacagtcgttggattactagccgcagtcgccgcactcttgctgggggtggtgagcagagaggaggtggatgtggccaaggttgagcttctgtgcgcgtcttctgtgctaactgcctttttggccgcatttgccctgggtgtattaatggtatgcatagtgattggcgctagaaagcttggcgtgaatccggataacatcgcaacgccaatcgctgcgtcactaggagatctgattacactttctatcctggccttagtgtccagcttcttctaccgacacaaagatagtagataccttactccattagtgtgtctctcattcgctgcactgactccagtgtgggtgttgatcgccaaacagagccctccgatagttaagattttgaaatttggctggttcccgatcatcttggccatggtgatttcctcttttgggggactcatcctttcaaagaccgtcagtaaacagcagtacaagggaatggcaatcttcacacctgtcatatgcggcgtgggtgggaacctcgtcgctattcagaccagtcgtatctcaacatatctccacatgtggtctgctccaggagtgctgcctctgcagatgaagaagttctggcctaacccttgttcaaccttttgcacatccgagattaattccatgagcgctcgggttctccttctgcttgtggtgcccggacacctcatttttttttacatcatctacctagtggagggccagtccgtgataaattctcaaacgttcgtggttctgtacctccttgcaggattaatccaggtgactatactgctctacctggcggaagtgatggttcggctcacatggcaccaggcactggacccggacaaccattgcatcccttacctgactggactaggcgacctgctgggctctagtagcgtggggcatactgccgctgtgccccgtagatgtactgcgtcacctggctggggtttaattcagccattcatttgcacccagcatctgatagtaagcttactgtccttttattttcctttttgtctgctggccaagacttcaatctag

SEQ ID NO: 241651 - DNA, 1416 bp, Artificial Sequence
  Description of Artificial Sequence: Synthetic coding sequence
atggatggaacggaaacaaggcagcgaagactcgatagttgcggcaagcctggagagttgggactgccccaccccctttccacaggtggcttacctgtggccagtgaagatggcgctcttagagcacccgagagtcagagtgttacgccaaagccgttggaaactgagccctcccgcgagaccacctggtcaatcggactgcaagtcactgtgccttttatgttcgccggtctcgggttgtcttgggcgggtatgttacttgattactttcaggcgaatactgggcagatcgacgatcctcaagagcaacacagagttattagttccaacctcgctttgattcaggtgcaagccacggtggtggggcttctggccgctgtggcagcactcttgctaggcgtggtatcccgggaggaagtcgacgtcgcaaaagtggagcttctgtgcgcctccagtgtgctgactgctttcctcgcagcattcgcccttggggtgttaatggtatgcattgtaatcggggctcgcaagctaggagtgaatcctgacaatatcgctacaccaattgccgcttcacttggagatctgataaccttgtccatattagcccttgtgtcatctttcttctatcgccacaaagatagtcgctatttaactcctctggtgtgccttagttttgcagccctaacccccgtgtgggtgctcattgccaagcagagccctccgatcgtaaagatcctgaagttcggatggttccccattattctggcaatggttatctcttcattcggcggactgatcctgtccaagactgttagcaaacagcaatataagggtatggccattttcactccagtaatctgtggcgtgggcggaaatctggtggccattcagacctctcggatttcaacctatctgcatatgtggtccgcccctggagttttgcccctgcagatgaaaaagttctggcctaatccgtgctccaccttttgcacatccgaaatcaatagcatgagtgcacgtgtattactcctcctggtggtgcctgggcacctcattttcttttatataatatacctcgtggagggacagtcggtgattaattcccaaacattcgtggtcttgtacctactggccggactgatccaggtgaccattttgctctacttggccgaggtcatggtgcgtctgacatggcaccaggccctggatcctgataaccattgcataccttatctgacaggactgggcgatttgctggggagctcatcagtggggcatactgccgcagtgcccaggaggtgtacggccagccccggttggggactgattcagccctttatatgtacccagcatctaatcgtttccttgctttctttttatttccctttttgtctactcgcaaaaaccagcatctag

SEQ ID NO: 241652 - DNA, 1464 bp, Artificial Sequence
  Description of Artificial Sequence: Synthetic coding sequence
atggatggtaccgaaacaaggcaaagaagactggattcctgcgggaagcccggtgagttaggactccctcatcccctctccaccgggggactgcccgttgcatcagaggacggggctctgcgggcaccggagagccaaagcgttaccccaaagccccttgaaacagagccatccagagagactacttggagcattgggctccaggtgacagtgccgtttatgttcgcgggtctcggcctgtcttgggccggtatgttgctggattattttcagcattggcccgtgtttgtcgaagtgaaggacctcctcacactggtgccccctttggtgggactgaagggaaacctggagatgactctggcaagtcggctgtcaactgcagcgaacacaggccaaatcgacgatccccaggagcagcacagggtcatctcctcaaacctcgcgctcattcaggtccaagcaactgtggttgggctcctcgccgcagtggcagctttattacttggagtggtaagcagggaggaggtcgatgtggctaaagttgagctgctgtgtgcatctagcgtcctgaccgcatttttggccgcattcgcactgggtgttctgatggtatgcatcgtgatcggggcacgtaagctgggggtgaaccctgacaatattgccacaccgattgcggctagtttaggagatctgatcaccttgtcaatattagctctggtctctagttttttttaccgccacaaagactcccggtacctgactcccctggtgtgtctgagctttgctgccctgactcccgtgtgggttcttatagctaagcagagtcctcccattgtcaaaattttgaagttcgggtggttccctattattctggccatggtcattagtagctttggcggattgatcctatcaaaaaccgtgtcgaagcaacaatataaagggatggcgatctttacccccgtgatatgtggcgtaggaggcaacctagtcgccattcagacgagtcggattagcacttatctgcacatgtggagcgcccctggtgttcttccacttcagatgaagaaattctggcccaatccctgtagcaccttctgtacgagtgagatcaactcaatgtccgcccgagtgcttctgctcctggtagttcctggacatctgatcttcttttacatcatataccttgtggagggtcagtcagtcataaatagtcagacttttgtggtactatacctcctggccggattgatacaggtgacgattctgctttatctggccgaagttatggtgaggctcacctggcatcaagcactggacccagataatcattgtataccctacctcaccggtttgggcgacttgctcgggactggccttttagcactgtgtttctttactgactggctcctcaagagcaaagccgagctgggtggaattagcgaacttgctagtggtcccccatag

SEQ ID NO: 241653 - DNA, 1386 bp, Artificial Sequence
  Description of Artificial Sequence: Synthetic coding sequence
atggtggtaacccagttgaatttagaattctgctttcaggggaaaaaattacggggatttagctgcgaactcacccgatctccacacggagtgttacctgaatcttttttcacaattatgtgtcaggttgtggtgcccatcctgctgtccgggctgtgcatgatgaccgccggactggtcatgaatacaatccaacattggcctgtgtttgtcgaagttaaggaccttctgaccctagtaccacctttagtgggactgaagggaaacctcgagatgacactggcttccagactgagtacagccgcaaataccggacagattgatgatccccaggaacagcatcgggttatttcctccaacttagccctcatccaggtccaggccaccgtggtaggcctgctggccgctgtggccgcactgttactgggagtcgtctctagagaggaagttgatgtggccaaggtagaacttctgtgcgcttcttccgtgcttaccgccttccttgcggcttttgcactgggcgtcctgatggtatgtatcgtcatcggcgctcgcaagctgggggtgaatccggataacattgccacccccatagcagccagccttggggatctcatcacattatccatcttagcattggtcagcagttttttttacagacacaaggattccaggtacctgaccccactagtctgtttgtcctttgcagcactgacaccagtctgggttttaattgcaaaacagtccccacctattgttaagatcttaaagtttggatggtttcccataatcctggccatggtgatttcttctttcggcggtttgattttaagcaagaccgtcagcaaacaacagtataaggggatggctatatttacacccgtcatctgtggggtgggtggcaacttagtcgccattcagacttcccgcatcagcacctacctacacatgtggagtgccccaggcgtcctgcctctccagatgaagaagttctggcccaatccttgctccacattctgcacctcggaaatcaattcaatgtcagcccgagttctcctgttgctggtggtgcctgggcacctgattttcttttacattatttacctcgtggagggccagtccgttattaactctcaaactttcgtggtgctgtatttacttgcgggtctaattcaagtgactattttactgtaccttgccgaagtcatggtgcgcctaacctggcatcaggcattggatcctgataatcattgcatcccttacctgaccggattgggagatctgttagggacaggccttctcgctctgtgctttttcaccgattggttgctgaaaagtaaggcagagctgggagggatatcggagctggcaagtggtccgccttag

SEQ ID NO: 241654 - DNA, 1437 bp, Artificial Sequence
  Description of Artificial Sequence: Synthetic coding sequence
atggatggtaccgaaacccgtcagcgcagactcgattcctgcggcaagcctggcgagctgggactgcctcaccccctgtccaccggcggtctgcctgtggcaagtgaggacggagctctgcgggcacctgaatcacagtcagttacccctaagccgcttgagaccgagccatcaagggttacagtgccgtttatgtttgccggtttagggctctcctgggcaggcatgctcctcgattacttccagcattggcccgtttttgtggaagtgaaagacctgctcactttagtaccaccgctagtgggattgaagggcaatctggaaatgaccctcgctagtaggctgtctacggctgctaacacaggtcaaatcgatgatcctcaggagcagcacagggtcatttcttccaacctcgcgttaattcaggtccaggccaccgtggtcgggctgttggcggcagtggcggctctgttgctaggggtggtcagccgggaagaggtagatgtggccaaggtagaactgctttgcgcttcctccgtgctaacagctttcctggctgcctttgcgctcggcgtgctgatggtttgtatcgtgatcggcgctcgcaagctgggcgttaaccccgataatatagccactcccattgcagcatcgcttggcgatctgattaccctgagtatcctggctctagtgtcttcgtttttttatcgtcataaggactcccgctatttaacccctctggtctgtctctccttcgccgctctgacacctgtttgggtgctgattgctaaacaatctccgcctatagtcaagatcctgaaattcggatggttcccaattatactggcaatggtgatctctagcttcggcggtctgatactatccaaaacagtctcaaaacagcagtacaagggtatggccatcttcacccccgtcatctgcggagtcggcggaaacttggtggctattcagacgtctagaataagcacctatctgcatatgtggagtgctcctggagtgctgccactacagatgaaaaagttctggcctaatccgtgtagcacattctgcacttctgaaatcaattccatgagtgcgagggtcctcctgttgctggttgtccccggacatctgatctttttctatattatctatttggtggagggccagtcagtgatcaattcacaaacttttgttgtgctctatctattagcaggcctcattcaggtgactattctgctgtacctggctgaggtcatggtccgactgacatggcatcaagcactcgatcctgataaccactgcattccctatcttacaggcctgggagatttattagggactgggctgctggccttgtgtttcttcacagactggctccttaaatctaaagccgaactcggcggaatctcggaacttgcttctggaccgccatag

SEQ ID NO: 241655 - DNA, 459 bp, Artificial Sequence
  Description of Artificial Sequence: Synthetic coding sequence
atggacgggacagagacccggcagagacggctggacagctgtggcaaacctggcgagctaggccttccacatcctctgagcaccggtgggcttccagtcgctagcgaagacggcgctttgcgtgcacccgagtcccagagtgtaactcctaaacccttagagactgaaccttcccgcgagaccacctggagcatcggtcttcaggtaactgttccttttatgtttgcaggcctggggctcagttgggccggaatgctgttagattacttccagcattggccagtgttcgttgaggtgaaggacctgctgacactggtgccacctctcgtgggcctgaagggaaatctggaaatgaccctggcctccagactgtccacggccgctaatacgggccagattgacgacccccaggaacaacacagagtgatcagctcgaatctggctttgatccaggtgtag

SEQ ID NO: 241656 - DNA, 459 bp, Artificial Sequence
  Description of Artificial Sequence: Synthetic coding sequence
atggacggaaccgaaactcgtcaaaggcgtttggatagctgcggcaaaccaggcgagctcgggttgccccatcccctatcgactggaggtcttccagtcgcttctgaggacggagccttgcgggctccagaaagtcagtccgtgacaccaaaacctctggaaacagagccctcacgcgagactacatggtcaatagggctgcaagtgacagtgccgtttatgttcgcaggtctcggcctctcttgggccggaatgctgcttgactactttcagcactggcctgtttttgtggaggtgaaggatctcttgaccctagttccgccacttgtgggactgaaagggaaccttgagatgaccctcgcgtcccggctgagcacagccgctaacaccggccagatcgacgacccacaggagcagcatcgcgtcatctccagtaatctggctctcatccaggtctag

SEQ ID NO: 241657 - DNA, 261 bp, Artificial Sequence
  Description of Artificial Sequence: Synthetic coding sequence
atggacggtacagaaacccgccaaagaaggctcgattcgtgtggaaaaccaggggagctgggactgccgcatcccctgtctacgggcggtcttcccgtggcgtccgaggacggagccttgcgcgctccagaatctcaatccgtgacacctaaacccttggagaccgagccgtcacgagagaccacctggagcattggactgcaggtgacggtcccattcatgttcgccggattagggctttcatgggccggtatgctttag

SEQ ID NO: 241658 - DNA, 606 bp, Artificial Sequence
  Description of Artificial Sequence: Synthetic coding sequence
atggacgggactgagactagacagcgcaggctggacagctgtggaaagcctggcgagctcggactgccacatccactttcgaccggaggactcccggtggctagcgaagatggagccctgagggcaccggaatcgcagtccgtgacacctaagcctctcgaaaccgaaccctctagggagacgacatggagcatcggactgcaggtgacagtcccatttatgttcgcgggacttggccttagctgggctggtatgctactggattactttcagcactggccagtgtttgtggaagttaaagacctgttaacgctggtgccaccactcgttggacttaagggtaatctcgagatgaccttggccagccgcttgtctacagctgcaaacaccggacaaattgatgacccgcaggaacagcacagagtgatcagtagcaatctggccctcattcaggtgcaagcaacggtcgttgggcttctcgcggctgtggcagcccttctgcttggggtcgtgtcccgcgaagaggtcgacgtggctaaggtagaattgttatgtgcaagcagcgttctgacggcattcctggcagcatttgcattgggcgagtag

SEQ ID NO: 241659 - DNA, 414 bp, Artificial Sequence
  Description of Artificial Sequence: Synthetic coding sequence
atggatggaactgaaacgcggcaacggagactagacagttgcggaaaaccaggggagctagggctgccacaccctctgtccacaggtggtctgcctgtggcctcagaagatggagccctgcgcgctccggagtcccagagtgtcacacccaaacctctggaaactgaacccagcagagagactacttggtcgataggactgcaggtcacggtccccttcatgttcgctggtttgggcctgagctgggccggtatgctgttggattatttccaagccaacacagggcaaatcgatgacccacaggagcagcatagagtgatttctagcaatttagccctcatccaagtgcaggcgaccgtcgtggggctgctcgcggctgtggctgccctgctgcttggagttgtgtctcggtag

SEQ ID NO: 241660 - DNA, 459 bp, Artificial Sequence
  Description of Artificial Sequence: Synthetic coding sequence
atggatggaacagaaacgagacaacgtaggctggactcctgtggtaaacccggtgagctggggctccctcacccccttagcacaggtggactccctgtcgctagtgaggacggcgctctcagggccccagaatcccagtctgtcacccctaaaccactagagactgagccctcaagggagaccacgtggagcattggacttcaagtgaccgtgccgttcatgttcgcaggccttgggctctcctgggccggaatgcttctggattatttccagcattggccggtgtttgtcgaagtaaaggacctactgaccttggtacctccactggtgggcctcaaggggaacctggagatgacacttgcatctagactgtccaccgcagccaacactggtcaaatcgacgacccccaggaacagcatcgtgtcatttctagtaacctagctctgatccaagtctag

SEQ ID NO: 241661 - DNA, 1680 bp, Artificial Sequence
  Description of Artificial Sequence: Synthetic coding sequence
atggcccctactctccaacaggcttatagaaggagatggtggatggcatgcacagcagttctggaaaacctgttcttctctgccgtgctgcttggatggggctctctgcttataattcttaaaaacgaggggttttattccagcacatgtcccgctgagtcaagcactaacaccacacaggacgagcagcggcgttggcctgggtgcgaccagcaagatgagatgcttaacctcggtttcacaataggcagcttcgtgcttagtgccacgactctcccgttaggaatcctgatggacagattcggcccaagacccgtccgacttgtgggcagtgcatgcttcacagcttcatgtaccttaatggctctggcgtccagagacgtcgaagcgctctctccactgattttccttgccctgagcctgaacggcttcggcggaatctgtctgacatttacctctctgaccctacccaatatgtttggcaacctcagatccacactcatggcactcatgattggatcatatgcgagctccgctatcacttttcctggcataaaactgatctacgatgcaggagtagcctttgtggtcataatgtttacttggtccggacttgcgtgtttgatcttcctgaattgtacattgaattggcctattgaagccttccctgcgccagaggaggtgaactacaccaagaaaatcaaactgtccggactcgccttggatcacaaggtaactggtgatctgttctatacacacgttacgaccatgggacagaggttatcccagaaggctccttccctggaggatgggtctgatgccttcatgagcccccaggatgtccggggtacgtcagagaacctaccagagcgttcagtgcctcttcgtaagtcactttgctcccccacttttctgtggtcattgttgacaatggggatgactcagctgcggattattttctatatggcagccgtgaacaagatgctggagtatttagtgactggtgggcaagagcatgagacaaatgaacaacagcaaaaagttgcggagacggtgggtttttatagcagtgtttttggtgcaatgcagttgctgtgtttgctgacatgtccgctgattgggtatatcatggattggcgcataaaagattgcgtggatgctcctacccagggaaccgtccttggcgacgcacgagatggagtcgccacaaaaagcatacgacctcgatattgcaaaatacagaaactcactaacgcaattagcgccttcacacttacaaatctcctactggtggggttcgggataacctgccttattaataatctacacctgcagttcgtaacctttgtcctgcacacaattgtgagaggtttctttcacagcgcctgtggatctctgtacgcagcagtttttcccagcaatcatttcgggaccttgacgggactgcagtcgctgatctctgcggtgttcgcccttctccaacaaccgctgtttatggccatggtgggcccacttaaaggcgaaccattttgggtgaatttggggcttttgctcttcagccttctggggttccttctgcctagttatctgttttactatagagctagactccaacaggagtatgctgctaatggtatgggtcccttgaaggtgctgtccggcagcgaggtcactgcttag

SEQ ID NO: 241662 - DNA, 1680 bp, Artificial Sequence
  Description of Artificial Sequence: Synthetic coding sequence
atggcaccaactctgcagcaggcatacagacgtagatggtggatggcatgcacagcagtactggagaatctgttcttttccgccgtgctgctgggctggggcagtctgcttatcatcctgaaaaacgaaggattttactcctcaacgtgccctgcagagtcttcaaccaatacaacacaggacgagcagcgcagatggccgggatgcgaccaacaggatgaaatgttaaacctaggcttcacgataggatcctttgtgctcagtgcaaccacgctaccattgggaatcctcatggaccgctttgggcctcgacctgtcagacttgtcggatccgcctgttttacagcctcatgcacactgatggccctagcctcccgcgatgtggaggccctgagccccttaatcttcctggctctgagcctgaacggctttggtggaatttgtctgacctttacttccctgaccctacccaatatgttcggaaatctacggtccaccttaatggcccttatgattggatcatatgctagtagcgctataacttttcctgggattaaactgatctacgatgcgggagtggcattcgtggtgatcatgtttacctggagtggattagcttgccttatctttctcaattgcacgctgaactggccgattgaagccttcccagcccctgaggaggtcaattataccaagaagataaaactgtccggcctcgcactagaccacaaggtcaccggggatttgttctacacccacgttaccacaatgggacagaggttgtcccaaaaagctcctagcctggaagacgggagtgatgcattcatgtcccctcaagacgtgcgaggcaccagtgagaacttaccggaacgcagcgtacctctacgcaaatctctctgcagtcccacgtttctgtggtctctcttgactatggggatgacccagcttcggattatattctacatggccgctgtgaataaaatgcttgaatacttagtgactggcggacaggaacacgaaacaaatgaacagcaacagaaggttgcagagacagtgggcttttattcgtccgtcttcggagccatgcagttgctttgcctcttaacctgtccacttatcggctacatcatggactggagaattaaggactgcgtcgacgctcccacccagggtacagtcctcggggacgcacgggatggtgtggccaccaaatccattagaccacggtattgcaagatccagaagctgactaacgcgattagcgccttcacactgactaacctgttgctcgtgggcttcggcattacctgcctgatcaataatctccacctgcagtttgtgacatttgtcctccatacgatcgtgagggggttcttccatagcgcttgcggctccctctacgccgcagtctttcctagtaaccacttcggaacactcaccgggttacagagcttgatctccgccgtcttcgcattactgcagcagcccctattcatggccatggtcggccctctgaaaggtgagcccttttgggtgaacctcggtctgctactcttttcccttttgggattcctcctacctagttacttgttctactatcgagcacgcctgcagcaggaatacgccgcaaatggtatgggccctctgaaagtgctatcgggctctgaagtcacagcatag

SEQ ID NO: 241663 - DNA, 333 bp, Artificial Sequence
  Description of Artificial Sequence: Synthetic coding sequence
atggccccaacattgcagcaagcctaccgaaggcgttggtggatggcctgtaccgctgtgctggaaaacttgttcttttccgccgtgctgcttgggtggggctctctcttaattattcttaaaaatgagggcttttacagctcaacttgtccagccgagtcctctactaataccactcaggacgagcagaggcgttggccgggatgcgatcagcaggatgagatgctgaacctgggtttcacaattggatcctttgtgctaagtgctacaactctgcctctgggaattctgatggatcgtttcggtccacgacccgtgcgcctggtgggttag

SEQ ID NO: 241664 - DNA, 1710 bp, Artificial Sequence
  Description of Artificial Sequence: Synthetic coding sequence
atggcccctaccctggccactgcccataggaggagatggtggatggcctgcaccgccgttttggagaacctcctgttctcagcagtccttttagggtgggggtcactgttaataatgctgaaaagcgaaggcttttactcgtacctttgcaccgaacctgagaacgttaccaatggaaccgtaggtggaaccgcggagcctggacacgaggaagtctcctggatgaatggctggctatcttgccaggcacaggatgagatgctgaacctcgcatttactgtgggctcctttctgctgagcgcgattaccctgccccttggcatcgttatggacaaatatggacccagaaagttgaggctgctcggaagcgcctgttttgctgtgagctgtctcttgatcgcctacggggcttctaagcccaatgctttgtccgtgcttatcttcattgctctggccctgaacggcttcggaggtatgtgtatgaccttcacctctctgaccctgcccaatatgttcggagatctcaggagcacatttatcgccctcatgattggctcttatgccagctccgcagtgaccttccctggcatcaagttaatttacgacgccggtgtgtcttttatcgtcgttctagttgtttgggcaggctgttcaggcctcgtgtttttaaattgtttctttaattggccgctcgaacccttccctggaccagaggacatggactactccgtgaaaatcaagttttcttggctgggctttgaccacaaaattacgggaaagcagttctacaaacaggtgaccaccgttggacggagactgagtgtgggcagctctatgcgatccgccaaagaacaggtggcactccaggaaggccacaaactttgcttatccaccgtagatctggaggtcaaatgtcaacctgatgctgccgtcgccccaagttttatgcatagcgtgttcagtcccatcttgctgctttcactcgtgacgatgtgtgtgacacaactgagactaatcttctatatgggcgcaatgaataatattctgaagtttctcgtgagcggggatcaaaagactgtgggcctctatacaagcatctttggtgttcttcagcttctgtgtctgttgactgccccagtgattggctatatcatggactggaggttaaaagaatgcgaggacgcctctgaggaaccagaagagaaagatgccaaccagggcgaaaagaaaaaaaagaagagagacagacaaatccagaagatcaccaacgccatgagagccttcgccttcactaacctgttgctggtgggcttcggtgtgacctgcttgattcctaatctcccacttcagatcttatctttcattctccacacaatcgtccggggatttattcactcggctgtcggcggtctctatgctgctgtctacccatccactcaattcggatctctgaccggactccagtccctcataagcgcactgttcgctttgctgcagcaacctctcttcctggccatgatgggacccttgcagggggatcctctttgggttaatgtgggtctgctgcttctttctctgctggggttctgtttgccactgtaccttatttgttatagaaggcagctcgaaaggcagctccagcagcgccaggaagacgacaagttgttcctgaagataaatggttcttcaaaccaggaggcatttgtttag

SEQ ID NO: 241665 - DNA, 1722 bp, Artificial Sequence
  Description of Artificial Sequence: Synthetic coding sequence
atggccccaactctggccactgctcatcgaaggaggtggtggatggcttgtaccgctgtgctggaaaaccttcttttttctgctgtgttgctcggatgggggagcctgctgataatgctgaagtcagaaggattctatagctatctctgcaccgagcccgaaaatgttacaaacgggaccgtgggtggaacagcggaacccggacatgaggaagtcagttggatgaatgggtggctgtcctgtcaggcccaggatgaaatgttaaatctcgcattcaccgtgggaagctttttgctatctgcgattacactgccgctgggtatcgtgatggataaatatggccctaggaagttgcgcctgctggggagtgcctgcttcgccgtttcgtgcctcttaatcgcctatggtgcaagcaaacctaacgctctttcggtcctcatttttattgctttggcccttaatgggtttggcggaatgtgcatgactttcacctccttgaccctgcctaatatgtttggggaccttaggagtacgtttatcgcgctgatgatcggctcatatgcatcgtcagctgtcactttccccggtatcaaactgatttacgacgcaggggtctcatttatcgtggtgctggtcgtttgggccggttgcagtgggctggtgtttttaaactgtttcttcaactggcctcttgagccctttcccggtccagaggacatggactattcagtgaaaataaagtttagttggctaggttttgatcataagatcacagggaaacagttctacaagcaagtaacaactgtgggccgacgtctcagcgttggctccagcatgaggtctgccaaagaacaggtggccttgcaggaaggtcacaaactctgcctgagcaccgtggaccttgaggtaaagtgtcagcctgatgctgccgtggccccttccttcatgcatagcgttttctccccaatcctgctgttgagcctcgtgactatgtgcgtgacacagcttcggctcatcttctacatgggtgcgatgaataacattcttaagttcctagtgtcaggggaccagaaaacagcctcatccactgtgggactttatacctctatttttggagtactgcagctgctgtgcttgctgaccgctcccgtgatcggctatattatggattggagactgaaggaatgcgaggacgcctcggaggaacctgaagagaaggatgccaaccaaggggagaagaaaaaaaaaaagcgggacagacagatccaaaagataacgaatgcaatgcgagcctttgcgtttacaaatctgctgttagtgggtttcggggtcacatgcctgattcccaacctgcccctgcaaatactaagttttatcctgcacactatcgttcggggattcatacattccgcggtgggtggcctgtatgccgctgtgtatccctccacccagtttgggagccttaccgggctgcaatcactcatatctgccctcttcgcactactacagcagcccctcttcctggcgatgatggggcctctacagggagatccgctttgggtgaatgtcgggctgctcctgctgagcttgctgggcttctgcctcccactctacctgatatgctataggcggcaactggaaaggcagcttcagcagagacaggaggacgataagctattcctgaagatcaacgggtcttccaatcaggaggctttcgtttag

SEQ ID NO: 241666 - DNA, 1299 bp, Artificial Sequence
  Description of Artificial Sequence: Synthetic coding sequence
atgacatatggttcaccccaagctaacgctagtccttccgacgcagtggctttggatcatggggaggtttctaggagacagcagcaggagctgcccaatatgttcggcgatctgagatcaacattcattgcgttgatgatcgggagctacgcctcttccgctgtcacctttccgggaataaagttaatctacgacgcaggagtgtcgttcattgtagtgctcgtggtctgggccggatgttcaggcttagtgtttctcaactgttttttcaattggcctctcgagccctttcccggtccggaagacatggactatagcgtgaaaattaagttcagttggctgggttttgatcataagatcactgggaagcagttttataagcaagttaccacagtgggacgtcgactttcggtgggatcctctatgcgcagtgccaaggaacaagtggcgctgcaggagggtcataagctctgtctgagcacggtcgacctggaagtgaaatgtcagccagatgcagccgtggctccttcatttatgcatagtgttttttcccccatactattgctgtccctggtgaccatgtgcgtcacacagcttcggctgatattctatatgggcgctatgaataatattttaaagttcctggtgtctggagatcaaaagacagttggattgtacacttcaatattcggtgttcttcagttattgtgtctcctcaccgcccctgtgataggttatatcatggattggcggttaaaagagtgcgaagacgcaagcgaggaaccagaagagaaggatgctaaccagggtgaaaagaagaagaagaaaagggatcggcagatccaaaagatcaccaatgccatgcgcgctttcgcatttaccaacttgctactcgtagggtttggtgtgacgtgcctgattcccaacctgcctctacaaatcttgtcttttatcctgcacaccatcgtgcgaggcttcattcattcagctgtcggagggctctacgcagctgtataccccagcacgcagtttggaagcctgacaggtctacagtccctgatctccgctctcttcgcattgcttcagcaaccattgttcctggccatgatggggcctctgcagggcgatccattgtgggtgaacgtaggcctgttgctgttgtccctgctgggcttctgtctccctctgtacctgatttgctataggcggcaactcgagcggcagcttcagcaacggcaggaggacgacaagctgttcttgaagataaacggcagctccaatcaagaggctttcgtctag

SEQ ID NO: 241667 - DNA, 1341 bp, Artificial Sequence
  Description of Artificial Sequence: Synthetic coding sequence
atgacatctaaggaaattatcctcgggctctgcctgctgtcactggtgctgagtatgatactcatggtcattatccgttatattagccgcgttctagtgtggattctcactatacttgtcattctcggaagccttgggggaaccggggtgctgtggtggctttatgctaaacaaaggaggagtcccaaggagaccgtgacccccgagcaacttcaaatcgctgaggacaatcttcgcgcacttttaatttacgcaatttctgctactgtgttcaccgtgatcctcttcctgattatgctggttatgaggaagagagtcgccctgactattgcactcttccacgtggccggaaaggtgttcattcatctcccgttattggtctttcagccgttttggacctttttcgccctggtgctgttttgggtgtactggataatgactctcctgttcctaggcacaacaggcagtccagttcagaacgagcaggggtttgtggaatttaagatatccggaccactccagtacatgtggtggtatcacgtcgtcggactcatctggattagcgagttcatcctagcttgtcagcagatgaccgttgccggagccgtcgtcacttattattttaccagggataagcggaacctgccttttacgcctatcctggccagtgtgaatcggctgattcggtaccacctcgggactgtcgcaaaaggtagcttcatcatcaccctagttaagatccctcggatgattctgatgtacattcatagccaattaaaaggtaaggagaatgcatgcgcaagatgtgtactcaaatcctgtatttgttgcctgtggtgcttagaaaaatgcctgaattacctcaaccagaatgcctacactgccactgccattaactctactaacttttgtacatcagccaaggacgccttcgtcattctggtggagaatgctttgcgcgtggctaccatcaataccgtcggggatttcatgttgttccttggcaaggtgctgattgtgtgcagcaccggcctggccggtattatgctattgaattatcagcaggactataccgtgtgggttctccctttaataatcgtgtgcctcttcgcctttttggtcgcccattgctttctgagtatctacgaaatggtggtcgatgtactcttcctttgctttgctatcgacacaaaatacaacgacgggtctccgggtcgagagttctacatggacaaggtcctcatggagtttgtggaaaactcgagaaaggccatgaaagaggctgggaagggcggagtagccgactctagagaactaaaacctatgctgaagaagcggtag

SEQ ID NO: 241668 - DNA, 1974 bp, Artificial Sequence
  Description of Artificial Sequence: Synthetic coding sequence
atgggctgctgctcttcagcctcctccgcagctcaatccagtaagcgcgagtggaagcccttagaggaccgaagctgcaccgacataccttggttgttactgttcattctgttctgcatcggcatgggatttatatgtgggttttctattgctactggcgctgccgcaaggcttgtttctgggtatgacagttatgggaacatctgcgggcagaaaaatacgaaactggaagcgatccctaacagcgggatggatcacactcagcgcaaatatgtattctttctggatccctgtaacctcgacctcataaatcgcaaaattaagtccgtggctctttgtgttgctgcgtgccctcgacaggaactgaaaactctgtccgatgtccaaaaattcgctgagatcaacggctctgctctgtgctcctacaaccttaagccatctgagtacacaacatctcccaaaagttcagttttgtgtcccaaattgccagtccctgccagtgctcctattcccttcttccaccgttgtgcccctgtcaacatttcctgttatgccaaatttgccgaggcgctgattacattcgtctccgacaatagcgtgcttcatcggctcatttccggcgtgatgacgtcaaaagagataatcctagggctctgccttctgagtcttgtgttgagcatgattctaatggtcattataagatatatcagccgggttctcgtctggatactcactatcctggtcatcctcggctcacttggaggcacaggcgtgttgtggtggctgtacgcaaagcagcgtcgctccccaaaggagacagttacccccgagcaactgcagatagccgaagacaatcttcgggcactgcttatatacgccataagcgctactgtcttcacagtgattctgttcctgattatgcttgtgatgcggaagagggtcgccctgaccattgcactgttccacgttgcaggaaaagtgttcattcacctgccccttctcgtgtttcagcctttttggactttttttgccctggttctgttctgggtctactggatcatgacactgctttttcttggaaccacgggatcccccgttcaaaacgagcaagggtttgtggagttcaagatatcggggccactgcaatatatgtggtggtatcatgtggtgggactgatttggattagcgaatttatccttgcctgccaacagatgacggtggctggagccgttgttacatattattttacgcgtgacaaacgaaacctgccgtttacgccaatcctggccagcgtgaaccggctgatccgataccacctgggaaccgtggctaaagggagcttcattatcaccctggttaagattccacgaatgattctcatgtatatacatagtcagctgaagggcaaggagaacgcctgtgctcggtgcgtcctgaagtcttgcatctgttgcctgtggtgtcttgaaaagtgcctgaattatctcaaccaaaacgcctacaccgccactgccatcaacagtacaaatttttgcaccagtgcgaaagacgctttcgtgattctggtcgagaatgcattgagggtggccactattaacactgtgggtgacttcatgcttttcctgggcaaagtcctcatcgtttgctctacaggcctcgcgggaattatgttattaaactaccagcaggactataccgtctgggtgctgcccctgataattgtgtgcctttttgctttcctagtagcacattgctttctaagtatatacgagatggtggttgatgtcttattcttgtgtttcgcgatcgacacaaagtacaatgacgggtccccagggagagaattctacatggataaagtcctcatggagttcgtggagaattctcgtaaagcaatgaaggaggctggcaaagggggtgtcgctgatagtcgggagttgaagccaatggcatctggagccagcagcgcctag

SEQ ID NO: 241669 - DNA, 1959 bp, Artificial Sequence
  Description of Artificial Sequence: Synthetic coding sequence
atgggctgttgcagctccgcttcatccgcagcccagtcatccaaaagagagtggaagcctctggaggacagaagttgcaccgacataccatggctactgctatttatactgttttgcatcggcatgggattcatttgcggcttctccatcgctactggagccgctgctcgcctggtgagcgggtacgactcatatgggaacatctgcggccaaaagaataccaagctcgaggcgatccccaacagtggtatggaccacacccaacggaaatatgtgttcttcctggacccctgtaatttagatcttatcaataggaaaattaagtcagttgcactgtgtgtggccgcatgccctagacaggagctcaaaaccttgtcagatgtccaaaagtttgcagagatcaatggcagcgccctgtgttcatacaacctcaagcctagcgagtacaccacatccccaaaatcctcagtgctgtgccccaaactcccagttcccgcaagtgcaccaattcccttctttcaccggtgcgcccctgttaacataagctgttacgctaaatttgccgaggccctgattaccttcgtgagcgacaatagtgtactgcacaggttgatttcaggcgtcatgacatccaaagaaatcatactcggattatgtctgctctcactggttctatctatgatccttatggttataatcaggtatatctccagagtgttggtgtggattctgacaattctggtgattctggggagtttaggcggaaccggcgtgctgtggtggctctatgcaaagcaacgccgatcccctaaggagacagtcaccccggaacagttgcaaatcgccgaggataacctgagagccttgcttatatacgccataagcgccaccgtgtttacagtcatactttttctgataatgctagtgatgcgcaagcgggttgcactgaccattgcgttatttcacgtggccggtaaggtatttatccatctgcccctactggtgttccagcctttctggaccttcttcgccttagtgctcttttgggtatattggatcatgacccttctgttcctcgggacgaccggcagtcctgtacagaacgagcagggctttgtggagtttaagatttcaggcccactacagtatatgtggtggtatcatgtcgtgggtctgatttggatttctgagtttatattagcttgtcaacagatgacagtggccggtgctgttgtgacctactatttcaccagggacaagcgcaacttaccttttactcctattcttgcctctgtgaatcggttgattagataccatctgggcaccgtggccaaagggagtttcattatcaccctggtcaaaattccgagaatgatactgatgtacatccacagtcagctgaagggtaaagaaaacgcatgtgccaggtgtgttctcaagagttgcatttgttgcctctggtgccttgaaaaatgtctgaattatctgaaccagaacgcctacaccgccaccgcgattaactctaccaacttctgtacctccgcaaaggatgccttcgttatcctggttgagaatgcattgcgggtcgccaccataaataccgtgggagatttcatgctgttcctcggcaaggtcctcatcgtgtgctccaccggactggccggtattatgcttctcaactaccagcaggactataccgtgtgggtgttgcccctgatcatcgtgtgtctgttcgccttcctggtggcacattgcttcctctctatctacgaaatggtcgtcgacgtgctgtttctgtgcttcgcaatcgacacaaaatacaatgatggctcaccagggagagagttttatatggacaaggtcctgatggagtttgtggaaaacagtagaaaagctatgaaggaggccggaaagggcggagttgccgattccagggaacttaagcccatgataaaatag

SEQ ID NO: 241670 - DNA, 1965 bp, Artificial Sequence
  Description of Artificial Sequence: Synthetic coding sequence
atgggatgttgtagctccgcctcctcagctgcgcagtcctcgaaaagggagtggaagccactcgaggaccgctcatgcacagacataccctggcttttgctcttcatcctgttctgcatcggtatgggtttcatctgtgggttctccatagcaacaggggcagcagccaggctcgtgagtggctatgatagctacggaaatatctgcggccagaaaaatactaagctagaagccattccaaacagtggcatggatcacacgcagagaaaatacgttttctttctggacccttgcaatctcgatctgataaaccgaaaaatcaagtccgtggctctgtgcgtggccgcttgtcccagacaggagctgaaaacactgtcagatgtgcaaaaattcgccgagataaatgggagtgctctttgcagttataaccttaaaccatccgagtatactacttcacctaagtcttcagtcctctgccccaaactgccagtgccagccagcgctcccatcccctttttccacagatgcgcgcctgtgaatatctcatgctatgctaaatttgcagaggctctgatcacattcgtatcggataactcggtgctccatcggctgatcagcggcgttatgacctctaaagaaatcattctaggcctgtgtctattgtccttggttctgagcatgatcctgatggtcattatccgatatatctccagagtgctggtgtggatccttactattcttgttatactgggatctctggggggaaccggggttctttggtggttatacgcgaagcagaggagatcacctaaggaaacggtgacacctgaacagctccagattgccgaagataacctccgggcattgctgatctacgccatcagtgcgaccgtcttcacagtgatcctctttctgatcatgcttgtgatgcgaaagcgagtcgctctgaccatagctttgtttcacgtggcaggtaaggtattcattcatctgccactgctcgtatttcagcctttctggaccttcttcgctctagtgctattctgggtctattggattatgaccctcttgttcctgggaacgaccggtagcccagtgcagaatgaacagggtttcgtcgaatttaagatctccggaccactccagtacatgtggtggtatcacgtcgtggggctgatctggatcagcgagttcatactggcctgccagcagatgacagtggccggagcagtcgtcacgtactattttacccgcgacaagcggaatctccctttcacccccatattagcgtcggtaaatcgtttaatccgttaccacttaggcacggtggctaagggaagttttataattacgcttgtcaagattcctcgcatgatcctcatgtacattcattcacaactgaagggcaaagagaatgcctgtgcacgctgtgtactgaagtcgtgtatctgctgcctatggtgccttgagaaatgtctgaattatctaaaccagaacgcctataccgccactgccattaattctactaatttctgcacaagcgctaaagacgcgtttgtcatcctcgttgaaaacgctctgagagtagccaccatcaataccgtaggagacttcatgctctttctcggaaaggtgctcatcgtttgttccacggggctggccggtatcatgctgctaaactaccagcaggattacacagtgtgggtgctgcctttaatcatcgtatgcctgtttgctttcctggttgcacactgctttttaagcatttacgagatggttgttgatgttctatttctgtgctttgctattgataccaaatacaatgacggttccccaggacgagagttttatatggacaaagttctgatggagtttgtggagaacagccgcaaagcgatgaaagaggctggaaagggaggtgtagctgacagccgtgaattgaagcccatgttgaagaagagatag

SEQ ID NO: 241671 - DNA, 1974 bp, Artificial Sequence
  Description of Artificial Sequence: Synthetic coding sequence
atgggctgctgttcctcggcaagcagtgcggcacagtccagtaaaagggagtggaagccacttgaagaccgctcttgcacagatatcccctggctgcttctgttcatcctattttgcatcggcatggggtttatctgcgggttttcaatagccaccggcgctgctgcccgtctggtgtccggatacgactcctacggcaatatttgtggccaaaagaacacgaaactggaggcgatccctaacagtggcatggatcacacccaacgcaagtacgtgttctttttggacccatgtaacctagatcttattaatcggaagatcaagtccgttgctttgtgtgtggcagcatgccccaggcaggaattaaaaacccttagcgatgtccaaaaatttgcagagattaatgggtcagccctttgcagctataacttaaagccgtcagagtatactacttctcccaagagctccgtgctctgtcccaaactccctgtgcctgccagcgcccctattccgtttttccaccggtgtgcccctgtcaacatttcctgctacgcaaaattcgcagaggctctgattacatttgtgtctgacaacagtgtcctgcatcgcctcattagcggcgtcatgacatctaaggaaatcattctcggcctttgcctgctgagcctagttctgtctatgatcctaatggtgatcatacgctacatatccagggtgctggtttggatcctcaccatattggtgattctcgggtccctaggagggacaggggtgctttggtggctctacgcgaagcagcgtagatctcctaaggaaactgtgacccccgagcagctgcaaatcgcagaggacaacctgagagccctgctgatctacgcaatcagcgcaaccgtcttcaccgtaatcttgtttctcattatgcttgtcatgcggaaacgggtcgcacttacaatcgccctattccatgtagccggaaaggttttcatccacctccccctgctggtttttcaacctttttggacatttttcgccctggtcctgttctgggtttattggattatgacactcctgtttttagggacaaccgggtctcctgtgcagaacgagcaagggtttgtggagttcaaaatctccggaccactgcaatacatgtggtggtaccatgtggtggggctgatctggattagcgagttcattttggcttgccagcaaatgaccgttgctggagccgttgtgacgtattatttcacccgggataagaggaatctgccatttacacctattctggcgagtgttaaccgtctgatcagatatcacctgggcaccgttgctaaagggagttttataattacactcgttaagatcccaaggatgattctaatgtatatccattcccaattgaaagggaaggaaaatgcctgtgctcgatgcgtgctcaagtcctgcatctgctgcttgtggtgtctcgagaagtgcttgaactatctaaatcagaatgcatatacagcaactgccattaactccactaatttttgtacttctgcgaaggacgcattcgtaatattggtggagaatgcccttcgggtggccacaatcaataccgtcggagactttatgctgttcctggggaaggtgctgatcgtgtgctcaacagggctggccggaatcatgctgctcaactaccaacaggattacacggtgtgggtgctgccacttatcatcgtctgtttgtttgcattcctggtggcacactgctttctgtctatttatgagatggtcgtggatgtactgtttctgtgttttgctatagataccaaatacaacgatggaagtccagggagagagttctatatggacaaggtcctgatggagttcgtcgagaactcgagaaaggctatgaaggaggccggaaagggaggcgtggcagattcacgggagctgaaacccatggcatcaggcgcatctagcgcctag

SEQ ID NO: 241672 - DNA, 2121 bp, Artificial Sequence
  Description of Artificial Sequence: Synthetic coding sequence
atgggcgatgagcgccctcattattatggaaagcatggaactccccagaagtatgacccaacctttaaggggcctatttacaataggggatgtacagacatcatctgttgtgtattcctactcctggccattgtgggttacgtggccgtggggatcatcgcctggacgcatggcgatcccaggaaggtaatatatcccactgattcccgtggagagttctgcggccaaaaaggcactaagaatgagaataagccttacctgttctattttaacatcgtgaaatgcgcatcacccttggttctgttggaatttcagtgccccacccctcaaatatgcgtggagaaatgtcccgataggtacctgacatacctaaatgctaggtcctcacgggacttcgaatactacaagcagttctgcgttcctggtttcaagaataataagggagttgccgaggttttacaggatggtgattgcccagccgtcttgattccctccaaacctctcgccaggaggtgcttcccggcaattcatgcatataaaggcgtgttgatggtggggaatgagacgacctacgaggatggacatggaagcagaaagaatattaccgacctggtggaaggtgctaagaaggccaatggggttctggaagcaaggcagctagccatgcggattttcgaggattacaccgtaagctggtactggatcatcatagggctggttatcgcgatggctatgagcttgctgtttattattctgctacgatttctggccggaattatggtatgggtgatgatcatcatggtcatcctggttctaggttatggtatttttcattgctatatggagtatagtcgcctgcgcggagaggctgggtcagacgttagtctcgtggacttgggcttccagacagacttcagggtgtacctgcatcttcgccaaacctggctcgcatttatgataatcctgtctatcctggaggttatcataattctacttctaatctttcttcgcaaaaggatacttatagctatagccctcatcaaagaggcaagtagagcagtgggctacgtgatgtgctcgctcctgtacccgctagttacatttttcctgctgtgtctctgcattgcatactgggcgagtacggcagtgttcctgtcaactagtaacgaggccgtgtacaagatctttgacgatagtccatgcccgttcactgcaaaaacttgcaatcctgaaacctttccctccagtaacgagagcagacagtgcccgaatgcccgatgtcagtttgcattttatgggggagaatcaggataccatagagctctcctcggtctccagatcttcaacgcgtttatgttcttttggttggccaactttgtgctggcactggggcaggtgacgctggccggagccttcgccagttactattgggccttgaggaaaccagacgatctgcccgcatttcccctgttctctgcctttggacgtgcgctccgctaccatactgggtccctggcttttggtgcactcatcttggctattgtgcaaatcattcgtgtgattctggagtatctcgaccaacgtctgaaagccgcagagaacaagttcgctaagtgcctcatgacttgtttgaaatgctgtttttggtgcctggagaagttcatcaagtttctgaacaggaatgcgtatattatgatcgcaatctacggaacaaacttttgtacatctgctaggaacgctttttttctgctgatgcgcaacatcatcagggttgctgtgctcgataaggttaccgattttctcttcctgcttggtaagctgcttatcgttggaagtgttggaatccttgcattctttttcttcactcataggatccgtattgtacaggatacggcacctcccttgaactattactgggtgcctattttaaccgtgatcgtcggctcgtacttaatagcccacggcttcttctctgtgtacggtatgtgtgtggatacactgttcctgtgttttctggaggatctggaacgcaatgatggctctgctgagcgcccttattttatgagtagcacgctgaagaagctcctgaacaagacaaataagaaggcagccgagtcgtag

SEQ ID NO: 241673 - DNA, 2121 bp, Artificial Sequence
  Description of Artificial Sequence: Synthetic coding sequence
atgggggatgaaagaccccactactacggaaaacacggaacccctcagaaatatgaccccaccttcaaaggcccaatctacaatagaggctgtaccgacataatatgctgcgttttcttgttgttggccattgtcggttacgtcgcagtgggcatcattgcttggacacacggggacccacgcaaggtgatctatcccaccgacagtaggggggagttctgtgggcagaaaggcacaaaaaatgaaaacaagccctacctgttttattttaatatcgtcaaatgcgcatctcccctcgttctgctggagtttcagtgccccacaccccagatttgcgtcgagaaatgtcccgacagatatctgacatacctaaacgcacggagttctcgagactttgagtactataagcagttctgcgtgccaggcttcaagaacaataagggtgtggccgaggtattgcaggacggagactgccccgctgtgctgatcccatcaaaaccattggccagaagatgcttccctgctattcatgcttataaaggggttctgatggtgggcaatgaaacaacctatgaagatgggcatggtagcagaaaaaacatcactgatctggtagagggcgctaagaaagctaacggcgtcttggaagcgcgacagctagcaatgagaatatttgaggattataccgtaagctggtattggattataattggtctggtgattgccatggccatgtcccttctcttcataatccttctaagatttctcgcaggaattatggtctgggttatgattattatggtgattctggttctgggttatggcatttttcactgttatatggaatatagcaggctgcggggtgaagcaggctctgacgtatcattggtggatctgggcttccaaacggacttcagggtgtacttgcacttacggcagacctggctggcatttatgattatcctgagtatcttagaagtgattatcatactgttactgatcttcctacggaaaaggattctgatcgcgattgcgttaatcaaagaggctagccgggcagttggttacgtaatgtgctcactgctgtacccccttgtcacgtttttcttgctgtgcctgtgtattgcttactgggctagtaccgccgttttcctgtccacaagtaacgaggctgtgtacaaaatttttgacgattcgccgtgcccatttactgctaaaacttgcaaccccgagacatttccgagttcaaatgagagccgacagtgcccaaacgccaggtgccagtttgctttttatgggggagagtcaggataccaccgcgctcttttagggcttcagatcttcaatgccttcatgtttttttggttggctaatttcgtgcttgccctgggccaggtaaccttagccggagctttcgcctcgtattactgggccttgcgcaagcccgatgatcttcctgcctttccactgttctccgcttttggtcgggcactaaggtatcataccggaagtctggcattcggagctctcattctagcaatcgtgcaaatcattcgggttatcttagaatacctggaccagagacttaaggcagccgagaacaaattcgccaaatgtttaatgacatgtctgaaatgttgtttctggtgtttggagaagttcattaagttcctgaatcgaaacgcatatattatgattgctatttacggcacgaatttctgtacctctgccaggaacgctttttttttgctgatgcgtaacattattagagttgccgtgctggacaaggtcactgactttctgtttttgcttggtaagttgctgatcgtcggaagtgttggtattctggcatttttttttttcacccacaggatcagaatcgtgcaggatacagccccacccctaaactactattgggtgcccattttaacagtgatcgtcggcagctatcttatagcacatggtttcttctccgtatatgggatgtgcgtggacactctttttctctgcttctgtgaagaccttgagcgcaacgacgggtctcaggagagaccatatttcatgtcccctgagttacgggacatccttcttaagggaagcgctgaggagggtaagcgttag

SEQ ID NO: 241674 - DNA, 2115 bp, Artificial Sequence
  Description of Artificial Sequence: Synthetic coding sequence
atggaggacgagcggaaaaacggcgcatacggcacccctcagaaatacgatccgactttcaaggggccaatctataatcgcggatgcactgatatcatatgctgcgtttttctgctgctggcaatcgttggatacgtggcagtcggaattatagcttggacccacggggacccacggaaagttatctacccgacggactccaggggagagttctgtggccagaaaggaacaaagaacgaaaacaaaccatatctgttttacttcaacatagtgaaatgcgccagtccgctagtgctcctcgagttccagtgcccaacaccccaaatctgtgtagaaaaatgtccagaccggtatctgacctacttgaacgccaggagctctcgagattttgaatattataaacaattttgtgttcccggattcaagaacaacaagggcgtagccgaagtgctacaggacggcgattgcccagctgtgctgataccatcaaagccgctggccagacggtgcttcccagctattcatgcctataagggagtgctaatggtggggaacgagactacctatgaggatgggcacggtagcaggaagaatatcacagatcttgtggagggagctaagaaggctaatggcgtattggaggctcgtcagcttgcgatgagaattttcgaggactacactgtgagctggtattggattattattggtttggtgattgccatggcaatgtccctgttattcatcatcctgctgaggttccttgcaggtataatggtatgggttatgataattatggtgatcctggtcctcggttacgggattttccactgttatatggagtattcaagactgagaggtgaggctggctccgacgtgagcctcgtcgatttaggcttccagaccgattttagggtgtacctgcacctgcggcagacctggctcgcttttatgatcattctctcaattctggaggtgataattatcctgctgttgatttttctgaggaagcggattctaatcgcaatcgctttaatcaaggaggcctcgcgggctgttggctatgtcatgtgcagcctgttgtatcccctcgtcacatttttccttttatgcctttgcatagcctactgggcctccaccgccgtctttctgtcaaccagtaacgaggccgtctacaagattttcgatgacagcccctgtcccttcacagctaagacctgcaaccctgaaaccttcccgagctcaaacgaaagccgccagtgcccaaatgctagatgccagttcgcattctatgggggtgagtccggatatcatcgggcactactggggctgcaaattttcaacgccttcatgttcttctggctggcaaactttgtcttagctctggggcaggttacactagccggagccttcgcaagctactattgggccctccggaagcctgatgacttacccgcatttcctctgttttctgctttcggcagggcactgcgataccacacggggtctttggccttcggggctctcatactcgctatcgtccaaatcatcagggtcattctggagtacctcgaccagcggctgaaggccgctgaaaacaaatttgcaaagtgtttgatgacttgtctcaaatgctgtttctggtgcctcgaaaaattcataaaatttctgaaccgaaacgcttacattatgatagctatctacgggaccaatttttgtacatctgcacggaacgccttcttcctactcatgcgaaatatcatccgggtggccgtactcgataaggtgaccgattttctctttctactgggcaaactgttgattgtcggctccgtgggtatccttgccttttttttcttcacacacaggatccgtattgtacaagatacagctccgcctctgaactactattgggtcccaattctcacagtgattgtgggtagttacctgatcgctcatggatttttttctgtgtatggaatgtgcgtggatacgcttttcctgtgcttcttagaggacctggagagaaatgatgggtctgctgaaagaccttacttcatgagcagcaccctcaaaaaactgctcaacaaaactaacaaaaaggccgcagagagttag

SEQ ID NO: 241675 - DNA, 1248 bp, Artificial Sequence
  Description of Artificial Sequence: Synthetic coding sequence
atgacgggcgaacgcccttccacagcgctgcctgacaggcggtggggacccaggattcttggcttttggggaggctgtagagtctgggtcttcgctgccattttcctcctattgtccctggctgcctcctggtcaaaggctgagaacgactttggccttgtgcagccccttgtaaccatggagcagctattgtgggtctcaggcagacagatcggctctgtcgataccttcaggattccgctgatcaccgcgacgccccgaggcaccctcctggccttcgccgaggctcgtaaaatgagcagctccgacgaaggggctaaatttatcgcccttcgacgcagtatggaccagggctcaacttggtccccaaccgcattcatcgtgaatgacggagatgtcccagatggactaaatctgggcgctgtagtcagcgacgttgaaacaggggtggtcttcctgttttactcactgtgcgcccataaggccggttgccaggtggcttcaactatgctagtgtggtcaaaagacgacggggtgagctggtccacgccccgtaacttgtccttggacatcggcactgaggtgtttgctcccggacctggctccggcattcagaaacagagagaacccaggaagggcaggctgattgtgtgcggccatgggaccctcgagcgtgatggagtgttctgcttactgtcagatgaccacggagcctcctggagatatggaagcggtgtatccggaatcccgtacggccagccaaagcaggagaatgacttcaatcctgacgagtgccagccttacgagctgccggacggttctgttgtgattaacgcccgtaaccaaaacaactatcattgccattgccgtatcgtgttaagaagctacgatgcttgtgatacgctgcgcccaagggatgtcacatttgatcctgagctggtggatcctgtcgtcgcagcaggcgctgttgttacatccagtggcatcgtgttcttttccaatccagcgcaccctgaattcagggtgaacctgacattgcgctggagttttagcaatggcacatcttggaggaaggaaaccgtgcagctgtggcctgggccttccggatactcctccctggccaccctggaaggctctatggatggcgaggaacaggccccacagctttatgtgctgtacgagaaaggaagaaaccactacaccgagtctatcagtgtcgctaaaattagcgtttacggcactctttag

SEQ ID NO: 241676 - DNA, 2007 bp, Artificial Sequence
  Description of Artificial Sequence: Synthetic coding sequence
atggggggaaaacagcgagacgaggatgacgaggcctacggtaagcctgtcaagtacgacccatccttcagaggacctattaagaaccgtagctgcactgacgtgatttgctgcgtccttttcctgcttttcatcctgggttacattgtcgtaggcatcgtggcatggctgtacggcgatccacgtcaagtgctgtatcctaggaactccaccggggcatattgcggcatgggcgagaacaaagacaagccgtacctcctttactttaatatttttagttgcattctgtcatcaaatatcatctcagtcgcagaaaatggtctccagtgccccacgcctcagaccgtaattacctccttgcaacaggaactctgtcccagcttcctcctgccttctgccccagctctggggagatgttttccttggacgaatgtcactcctccagctctcccaggcatcaccaatgacacgactattcagcaggggattagtgggcttatcgatagtctgaatgcccgtgatatttccgtcaaaatcttcgaggacttcgcgcagtcgtggtactggatattggttgccttaggcgtagcccttgtcttgagcctgcttttcatactgttgctgagacttgtggccggaccattagtgctcgttctgatcttgggcgtactaggagtgctcgcatatggcatctattactgctgggaagaataccgcgtcctgcgggataaaggcgcttctatatcccaactgggattcactaccaatctgtctgcctaccaaagcgtgcaggaaacctggctcgctgcactgatagtgctggccgtcctggaggccatcctcctactgatgctcatattcctgagacaacgaattcggatcgccatcgcgctgctgaaggaggccagtaaggccgtaggccagatgatgagtactatgttttacccactggtgacgtttgtgctgcttctaatatgtatcgcatactgggcaatgaccgccctctacttggccacctctggtcagccacaatatgttctttgggcttctaatatttcctccccagggtgcgaaaaagtccccataaacacttcttgtaacccaactgctcatcttgtaaatagttcatgccccggtcttatgtgcgtgttccagggatactctagcaagggccttatacaacgtagtgtgttcaacctgcagatatatggtgtgttgggcctgttttggacactcaactgggtcctcgctcttgggcagtgcgtgctggctggcgctttcgcctccttctactgggcctttcataagccacaggatataccaacttttcccctgatttccgcttttatcagaacactgcgatatcatacaggatccctagctttcggagctcttatactgaccctcgtgcagattgccagagttatattagaatacattgatcataaattaaggggagtacaaaatcctgtggcccgttgcattatgtgctgtttcaagtgttgcctctggtgcttggagaaatttataaagtttctcaacagaaatgcatacatcatgatcgccatctacggtaaaaatttctgcgtcagcgccaaaaacgcctttatgctgctgatgaggaatattgtgcgtgtggtggtgcttgataaagtcactgaccttctgctgttttttggcaaactcctcgttgtcggcggagtaggggtgctgagcttctttttctttagcggtaggattcccggactgggtaaagacttcaaatctccccacttaaactactactggctgcccatcatgacctctatcctcggcgcatacgtaatcgcatctggtttcttttctgtgttcgggatgtgcgtggacactctttttctatgcttcctcgaggacttagaaagaaacaacggctctctggaccgcccttattacatgtccaaaagtctcttgaagatccttggcaaaaagaatgaggctccccctgacaacaagaaaaggaaaaagtag

SEQ ID NO: 241677 - DNA, 2133 bp, Artificial Sequence
  Description of Artificial Sequence: Synthetic coding sequence
atgggcggaaaacagcgggacgaggacgatgaggcttacgggaagccagtgaaatatgaccctagcttcaggggacctatcaagaataggtcctgcaccgatgtgatctgttgtgtcttgttcctcttattcatactgggttatattgtggtcggcattgtggcttggctctacggcgatcccagacaggtgctctatccacgaaacagtaccggagcctattgcggaatgggcgagaacaaggataagccgtacctcctgtacttcaacatcttcagctgcatcctgagcagcaatataattagcgtggccgagaatggacttcagtgccctacaccccaggtgtgtgtgtcaagttgtcccgaagacccttggactgtgggaaagaacgagtttagtcagactgtgggtgaggtattttacactaagaacaggaacttctgcctccctggcgtgccctggaatatgacagtaatcactagtctacaacaggagctttgcccctcctttctcctgccatcggctcctgcccttggacgttgtttcccttggacaaatgtgacacctcctgctcttcctggaattacaaatgacacaactattcaacagggaatttctgggctgattgactctctgaatgccagagatatctctgttaagattttcgaagattttgcccaatcttggtattggatcttggtggccttgggcgtagccctcgtcctgtctcttctctttattctgcttttgcgcctcgtagctggacctctggtattggtactaatcctgggggtgctaggcgtgcttgcctatggcatatactactgttgggaagagtacagggtgttacgtgacaagggagccagcatctctcaattggggttcaccactaacctgagcgcttaccagagcgtccaggagacctggctagcagcgctgatcgtactggctgtgctggaggcaatcctgttgttaatgttgatattccttcgtcagcgaatacggatcgccattgccctgctaaaagaggcatccaaagccgtcgggcagatgatgtcaacaatgttttaccctttggtgacatttgtgttattgcttatctgcattgcatactgggctatgaccgccctctatctggccacaagcggacagcctcaatacgtgttgtgggcctccaatatcagcagccccggttgcgagaaggtgcccattaacacttcgtgcaaccccacagcccacctcgttaactcctcttgccctggcctgatgtgcgtttttcaagggtactcttctaaagggttgatccagcggtctgtctttaacctccagatatatggcgtcctcggtctgttttggactctcaattgggtgttagccctcggacagtgtgttctagccggagcgtttgcgtcgttctactgggcattccataagcctcaggatatacccacattcccgttgatttccgccttcatcagaacccttcgctatcacacagggtccctggcattcggtgctctaatcctgacgctggtgcagatcgctagagttatactggaatacatagaccacaaactccggggagtgcagaatcccgtcgcgaggtgtatcatgtgctgttttaagtgctgtctctggtgcctcgaaaagttcataaaatttctgaacagaaatgcctacatcatgattgccatatatggtaagaatttctgtgtgagcgctaagaacgctttcatgttgctgatgcgaaacattgtgagggtcgttgtactagacaaggtcactgatctgctgctgtttttcggcaagctcctggttgtcggaggcgtcggggtgttgagctttttcttcttctctgggagaataccaggtctgggcaaggactttaaatctccccatctcaactactattggctgcctattatgacttccatcctgggagcttacgttattgcctccggattcttttcggttttcgggatgtgcgttgatacactgtttctgtgttttctggaggacttggagagaaacaacgggagcctggacagaccgtactatatgagtaagagcttgttaaagatcctgggcaagaagaatgaagccccaccagataacaagaagcgaaagaagtag

SEQ ID NO: 241678 - DNA, 1236 bp, Artificial Sequence
  Description of Artificial Sequence: Synthetic coding sequence
taacgggacgaggacgatgaagcttacggcaagccagtgaaatacgacccatccttccgcggtcccattaaaaatagaagctgtaccgacgtcatctgttgcgtcttgttcctcttatttattttggggtacattgtagtaggcattgtggcctggttgtatggcgatcccaggcaagtattataccctagaaattccacaggagcttactgcgggatgggagagaacaaggacaagccctatctcttgtattttaatatattttcctgcattctatcgagcaacataatctccgtggccgagaacggcttacagtgtccaacccctcaggtgtgcgtgagttcatgtccggaggatccatggaccgtaggaaaaaatgagttttcccagacagtgggtgaggtgttctacacaaagaacaggaacttctgtctgcccggagtgccttggaatatgaccgtgatcacttccttgcagcaggagctttgccctagcttcctattaccctctgcccctgccctaggacgatgctttccttggacaaatgtcacaccacccgctctaccgggaatcaccaatgacaccaccattcagcagggaatctccggtcttatcgactccctgaacgcacgagacatttccgttaagattttcgaagactttgcccagtcttggtactggatcctggttgccgtgggacagatgatgagtactatgttctatcccctggttaccttcgtgctgctgctgatctgtattgcctactgggccatgacggctctttatctagccacctccggccaaccgcagtacgtcttgtgggcttcgaatatttcatcccctgggtgtgaaaaggttccgattaacaccagttgtaaccccaccgcacatttggtgaattcatcatgccctggtttgatgtgcgtgttccaagggtattcaagtaaaggactaattcagcgctctgttttcaacctccagatatacggagtcctgggcctgttttggaccctgaattgggtgctcgcgctcggtcaatgcgtgctggcgggagccttcgccagcttctattgggcttttcataagccccaggatatcccgacttttcccctgatcagtgcgtttatccgaacgctgcgatatcacactggcagtttggcctttggagcactgatacttactctcgttcaaatagcccgagtgatcctcgaatacatcgaccacaagctgagatag

SEQ ID NO: 241679 - DNA, 1236 bp, Artificial Sequence
  Description of Artificial Sequence: Synthetic coding sequence
tgacgggacgaagatgacgaggcttatggtaaacctgtcaagtacgatccctcttttcgtggacccataaagaaccgatcttgtacagacgtgatctgctgtgtcctgtttcttctatttatcctcgggtatattgtggtagggattgtggcttggctgtacggtgaccccagacaggtgctctaccctcgcaatagtaccggtgcctactgcggtatgggcgagaacaaagacaagccttacctcctctatttcaacatcttttcgtgtattttatccagtaacatcatatcagtggcggagaacggcctacagtgccccacaccacaggtatgcgtgtcttcatgccctgaagatccctggacggtgggaaaaaatgagtttagtcagactgtgggtgaagtcttttacacaaagaatcgcaacttttgtctccccggagtaccctggaacatgacagtgattacctccctccagcaggagctttgcccatcttttcttctcccatcggcgcctgcgctgggcaggtgctttccctggactaatattaccccacccgcacttcctgggatcacaaatgacactaccatccaacaaggaatcagcggcctgatcgacagtctaaatgcccgtgacataagcgttaagatcttcgaggattttgcccagtcatggtattggattctggttgccgtgggacagatgatgtccaccatgttttaccctcttgtgacgttcgtgctgctattgatctgtattgcgtactgggccatgacagccctgtaccttgccacaagcgggcagccccagtacgtcctctgggccagcaatatctcttctccaggttgtgagaaagtcccaatcaacacgagctgcaatcccactgctcacctggtaaactcctcctgtccagggttgatgtgcgtgttccaggggtatagttctaaggggctcatccagcgcagcgtcttcaatctccagatttacggagtgctgggactgttctggactctgaactgggttctcgcattaggccagtgcgtcctggccggtgcctttgccagcttttactgggccttccataagcctcaagatatcccaacatttcccctcatttctgcttttatccgcacactgcgatatcacaccggttctctggccttcggcgctctgatccttacactggtgcagatcgccagggtgatccttgaatacattgatcataagttgcgttag

SEQ ID NO: 241680 - DNA, 2133 bp, Artificial Sequence
  Description of Artificial Sequence: Synthetic coding sequence
atgggtggaaagcaaagggacgaggacgatgaggcctatggaaagccagtgaaatatgacccaagcttcagagggccaatcaaaaaccgtagttgtaccgatgtcatttgctgtgtcctcttcttgttgttcatcctaggctatatcgtcgtcggcatcgtggcctggctctatggcgatcctcggcaggttctctatcccagaaacagtaccggggcatattgtggaatgggcgagaacaaggacaaaccctatctgctgtatttcaatatcttcagctgcatcctctcctctaacatcataagtgtggccgagaacggcctccagtgcccgacccctcaggtctgtgtgagcagctgcccggaggatccttggaccgtagggaagaatgagttctcccaaacggttggcgaggttttctataccaaaaaccgaaatttttgcctccctggagtcccttggaatatgaccgtgatcacctccttgcaacaggagctgtgcccgtcatttctgctgccatccgcaccagctctgggtaggtgcttcccttggaccaatattaccccccctgctctgcctggaataacgaacgatactactatccagcagggaatttcagggctgattgattctctcaacgccagagatatttcagtgaagattttcgaggattttgcccaaagttggtattggatccttgttgccctaggagttgccttagttctatcgctgctgttcattttgctcttgcgtcttgtggccggtcccctagtcttggtgctgattttgggtgttttaggagtcctggcttacgggatatactattgctgggaggaatacagggtgctgcgagataaaggcgcatctatttcccagcttggattcaccactaacctgtcagcataccaaagcgtgcaagaaacctggctcgccgctctgatcgttctagccgtgctggaggcaatactcctgctcgtcctcatttttttacggcaaaggattagaattgcaattgcactgctcaaagaagcctcaaaagcagttggccaaatgatgtccaccatgttctatcctctggtgaccttcgttctgctgctaatatgcatagcttactgggccatgaccgcattataccttgcgacgtccggccaaccccaatacgtcctttgggcgtccaacatctcaagtcccggttgtgaaaaggttcctatcaacacgtcttgcaatccgactgcgcatctggttaactccagttgccccggtctcatgtgcgttttccaggggtatagctccaaggggctgatccaacgttcagtgtttaacttacagatctatggagtcctcggactgttttggaccctgaattgggtgctagccctgggacagtgtgtgctcgcaggcgcttttgccagcttttactgggcattccacaaaccgcaggatataccgactttcccgcttattagtgctttcatccggacactgagataccatactggctccttagcctttggtgctttgatactgacccttgttcagatcgcacgagtgatattggaatacattgatcacaaattaaggggcgtccagaaccccgttgccaggtgcatcatgtgttgtttcaaatgctgtctttggtgcctggagaagttcatcaagttcctgaataggaatgcgtacataatgattgcgatatacggcaaaaacttctgtgtgtctgccaagaacgcctttatgcttctgatgaggaacatcgtccgagtggtggtgcttgataaggttacggacctgctgttattcttcggtaagcttctggttgtgggtggcgtgggcgtgctttcatttttcttcttctcgggcaggatcccaggactcggaaaggacttcaagagcccccacctgaactattactggttgccaatcatgacctccatcctcggggcatacgtgattgcttccggatttttctcagttttcggaatgtgcgtggataccctttttctttgcttcttggaagatctcgaacgaaataatgggtccctggacagaccttattacatgagcaagtccctcctgaaaattctgggcaaaaagaatgaggcaccccctgataataaaaagaggaagaaatag

SEQ ID NO: 241681 - DNA, 2133 bp, Artificial Sequence
  Description of Artificial Sequence: Synthetic coding sequence
atggggggaaaacagcgagatgaggacgacgaagcctacgggaagccagttaaatatgaccccagcttccggggacccatcaaaaataggtcctgcaccgacgtcatctgctgcgtgctgtttcttctgtttatcctcggttacatcgtcgtgggcatcgttgcttggctttatggtgaccctcgccaggtgctctatcctagaaactccacgggggcatactgcgggatgggggagaataaggacaaaccatacctcctctattttaacatcttctcatgcatactgagcagcaatattatctcagtggccgagaacggcctgcagtgtccaaccccccaggtgtgcgtctcctcctgccctgaagacccttggaccgtcggaaagaatgagtttagtcagaccgtcggggaggtgttttatacaaagaaccgaaacttttgcttacccggagtcccgtggaacatgactgttatcaccagcctgcagcaggagctgtgcccaagcttccttctccccagcgctcccgctttgggtaggtgtttcccttggaccaatataacaccacctgccctcccgggtatcacaaatgacactaccatccagcaaggcatttccggtctgattgattccctcaacgccagggacatctcagtaaagatcttcgaggacttcgcacagagttggtactggatcctggtggcccttggtgtggctctggtgttgtcactactctttatcctgttgctgcgcctggtggccggacctctcgtgcttgtgcttattctgggcgtgcttggtgtgctcgcatacggcatatactattgctgggaggagtacagagtactcagagacaaaggcgcatcaatctctcaattggggtttaccacaaatctctccgcgtatcagtcagtgcaggaaacatggctggcggcactgattgtcctggccgtgcttgaggcaattttgcttcttgtgcttatcttcctccggcagcgaatccggatcgcaatcgctctattaaaggaggccagcaaggccgttgggcaaatgatgagtactatgttttatccccttgtgaccttcgtgctgctgctgatttgcattgcctactgggccatgactgccctgtacttagccacttccggccaaccccagtacgtcctatgggctagtaacatttcctcgccgggatgtgaaaaggtaccaataaacacgtcgtgcaatcctacagctcaccttgtgaattccagttgcccaggtctcatgtgcgtgttccagggctacagcagtaaaggtttgattcagagaagcgtctttaacttgcagatctatggcgtactgggcctgttttggaccctcaactgggtattggcactcggacagtgtgttctagccggagcgttcgcgtccttctactgggcgttccacaagcctcaggatatacctacattcccgttaattagcgccttcatcagaacgctgaggtaccatactgggagcctggctttcggggcactgatactcactcttgtgcagattgcccgagtcatcttggagtacatcgaccacaagctgcgcggtgtgcagaatcccgtcgccagatgtatcatgtgctgtttcaagtgctgcctgtggtgtctcgagaaatttattaaatttcttaaccgcaacgcatacatcatgattgcaatctatggcaaaaatttttgtgttagtgcaaagaatgcctttatgctgctcatgaggaatattgtgcgggtggtcgtgctcgacaaggtgactgatctcctcctctttttcggcaaattactcgttgtagggggagtgggggtgctctcctttttcttctttagtgggcgtatccctgggctaggtaaggattttaagtccccgcacttgaactattattggctgccaattatgacatccattctgggggcttacgttattgcatccggcttcttctccgttttcggtatgtgcgttgacaccctgttcctgtgttttctggaggacctggaacggaataacggttctctggatcggccatactatatgtctaaatccctgctcaagattcttggaaaaaaaaacgaagcccctccagacaacaaaaaacgtaagaagtag

SEQ ID NO: 241682 - DNA, 2133 bp, Artificial Sequence
  Description of Artificial Sequence: Synthetic coding sequence
atgggagggaagcaacgtgatgaagacgatgaagcatacggaaaaccggtcaagtatgatcctagctttcgcggacccatcaaaaataggagctgcactgatgtgatatgctgcgtgttgttcctgttatttattttagggtacatagtggtcggcatcgtcgcgtggctttacggggaccctagacaggtgctctacccacgcaactctactggcgcttactgcggcatgggagaaaacaaagataaaccttatcttctctattttaacatcttctcttgcatactgagtagcaatatcattagcgtcgcagagaacggcctccaatgtcctaccccacaggtgtgtgtctccagttgtccggaggatccttggacagtgggtaagaacgaattctcccagaccgtgggagaagtattctatactaagaatcggaatttctgcctccctggcgtgccatggaacatgacagtgattacatctctccagcaggaactttgtccatcatttttgctcccatccgccccagccttgggaagatgcttcccttggacaaacgtcactcctcctgccctcccgggaatcacgaatgacactaccatacagcagggcataagcggacttatcgattctcttaatgctcgggacataagcgtcaaaattttcgaagacttcgcacaaagctggtactggatactggtcgctttgggtgttgcattagtgcttagtcttttgtttattctcttactccgcttggttgccggaccactggtactggtcctgattctcggcgtgctcggagtcttagcttatggcatttattattgctgggaggagtatcgcgtcctgcgagacaagggtgccagtatatcccagctgggctttaccaccaatctctcagcatatcagtccgtgcaagagacctggctggccgcattaatcgtactggccgtgctcgaggcgatccttctgctcatgcttatttttcttaggcaaaggatccgaatcgccattgccctcctcaaagaggctagtaaagcagtggggcaaatgatgtctaccatgttttatcctctggtcacattcgtccttttacttatctgtatcgcgtactgggcaatgaccgctttatacctggccacttccgggcagccccagtacgtcttgtgggccagtaacatctcaagccctggctgcgaaaaggtcccaatcaataccagttgtaatcccacggcccatctggtgaactcctcatgccccggacttatgtgcgtgtttcaggggtactcctccaagggattgatccagagaagcgtgtttaacctgcaaatctatggcgtgctcgggctattctggactctgaattgggtactcgccttaggacaatgtgtgctggccggagcttttgcttccttctactgggcctttcacaagccacaagacatacccacctttcccctgatttcagccttcatccgaactctgcggtatcacactggtagtctcgctttcggtgcactgatcctcacactggtgcaaatagcacgggtgatcctggagtacatagatcacaaactccgcggagtccaaaatcctgtggcacgctgcatcatgtgctgcttcaaatgttgtctctggtgcctggaaaagtttatcaagttcctgaacaggaacgcatacattatgatcgctatatacggaaagaatttctgtgtgagcgcaaagaatgccttcatgctgctcatgagaaacattgtccgcgtagtggtcctggataaggttaccgatctgcttttgttctttgggaagctgctggtcgtggggggtgtgggtgttctcagcttttttttcttctcaggccgtatcccagggctgggaaaagacttcaaatccccacacctaaactactattggctgcccatcatgactagtatcctgggggcttatgtgatagccagcggcttcttcagcgtctttggtatgtgcgtggacacactgtttctatgcttccttgaagacctcgagaggaacaacggaagtctcgacagaccatactacatgtcaaagtccctactgaagatattggggaagaagaacgaggcacccccagataataagaagaggaaaaagtag

SEQ ID NO: 241683 - DNA, 1236 bp, Artificial Sequence
  Description of Artificial Sequence: Synthetic coding sequence
tgaagagacgaagatgatgaggcctatgggaagcctgtgaagtacgatccgagctttaggggacccatcaagaacaggtcatgcacagatgtcatatgctgtgttttatttctgctgtttatacttggttatattgtcgtcggcattgtggcttggctgtacggcgatccgagacaggtgctgtacccccgtaactctaccggcgcttattgcggtatgggcgagaacaaggataaaccttatcttttgtattttaacattttctcatgtatcctatcctctaacattatatctgtcgctgagaacggcctgcagtgcccaaccccgcaggtgtgtgtgagcagctgtcctgaagatccatggactgtcggaaagaatgaattttcacaaaccgttggagaggtgttttataccaagaataggaatttttgcctcccaggcgtaccttggaacatgacagtaattacaagccttcagcaggagctctgtccctcattcctcctgccctccgccccagccttgggacgctgcttcccttggactaacgtgacacctcccgctctgcccggaatcacaaatgacaccaccatccagcaggggatctctggtctgatcgatagcctaaatgctcgcgacatctccgtgaaaatatttgaagacttcgctcagagttggtactggattcttgttgctgttggacagatgatgagcactatgttttaccctctggtgaccttcgtcctgctgctcatttgtattgcctattgggcaatgaccgctctgtaccttgcgactagcggacagccgcagtacgtgttatgggcatctaacattagctctcctggttgcgagaaggtgcctatcaatacgagctgcaatcccacggctcacctcgtcaacagcagctgtcccggactcatgtgcgtcttccaggggtatagctcaaaaggacttattcagagatctgtctttaatctgcaaatttacggtgtgctgggactgttttggaccctgaactgggttctggcccttggacagtgtgtactcgcaggcgctttcgcttctttttattgggcctttcacaagccacaggacattcctacctttcccttgatttccgccttcatccgcacattgagataccatacaggtagcttagcctttggtgccctcatcctgaccctcgttcaaattgcaagagtaatcttagagtacattgaccataaactaagatag

SEQ ID NO: 241684 - DNA, 1236 bp, Artificial Sequence
  Description of Artificial Sequence: Synthetic coding sequence
taaagggatgaggatgacgaagcgtacggcaaacctgtaaaatatgatccatcattccgcggtccgatcaaaaatcgcagttgcactgacgttatctgctgtgtcctgttcctgcttttcatattgggctatatcgtggtggggatcgtggcctggctgtacggagatcctcggcaggtgctttacccaagaaattccacaggcgcatattgtggtatgggggaaaataaggataagccatacctgctgtatttcaatatcttcagctgcattctcagcagtaatatcatatccgtggcagagaacgggctccagtgcccaacaccacaggtgtgcgtgagttcctgtcccgaagacccttggactgtgggaaagaatgaatttagccaaacagtgggagaagtgttttataccaagaatcggaacttttgtcttccaggcgttccttggaacatgaccgtgataacaagcctacagcaggaattgtgcccatcctttcttttgccctctgctcccgctctgggaagatgtttcccctggaccaacgtcacccccccagccttgccgggaattactaacgataccacgattcagcaaggaatttctggactaatcgacagtttgaatgccagagacatcagcgtgaagatatttgaggattttgctcagagctggtactggattctggtcgccgtggggcagatgatgagcacaatgttctatccactcgtgacgttcgtgctgctgctaatttgtatcgcatactgggcgatgaccgccctgtacctggcaacaagcggccagcctcagtacgtgctgtgggccagcaacatatctagccctggctgcgagaaggtgccgattaacacctcatgcaatcccaccgcccatttggtgaacagtagttgccccggactcatgtgtgtgtttcaggggtacagcagcaaaggcctcattcagagaagtgtgttcaacctgcaaatatatggtgtactcggcttgttttggacactcaactgggtgctggctttgggtcagtgtgtcctagctggagccttcgcgtctttttactgggcttttcacaaacctcaggacatccccaccttccccctcatctctgcctttatcaggactctcaggtaccacaccgggagtcttgctttcggcgctctgatccttactctagtgcagatcgctagagtcattcttgaatacatcgatcataagcttcggtag

SEQ ID NO: 241685 - DNA, 1236 bp, Artificial Sequence
  Description of Artificial Sequence: Synthetic coding sequence
tagagggatgaagatgacgaggcatatggaaaaccagtgaagtatgatccctccttccgcggtccaatcaaaaaccgttcttgtacggacgtgatttgctgcgtcctttttctgctatttatcctgggttacatagtggttggtattgtggcttggctctacggcgaccccaggcaggtactctaccccaggaattctaccggagcctattgtgggatgggtgaaaacaaggacaagccctacctactgtacttcaacatcttttcatgtatcctgtctagcaacatcatctccgtcgctgagaacgggttacaatgtcccaccccacaagtatgtgtgtcatcttgtccagaagatccatggaccgtcggcaaaaacgaattctctcagaccgtgggtgaagtgttctatactaagaatagaaatttctgcctgcccggagtgccctggaatatgacagtgatcacgtcactgcaacaggaactgtgccctagctttttgttaccatctgccccagctctgggacggtgctttccatggacaaatatcacccctccagctcttcccggaattacgaatgacacgactattcaacaagggatctcaggactaattgattcactcaatgcacgagatatttccgtcaagatcttcgaggacttcgctcagtcgtggtactggatcctggtggctgtggggcaaatgatgtctaccatgttttatcctctcgtgacgttcgttcttctcctgatctgtatagcatactgggcaatgaccgcactatatctggctacctcagggcagcctcagtacgtgttgtgggcaagtaacattagttctccgggatgcgagaaagtgcccatcaatacaagctgcaatccgacagcccatctggtcaactcttcctgccctgggctgatgtgcgtctttcaaggatattcaagtaaagggttaatccagaggtcggttttcaacctccagatctacggggtgttggggctgttttggaccctcaactgggtcctcgccttagggcagtgtgtcctcgctggggcatttgcctcgttctattgggcctttcacaagccacaggacattccaaccttccctctaatctcagccttcatccgcaccctgagatatcacactggaagcctcgcctttggggctctcattctgactctagtgcaaatcgccagagtgatcctggaatatatagaccacaaactgaggtag

SEQ ID NO: 241686 - DNA, 2133 bp, Artificial Sequence
  Description of Artificial Sequence: Synthetic coding sequence
atggggggaaagcagagagatgaggacgacgaagcctatgggaagccagtcaaatacgatccatcctttagggggcctattaagaaccgatcttgcacggatgtgatttgctgcgtgctgttccttctcttcattctaggatacatcgtggtcggcatcgtggcctggctgtatggggacccgaggcaggtactttaccctagaaatagcactggcgcatactgcggtatgggcgaaaacaaagataagccttacttgttatatttcaacatattctcttgcattcttagttctaatataatctctgtggccgaaaatggtctgcagtgccccacacctcaggtctgcgtgtcaagttgccccgaggatccctggactgtagggaagaatgaattctcccagacagtgggcgaggtattttacaccaaaaatcgcaacttttgcctgccaggggtcccatggaatatgaccgtgattacttcactgcagcaagagttgtgtcctagcttcctgctcccctcagctcccgctctgggtaggtgcttcccttggactaacattaccccaccagccttgcccggaatcaccaacgacacgactatccagcagggtatttctgggctgatagacagtctgaatgctcgcgatatttcagtgaagatttttgaagacttcgcacagagctggtattggatactggttgccctgggcgtggccctggttcttagtctcctgttcatcttgttgttgagattggttgctggcccactggtactggtgcttattttgggagtccttggagtgctggcctatgggatttactattgttgggaggaataccgggtgctgagggacaagggagcatccatctcccagctgggcttcaccacaaatcttagcgcttatcagagcgtgcaagaaacttggctggcggctttgattgtcctggccgtcttagaggccattcttctattagtcctgatattcctgcgccagcgtattcggattgctatcgctctcctgaaggaggcgagcaaggcagtggggcagatgatgtcgaccatgttctatccgcttgtcaccttcgtgttattactcatttgcattgcttattgggcgatgacggcactatatctggcgaccagcgggcaaccgcagtacgttctgtgggctagtaacatctcctcccccggttgcgagaaggtgcctataaacacttcatgcaaccccaccgctcaccttgtcaacagcagctgccctggactcatgtgtgtgttccaaggttacagttcgaaaggactgattcaacggagcgtatttaatctacaaatctacggcgttctcggactgttctggaccttgaactgggtcctcgcacttgggcaatgtgtgctggctggcgctttcgcgtcattctactgggcattccacaaacctcaggacattccaaccttcccacttattagcgcgtttataaggaccttgcgctatcacactggaagcctcgcttttggggcattgattctcaccttggtgcagatcgcacgcgtgatcctcgagtacatcgatcacaagcttcgaggtgttcagaacccggttgccagatgcatcatgtgttgctttaagtgttgtctctggtgtctggaaaaatttatcaaattcctgaatcgaaacgcgtatatcatgatcgccatctatggaaagaacttttgcgtttcagctaaaaatgcctttatgctgttaatgcgcaatatcgtgcgcgtcgtcgtgctggataaagtcacagatttgttgctgttcttcggtaagttgcttgtggtggggggagtgggagtacttagcttctttttcttttctggacgcatccccggtctgggtaaggatttcaaaagcccgcacctgaactattactggctccccatcatgactagtatccttggcgcatacgtgattgcgtcgggcttttttagtgtgtttggcatgtgcgtggacacccttttcctgtgcttccttgaagacctggaaaggaataacgggagcctggaccgaccctactacatgtcaaagtcactgctgaagattttggggaagaaaaacgaagccccaccagacaataaaaaacggaagaaatag

SEQ ID NO: 241687 - DNA, 1236 bp, Artificial Sequence
  Description of Artificial Sequence: Synthetic coding sequence
tgacgcgatgaagatgatgaagcatatgggaagcccgtgaagtacgatccttcttttagaggacccattaaaaaccggtcctgtactgatgtcatatgctgtgtactgtttctgctgttcattctgggatacattgttgtcggcattgttgcatggctgtatggcgacccaaggcaggtactatatcctcgcaactcaacaggtgcctactgtggaatgggagagaacaaggacaaaccctacctcctgtacttcaacattttttcttgcattcttagcagtaatatcattagcgtggcagaaaacggtttgcaatgtcctacaccgcaagtctgtgtttctagctgccccgaggacccgtggacggttggcaagaatgaattctcccagactgttggtgaggtcttttataccaaaaacaggaacttctgcttgcctggagtaccctggaatatgaccgtgataacaagtctgcagcaggaattgtgccctagtttcttgctgccaagtgccccagctctcggacgctgttttccatggaccaacatcactcccccagctctgcccggaattacaaatgacacgacgattcagcaggggatcagcggattgatcgatagtctcaatgccagagacatttcagtaaagatattcgaagactttgctcaatcctggtactggattctcgttgcagtggggcagatgatgtcgactatgttctaccccctggtgacctttgtcctgcttttgatctgtatcgcgtattgggcgatgacggccctctacctggccaccagtggccagccacagtacgtactttgggccagtaacatatcatctcctggatgcgagaaggtccctatcaacacctcctgtaatccaaccgcccatcttgttaatagcagctgtccgggactgatgtgcgtgttccaaggctattcttctaaaggcctcatccagcgttctgtttttaatctccagatttacggtgtcttgggcctcttctggacactaaactgggtgctagcacttggccaatgtgtgttggccggagccttcgcgtcgttttattgggccttccataagccccaggacatcccgacattccccctcattagtgcctttattcggactctccgctaccataccgggtctctggcctttggggcactgatcctgactctggtgcagatagctagagtcattctggagtacatcgaccataagctacgttag

SEQ ID NO: 241688 - DNA, 2133 bp, Artificial Sequence
  Description of Artificial Sequence: Synthetic coding sequence
atgggcggaaaacagcgagatgaggacgatgaggcttatggcaagccggtgaagtacgatccgagctttcgcggacccatcaagaatcggtcctgtacagatgtgatttgttgcgtattattcttgctgtttatcctgggatacatagttgttgggatcgttgcttggttgtacggcgacccacgacaggtactttatcccaggaattccaccggagcctattgcggcatgggagaaaataaagataaaccgtatcttttgtacttcaacatcttttcttgcattcttagcagcaacattatctcagtcgctgaaaacggattgcagtgtccaactccgcaagtgtgtgttagtagttgccctgaggatccctggaccgttggaaagaacgagttttcccaaaccgtcggggaagtattctatacaaagaaccggaacttctgtcttcctggcgttccctggaacatgactgtcatcacctccctgcaacaggagctgtgcccctccttcttacttccctcagctcctgccctgggccgttgtttcccttggacgaacgtgaccccccctgcactgcccggtattaccaacgatacaactatccagcaaggcatctcaggcctgatcgacagccttaacgcgcgagacatctcagtgaaaatcttcgaagactttgcccagagctggtattggatactcgtggcccttggggtcgccttggtgctgagcctactctttatactgctgctgcggttagttgccggtcccctcgtgctcgtgctgatactgggggtgctgggagttctggcctatggaatttactactgttgggaggagtaccgcgtgctaagagacaaaggcgcatccattagccagctgggattcaccactaatctgtccgcctaccagtctgtgcaagagacctggctagcagccctgattgttttggctgtacttgaggcaatcctattattgatgcttatttttttgcggcagaggatacgcatagccatcgccctcctaaaagaagcaagtaaggccgtaggtcagatgatgtccactatgttttatcccttagtcacgtttgtcctcctgttgatctgtattgcttattgggcgatgactgccctctacctggcaaccagcgggcagccccagtatgttctgtgggctagtaatatcagctcgccaggctgtgagaaggttccaattaatacgtcatgcaatcctacagcccacctagtaaattccagctgtccaggtttgatgtgcgtcttccaaggctacagtagcaagggcctgatccagcgcagtgtctttaacttgcaaatctacggtgtactcggcctcttttggactctcaattgggtcctcgctttgggccagtgtgtgctcgccggagcattcgcctctttctactgggcattccacaaacctcaggatataccaaccttcccccttatctcagcgtttatcaggacactgagatatcacacaggtagtctggcctttggggctcttatcctgactttggtacagattgccagggtcattctcgagtacatcgaccacaagctgaggggggtgcaaaaccccgtagcccgatgcataatgtgctgtttcaagtgctgcctctggtgcctggagaagttcattaagttcctgaacagaaacgcttacatcatgatcgcgatctacggtaagaacttctgtgtatcagccaaaaatgcattcatgctcctcatgagaaacatcgtgagggtggtcgtgcttgacaaggtgaccgatctgctgctgttcttcgggaaattgctggtagttgggggtgtgggtgttctgtctttttttttcttttcgggtagaatccccggactcggaaaagacttcaagagccctcatttgaattattattggctgccaatcatgactagcattctgggagcttacgtgattgcgtcaggctttttctccgtgttcggcatgtgtgtggacacccttttcctctgcttccttgaggacctcgagagaaacaatgggtctctggaccgaccatattacatgtccaagtccctgctcaagattctcggtaaaaagaatgaggcccctcccgacaataagaagcgcaagaaatag

SEQ ID NO: 241689 - DNA, 1236 bp, Artificial Sequence
  Description of Artificial Sequence: Synthetic coding sequence
tgacgagatgaggacgacgaagcatacggcaaacccgtgaagtatgatccttcctttcgcggtccaataaagaatcgttcctgcaccgatgtaatttgctgcgtcctgtttctcctcttcatccttggatacatagttgtgggaatcgtcgcctggctttacggcgatccccgacaggtcttgtacccaagaaattctactggcgcatattgcggaatgggtgagaacaaagataaaccctatctgctatacttcaatattttctcttgtatcttgagttccaacattatctcggtggcagagaacgggctccagtgtcctaccccccaggtctgtgtttcctcctgccccgaggacccatggacagttggaaagaatgagttcagtcagacagtgggtgaggtcttctacacaaaaaacaggaacttttgtctccctggagtgccctggaacatgaccgtcattacgtccttacaacaggaactgtgcccttcatttctactgccatctgcaccggctcttggaaggtgcttcccttggaccaacgtgacaccacctgccctcccaggcattactaacgacaccactatccagcaaggcataagtgggctgatcgactcactcaatgctagggacatttccgtgaagatcttcgaggactttgcgcagtcttggtattggatccttgtcgctgtgggtcaaatgatgtcgacaatgttttatcccctggtgacatttgtgctgttgctgatttgtatcgcttactgggcaatgaccgccctgtaccttgccacatcaggtcagccccagtatgtactgtgggccagtaatatcagttcaccaggctgcgagaaagtgccaatcaacacctcctgcaaccccacagcccacctggttaactcatcttgcccagggctaatgtgcgtgtttcaaggctactcctcaaagggtctgatccagcggtcagtgtttaaccttcagatctatggggtgctgggcctattttggaccctcaactgggtgttggcactggggcagtgcgtactagcaggcgctttcgccagcttttactgggcattccacaagccacaggacattcctacattccccctgattagtgcttttattcgcacactgagataccacactggtagcctcgcctttggcgcactcattctgacactggtccaaatcgctcgtgtgattctggaatatatcgaccacaagcttaggtag

SEQ ID NO: 241690 - DNA, 1905 bp, Artificial Sequence
  Description of Artificial Sequence: Synthetic coding sequence
atgggcgagaataaagataaaccctatctgttatactttaacattttctcctgtatactttcttcaaatattataagcgtggcggagaatgggctgcagtgtcccactccgcaagtctgtgtgtcatcatgccccgaagatccctggacggttggcaagaacgaattttcccaaactgtgggtgaagtgttctatactaagaatagaaacttttgtctgcctggggttccttggaatatgactgtgatcacttccctccagcaggagctgtgccctagcttcttgcttccgtctgcacccgctctgggcagatgcttcccttggaccaatgtaactcctccggctctgcctggtattacgaacgacacaactattcaacaaggcatttctggacttatcgatagcttgaacgcaagagacattagtgtgaagatcttcgaagactttgctcaatcctggtattggatcttggtcgcactgggcgtggccctcgttctgtctctgttgttcatcttactgctgcgccttgtcgctggccctctggtgctggtactgattctgggagtgctcggagttctcgcctacgggatctattattgctgggaggagtatcgagtcctgagggataaaggcgcatccattagccagttgggatttacaactaacctgagtgcatatcagtcggtccaggaaacctggctggccgcactgatcgttctggcagtcctggaggccatcctgcttctcatgctgatcttcttaaggcagcgcattcgcatcgccatcgcacttctcaaggaggcctccaaagctgtgggacagatgatgagtactatgttttaccccctagtgactttcgttctactgttgatctgtattgcttactgggccatgaccgccctttatctggccacaagcggacagccgcagtatgtattatgggccagcaacattagttctccaggatgcgaaaaagttcccattaatacctcctgtaaccctacagcccaccttgtcaactcatcctgccccggactgatgtgtgtgttccagggttatagttcaaagggactgatccagcggtccgtgtttaatctgcaaatatatggtgtcctggggctgttttggaccctgaactgggttctagcgctcggtcagtgtgtgctcgccggtgcatttgcctctttttactgggcgttccataagccacaagatatccccacattccccctgatttctgctttcatccgcaccctgcgctatcatacgggatcgctggctttcggagctttgatactgaccttggtgcagattgccagggtgattcttgaatatatagatcataagttgagaggggttcagaaccctgtggccagatgtattatgtgttgcttcaaatgctgcctctggtgcctggaaaaatttataaagtttttgaacagaaatgcttacataatgatcgctatctacgggaaaaatttttgcgtgtccgccaaaaatgctttcatgctgctcatgcgcaacatagttagggtcgtagttctggataaggtgaccgatcttctgctttttttcggcaagctcctcgtggttggcggagtcggagtgctcagcttttttttcttcagtgggaggatccccggactggggaaagactttaaatctcctcacttgaattattattggcttccaataatgactagcattcttggcgcatacgtcatcgcaagcgggtttttcagcgtgttcgggatgtgcgtggataccctgtttctgtgcttcttagaggacttggaaaggaacaatggctctctggaccgtccttactatatgagcaaatcactgctaaagattctaggaaagaaaaacgaagcccctcccgataataagaagagaaagaaatag

SEQ ID NO: 241691 - DNA, 1905 bp, Artificial Sequence
  Description of Artificial Sequence: Synthetic coding sequence
atgggcgagaacaaggacaaaccatacctgctgtatttcaatattttctcctgcatcttaagctccaatattatcagcgttgcagaaaatgggcttcagtgtcccacaccacaggtctgtgtatcaagttgccctgaggatccatggaccgtcggaaaaaatgagtttagccagactgtaggggaagtcttttacaccaaaaaccgcaacttctgcttgcccggtgttccatggaatatgacagtcattacatccttgcagcaggagctgtgcccctcattcttactgccttccgcaccagctttgggaagatgcttcccttggactaacgtgaccccaccagccctgcccggaattactaacgataccaccattcagcagggcatttccgggttgatcgacagcctcaatgcccgtgatatttccgtcaagatattcgaggacttcgcccagagctggtattggatacttgtcgccctgggtgtcgctctggtactgtccctgctattcattctgcttcttcgactcgtcgcaggccctttggttttggttctgatcctcggcgttctaggggtgctggcgtatgggatttattattgctgggaagagtatcgcgtgcttagggataaaggtgcttccatttctcagttaggctttacaacaaatctatccgcttatcagagcgttcaggaaacatggctagcagccttgatcgttctggcggtcctggaagccattctacttctgatgctgatcttcctccgccagcgcatcagaatagccatcgctctcctgaaggaagcaagcaaagctgtggggcaaatgatgagcaccatgttttatccgcttgtgacgttcgtgctccttctgatctgcattgcctattgggccatgactgccctatacctcgccacaagcgggcagcctcagtacgtcctgtgggcctctaatatctcgagcccgggatgcgaaaaagtcccaatcaacacctcttgtaaccccaccgcacacctagtcaactctagttgtccaggcctgatgtgtgtgttccagggctactcaagtaagggactgatccagcggagcgtgttcaatctccagatttacggtgtattgggcctattttggactctgaattgggtgctggcactggggcagtgtgtgttagcaggcgcttttgccagtttttactgggccttccataagccccaggacatcccgacattcccccttatttcggcttttatacggacccttcggtatcatacaggcagtctcgcatttggagccttgattcttactctggtgcagattgccagggtaattttggaatacatcgatcacaaactgcgcggagtgcaaaaccctgtagcacgctgcattatgtgctgtttcaaatgttgtctctggtgcctcgagaaatttataaagttcctgaaccgaaatgcctatataatgattgcgatatacgggaagaatttctgcgtctcagccaagaatgcttttatgctgttgatgaggaacattgtgcgcgttgttgtactcgataaggtcacagacctcctgcttttcttcgggaagctgctcgtggtcggcggagtgggagttctgtctttcttttttttctctggcagaatacccggactgggcaaggactttaagtcaccccatcttaattactattggttgcccatcatgactagcattttgggtgcctatgttatagccagtggtttctttagtgtcttcggtatgtgtgtcgacactctgtttttgtgctttctagaagacttagagcggaacaacggcagcctcgacaggccgtactatatgtccaagtctctgcttaagatcctcggaaagaagaacgaggcccctcccgacaacaagaaaagaaagaagtag

SEQ ID NO: 241692 - DNA, 1905 bp, Artificial Sequence
  Description of Artificial Sequence: Synthetic coding sequence
atgggcgagaacaaggacaaaccttatcttctttacttcaacatttttagttgtatccttagttccaatatcatttctgtcgcagagaatggtctgcaatgcccgaccccccaggtgtgcgtgagctcatgtcctgaggacccatggactgttggaaaaaacgagttttctcaaactgtcggcgaagtattctacacaaagaacagaaacttctgtctgcccggagttccatggaatatgactgtcattactagcctgcaacaagagctttgcccctcttttttactgccttcagccccagctctggggaggtgctttccatggaccaacatcacccccccagctttgcccggaatcaccaatgacacaactatccagcagggcattagcggcctgattgacagcctgaacgctagagacataagcgtcaagatcttcgaggacttcgctcaaagctggtattggatccttgtcgccttaggcgtcgcactggtgctgtccctcctattcattcttctcctgagattggtagctggacccctggtgttggtgctgattctgggcgtgctcggtgtcctggcctacgggatctattactgctgggaggagtacagggtcctgcgggataaaggggcaagcatttctcagttggggttcactacaaacctgagcgcctaccagagtgtgcaggagacgtggctcgctgccctcattgtcctggctgttctcgaggctatcctcctgctagtgcttatttttctgcgccagaggatccggattgctatcgcacttttaaaggaagcaagcaaggccgttgggcagatgatgagcaccatgttttatcctctggtcaccttcgtcctcctactaatctgtatcgcctattgggcgatgacagcgctgtacctggccacctccggacagcctcaatatgtgctgtgggctagcaatattagctctccaggctgtgaaaaagtgcccataaatacaagctgcaatcccacagctcatctagtcaactcctcctgcccgggtcttatgtgcgtcttccagggctactcctctaaaggtctgattcagaggtctgtcttcaacctgcagatatacggagtgctgggtttgttttggaccctgaattgggttttggcccttggccagtgcgtgctcgcaggcgcttttgccagtttctactgggcttttcataagcctcaagacatcccaacctttcccttaatctccgcctttattagaactctacggtatcacaccggttcccttgcctttggtgcccttattctcacattggtccaaatcgcccgtgtgattcttgagtacattgaccacaaacttcgtggtgtgcagaatcccgtggcaagatgcattatgtgttgctttaagtgttgcctgtggtgcctggagaaatttattaaattcctgaacaggaacgcctacattatgatcgcaatctacgggaaaaatttctgcgtatcagccaaaaatgccttcatgcttcttatgcggaatatcgtccgcgtcgtggtgttagataaggtgacagacttgctgttgtttttcggcaaactactagtggttggcggtgtcggagtgttgtctttttttttcttctcagggagaattcccggtcttggcaaggatttcaagtcaccacatctcaattactattggctgcctatcatgaccagcattctcggggcttacgtcatagcctccggattcttctcagtgtttggaatgtgcgttgacacgctgttcctgtgtttcctagaagacctggaacgcaacaatgggtcgctggacaggccttattatatgagcaagtcactcctcaagattttggggaaaaagaatgaggctcccccagataataagaagcgcaagaagtag

SEQ ID NO: 241693 - DNA, 2007 bp, Artificial Sequence
  Description of Artificial Sequence: Synthetic coding sequence
atggggggtaagcagcgcgacgaggacgatgaggcatacgggaagccggtgaagtacgatccttcattccgaggccctattaaaaataggagttgtacagatgtcatctgttgcgttctcttcctgttgttcattctgggatacattgtggtgggtatagtcgcttggttgtatggcgaccctaggcaggtgctgtacccaaggaacagcaccggagcatactgtggcatgggggaaaacaaagataaaccatacttgttgtattttaacatattcagctgtattctgtcatcgaatatcatctcggtggccgagaatggacttcagtgccccacaccacaaaccgttatcactagcctacagcaggagctgtgcccttctttccttctgccttctgctcccgctctaggtcggtgtttcccttggaccaatatcacaccccctgcgctacccggtatcacaaatgatacaactattcagcagggaatcagtgggctgattgacagcctgaatgcacgggatatttccgtgaaaatttttgaggattttgctcagtcctggtattggatattagttgccttaggcgtggcacttgtcctatcgctgctttttatcctactcctgcgcctggtggcgggaccgctggttcttgtgctcatcctgggggtcctgggagtactggcgtatgggatctactattgctgggaagaatatagggttctaagggacaagggggcttcgatttcccagctgggcttcacaactaacctttccgcctaccagtcagtgcaggaaacctggctcgcagccctgatcgtgctggcagtgctggaagcaatccttctcctggttctcatttttcttcgccagaggatacgtattgcgattgccctgctgaaggaggcttccaaagcggtgggacaaatgatgagcacgatgttctacccactggtgacctttgttttgctacttatctgcatagcctactgggccatgacagcactatacctggcaaccagtggccaacctcagtatgtcctgtgggccagcaatattagcagccccggatgcgagaaggttcctatcaacaccagctgtaatccgaccgcacacttagtgaatagttcctgtcctggattgatgtgcgtcttccagggttactcatcaaaaggcctgatacaaagaagcgtttttaacctgcagatctacggtgtgctgggactattctggaccctgaattgggtgcttgctcttggccagtgcgtgctggccggagcgttcgctagtttttattgggcatttcacaaaccccaggacatccccacttttcccctgatcagtgcgttcatccgcacgctgcggtatcacacaggttcgctggcctttggtgcactcattttgacactcgttcagatagctcgggtcattcttgagtatatcgaccataagctgcgcggtgttcagaaccccgtggcacgctgcattatgtgctgtttcaaatgttgcctctggtgcctggagaagtttatcaagttccttaaccgaaacgcatatatcatgatagctatttacggaaaaaatttttgcgtgtcggctaaaaatgcgttcatgctgctgatgagaaatatcgtgcgcgtcgtggttctcgacaaagtaaccgacctgctcttgttctttggcaaacttctagtggtaggcggagtcggggttttgagtttctttttcttttcaggccgtattcctgggctgggcaaggatttcaagtccccacacctaaattactactggctgcctatcatgacgagtatactgggcgcatatgtcattgcatctggcttcttttctgtgttcgggatgtgcgtcgacaccctgtttctatgcttcctggaagatttggaacggaacaacggaagtctcgatcgaccctactacatgtccaagtccctgttgaagattctgggcaaaaaaaatgaggctcccccagacaacaaaaaacgtaagaaatag

SEQ ID NO: 241694 - DNA, 1905 bp, Artificial Sequence
  Description of Artificial Sequence: Synthetic coding sequence
atgggcgagaataaggacaaaccttaccttctctactttaatatattctcctgtatcctaagttcgaacattatttcagttgccgaaaatggcttgcagtgtcctacacctcaggtttgtgtatcttcatgccccgaggatccctggacagttggaaagaatgaattcagccaaaccgtcggcgaggttttttatacgaagaatcgcaatttttgtttacccggtgtgccttggaacatgaccgtcatcactagcctgcaacaagagctgtgtccctcctttctactgccttctgctcccgctctaggccgatgcttcccttggacaaacgtgacacccccagccctgcctggaataacgaatgacaccacaattcagcaggggatctcaggactcatcgattccttaaatgcacgagatatcagcgttaagatttttgaggactttgcacagtcctggtattggatcctcgtggctttgggggtagcgttggtgctgtctctgctgttcattttgctcttaaggctcgttgcaggtcctctggtcctcgtgttgatcttgggagttctcggggttctggcctatggtatctactactgctgggaggaatatcgtgttttgcgagataaaggtgcctctatttcgcagttgggtttcacaactaatctaagtgcctatcagtccgtgcaagaaacctggctggcagctttgattgtgttggccgtcctggaggccatcttactgttaatgctcatttttctgagacagagaattcggatcgctattgctctactcaaggaggccagcaaagctgtgggccagatgatgtcaaccatgttctaccccctcgtaacttttgtcctgctcctgatttgcatagcatattgggctatgactgctctttacctcgccacatccgggcagcctcagtacgtcttatgggcctctaatatcagtagccccggatgcgaaaaggtgccgataaatacttcatgcaacccaacggcccatctagtcaacagttcctgcccaggcttaatgtgcgtgttccaagggtactcctccaagggactcattcaaaggtcggtatttaatctgcagatttatggcgttctgggtcttttctggacactcaattgggttctggccctcggccaatgcgtgctcgccggagctttcgctagcttttactgggccttccacaagccccaggatatcccaacattccctctcatatccgcattcattcgaaccctacgctatcataccggttctttggcctttggcgctctgatcctgacactggttcagatcgccagggtgattttggaatatatcgatcataagctgcgcggagtgcagaaccctgtcgcacgctgcatcatgtgctgctttaaatgctgcctatggtgtctggagaagttcattaaatttctgaatagaaatgcctacataatgatcgcaatttatggcaaaaacttctgtgtttccgcaaagaatgcgtttatgctcctcatgaggaacatcgtccgagtcgtagtgttggataaagtgacagatcttcttttgttttttgggaaactcctcgttgttggaggggttggtgtgctctcattcttcttcttttccggccgtatccccggactcggtaaggactttaagtctcctcatctgaactattattggttgccgataatgacttcaattctcggcgcttacgtgatcgcttcgggcttcttttcagtgttcggcatgtgtgttgacactctgttcttgtgtttcctggaagacctggaaagaaacaacggttctctggatagaccttactatatgagcaagtcactcctgaaaatactcggcaagaaaaatgaagctcccccagacaacaagaaacgaaaaaaatag

SEQ ID NO: 241695 - DNA, 1905 bp, Artificial Sequence
  Description of Artificial Sequence: Synthetic coding sequence
atgggtgagaataaggacaagccatacttgttgtacttcaatatctttagctgcattctgagcagcaatataatttctgtggccgagaacgggctgcagtgccccacgccccaggtgtgcgtgagcagttgtcctgaagatccttggactgtcgggaagaacgagttctcacagacggtcggggaggtcttctacactaagaatcgcaatttctgtctgcctggggtgccctggaatatgacagtcatcacttccttacagcaggaactctgcccatcttttttgcttccttctgcccctgccctggggcgatgctttccctggaccaacgttacgccgcctgcattgcctggcatcaccaatgacacaaccatccaacaaggcattagtggtctcatagattcactcaacgccagggacatttccgtgaaaatttttgaagattttgcccaaagctggtactggattctggtcgctctgggagtggctctcgtcctttctttgctcttcattcttctattgcggctggtggcgggacctctggtgttggtgctgatcctcggggttctcggggttctggcctacgggatttattattgttgggaagaatacagagtgctacgcgacaagggcgctagtatctcacagctcggcttcacaactaatctttccgcctaccagagcgtgcaggaaacctggctggcagctttgatcgtgcttgcagtactggaggcaatcctgctcctgatgttaattttcctgagacagcgtatccgaatcgctatcgccctgctcaaagaggctagtaaagcagtagggcagatgatgagtaccatgttttatcctttggtcacctttgtgttgctgctcatctgcattgcatactgggccatgactgctctgtacctggccacttctggtcagccccagtatgtgctttgggccagtaacatttcttctccgggatgcgagaaagtacccatcaatacatcctgcaaccctaccgcgcacttggtaaattcttcttgtccagggctgatgtgtgtgtttcagggctatagttccaaaggactgattcaaaggagcgtgttcaatctgcagatctatggagtgttgggactcttttggacactaaattgggtcttagcactgggacagtgcgtcctggctggagcattcgccagtttctattgggcctttcataagcctcaggatatacctacgttccctctcatctccgcatttatcaggacactccgctatcacacgggatcactagcttttggtgccctgatcctgacactggttcagatcgccagagttatactagagtacattgaccacaaattgcgcggtgtgcagaacccagtggcccgatgtattatgtgttgtttcaaatgttgcctatggtgtctggagaagttcattaaattcctgaatcgcaacgcctacattatgatagccatctacggtaaaaacttttgtgtttctgcaaaaaatgcatttatgcttctaatgagaaacatcgtgcgcgtcgtagtgctagacaaggtcacagacctgcttctcttcttcggcaagcttctggtggtgggcggagtcggggtgctcagttttttctttttcagcggcagaatcccaggtcttggcaaggatttcaaaagcccgcacctgaattattattggctgcctattatgacttctatacttggcgcttacgtgatcgcctctgggttcttctcagtgttcggcatgtgcgttgacactttgttcttatgcttcttagaagatctggagaggaacaacggttctctggacagaccttactatatgtctaagtcgttgctgaagatccttggcaagaagaacgaagcaccgcctgacaacaagaagaggaagaagtag

SEQ ID NO: 241696 - DNA, 2007 bp, Artificial Sequence
  Description of Artificial Sequence: Synthetic coding sequence
atgggtggtaagcagcgagacgaagatgacgaagcatatggtaagccagttaaatacgatccctcattcaggggtcccattaaaaatcggtcctgcaccgacgtgatctgctgcgtgctttttctgctatttatactcgggtacatagtggtcggtattgtcgcttggctgtatggagatccacggcaggtactgtatccaaggaattcgactggggcttattgtggtatgggggaaaataaagataagccctacctgttatattttaatatctttagctgcatcctgagttccaatatcatttccgtggccgagaacggtttacaatgtcctacaccccagactgtgatcaccagtctgcagcaggaactctgtccttcgtttttgctgcccagcgcaccggctcttggacgatgttttccgtggaccaacgtgacccctccagcactccccggaattacaaacgacacgacaattcagcagggtattagcggtctgattgacagtctgaatgcaagagacatttcagtcaaaatctttgaagacttcgcacagtcctggtactggatccttgtcgccctaggggtagccctggtgctgtccctcctcttcatcttgcttctgagactcgttgccggacctctggtgcttgtcctaatcctcggggtcctgggggtgctggcatatggcatctattattgttgggaggagtacagagtactgagggacaagggcgcttcgatttcccagctcggattcaccacaaatctcagtgcttatcaatctgtgcaggaaacatggctggcagcgctaatcgtacttgctgttttggaggcaattctgcttctgatgctgatcttccttagacaaagaatcaggattgccatcgccctcctaaaggaggcttcgaaggcagtcggccagatgatgagcactatgttttatccactcgttaccttcgtcttactgttgatatgtattgcctattgggccatgacagctctgtatttagcgacctctggtcaaccccaatatgttctctgggctagcaacatctcctcacctggttgtgagaaggttcctattaataccagctgtaaccccaccgcccatcttgttaattcttcatgccccggactcatgtgcgtctttcaggggtacagtagtaaagggctcatccagaggtcagtgtttaacctgcagatttacggagtgctcggacttttttggaccctgaattgggtgttagccctggggcagtgtgtgctggctggcgcattcgcaagcttctattgggccttccataagccccaagatattcctactttccctctcatcagcgcatttatccgaaccctgagatatcacacgggcagtctggcattcggggcactcatcctaactctcgtgcagatcgccagagtgatcttggaatatatcgatcacaaactgaggggcgtgcagaaccccgtagcgaggtgtattatgtgctgtttcaaatgctgcctctggtgtctggaaaagttcatcaaattcctcaaccggaacgcgtacataatgattgccatctatggcaaaaacttctgtgtatctgctaagaacgcgttcatgttgttaatgaggaatatcgttcgcgttgtggtgttggataaggttactgacctgttactctttttcggcaaactactggtggttggtggagttggcgtactgagcttctttttctttagcggcaggatcccaggcctgggaaaggacttcaaaagtccgcaccttaattactactggcttccaatcatgacttccatcctgggagcgtatgtgatcgccagtggatttttttcggtgttcgggatgtgcgtggataccctgtttctgtgcttcctggaagatttggagcggaataacgggagccttgaccgaccttattatatgtccaagagcctgctcaagattctcggcaagaagaacgaagccccacctgataacaaaaagcgcaagaagtag

SEQ ID NO: 241697 - DNA, 2007 bp, Artificial Sequence
  Description of Artificial Sequence: Synthetic coding sequence
atgggcggaaagcaaagagacgaggatgacgaagcgtacggaaagcccgtaaagtacgaccccagctttcgcggtcctatcaaaaacaggtcttgtaccgacgtgatatgttgtgtgctgttcctgttgttcatcctgggctatatcgtcgtagggatcgtggcctggctgtacggggatcctagacaggtcctctaccccagaaactcaaccggcgcatactgcgggatgggggaaaacaaagataagccttatcttctttacttcaacattttttcgtgtatactgtctagtaacatcatttccgtggcggaaaatggacttcagtgccccacccctcagaccgtgatcaccagtttgcaacaagagttatgcccctcattcctgctgccttcagcgccagctctgggacgctgttttccatggacaaacgtcactccccctgctcttccagggattaccaatgataccacaatccagcaggggatcagtggactcattgatagtctcaacgcccgtgacatcagtgtaaaaatattcgaggattttgctcaaagttggtattggatactagttgcactaggcgtggcgctggtgttgtccctcctctttatcctgctgctacgactggtggccggacctctggtgctggtgctgatcctaggggtcctgggtgtacttgcctatggcatctattattgttgggaggaatatcgggtgctaagggacaagggggcaagcatctcgcagctcggatttacaacaaatcttagtgcctaccaatcagtgcaggagacatggctggctgcattgattgttctggcggtgttggaggcaatcctgctcttgatgctgatcttccttcgccagcgcatccgcattgctatcgcactgttgaaggaggcatctaaggcagtcgggcagatgatgtccaccatgttttaccccctcgtcacttttgttctgctgcttatttgtattgcctactgggcaatgacagctctgtatctagccacgtccggccagccgcagtacgtgctctgggcatctaacatttcctctcccggttgcgagaaggtgcctatcaacacctcttgcaaccccaccgcacacctggtcaacagctcttgtccaggccttatgtgtgtgttccaaggctattctagtaaaggtctcatccagagatccgtgttcaaccttcagatctacggggtcctcggactcttctggactctgaattgggtgctcgccctgggccaatgcgtgctcgccggtgcattcgcctccttttactgggcttttcataaaccccaggatattcctacattcccactgatctcagcatttatcagaactctgcgatatcatactgggtcacttgcattcggcgcactgattctgacactcgtccaaatcgccagagtgatcctcgagtacatagaccacaagcttaggggggtgcagaatccagtcgcccgatgtattatgtgctgctttaaatgctgtctgtggtgtctggagaaatttataaaattcctgaatagaaatgcctacataatgatcgcgatttacggtaagaacttttgtgtgtccgcgaagaatgctttcatgttactcatgcggaatatagtgagggttgtggtcctcgataaagttacagacctccttctgttttttggtaaactgctggtggtcggaggtgtgggtgtgttgtcctttttcttcttttcggggagaatcccaggattgggaaaagacttcaagtcaccacacctgaattactactggctccctatcatgacaagcattttgggagcgtacgtgattgcatcgggctttttctctgtctttggtatgtgcgtcgatacgctgttcttatgctttctcgaagacttggaacgaaataacggatccctggacaggccatattatatgagtaaatccctgctgaaaattctgggaaaaaaaaacgaggccccacctgataataaaaagcgaaagaagtag

SEQ ID NO: 241698 - DNA, 2007 bp, Artificial Sequence
  Description of Artificial Sequence: Synthetic coding sequence
atgggtgggaaacagcgagatgaagatgatgaggcctacggtaagcctgtgaagtacgatcccagtttccgcggacccatcaaaaacagaagttgtactgacgtaatctgttgcgttctctttcttttattcattttggggtacattgtcgttgggatcgtggcgtggctgtatggcgaccccagacaagtgctctatccaaggaattcaacaggagcttactgcggaatgggtgaaaataaggataagccttacctgctgtacttcaacatcttttcatgcatcctgtcttccaacataattagcgttgcagagaatggcctgcagtgccccactccccagacggtgataactagtttgcagcaggaactgtgccccagtttcttacttcctagcgccccagcgctgggtcggtgcttcccctggacaaacatcaccccccctgcgttaccaggtataacaaatgacaccacaatccagcagggtatctccggtctaatcgattccctgaacgcaagggacatcagcgtcaaaattttcgaagacttcgcacaaagttggtactggatcttagtggctctgggagtcgcactcgtgttatcactgctctttatccttctgctacggctggtcgccggtccactcgtgctggtattaatcttgggagtactgggcgtgctagcctatggcatatattactgctgggaggaatatagggttctccgcgataaaggagctagcatatctcaacttggttttacgaccaatttgagtgcctatcagagtgtccaggagacctggcttgccgctctcattgtcctcgccgttctggaggcaatcctcctgcttgtcctgatatttctgcgccaacgcattaggattgctattgcactgctgaaggaagcctccaaggccgtgggccaaatgatgtccaccatgttctatcctttggttacatttgtgcttctcctgatctgcattgcctactgggccatgacggccctgtacctggcgacctctgggcagcctcaatacgttctctgggcctcaaacatcagctcccccggatgtgaaaaggtgcccattaatacaagctgtaatcctaccgcccacttggttaactcttcatgccctggcttaatgtgtgtcttccaggggtactcgagcaaggggctgattcagaggagcgtttttaaccttcagatctacggggtgctgggcctgttctggaccttgaattgggtcctggcactgggccagtgtgttctagctggcgcattcgcatccttctactgggccttccataagcctcaggatatacctactttcccattgatttctgcattcatccgtaccctccggtatcataccgggtcactcgcgttcggggctctcattctcacactcgtgcagatcgctcgcgtgatcctggagtatattgaccacaagctgcgtggggtccagaaccctgtggccagatgcataatgtgctgtttcaagtgctgtctgtggtgcctggaaaaatttattaagtttctaaatcggaatgcttacatcatgatcgccatttatgggaaaaatttttgcgtgtctgccaaaaatgcttttatgctgctgatgcggaatatcgtgcgggtggtggttcttgataaggtcacagatctcttgctgttttttggaaagctcctggtggtggggggtgtgggcgtactgagcttcttctttttctccgggcgaatccctggtttggggaaggactttaaaagtcctcacttaaattattactggctcccaatcatgacatctatactgggcgcatatgtgatcgcgagcggattcttctccgtttttgggatgtgcgttgacaccctgttcctttgtttcctcgaggacctcgaacggaataacggaagcttagaccgcccatactacatgtcgaaatcactccttaagatactaggtaagaagaacgaagcacctcccgacaataagaagcgcaagaaatag

SEQ ID NO: 241699 - DNA, 1905 bp, Artificial Sequence
  Description of Artificial Sequence: Synthetic coding sequence
atgggagaaaataaagacaaaccatacctgttatattttaacatcttctcttgcattctaagcagcaatatcatctccgtggctgaaaatggacttcagtgtcccacacctcaggtttgcgtgagcagttgtcccgaggatccctggactgtgggcaagaacgagttttctcagacagtgggggaagtgttttatacaaaaaacaggaacttttgtctgcccggagtaccctggaacatgaccgttattacgtccctccagcaggaactgtgccccagttttctgttgccctccgctcccgctctaggcaggtgttttccgtggacgaacattacgccgcctgctctccccggaatcaccaacgacaccacaattcaacagggaatctctggcttgatcgacagcctcaacgccagagacatttctgtaaaaattttcgaggacttcgctcagtcctggtactggattctggttgcgttaggagtagctcttgtgttatccctgctgttcattctgcttttacggctcgtagcaggacctttggtgctcgtgctcattctcggggtactgggcgtgcttgcatacgggatctattattgctgggaagagtaccgcgttctgcgagacaagggcgctagcatttctcaacttggatttactactaatctctcggcctaccagagcgtacaggagacctggctggcagccctgatcgtactggctgtcttagaagccattctgttattggttttaatctttcttcgccagcggatacgaattgcgattgccctgctgaaagaagcaagtaaggctgtgggccaaatgatgagcaccatgttctacccgctagtcacattcgtcctgctcctgatctgtatcgcttactgggctatgacggccttgtacctggcaacatccgggcaaccccagtatgtgctgtgggcatctaacatctcttcccccggatgtgaaaaagtccccataaatacttcatgcaaccctactgcgcatttggtgaactcaagctgccctggcctcatgtgtgttttccagggatacagctctaaagggttgattcaacgctccgttttcaatctgcagatttatggagtgctaggattgttctggacactaaactgggttctagctcttggccagtgtgtcctggccggtgccttcgcgagcttctactgggcgtttcacaagccccaggacatcccaacattcccacttatcagcgcgtttatacggactctgcggtaccacactgggagcctggcatttggggctttaattcttaccctcgtacagattgcacgggtgattctggaatacatagatcacaagctgagaggggtccaaaatcccgtcgcccgatgtatcatgtgttgcttcaaatgctgcctttggtgcttggaaaaatttataaaatttctgaataggaacgcttatattatgatagcaatctatggcaaaaatttttgtgtcagcgcgaaaaacgccttcatgctgctgatgcgaaatattgtgagggtggtcgtgttggacaaagttactgacttgctcctcttctttgggaaacttctggtcgtcgggggtgttggggttctaagctttttttttttctccggcagaattccagggcttggtaaggattttaaaagtccccatctaaactactactggctcccgatcatgacatcgatcctaggggcttacgttatcgccagtggcttctttagcgtttttgggatgtgtgtcgacactctgttcctctgtttcctcgaggatctggagcgcaacaatgggagcctggatcgaccttactatatgtctaagagtttactcaagatcctgggcaaaaaaaatgaggccccaccggacaacaaaaagagaaaaaagtag

SEQ ID NO: 241700 - DNA, 2007 bp, Artificial Sequence
  Description of Artificial Sequence: Synthetic coding sequence
atgggcggtaagcaacgtgatgaagatgatgaagcatacggtaaaccagttaagtacgaccctagctttcggggtcccatcaaaaaccgatcttgcacagacgtcatttgctgcgtgcttttcttgttgtttatcttggggtatattgtggtcggcattgttgcgtggctgtatggggatccgaggcaggtgctgtaccccagaaattcaaccggtgcgtactgtggcatgggcgaaaataaggacaagccctatctcctgtattttaacattttctcctgtattctgagttccaacataatctcagttgccgaaaacggcttgcaatgtcccacccctcagactgttattactagcctgcaacaggaactgtgtccatcttttctgctgccttctgcgcctgctctgggcagatgcttcccatggacgaatgtgaccccacccgctctgccaggaattacaaatgatacaaccatccagcagggaatttccgggctgatcgattcattaaatgcccgtgacataagtgtgaaaatcttcgaggatttcgcccagtcatggtattggatactggtcgccctgggagtggccttggtcctctccctcttgtttatcctgttgctccggctagttgctgggccactcgtgttagtgttgatcttaggggtgctgggggtgctagcttatggcatttattactgttgggaagagtaccgggtgctgagggataaaggcgcatcaattagtcaactagggtttacgaccaacctctccgcataccagtctgtccaggaaacctggcttgcggcactgattgtcctcgctgtcctcgaagcaatacttcttttgatgctgattttcctcagacagcgcatcaggatcgccatcgctcttctgaaagaggcttctaaggccgtcggtcagatgatgagcacaatgttctatccgcttgttacctttgtgctgctgctgatttgcatcgcatactgggccatgaccgccctctatttggccacgagcgggcagccacaatatgtgttatgggccagcaatattagctcgcccggatgcgaaaaggtgcccatcaatacatcatgcaatcctactgcgcacctcgtcaactcttcctgccccggactcatgtgcgtgttccagggctacagcagcaagggcttgatccaacggagcgttttcaacctgcagatttacggcgtcctggggctgttctggaccttaaactgggtacttgcactcggccagtgtgttttagcaggcgcttttgcgtcattctactgggccttccataagccacaagacataccgacctttcccctcatatccgcatttatccgaacgctgcgctatcacaccggcagtctagcgtttggagcccttatccttaccctcgtccagattgcaagggtgattctcgagtatatcgaccacaagctgagaggagtacagaacccagtcgcaagatgtatcatgtgctgcttcaagtgctgtttatggtgcctggagaagtttatcaagtttctgaaccggaatgcgtacatcatgatcgcaatctatggaaaaaatttctgtgttagtgccaagaatgccttcatgttgctgatgcgtaatatagtccgtgtggtggtcctggataaggttactgacctcctgctcttctttggaaaattgctcgttgtggggggagtaggcgtgctgagtttcttcttttttagcggtagaattcccggtctgggcaaagactttaagtccccacacctcaactattactggctcccaattatgacctcgattcttggagcatatgtgattgcctccggcttcttctcggtttttggaatgtgcgtggataccctgttcctgtgctttttggaggatctggagaggaacaacggaagcctggaccggccttactatatgagcaagagtctcctgaagattctcggtaaaaagaatgaagcaccaccagataacaagaaaagaaagaagtag

SEQ ID NO: 241701 - DNA, 2007 bp, Artificial Sequence
  Description of Artificial Sequence: Synthetic coding sequence
atgggcggaaaacaaagagacgaggacgatgaagcttatgggaaaccagtgaaatacgacccaagctttagaggtcctatcaaaaatcgcagctgcactgacgtgatctgctgcgtgcttttcctgctctttattttggggtatatcgtcgtgggcatcgttgcctggttgtacggtgacccgcgtcaggtgctgtaccccagaaactccacgggagcatactgcggcatgggagagaacaaagacaagccatatctcttatatttcaacattttttcctgcatcctgtcctcaaatatcatctcagtggcggaaaacggactacaatgtccaacgcctcagacagttattaccagtctccaacaggaattatgcccaagtttcctcctcccttccgcacctgctctggggaggtgcttcccatggacaaatatcaccccccctgcactgcctggaatcacgaacgacaccacaatacaacagggaatctcaggtttaatcgactccctgaatgctagagacatatcagtgaaaattttcgaagacttcgcccagtcttggtactggattctggttgccctgggcgtggccctggtcctctctctactctttatcctgctgttgcgtttggtcgctgggcctttggtgttagtgcttattctgggggtgttgggggtgctggcctatggcatttattattgttgggaagaatacagagtcttaagggataagggggcatctatatctcagctgggatttaccacaaatctctccgcctaccaatccgtgcaggagacctggctcgctgccctgatcgtgttggcagtcctggaggccatactgctgctggtgctgatcttcctgagacagcgtatccgaatcgcaattgccttgctcaaagaagcctccaaagccgttgggcagatgatgagcaccatgttctacccccttgtgaccttcgtgctccttcttatttgcattgcctactgggcaatgaccgccctgtacctcgcaacctccggacaacctcagtacgtgttgtgggctagtaatatctcctcgccaggttgtgagaaagtgcccatcaatacgagctgcaaccctacggcacacttagtcaactcaagttgtcctggactgatgtgcgttttccaagggtactcttcaaagggcctgattcagagaagtgtgttcaacctgcaaatatatggcgtgctggggctattctggacactaaactgggtgctggctttgggacagtgcgtactcgccggagcttttgcctccttctattgggccttccataaaccgcaggacatccctaccttccccttgataagtgcattcatccggaccctgcggtatcacacaggctccctcgcttttggcgcattgatcctaacattggtgcagatcgcacgggtcatactagagtacatcgatcacaagcttcgcggtgtgcagaatccagtcgcacggtgtattatgtgttgcttcaaatgctgcctatggtgcctggagaagttcatcaaatttttaaatagaaacgcatatattatgatcgccatctatggcaagaacttttgcgtttcggcgaaaaacgcatttatgttgttgatgcggaacatcgtgcgagtggtggttttggataaggtgaccgatctgctgcttttctttgggaaacttctggtggtgggcggagtaggcgtgttatcctttttcttttttagcggccgtatcccaggcttagggaaagatttcaaatctccgcacctcaactactattggctgcctatcatgacaagtattctgggggcatacgtgattgccagcggctttttctccgtgtttggaatgtgtgtggacaccctcttcctgtgcttccttgaggatttagaaaggaacaatggcagcctggatcgaccttactatatgtctaagtctctgctgaagatcctcggaaagaagaatgaggcacctcctgacaataaaaagcgaaagaaatag

SEQ ID NO: 241702 - DNA, 1905 bp, Artificial Sequence
  Description of Artificial Sequence: Synthetic coding sequence
atgggtgagaataaagataaaccctatctattatactttaacatcttctcttgtatcctaagcagcaacatcatctctgtcgcggaaaacggtttgcagtgccccacccctcaagtttgtgttagcagctgcccagaagatccatggactgtaggaaagaacgaattctctcagacggtgggagaggttttctacacaaaaaatcgaaacttctgcttaccaggcgtgccatggaacatgaccgtgatcaccagtctgcaacaggagctctgcccgtcctttttattgccctctgctcccgctctgggaaggtgttttccatggacgaatataactccccctgccctaccagggattactaacgataccaccatccagcagggcatctctggtctgatcgactctcttaacgcaagggacattagtgtgaagatattcgaggacttcgcccagagttggtactggatcctggtggcactcggcgtggccttagtactgtccctcctcttcattcttctccttcggctagtcgctggtccacttgtccttgtgctgatcttgggagtcttgggtgtcttggcttacggaatctactattgctgggaggagtacagggtgctgcgagacaaaggggcttcaatttcccagttaggttttactacaaatctgtcagcttaccagtcggtacaggagacatggctggccgctctcatcgtgttagctgtcttggaggctatcctcctcctggtgctgatcttccttagacagagaattcgaatcgccatcgctcttctgaaggaggccagtaaagccgtagggcaaatgatgtccaccatgttctacccactggtgacatttgtgctactcttgatatgcattgcgtattgggcgatgacggccttgtatttagctactagtggacagccccagtacgtgttgtgggcttcgaatatcagcagtcctggatgcgagaaggtacctatcaataccagctgcaacccaactgcccacctcgtgaattcctcctgtcccggacttatgtgcgtctttcaaggctatagctcaaaaggtctgattcagaggtctgtattcaaccttcaaatttatggcgtgctggggctgttttggactctgaattgggtgctggccctcggacaatgtgtactcgcaggggcttttgcctcattctattgggccttccacaagccgcaagatattcctacctttccgttgatttcggccttcatcagaaccctgaggtatcatactggaagtcttgcctttggagcactgatattaactctagtgcaaatcgctcgagtgattctcgagtacattgaccacaaactgagaggcgtacagaatcctgttgctagatgcataatgtgttgtttcaagtgctgcctctggtgcttggaaaagtttatcaaattcctaaatcggaatgcctacatcatgatagctatctacggaaaaaacttttgcgtgagcgcaaagaatgctttcatgctgctgatgagaaatatagttagggtggtcgtgctcgacaaagtgaccgatttactcctcttctttggtaaacttttagtggtgggaggcgtgggcgtgctgtctttcttttttttttctggcaggattcctggcctaggaaaagactttaagagcccccatctaaactactattggctgccgattatgacatccattcttggagcctacgtgattgctagtgggttttttagcgtgttcgggatgtgcgtggacaccctgtttctctgttttctcgaggatcttgagcgaaacaatgggtccttggacaggccctattatatgtccaagagcttactcaagatcctaggcaaaaaaaatgaggcgccacccgacaacaaaaaacgaaagaagtag

SEQ ID NO: 241703 - DNA, 2247 bp, Artificial Sequence
  Description of Artificial Sequence: Synthetic coding sequence
atgatacccgctgcctccagtactccaccaggcgacgcccttttcccgtcagttgcccctcaggacttttggcggtctcaggttaccggttattctggaagtgtgacccggcatctttcacacagagctaataatttcaaacgccacccaaaaagacgcaagtgtattaggccttcaccacctcccccaccaaataccccatgccctctcgaactagtagacttcggtgacttacatccccaacgctcttttcgggagctgctttttaacggctgcatactgttcggtatagaattctcatacgccatggagaccgcatatgtcacccctgtcctcctccagatggggctgccggaccagctttactctctggtgtggtttatctctcctatcctgggatttctgctgcagccactcctgggcgcttggtctgaccgatgtacatcccggttcggccgaaggcgtccattcatattagttctcgcaatcggcgctctgctggggctttcacttttgctcaacgggagagacattggaattgctctggccgacgtgacaggcaatcacaaatgggggctcttgctgactgtgtgcggagtagtcttgatggatttctcggccgatagcgcagataacccctcacatgcctacatgatggatgtttgctcaccagctgatcaggaccgcggactgaatattcacgccctgttggcgggtctcggtgggggatttggctacgtagtgggtgggattcactgggataaaactggtttcggccgagcgctgggaggccagctgcgcgtgatctacctttttactgctgtgaccctttctgtcacaactgtgcttacactcgtgtctataccagaaaggcccctgcggcctcccagcgagaaacgagcagccatgaagtctcctagtctgcctcttcctccctcccctcctgtgcttcctgaggaaggacctggagactctctgccatctcatactgccacaaacttttcctcccccataagtcccccttcgcccctcaccccaaagtatggcagttttatctctagagacagctccctaaccgggatatccgagtttgccagcagcttcggaactgccaacatcgactcggttctgatcgattgctttactggcggacacgactcatatctggctatccctggctccgtccctcggccaccgatctctgtttcctttcccagagctcctgacggcttctacagacaggaccgagggctgctggagggtagggaaggtgccttgacctccggatgcgatggggacattctaagagtgggttcgctggatacttccaaaccccgtagttcaggaatcttgaaacgacctcagactttggctattcccgacgctgcaggcggaggcggacctgagacctcaagacggaggaacgtcactttctctcagcaggtggctaatattctgctgaatggcgttaaatatgagagcgaactcaccgggtcttcagaaagagcggagcaaccgctgagcgtcggacgtttgtgctcaaccatttgcaacatgccaaaggcattgaggaccttgtgtgttaaccactttcttggctggcttagcttcgagggtatgctgcttttttacacagattttatgggcgaggttgtgtttcaaggggacccaaaggcccctcacacctccgaagcttatcaaaagtacaatagcggcgtcactatggggtgttggggtatgtgcatctacgcattctccgcagctttttactctgccatactggagaaactcgaggagtttctgagtgtgagaacactctattttattgcctacctggcattcgggctcggaacaggattggccacactgtctaggaatctctacgttgtgcttagcctttgcattacctatgggatactcttctcaacgttatgcacacttccctattccctcctgtgcgactattaccagtcaaaaaagtttgcaggaagcagcgccgatgggacaagacggggaatgggagtagatatctctcttctgtcgtgccaatactttttagcacagatcttggtttcgttagtcttgggacctcttacctcggcagtggggtcggctaatggcgtgatgtattttagcagtctggtgagcttccttggctgtctgtattcctcattgttcgtaatttatgaaattcccccatcagacgcagccgatgaggaacaccgtcccttgctgttaaacgtctag

SEQ ID NO: 241704 - DNA, 2349 bp, Artificial Sequence
  Description of Artificial Sequence: Synthetic coding sequence
atgctacagcagcctggaccacgaccaggccgacagcagccctccggggacagggacgcatgtcggctgcacccccagggcaggccaccagccctacccacaatgattccagcagcctcatctacaccccctggggacgcactcttccccagcgtcgccccacaggacttctggaggtcacaagtgacaggctactcagggagtgtcacaagacacttgtcacaccgagcgaataatttcaagcgccatcccaaaaggcgtaagtgtattaggcctagtccacctccgcctcctaataccccttgcccgttggaactggtggactttggagacctccatccgcagcggagttttcgtgaactgctgttcaacggatgcatactctttggaatagagttctcatacgccatggagaccgcctatgtcacccccgtgctgctgcagatgggcctacccgaccagctgtattctctggtgtggttcatttctccaattctcggcttcctccttcaacctcttctgggcgcttggagcgacaggtgtacttctaggttcggcagaagacgacccttcattctggtgttggccatcggcgctctcctcggattaagcctcctgcttaacggtagggacatcggcattgcgctcgctgacgttaccggcaaccataagtgggggctcttactgacggtgtgcggcgtcgtgctcatggacttcagtgcggactcagcagataaccccagtcatgcttacatgatggacgtgtgctctccggcagaccaggatcgtggcctaaacattcatgcactcctggcgggactagggggtggatttggctacgtggttggtggcattcattgggacaagaccggcttcggtcgggctctagggggacagctcagagtgatttatttgttcactgcagtaaccctatccgtgactactgtcttgactcttgtctctattcccgagcgtcctctgcgcccacccagtgaaaagagagccgctatgaagtccccttctctccctctgccgccatcccctccagtgctccctgaggaaggtccaggggattccctgccctcgcacaccgctacaaatttttcctcgcccatttcaccgccatctcctctgactccgaagtatggatcttttatttcccgggattcctcactgaccgggatttcagagtttgcgagcagtttcggtacagccaacatcgactcagtactcattgattgtttcaccgggggacatgactcttatcttgcgattcccggtagcgtccccagacctccaatttctgttagtttccccagggcacccgacggattctatcgccaggatcggggacttctggaagggagagagggtgccctgacttccgggtgcgacggcgacatcctcagggtaggttcacttgacacaagcaagccaagatccagcggcatattaaagcggcctcagactttggctatccccgacgcagccggaggcggaggaccggaaacatctcggaggagaaatgtgacctttagccaacaagtggcaaacattctactcaacggtgtgaaatacgaaagcgaactgaccggatcctctgagcgcgctgagcagcccctgtccgtcggcagattgtgcagtaccatttgcaatatgcctaaggctctgcggaccctgtgcgtgaaccacttcctcggctggctttcttttgagggcatgcttctgttttatactgattttatgggggaagttgttttccagggtgatcctaaagctccacatacctccgaggcttaccagaaatacaacagcggggtgacgatgggttgttggggcatgtgtatctatgctttttctgccgctttctatagcgccatcctggaaaaacttgaggaattcttgtccgtgagaactctgtatttcatcgcctacctcgcctttggcttaggcacaggtctggccacactgtctcgcaacctgtatgtcgtcctgtcactttgcataacctacggaattttgttcagcactctgtgtaccctgccatattccttgctttgcgattattatcagagtaagaagttcgctggaagttcagccgatgggactcggaggggaatgggggtcgacatcagtctgctgagttgccagtactttctggcacagatactcgttagcttagtcctgggacccttgacctccgccgtgggttccgccaatggcgtaatgtacttttccagcctcgtcagttttctggggtgcctctacagctccctttttgttatttacgagatacctccaagcgacgctgcagacgaggaacaccggccacttctactgaacgtttag

SEQ ID NO: 241705 - DNA, 2247 bp, Artificial Sequence
  Description of Artificial Sequence: Synthetic coding sequence
atgattcctgccgcatcttcgacgccccctggggacgctctatttccatcagtcgccccacaagacttctggagatctcaggtgaccgggtatagtggcagcgttaccagacacctgtcacaccgcgcaaataacttcaaaagacaccctaaacgccgtaagtgcatcagacctagcccccctccccctccaaatacgccatgcccacttgaattggtggattttggggatttgcatccacagagatcattccgcgaactgctctttaacggttgcatactgtttggcatcgagttttcctatgctatggagacggcctacgtgactccggtgcttctgcagatggggcttcccgaccagttgtatagcctggtctggttcatctcacctattttggggtttctgctgcaacctctcttgggagcatggtccgaccgctgtacctcaagattcggtcgcaggcgccctttcatcctggtcctggccattggcgctctgttgggactcagcctgctgctcaacggcagagacattggcattgccttggcagacgtcactggcaaccacaagtgggggctcctactgactgtgtgcggcgtcgtgttgatggatttcagcgccgactcagcggataatcccagtcacgcgtatatgatggatgtgtgctctccagctgaccaggacagagggctgaacatccacgcactcctggctggcctgggcggtggcttcggctacgtggtcggcggtatacattgggataaaacagggttcggccgtgcacttgggggacagctccgggtcatttacctctttactgcagttactctcagcgttacaactgttctcaccttagtaagtattccagaaagacctctacgccctccaagtgaaaagcgagccgcaatgaagagcccatcgttgcctcttcctccatcaccccctgttctgcctgaagaagggcctggcgacagccttccatctcacacagcaactaacttttcatcacctatctcaccacccagtcctcttacacctaagtatggctcttttatatccagggattcttctctcaccgggatttctgaatttgcgagctccttcggaaccgcgaacattgattccgtcctaattgactgctttaccgggggacacgacagttatctcgctatccctggctccgtccccagaccaccaatttctgtatctttcccgcgagccccagatggattctatcggcaggatcgaggtttactcgaaggacgagaaggggctctcacaagcgggtgcgacggggacattttacgcgtcggtagcctcgataccagtaagccgaggagtagcgggatcttgaaacgcccacagaccctggcaatacctgacgctgccggaggcggaggccctgaaacgagccggcgacgtaacgtcaccttcagccaacaggtggctaacatccttctcaatggggtcaagtacgagtccgaactcactgggtcgtccgagcgtgcagagcaaccactgtccgtggggagactctgtagcaccatatgcaacatgccgaaagcactgaggacactttgtgtgaatcacttcctcggctggctgtcattcgaggggatgctgctcttctatacggactttatgggcgaggtcgtatttcagggcgaccccaaggcacctcacacaagtgaagcttatcagaagtataatagcggagtgactatgggttgttggggaatgtgcatttacgctttttcagccgctttttactcagcgattcttgagaaactggaggagtttctgtctgtccgcacactttactttattgcctacttagcctttggtttgggcacaggactcgccacactctctcgcaacctatacgtggtgttgagtctgtgcataacctatggaatcctgtttagcactctctgcacactgccttacagtttgctgtgtgattattaccagtctaaaaaattcgctggctcctcagccgatggtacacgacgaggcatgggcgttgatataagcctcctgtcctgtcagtacttcttagcccagattttggtgtctctggtgctgggccctctgacaagcgcagtgggcagcgcgaacggcgtcatgtacttttcttcattggtatcattcctgggctgcctgtacagctctcttttcgtcatttatgaaatccctccgtcagatgccgcagacgaggagcatcggccattgctcttgaatgtatag

SEQ ID NO: 241706 - DNA, 1593 bp, Artificial Sequence
  Description of Artificial Sequence: Synthetic coding sequence
atggggagcaattccgggcaggccggtcgtcacatttataagtcactcgccgatgacggcccttttgacagcgtagaaccccctaagcggcctacatccaggttgataatgcacagcatggcgatgtttggtcgggaattctgctatgcggtcgaagcggcttacgtgacccctgtgctcttaagtgtcggactgccatcgagcctgtattcgatcgtatggttcctgtcccctatcctggggtttctactgcagcccgtggttggtagcgcatctgaccactgtcgcagcagatggggacggcgtaggccctacatcttgaccctcggcgtcatgatgctcgttggcatggcactgtatttgaatggcgctactgtggtcgctgcacttattgcgaatccgagaagaaagttagtttgggcgatcagtgtcactatgatcggcgtcgttcttttcgactttgccgcagactttatcgatgggcctatcaaagcgtacctgtttgatgtgtgttctcaccaggacaaagagaaagggctgcactaccacgctctgtttactgggtttggcggtgctctggggtacttactcggagccatcgattgggcacacttagagctgggaaggctactgggaacagaatttcaggttatgttctttttctccgccctcgtactaacactgtgtttcacagtccacttgtgcagcatctcagaggctccattgaccgaggtggcaaagggcattcccccacaacagactccgcaagacccacctcttagctccgacggcatgtacgaatatggatctattgagaaagtcaagaatggctatgtgaatccagaactggcaatgcagggcgcaaagaataagaatcacgcagagcaaacccgccgagctatgactctgaagtcattgctgcgggctttggtgaatatgccaccccactaccggtacctctgtatttcacatctgatcggatggacagccttcttgtcaaacatgctattttttacagattttatgggacagatcgtgtacaggggagacccctactctgcgcataattctactgagttcctgatttatgaacgtggcgtggaggtcgggtgctggggtctgtgtattaattcagtgttctcatcactgtattcctacttccaaaaggtgctggtctcctacattggactcaaggggctgtactttaccgggtacctgctcttcggactgggtaccggatttattgggcttttcccaaacgtctattcgaccttagtgctgtgttcactttttggggtgatgtcctcaactctgtacacggttccattcaaccttatcaccgagtaccaccgggaagaggagaaggaacgccaacaggcccctggaggtgacccggacaacagtgtgcgaggaaaaggtatggattgtgcaacactgacttgcatggtgcagctggctcagattctagttggtggcggactgggatttctggtcaacactgccggtacagttgtagtggtcgtcataacagcttccgcagtagcgttgattgggtgttgcttcgtggctctattcgttcgctatgtcgattag

SEQ ID NO: 241707 - DNA, 1416 bp, Artificial Sequence
  Description of Artificial Sequence: Synthetic coding sequence
atgggctccaactccggacaggcgggaaggcacatttataagtccctcgctgacgatggccctttcgattccgtagagcctccaaagcgacctacctcaaggctaatcatgcactctatggccatgttcggccgtgaattctgctacgccgttgaggcagcctatgtgaccccagtgctcctgagcgtggggctaccttcaagcctgtactcaatagtgtggtttctcagtccgatcttggggtttcttcttcagccagtcgtcggttccgcctcagaccactgccggtctagatggggaagacgacggccttatatacttactctgggcgtcatgatgcttgtgggaatggccctgtatctaaacggggctacagtggtcgccggattcggcggtgccttggggtatctgctcggagcaatcgactgggcacatcttgagctgggaagactattggggacggagttccaagtgatgttctttttctccgccttggtcttgacgctgtgcttcacggtgcatctatgcagtatctccgaggcaccactgacagaggtcgcgaagggtatccccccacagcaaaccccccaagatcctcccctgagctcagatggaatgtacgagtacggttccatcgagaaggtgaaaaacgggtatgtgaaccccgagctggcaatgcagggtgcaaagaacaaaaatcacgcagagcaaacgcggcgagccatgaccctcaaaagtctactgcgagcgttggtgaacatgccgcctcattatcgctatctgtgcatcagccatctgatcggttggactgcttttctgtcaaacatgttgttctttaccgattttatggggcagatagtttataggggagatccttactccgctcacaatagtactgagttcctcatttatgagaggggggtggaggttgggtgttggggactgtgcatcaacagcgtgttttctagtttatattcatatttccagaaagtccttgtctcatacattggcctaaagggcctttattttactgggtatctgttattcggcctgggcaccgggtttataggactctttcctaatgtgtattctactttggttctttgctccctctttggagttatgtcctcaacactttacacagtgccctttaacttgatcactgagtatcatcgggaggaagaaaaagagagacaacaggctccgggtggggaccccgataattccgtcagaggcaagggaatggactgcgctacgttaacctgcatggtccaactggctcagattttagtcggcggaggactgggattccttgtgaacacagcagggactgtcgtggtagtggtcatcacggctagcgccgtcgcccttataggctgttgttttgtggcgctgttcgtgagatatgtggattag

SEQ ID NO: 241708 - DNA, 897 bp, Artificial Sequence
  Description of Artificial Sequence: Synthetic coding sequence
atgggatcgaacagtggtcaggcaggacgccacatctacaaaagtctcgccgatgatggaccatttgatagcgtggagcccccaaagcgaccaactagcaggcttattatgcatagtatggccatgtttgggagggaattttgttacgccgtggaagctgcatatgtgacccccgtgctgctcagcgtgggcctacctagtagcctatactcaattgtctggttcttaagtcctatcctggggtttcttttgcagccagttgtaggtagcgcttcggaccattgcaggtcccgctggggacgcagacgaccttacatcctgactctgggcgtcatgatgcttgttggcatggctctctatttgaatggggctaccgtcgtcgccgcattaattgccaacccacggagaaaactggtgtgggccatttctgtgacaatgattggagtcgtccttttcgactttgcagccgatttcatcgatgggcctatcaaggcctatctattcgatgtatgcagccaccaggacaaggaaaagggcctacattaccatgccctgtttacaggaactcgcagagcgatgaccttgaaaagtctgcttcgtgccctggtcaatatgccccctcactataggtatctttgcatcagtcatctgatcgggtggacagctttcctgtctaatatgctgtttttcactgactttatgggacagattgtgtataggggagacccttactcagcccacaattctactgagttcctgatctacgagcgcggtgtcgaggtggggtgctggggcttatgcatcaactcagtttttagcagtctctactcatgtaagtctttcagcctgctgagaatgtccagtaagagtttttggtctagcactacttggatctag

SEQ ID NO: 241709 - DNA, 1383 bp, Artificial Sequence
  Description of Artificial Sequence: Synthetic coding sequence
atgggaagcaattctggccaggctggtagacacatctataagagtttggccgatgatggcccattcgacagcgttgagccacctaagcgacctacaagccgattgattatgcactctatggctatgtttgggagagaattctgctatgctgtggaggccgcatatgtgacccccgtgctgctgagcgtcggcctgccttccagcctctattctatcgtctggtttctttctccaatcctggggttcctcttacagcccgtggtggggtccgcctcagatcattgccgtagcaggtggggcagaagacggccatatatcttaacactgggagtcatgatgctagttgggatggcactgtacctgaacggcgctactgttgtggcagcattaattgctaacccccgacgcaagctggtgtgggccattagtgttacaatgatcggcgtcgtactgtttgattttgccgcagatttcatcgatggcccaattaaagcatatcttttcgacgtgtgctcacaccaggataaggagaaagggctgcattatcacgccctgttcacaggatttggaggagctctgggatatctgcttggggctattgactgggcccacctggagctcggcagactactgggtacagagttccaggtaatgttctttttctccgcactcgtgctaacactgtgctttacggtacatctgtgctcaattagtgaggctccattaaccgaagtcgccaaagggatcccaccacagcagacccctcaggacccccctctgagcagcgacggaatgtacgagtacggatctatcgagaaggtgaagaatggctacgttaaccccgaactcgcgatgcagggcgcaaagaacaagaatcacgcggagcagactcgtcgggcaatgactctgaagtccctgctgagggctctggtcaacatgccccctcattacagatacctctgcattagtcacctgattggatggacagcgttcctcagcaacatgttgttcttcaccgattttatggggcagatagtttaccgcggtgacccatattccgctcataactcaaccgaattcctgatttacgagcggggtgtggaagttggctgttgggggttgtgtatcaatagtgtgttctcctcactctactcttattttcaaaaggtcctggtgtcatacatcggcttgaaaggactgtattttacggggtacctgttgtttgggctgggaaccggctttatcggactcttcccgaacgtctacagtacccttgtgctgtgctcactcttcggagttatgtcctctaccttgtataccgtcccgttcaatttgatcaccgagtaccatcgggaggaagaaaaggaagtctgctgccactag

SEQ ID NO: 241710 - DNA, 732 bp, Artificial Sequence
  Description of Artificial Sequence: Synthetic coding sequence
atgggttctaattcaggccaggcagggaggcacatctataaatccctggccgacgatggcccttttgacagcgtcgaaccacctaaaagacctacctcacgacttattatgcatagtatggcaatgttcggacgcgagttctgctatgccgttgaggctgcttatgtaactccggtactgttatccgtgggcctccctagctcattatactcaatagtctggttcttgtcgcctatcctgggatttctcttacagccagtagtgggctccgcctccgaccattgcaggtcccggtggggacgtagacgtccatacatactgactctcggcgtgatgatgcttgtcggtatggctctctacctcaatggagccaccgtggttgccgctctgatcgctaatccgcgtaggaagctcgtctgggcgatcagtgtaaccatgattggcgtggtgctgttcgattttgctgctgatttcattgacggacccataaaggcttacctctttgacgtctgttcacatcaagacaaggagaagggactccactatcacgctctgtttaccgattcacagggcaatgacatcaaggtcacagccgagtcaactggtgagcatgctagctctctccccctgccccttcaccaacctccgcactggatggatagtctccctgttcagcacgctgtattacacaggtttcacgggccagactgtgtcccaaggggctccctatag

SEQ ID NO: 241711 - DNA, 741 bp, Artificial Sequence
  Description of Artificial Sequence: Synthetic coding sequence
atggcgttgtacttaaacggggctacggtcgtcgccggatttggaggtgcactgggatacctgctcggtgctattgattgggcccacctggagcttgggcgactgctaggaacagaatttcaagtgatgttcttcttcagtgccctcgtgttgactctgtgcttcactgtgcatttgtgttcaattagcgaagcccctcttacagaagttgccaagggcatccctcctcaacagacccctcaggatcccccattgtcaagtgatggcatgtacgagtacggcagcatcgagaaagttaagaacgggtatgtgaaccctgagctcgctatgcagggagctaaaaacaaaaaccatgctgagcagacccggagagccatgactctaaagagtttattgagagccctggtcaacatgccaccccactataggtatttatgcatttcacatttgatcgggtggaccgcctttctctccaatatgctctttttcaccgactttatgggccagatcgtctacaggggcgacccttattccgcacataattctactgagttcttgatatatgagcgaggcgtggaggtggggtgctggggattgtgcatcaactctgtatttagtagcctctattcttatttccaaaaggtcctagttagctatattggtctgaaggggctttatttcaccggatacctcctgttcggcctcggcactgggtttataggcctattccccaacgtgtag

SEQ ID NO: 241712 - DNA, 1662 bp, Artificial Sequence
  Description of Artificial Sequence: Synthetic coding sequence
atggtgcaaagactctgggtttctcggctgctgaggcacagaaaggcgcagctattgttggtgaatcttctcacctttggtctcgaagtttgcctggccgctggcattacctatgtcccccctctgctcttagaggttggcgtggaggagaaatttatgacgatggtgctgggcattggtcccgtcctcggactagtctgcgtgcccctcttggggagtgcgtctgaccattggagaggccgttatggccgtcgcagaccctttatttgggcactgtcacttggcatcctcctgtccctgtttctgatcccccgtgctggatggctggctggccttctgtgccccgatcccagacctctggaactggccttgttaattttaggtgtcggcctgctggatttttgcggacaagtgtgttttacacccctcgaagccctgctctctgatttgtttagggatccagaccactgtagacaggcttacagcgtctatgccttcatgatctccctcggaggttgcttaggttatctgctcccagctattgactgggatacttcagcattggctccctacctcggtacccaggaggaatgtctcttcggcctactcacacttattttcttaacgtgtgttgcagcaacgttgctcgtggccgaggaagcagctctaggacccaccgagcctgctgagggcctgtctgccccatctctgtcaccccattgctgtccttgccgcgcacggttggcatttcgtaacctgggggctctgctgcctcgcctgcatcagctttgttgcaggatgccgaggactctgaggcgattgttcgtcgccgagttatgctcatggatggcactaatgacctttactcttttctatacggactttgtcggagaggggctgtatcagggcgtaccacgggctgagcccggaaccgaggctcgacggcattacgatgaaggtgtgcgcatggggagcctggggctttttctgcagtgtgcaatcagcctggtattttcattagtgatggataggttggtgcagaggttcggtacacgtgctgtatatctggcatctgttgccgcttttccggtcgctgccggagcaacatgcctgtcccacagcgtggcagtggttacagcatcagccgctcttactggcttcaccttttcagctctccagatcttgccttataccctggccagcttgtaccacagggaaaaacaggtgtttctgcctaagtatcggggagatacagggggagcttcttcagaagacagcctgatgacctcattcttgcccggaccgaagccgggagctcccttccctaatggccatgttggagctggaggctcaggcctcttgcctcctccccctgctctctgcggcgcatccgcatgcgacgtgtcagttagggtggtcgttggagagccaaccgaagctagagttgtccccggaagagggatttgccttgacctggctatcctcgactctgcgtttctgcttagccaggtggcaccctccctgtttatgggaagtattgtgcagctctcccaatccgtgaccgcatatatggtgtctgcggctggtctcggcctagtggctatttacttcgccacccaggtcgtgttcgacaaatcggaccttgccaagtacagtgcctag

SEQ ID NO: 241713 - DNA, 1293 bp, Artificial Sequence
  Description of Artificial Sequence: Synthetic coding sequence
atggaaggatcagcatctccccctgaaaaaccacgcgctagaccagcagccgctgtattgtgccgaggcccagtggagcccttggtgtttctggctaacttcgccctggtgttacaaggcccactgacaacccaatacctttggcataggttcagcgcggaccttggctacaatggaactcgccagcgaggaggctgcagcaatagatctgcagaccctacaatgcaggaagtggagacgctgaccagccactggactctgtacatgaatgtgggaggcttcctcgttggccttttttctagtaccctgctcggcgcatggagcgattcagttggcagacggccactgctggtgctggccagcttaggcttgttgctccaggcccttgtgtccgtattcgtagtgcaattgcagctccacgttggctactttgttttgggccgaatcctatgcgccctcctgggtgattttggaggactcctggcagcctcattcgcgagtgttgctgacgtctcgtcttccaggtcccggacttttagaatggcgctcctggaggcctctattggggttgcaggcatgttggcctccctcctggggggacactggttgagagcacaggggtacgccaatccgttttggctcgctctcgctctgctgatcgctatgactttgtacgctgccttttgctttggcgagacgctgaaagaaccaaagtccacaagactgtttactttcaggcatcatcgctccatcgttcagctatatgtagcacccgctcccgagaagtcccggaaacatctcgcactatattcccttgctatcttcgttgtgatcaccgtgcactttggagcacaagacatacttactttatatgagctgagcacacctctgtgctgggattctaagctgatcggttatggtagcgctgctcagcatctgccctatctaacttctctcctcgctctgaaactcctccaatactgtcttgccgacgcttgggtggcggaaatcggtctggcctttaatatcctcggcatggtagtttttgctttcgccaccatcacgcccctgatgttcacaggggctctttttagtgccgtggcatgtgtgaattctcttgcaatgttgaccgcctcaggttttaatagcctgtacccagccacactcaactttatgaaggggttcccatttttacttggagccggactcctgctgatcccagcagtgctgatcggaatgctggaaaaggccgatcctcacctagagttccaacagttcccacagagcccttag

SEQ ID NO: 241714 - DNA, 1380 bp, Artificial Sequence
  Description of Artificial Sequence: Synthetic coding sequence
atggagggctctgcctcgccccctgagaagcccagagcccgtcccgctgcggcagtgctgtgtcggggacccgttgaacccctagtgtttttagccaacttcgcattggttcttcaggggcctttgacgacacaatatctttggcatcgctttagcgctgacctggggtacaatgggacaaggcagcgaggagggtgctccaataggtctgcagaccctaccatgcaggaggttgagactcttacatcccattggaccttatacatgaacgtcggtgggtttctggttgggctgtttagcagtaccttgctgggtgcctggtcagattccgtaggaaggcgcccactgctggtgctggcctccctgggactactccttcaggctctggtctccgttttcgtggtgcaactgcagctgcacgtggggtacttcgtactggggcgaattttgtgtgctctcttgggtgattttggagggctactggccgcttccttcgcgagtgtggctgatgtcagttcgtcgcggtctagaacttttcgtatggcgctgcttgaggcatctataggagtggcagggatgttagcctcgttacttggtggccactggctgagggcccagggctatgccaatcctttttggttagccctcgcactattgattgcaatgactctttacgccgctttctgctttggggagacacttaaggaacctaagtctacgagactgtttacgtttcgccatcataggagtattgtgcagctgtatgtcgctcccgcacccgagaaatctaggaagcacctcgccctctacagcctggccatttttgtggtcattactgtccatttcggggcacaagacattctgactctgtatgagcttagcacacccttgtgctgggactctaagcttatcggctacggatccgccgcacagcacttgccttacttaacatcgctgctggcattaaagttgttgcagtattgcctggctgacgcttgggtcgcagagatcgggctggcctttaacatactggggatggttgtgtttgccttcgcaactattactccgctgatgtttaccgggtatgggctcttatttctaagtttagtaataacccccgtgatcagggctaagctgagcaaactggtgcgggagactgagcagggcgcactgttctcagccgtcgcgtgcgtcaacagcctagctatgctgaccgcgtcaggcatcttcaattctctttaccccgctaccttgaacttcatgaagggcttccctttccttttgggcgcaggattgttgttgattcctgccgtacttatcggaatgctcgaaaaagcggatccccatctggagtttcagcagttcccacaatccccatag

SEQ ID NO: 241715 - DNA, 1428 bp, Artificial Sequence
  Description of Artificial Sequence: Synthetic coding sequence
atgtcgcccgaggtgacgtgtccgcgacgaggacatctgccacgctttcaccccagaacctgggtcgagccagtcgtcgccagttctcaggtggcagcatctttatatgacgctgggcttcttctcgtggttaaagcatcatatggaactggcggatcgagtaaccattctgccagtccatcacctagaggggcactggaagaccagcagcagcgtgccatttctaacttctacattatctataacctagtggtgggactctccccccttctcagcgcgtatggcctgggctggctcagtgaccgttatcaccggaagattagcatttgcatgtcgttgctcggattcctgctaagtcggcttggcctgctcctcaaagtcttattggattggcccgtcgaagtgttgtacggggcagcggctttaaatggcttgtttggcggtttcagcgccttctggagcggcgtcatggccctcggcagtctcgggtcctccgaaggcaggagatccgtcagactcatcctaatcgacttaatgctaggcctggcaggcttttgtgggtctatggcctccggacacctgtttaaacaaatggccggacactctggccagggcctaatcctgaccgcctgttccgtatcgtgcgcttcgtttgccctgctctattcactattagtacttaaggtaccggaatcagtagccaagccgtcccaggaacttccggctgtggacacggtctcaggcacagtcgggacttaccgcactcttgatccagatcaactcgaccagcagtatgcggtcgggcacccaccatcacccggaaaagccaaaccacataagaccaccattgccttgctgttcgttggcgctatcatctacgacctcgcggtcgtcgggactgtagacgtgatcccgctgttcgtcttaagagaacccctgggctggaatcaagtccaagtggggtatggcatggcagcaggctataccattttcatcacctcttttctcggtgtgttggtgttctccaggtgcttcagggacaccacgatgatcatgattgggatggtctcattcggtagtggggctctgttgctggcttttgtcaaggaaacctacatgttctatatcgccagagccgtgatgcttttcgccctgatccctgtgacaaccatccgttccgccatgagcaaactcatcaaggggtccagttatggcaaagttttcgtcatattgcagctgtcccttgccctcacaggggtcgtcacctctacactgtataacaaaatctaccaactgaccatggacatgtttgtggggagctgcttcgccctgagctcatttctcagttttctggctatcatcccgatctccatagttgcatataaacaagttcccctgtctccttacggcgatattattgagaagtag

SEQ ID NO: 241716 - DNA, 1713 bp, Artificial Sequence
  Description of Artificial Sequence: Synthetic coding sequence
atggaagcccctgaggaacccgctcctgtgcgcggaggcccagaggccaccctagaggtccgtgggagcaggtgcctgcgcttgtcagctttcagggaggagttgcgagcacttctcgtgctagcaggcccagcattcttagtgcaactgatggtgtttctgattagtttcatttcaagtgttttttgcggccatttggggaagctggagctggatgcggtaaccctcgctatcgcggttatcaatgttacaggagtttctgtgggattcggcctgtcaagtgcctgtgataccctgatatcccagacctacgggagccaaaatctgaagcacgttggagtgatccttcagcgctcagcactcgtgctgctgctgtgctgctttccgtgttgggccctgtttctgaacacgcagcacatcctgctgctatttcggcaagaccccgatgtctcacggctaacacaaacgtacgttaccattttcattccggcactgcccgcaacttttctgtatatgctccaggtgaaatatctcctaaatcagggcatagtgctgccccagatcgtaacaggcgtggctgcaaacctggttaatgcgctggcgaattacctctttcttcatcaacttcatctgggcgtgatcgggagtgctctagctaatctgataagtcagtacacactagccctgttacttttcctgtacatccttggcaaaaagctgcaccaggcaacatggggcggttggtcgctcgaatgtttgcaggattgggctagcttcctgagacttgctatccccagcatgttaatgctgtgcatggaatggtgggcctacgaagtgggcagcttcttaagcggcatcctgggaatggtcgagctcggcgcacagtcaatcgtctacgaactggctattatcgtctacatggtccctgctgggttctccgtcgccgcttcggtcagagtaggaaacgctttaggggcaggcgatatggaacaagcaagaaaatcctcgacggtgtcccttttgattaccgtgctctttgccgtggcattctccgtacttcttctaagttgtaaggatcatgtcggttacatattcacgactgatagggatattataaatctagtggcacaggtcgtgccgatatatgctgtgtcccacctgtttgaggcccttgcttgtacaagcgggggtgtgctgcgcggtagtgggaaccaaaaggtcggcgctattgtgaataccattggctactacgttgttgggctgccaatcggaattgcgctgatgtttgcaacgactctgggagtcatgggattatggtctggaataattatatgtactgtgtttcaagcagtgtgcttccttggctttattatccagctaaactggaaaaaagcatgccagcaggctcaggtgcacgccaacttgaaggttaacaacgtcccaagatctggtaattccgcccttccacaggaccctttgcaccccggttgtcccgagaacctggaaggaatcctcaccaatgatgtcggcaaaaccggagaacctcagagcgaccaacagatgcgtcaagaagagcccctgcctgagcatccgcaggacggggcaaagctttccagaaagcaactcgttcttcggagaggcctgctgctgctgggagtgtttttgattctgttggttggtatcttggtccgcttctacgtccggattcagtag

SEQ ID NO: 241717 - DNA, 1761 bp, Artificial Sequence
  Description of Artificial Sequence: Synthetic coding sequence
atggaagctcccgaggagcctgccccagtccgcggagggccagaagccaccctggaggtgcgcggtagcaggtgcctccgacttagcgctttcagggaagagctgcgtgccttacttgtgctggccggacctgcattccttgtgcagttgatggtgtttctcattagctttatctcctcagtgttttgcgggcacttgggaaaactggagttggatgccgttacattagccatcgccgtgattaatgtgacgggcgtcagtgtgggcttcggcctgtcgagcgcttgtgacacgctaatttcccaaacctacggatcgcagaacctgaagcacgtcggggtgattttgcaaagaagtgccctcgtcctgctattgtgctgcttcccctgttgggccctgtttcttaacactcagcacattctactgctctttagacaggatccagatgtgagtaggctcacccaaacttacgttacgatctttatccctgccctgccagccactttcctgtacatgctacaggttaagtatctcttgaaccaggggatcgtcctgccacagatcgtcactggcgtcgcagccaaccttgtgaacgcgctggccaactacctgtttctgcaccaacttcaccttggggtaattggctctgccctggctaacctcatttctcagtacacgctggccctgctgctgttcttgtacatcctgggaaaaaagctccatcaggcaacttggggcggatggagtctcgagtgcctgcaggattgggcatcgttcctgcggctggccatcccttcaatgctgatgctatgcatggagtggtgggcttatgaggtcgggtccttcctcagtggaatccttggcatggtagaattgggggctcagtcaattgtatacgagcttgctataattgtctacatggtgccagccggtttttctgtcgctgcatccgtgcgggttggcaacgcactgggggctggggatatggagcaggcaagaaagtcttcaacagtgagtttactgattaccgtcttgttcgccgtagctttcagcgtcttgttgctaagctgcaaagaccacgttggttacatcttcactactgatcgagatataataaatctagttgctcaggtggtcccgatttatgccgtcagccatcttttcgaagccttggcctgcacatccgggggagtgttacggggaagcggcaatcaaaaagtgggagctattgtgaatactattgggtactacgttgtaggcctgcctatcggaatagccctgatgtttgccacgacactcggagtaatggggctgtggtccgggatcataatttgtaccgtcttccaggctgtctgctttcttggatttatcattcagctgaactggaaaaaagcttgccagcaggcccaggttcacgccaacctaaaggttaacaatgtgcctcgttccggaaattcagccctgccccaggatcccctccatccgggatgccccgagaacctggaggggattctaacaaacgatgtcgggaagacaggagagcctcagtctgaccaacaaatgcgacaggaagagccccttccagagcacccacaggatggggctaaactgtctcgcaagcagctggtgttaagaagggggctgctcctgctcggagttttcctcatactgttagcaggggttagatggtgtgaccactcctctctgcagcctagaacactgggcctccaggcaatcttactatgccagccccctgagtag

SEQ ID NO: 241718 - DNA, 849 bp, Artificial Sequence
  Description of Artificial Sequence: Synthetic coding sequence
atggtcgagctaggtgcccagtcgattgtgtacgagctcgccatcatagtttacatggttcctgccggtttttctgttgctgcatccgtgcgggtaggcaatgcactcggtgctggtgacatggagcaggccaggaagagctccaccgtctctcttcttattaccgtgctgttcgccgtggcattttccgtgcttctactgtcctgtaaggaccatgtaggttatatctttacaactgaccgggatattatcaacctcgtggcccaggtagtaccaatttatgctgtctcccacctgttcgaagccttagcttgcacctctggcggtgtgctcaggggctcagggaaccaaaaggtcggtgcaattgtgaatactattggttattatgtcgttggtcttcccataggcattgcgctgatgttcgccaccacactgggcgttatgggcttgtggtcaggtattatcatctgcaccgtttttcaggctgtgtgcttcctaggctttattatccaactcaattggaaaaaggcatgccaacaggcccaagtccacgctaaccttaaagtgaataatgtcccacgaagtggcaattctgcgctgccccaggaccccctacacccaggatgcccggaaaatctggagggtatcttaaccaacgatgtcgggaagactggggagccccagtctgatcagcagatgagacaggaagagcccttaccagaacatccccaggatggtgcaaagctttcacggaagcaactcgtcctgcgtaggggcctactcttgctgggggtgtttctgatcctactagtcggaattctcgtgcgattttatgtgcgcattcaatag

SEQ ID NO: 241719 - DNA, 1332 bp, Artificial Sequence
  Description of Artificial Sequence: Synthetic coding sequence
atggaggcccctgaagaacctgctccagtgagaggtggtcccgaggcaaccttggaggtgcggggaagccggtgcctccgactgtctgcattcagagaagagcttagagccttactcgtgttggcgggtcctgcctttctagtccagctgatggtgttcttgatctcattcatcagcagcgttttctgcggacaccttgggaagctggagctggacgccgtgaccttggcaattgccacatacgggagccaaaacctcaaacacgtgggggtgattctgcaaagatcggcactcgtgttgttgctgtgctgcttcccttgctgggcactctttctgaatacacagcacattttattgttattccgccaagacccggatgtaagcaggctcacacagacctacgtgaccatatttatccccgcattgcctgctacctttctctacatgctccaggtaaaatatcttttgaatcagggcatcgtcctgcctcagatagtcacaggcgtggccgcaaacctggtaaatgccttggctaattacttatttttacaccagttacatttgggggtgattggatcagccctcgcgaacctgatctctcaatataccttagcgctgctgctgtttctgtacattttgggtaagaagctgcaccaagccacatggggcggatggtcattggagtgtctgcaggactgggcctctttcttacgattagccatacccagcatgcttatgctgtgcatggaatggtgggcgtacgaagtgggctcttttctgagcggaattctcggtatggtagaacttggcgctcaaagtattgtctatgagctggctattatcgtttacatggtcccagcgggattcagcgtcgccgctagtgtccgcgtgggtaacgcactgggagcaggagacatggagcaggccaggaagagtagcaccgtatccctcctgattacagtgctgttcgctgtagcattctctgtgctgctcctgagttgtaaagatcacgtgggttatatatttaccaccgatagagatatcatcaacctggtggcacaggttgtgccaatatatgcagtcagccacctgttcgaggcccttgcttgtactagtggcggagttctcaggggctccggcaaccagaaggtgggggcaatcgtaaatactatcggctactatgtggttggtctgcccatcggcattgctctgatgttcgccaccaccctgggcgtgatggggtccgggacacgccagtttgagtcaaagcagcgcgcaagcgaatgggagttttgttccccctcgggctctgctagcccccgtgtaccctag

SEQ ID NO: 241720 - DNA, 738 bp, Artificial Sequence
  Description of Artificial Sequence: Synthetic coding sequence
atgctcatgctgtgcatggagtggtgggcttatgaagtcggctcattcctgagcggtatactggggatggtcgagcttggggctcaatccatcgtgtacgaattagctatcatagtatacatggttccggctggtttctccgtcgcagcttctgtcagggtcggaaatgctttaggcgcaggcgacatggagcaggcgaggaaatcttctactgtaagtcttttgattaccgtgctgtttgccgtggcattttcagtgcttcttctctcctgcaaggaccatgtgggttacatctttacaacggacagagatatcattaatcttgtcgcccaagtggtgcccatttacgcagtgtcccacctgtttgaagccctggcatgtacaagcggcggtgttcttcggggatcagggaatcaaaaagttggcgctatcgttaatacaattggctactatgtcgtcggcctaccaatcgggatagcactgatgtttgcgacgacactcggtgtcatggggtgccctgagaatctggaggggatcttaaccaatgatgtgggaaaaactggggagccccagtctgatcagcagatgaggcaggaagaacccctgccagaacaccctcaggatggcgcaaagttgtcacggaaacaattggtgctaagacggggactcttgctgcttggcgttttcctcatcctgttggtcggaattctggtgcggttctacgtaaggatccagtag

SEQ ID NO: 241721 - DNA, 1761 bp, Artificial Sequence
  Description of Artificial Sequence: Synthetic coding sequence
atggaggccccagaagaacctgctcccgtccggggaggaccagaagccactcttgaggtgcgtgggtctaggtgtttacgtctgtccgcattcagggaggagttgcgagctctgctagtgctggccggacccgctttccttgtgcagctcatggtctttctaatctcattcattagcagtgttttttgcggccacctgggcaaactcgagctcgatgcggtgactttggctatcgccgtgatcaacgtaactggggtttccgtgggctttggattgtctagtgcatgcgacacgctaatcagtcagacttacgggtcccagaatttaaagcacgtgggcgtgattcttcagaggagcgcgcttgtgctcttattatgttgctttccttgttgggcgctctttttgaacacccagcacatattgttattgtttcgacaggaccccgacgtctcccgccttacccagacttatgtgacaatcttcatcccagccctaccggcaacatttctgtacatgctgcaggtgaaatacctactcaaccagggaatcgtgttaccccagatcgtgaccggggtcgcagcgaatctggtgaatgctttggcaaattatctcttcctgcatcagttacatttgggagtcatcggaagcgctctagccaacctgatatctcaatatacgttagctctgttgttgtttctctacatcctgggcaagaaacttcaccaagcaacctggggagggtggagtctggagtgcctgcaggattgggcctcttttctccggctcgctattccttctatgctgatgctatgcatggaatggtgggcttatgaggtgggtagctttctgagtggtattcttggcatggtggagctgggtgcccaatccatcgtgtatgagctggccattatcgtctatatggtgcccgctggcttttccgtcgccgcttcagttcgcgttgggaacgcattgggcgctggtgacatggagcaagccaggaagtcgagtactgtaagcctgctcatcactgtcctgttcgctgtggcctttagcgtgctcttgctgtcctgcaaggatcacgtaggttatattttcactaccgaccgggatattattaacctcgtggcccaggtagtgccaatctacgcagtgagccacctttttgaggccctggcatgtacaagcgggggagtcttgagaggctcggggaaccaaaaagtgggcgcaatcgtcaacaccatcgggtattacgttgtcgggctgcctatcggaatcgccctgatgttcgcaactaccctgggcgtgatggggctgtggtccgggatcattatctgtactgtcttccaggctgtctgctttctgggcttcattatacagttaaactggaagaaggcttgtcagcaggctcaggttcatgcgaatctgaaggtgaataacgttcctcggagcggcaatagcgcattgccgcaagatcctctgcaccccggttgtcccgagaatctagaggggattctgacaaatgatgtgggaaagaccggggaaccacagagtgatcagcagatgaggcaggaggagcctcttccagagcacccacaagatggggcaaagctgtcccggaaacagctcgtgcttcggagaggattgctattgctcggtgtgttcctgatcttactggctggcgtacggtggtgtgatcacagctcgctgcagcctcgcaccctggggctgcaggccattcttctgtgtcagcccccagagtag

SEQ ID NO: 241722 - DNA, 735 bp, Artificial Sequence
  Description of Artificial Sequence: Synthetic coding sequence
atggaggcacccgaggagccagcgcctgtgcgtgggggacccgaggcaacgctcgaagtgcgtggctcccgatgcctgcggttaagcgcatttagagaggagctgcgtgcgctcctggtcttggctggtcctgctttcctggtacagctgatggtgttcctaatttcctttatctccagcgtattctgtggccacctgggtaagctcgagttggatgcagtcacgctggccatcgcagtgatcaacgttaccggagtcagcgtgggatttgggctcagcagcgcctgcgacactttgatatctcagacctacggctcacaaaatctgaaacacgtgggagtcatcttgcaaaggtctgccctcgttctgttactgtgttgcttcccttgctgggcgctgtttctaaacacacaacacatcctgctgctctttcggcaggaccccgatgtttctaggcttacccagacttatgtgaccatatttattccggctttaccagctacattcctgtacatgctacaggtgaagtatctactcaaccagcggctctgcaccggcaaattagatttccctgtccacccaggctcgacgcctctctctcttcatccaagggagaagactgcctccagctacatgggcaggctcgtgcccagagtgcctgcgggactcggcctgctgcccccaccaggacaccctcagcacgcccacgcggttcacggagttgttggcctttag

SEQ ID NO: 241723 - DNA, 1809 bp, Artificial Sequence
  Description of Artificial Sequence: Synthetic coding sequence
atggactccctacaggacactgtcgctctggaccacggaggctgttgtccggcattgagtcgactggttcctcggggattcggtacagagatgtggacactctttgctctgtccggcccattgtttttgtttcaggtgctaacctttatgatttatattgtcagtaccgtgttctgcggtcacctggggaaggtggagctggcttccgtcaccttagcagtcgcattcgtaaatgtctgcggagtgagtgtcggcgtgggcctgagtagtgcatgcgatacactcatgtcccagtcctttgggtctcctaataagaaacacgttggtgtaatcctacaaagaggggcactagtgctgctgctctgttgcttaccctgctgggctctattcctgaatacccagcatatcctcctgctctttcgacaagaccctgacgtgagtcgcctgactcaagactacgtgatgattttcatcccgggtctcccagttattttcttgtacaatttgctcgccaagtacctgcaaaatcaaggctggctgaagggtcaggaggaggaatcgccctttcagacaccgggactgtccattctgcacccgtcgcattcccatctgtctagagcaagttttcacttgttccagaagataacctggcctcaggtactcagcggggtggtcggcaattgcgtcaatggggtcgctaactacgcgctcgtatctgttctgaatctgggcgtccggggaagcgcctacgcgaacataataagtcaattcgcacaaactgtatttctgttgttatatatagtcctgaagaaactgcatctagagacttgggctgggtggagctcccaatgcctgcaagattggggaccctttttttcactggccgtcccatctatgctcatgatctgcgtggaatggtgggcgtatgaaatagggtcgttcttgatgggcctgctgagtgtagtggatctgagcgcccaagccgtgatctatgaggtcgcaaccgtgacgtacatgatcccgctcgggcttagtattggcgtatgtgtgagagtcgggatggccctgggcgctgcagatactgtgcaggcaaagcgctccgccgtaagtggagttctttccattgtggggatctcactagtgctaggcacactgatctctatcttaaagaaccagttaggtcacattttcacaaacgatgaagacgttatcgccctagtaagccaggttctgccagtatacagcgtgttccacgtgttcgaggcaatctgttgtgtgtatgggggagtgctgcgtgggaccggaaagcaggcattcggcgcagctgtaaacgcgattacctattacataattggacttccacttggcattctcctcacgtttgtcgtcagaatgcgaatcatgggattgtggctgggcatgttagcctgtgtatttctggctaccgctgccttcgtcgcttataccgcaagattggattggaagctcgctgctgaagaggcaaaaaagcatagtggccgtcagcagcagcagcgagctgagtcaaccgccacacggcctggacctgagaaggccgtgttaagtagtgtggccacaggcagttcgcctggcattacactcacaacctactcacgcagtgagtgtcatgtggatttttttcggactcccgaggaggcacacgcactttctgcccctacatcccggttatctgtgaagcaactggtgatccgacgcggagccgcactgggggcagcgtctgcgaccctgatggtgggcctgacagtgcgcatactagcaacacggcattag

SEQ ID NO: 241724 - DNA, 1743 bp, Artificial Sequence
  Description of Artificial Sequence: Synthetic coding sequence
atggatagcctacaggacaccgtggcattggatcatggagggtgttgccccgcactgagccgcctcgtgcctcggggttttggcaccgaaatgtggaccctgtttgccctgtcagggcctttgttcctgtttcaggtgttgacgttcatgatttatattgtcagcacggtcttttgtggacatctgggcaaagtcgaactggctagtgtgactctggccgtggccttcgtaaatgtttgcggagtcagtgtgggcgtgggactgtcatccgcttgtgacaccctgatgagccagtcttttggtagccccaacaaaaagcacgttggcgtgattttgcaacggggtgccctagtgttgttactgtgctgtctgccgtgctgggcactgttcctgaatactcaacacattttactgctattccgccaagaccccgatgtgtctaggctgacacaggactatgttatgatctttatcccaggactacccgtgatcttcctgtacaacctcctggctaaatacctgcagaaccagaagattacttggccccaggttctttctggcgttgtcggcaactgcgtgaatggagtcgccaactatgctctggtgagcgtactgaacctgggggtgagaggcagcgcttatgctaatatcatttcccagttcgctcagactgtgtttctgctactttacattgttctgaagaaactccacttggaaacctgggccggatggtcttcgcaatgcctccaggactgggggccttttttctctctagccgttcctagcatgctgatgatatgcgtcgagtggtgggcttatgagataggaagcttcctgatgggcctgctgagcgttgtggacctgtcagcgcaagcagtcatttatgaggtggcaacagtaacatatatgaggcactcccacaggctggcgtacgccgctcacgtcacccgaattcccttaggcttgtccattggcgtatgcgtcagggttgggatggctcttggcgcagcggataccgtgcaggcaaagcgttcagccgtgagcggggtgttgagtatcgtaggaatctccttggttttgggcaccctgatttccatcctgaagaaccagctgggccacatctttaccaacgatgaggacgtaatagcactagtttcccaggtgctgcccgtgtactccgtcttccatgtctttgaagccatctgctgcgtgtacgggggagtgcttaggggaactgggaagcaggcttttggggctgccgttaacgcgatcacctactatataattggtttgccgttgggcatcctgctgacttttgtggtacggatgcgcatcatgggactttggttgggcatgttagcatgcgtctttctcgccacagctgcgttcgtggcctatactgctaggttagactggaaattggccgctgaagaagcaaagaagcactcaggtaggcagcagcagcagcgtgccgagtctacagccactagacctgggcctgaaaaggccgtcctgtcttccgtggctaccgggagcagtccaggcatcaccttgacaacctattcacggagtgagtgccatgtggacttttttaggactcccgaggaagcacatgcgttaagcgcccctaccagtagactctccgttaagcagcttgtgatcaggaggggggctgcattgggcgcagcaagcgctactcttatggtgggcctgacagttcgcatcttggccactcgccactag

SEQ ID NO: 241725 - DNA, 1092 bp, Artificial Sequence
  Description of Artificial Sequence: Synthetic coding sequence
atggactcgctccaggacacagtcgccctggaccatggaggctgctgtcccgctctgtctcgtctcgtccccaggggcttcggcaccgagatgtggaccttgtttgcactgtcaggcccactgttcctattccaggttcttacgttcatgatttatatcgtatccacagtgttctgtggccatctgggcaaggtcgagcttgcgtccgtaactttggcggtagcctttgtgaacgtctgtggagtatcagtcggagtgggcctgagctccgcctgcgatacacttatgagccagagcttcggctcccccaataagaagcacgttggagtcattctgcagcgaggcgcactcgtgctcctcttgtgttgtttgccctgctgggccttgttcctaaacacgcagcacatcttgctgctgtttcgacaggacccagacgtttcccgactgacacaggattatgtgatgatctttattccaggacttcctgtgatctttctttacaatctcctcgccaaatatctgcagaatcagaaaatcacatggccacaggtcttgtcaggagttgtcggtaactgtgttaatggggtagctaattatgcattggtgagcgtgctgaacctgggcgttaggggttcagcatatgctaacattatctctcagttcgcacagaccgttttcctactcttatacatcgtgttaaagaagcttcacttagaaacttgggccggatggagcagccagtgcctgcaagactggggcccattcttttcactcgccgtgccttcgatgctgatgatatgtgtggagtggtgggcgtatgagattggatcgtttttgatgggactgttgagtgtggtggatttgtcagcacaggccgtgatctatgaagtggctaccgtcacatacatgattcctttaggactgagcataggagtttgcgttagggtcggcatggctctaggcgcagccgacacggtccaagcaaaacgctccgcagtgagtggagtgctcagcattgtcgggatttcattggtgcttgggacccttatttcaatcctgaagaaccagcttgggcacattttcactaattag

SEQ ID NO: 241726 - DNA, 891 bp, Artificial Sequence
  Description of Artificial Sequence: Synthetic coding sequence
atgatctacattgtcagtacagtgttttgtgggcatctgggtaaggttgagcttgcttccgtcacactcgccgtggcatttgtcaatgtctgcggggtctcagtcggggttgggctctcttccgcatgtgacactcttatgagtcagagttttggcagcccgaacaaaaaacatgtaggcgtcattctgcagagaggcgcactggtcctcctgctgtgctgcctgccgtgttgggctcttttcttaaacacgcagcatatcctgctgctgtttaggcaagacccggatgtcagcaggctgactcaggactacgtcatgatttttattccaggattgccggtcatttttctctacaacctgttagctaagtatctgcagaaccagaagatcacatggcctcaagttctcagtggcgtggtcggcaactgtgttaatggagtcgccaattacgcactggtttccgttttgaatttgggagtgcgcggtagcgcatatgcaaacattatatcccagttcgctcaaactgtgtttcttctcctgtacatagtgctgaaaaaacttcatctagagacatgggctggatggtcttctcagtgcctgcaagattgggggccatttttctcgctggctgtgccttcaatgctgatgatttgcgtagagtggtgggcttatgaaatcggttcatttcttatgggcctactgagcgtagtagacctgtcagcgcaagcggtgatttatgaagtagccacagtaacctacatgatccccctcgggctgagtatcggggtttgtgtgcgggttggcatggccctcggggctgcggacacagtccaagcaaagcgatcagctgtatcgggcgtactcagtatcgcaagaagcgatccttggtag

SEQ ID NO: 241727 - DNA, 531 bp, Artificial Sequence
  Description of Artificial Sequence: Synthetic coding sequence
atgaaggcgagcggtaccttgcgagagtacaaagtcgtggggcgatgcctccccactcccaaatgccacacccccccactataccggatgagaatctttgcccctaatcacgtcgttgccaagagtaggttctggtactttgtgtcgcaactgaagaaaatgaaaaagtcctcaggagaaattgtgtattgtggccaggtgttcgagaaaagccccctgcgggtgaaaaatttcggtatctggctgcgctatgattccaggtcggggacccacaatatgtaccgcgaatatagagacctgactacagcaggtgcagttactcagtgctatagggatatgggagctcgacaccgagcacgggctcactccatacagattatgaaagtagaagagattgccgctagcaagtgcagacggcctgctgtgaagcaatttcacgacagcaaaataaagttccccttgccacatcgggtccttcggagacaacacaagccgagattcaccaccaagagacctaacacctttttctag

SEQ ID NO: 241728 - DNA, 1995 bp, Artificial Sequence
  Description of Artificial Sequence: Synthetic coding sequence
atggactcatcaacttggagccctaagacgacagcagtgacccgccctgtggaaacgcatgaactcattcgcaatgcggcagacatctctattattgtgatttactttgtggtagtcatggcggtaggcctgtgggccatgtttagcactaaccgcggaacagtcggaggattctttctggccggaaggagtatggtgtggtggcctataggcgcaagtctgtttgcttcaaacataggtagcggccatttcgtgggactagccggaaccggggctgcaagcggaattgctataggagggttcgaatggaacgccctcgtgttagttgtggttctcgggtggctgttcgttcctatttacatcaaagccggagtcgttaccatgcccgaatacctgcgcaaacggtttggcggtcagcggattcaggtgtatctgtctcttctcagcttgttgttatacatttttaccaaaatctctgctgatatctttagtggggctatctttattaatctggccctgggacttaatctttatttagcaatctttctgttgcttgccattacagctctttataccatcacaggcggactggctgcggtaatctacaccgatacgctacagaccgtgataatgctggtagggagcctaatcctcactggcttcgctttccacgaggttggaggatacgacgcctttatggagaagtatatgaaggctatacctacaatcgttagcgacggcaacacaacatttcaggagaaatgttatactccaagagccgatagctttcacatttttagagacccactgacgggggatctcccctggcctggcttcatatttggtatgtccatcctaactttatggtattggtgtaccgaccaggtcatcgtgcagcgttgtctgtccgctaagaacatgtctcacgtgaagggcggttgcattctatgtggctaccttaaattgatgccgatgttcattatggttatgcctggcatgatctcccgcatcctctacactgagaagattgcctgcgttgttccatctgaatgtgagaagtactgcggaaccaaagtcggctgcaccaatattgcctacccaacgcttgttgtcgaactgatgcccaatgggctgcgaggactgatgcttagcgtgatgctggcgagcctgatgtcgtctctgacttccatcttcaattcagcatctaccctctttactatggatatatacgccaaggtgcggaaaagggcttccgaaaaggagcttatgatagccggaaggctgttcatcctagtcctgatcggaatcagtatcgcctgggtcccaattgtgcagagtgcccagtccggtcaactgtttgattacatccagtcgataacttcatacctgggccctcccattgccgcagtcttcctgttagccattttctggaagagagtgaatgaacccggtgccttttggggactgatcctcgggttgctgattgggatcagccggatgatcactgagttcgcttacggcactggatcctgcatggagccctcaaattgtcccactattatctgtggagtgcattatctgtactttgctattatccttttcgcgatcagcttcataaccatagtggtgatctccctcctgaccaaaccaatccccgatgtgcatctttatagattgtgctggagtctgaggaacagtaaagaggagaggatcgacctggacgcggaagaagaaaatattcaagagggcccaaaagagactatcgaaattgagacccaggtcccagaaaagaagaaaggcatcttccgcagagcttacgacttgttttgtggtttggagcagcacggggctcctaagatgaccgaggaggaggaaaaggctatgaaaatgaagatgactgataccagtgaaaagccactgtggcgcacagtgctcaatgtgaacgggattatactcgttactgttgccgtattctgccatgcctacttcgcgtag

SEQ ID NO: 241729 - DNA, 1614 bp, Artificial Sequence
  Description of Artificial Sequence: Synthetic coding sequence
atgcctgagtaccttcggaagagattcggaggccaacgcattcaggtttacctctccctgttgtccctgctcctctatatttttactaaaatttctgccgatattttcagcggcgctatatttattaacctcgccctgggcctgaatttatacctcgctatttttctgttgctagccataacagctctgtatactatcactggcggattagcagctgtaatttatactgacactctccaaaccgtgattatgttagtgggaagcctcattctaaccggatttgctttccacgaagtcgggggatatgacgccttcatggagaagtatatgaaggccattccaaccattgtttctgacggcaataccacgttccaggagaaatgctacacgccccgagctgactcttttcatatattccgggatccattgacaggcgatctgccatggcccggtttcatcttcggcatgtctatcctcaccctctggtattggtgtactgaccaagtgatagttcagcgctgcctgagtgctaagaatatgagtcacgtgaagggcggttgcattctgtgcggataccttaagctgatgcccatgttcatcatggttatgccaggaatgatatcccgcattctatacaccgaaaagatcgcttgtgttgtacccagtgagtgcgagaagtactgcgggaccaaagtggggtgtactaatatcgcctaccccacactcgtagtcgaactgatgcctaatgggttacggggactcatgctgtctgtgatgttggcgtcactgatgagcagtctgactagcattttcaactccgctagcaccttgttcactatggacatctatgcgaaagtcaggaagcgggcaagtgagaaagagcttatgatcgctggcagactcttcatcctggtccttatcgggatatccatcgcctgggtgcccatagtgcaatctgctcagtcaggacagctatttgactacattcagagtattaccagctatctgggaccccctatagcagctgtgttcctgcttgccatcttttggaagagggttaacgagcccggtgccttctggggactgatcctcggcctgctcatcggcatttcccgcatgatcacagagttcgcttatggcacggggtcctgtatggagccttctaattgtcctaccatcatttgtggagtgcattatctttattttgccattattttattcgccatctcattcattaccattgtcgtgatcagcctcctcaccaaacctatccccgatgtacatctgtaccgattgtgctggagcctccgtaattctaaggaggagcgcatcgaccttgatgccgaggaggaaaatatccaggaaggaccgaaggaaacaattgagattgagacccaagtgccagaaaagaaaaagggaatcttcaggcgggcatatgacctcttctgcgggctcgagcagcacggtgcaccaaaaatgaccgaagaagaggagaaagctatgaaaatgaagatgacggatacctcggagaagcccctttggcggacagtcttgaatgtgaatgggataatcctggtgaccgtcgctgtattttgccatgcctacttcgcatag

SEQ ID NO: 241730 - DNA, 1191 bp, Artificial Sequence
  Description of Artificial Sequence: Synthetic coding sequence
atggaggttaagaattttgccgtgtgggattacgttgtgttcgctgccctgtttttcataagctctggcatcggagtgtttttcgctattaaagaacgaaagaaagcgacttccagggagtttttagtcgggggtcgccagatgtccttcggcccagttggattgtcactgactgcatcatttatgagtgccgtgaccgtgcttgggaccccctccgaggtataccgctttggagcttctttcctcgttttttttatcgcctacttgttcgttattcttctgacctctgagctgtttctccctgtgttctataggtctggaattacctccacctacgaatacttgcagctgagatttaacaagcctgtgcgttatgccgcaacggtgatctatattgtgcagacaatcctctacactggcgtagtggtctatgctccggcactcgcccttaatcaagtcacgggatttgatctctggggctcagtcttcgccactggtatcgtctgcaccttctactgtaccttgggaggcctgaaagctgtggtgtggacggacgctttccagatggtggttatgatcgtgggctttctcactgtactgatccagggttcaacccacgcaggcggatttcataacgtgctggagcagtcgaccaacggttccagactgcacatttttgattttgacgtggatccacttcgcaggcatacattctggaccattaccgtgggtggcacattcacttggctgggcatctatggcgttaatcagtctactattcaacggtgtatctcctgcaagaccgagaagcacgcaaaattggccctctatttcaacctgttgggattatggatcattctggtgtgcgctgtattctcaggactgatcatgtacagtcactttaaagattgtgacccatggacttccggcattatcagcgcgcctgatcagctgatgccttattttgtgatggagatctttgctaccatgcctggattgcctggattgtttgttgcctgtgcgttcagtgggaccctcagtaccgtcgcaagcagtatcaacgcactggctacggtgacgtttgaagacttcgtcaagtcttgctttcctcacttatctgacaagttgtccacttggatttccaaagggctgtgtagatattcttggtggacattctattccataagctag

SEQ ID NO: 241731 - DNA, 1857 bp, Artificial Sequence
  Description of Artificial Sequence: Synthetic coding sequence
atggaagtgaaaaactttgcagtgtgggattatgtggtgtttgcggctctgttctttatctcttcaggaatcggggtcttcttcgctattaaggagcgcaagaaggccacatcccgggagtttctggtgggcggacgtcaaatgtcttttggacccgtcggacttagcttgacagcgtcttttatgtctgccgtgaccgttctagggacaccgtctgaggtatacaggtttggcgcatcatttctggttttcttcatcgcatacctgtttgtgatcctattgactagtgagttgttcctccctgtgttttataggagtggcataacgagcacatacgagtacttacagttgcggttcaacaagcccgtccggtatgccgcaaccgtgatttacatagtccaaaccatcctgtataccggggttgtggtttacgctccagccctggccctgaatcaagtgactgggttcgatctgtggggctctgtcttcgccacgggaattgtgtgcacattctactgtacactcggtggacttaaggccgtagtgtggactgacgctttccaaatggtcgtgatgatagttggcttcctgacggtattgattcagggctccacccatgccggagggtttcataacgtcctcgagcagtctaccaacggtagtaggctccacatttttgatttcgacgttgaccccctgcgcagacacaccttctggacaattaccgttggaggcacatttacatggctcggaatctacggagtgaaccagtcgactatccagcgctgtattagctgtaaaactgagaaacacgcaaagctagctttgtattttaacctgttgggactgtggatcatattggtatgcgccgtgtttagtggactaatcatgtactctcactttaaggattgcgatccatggacttccggtattatatctgctcctgaccaactcatgccttatttcgtcatggagattttcgccacaatgcctggattgcctggactttttgtggcttgcgcattcagcggaaccctgagtactgtcgcaagttctattaacgccttggccacagtcactttcgaagacttcgtgaaaagttgcttccctcatttgtcagacaagcttagtacatggatttctaagggactgtgccttctcttcggggtgatgtgcacctccatggctgtggcagcgagcgtcatgggaggcgtcgtacaggcctctctgtccattcacggcatgtgtggcggtccgatgcttggcttgttttccctcgggattgtcttcccattcgtgaactggaaaggcgcactgggcggactgctaacaggcatcacactgagcttctgggttgccataggtgctttcatctaccccgcaccggcttctaagacatggcccctcccactgtccaccgaccagtgcataaaaagtaacgtcaccgcaactggacctcctgtcttgtccagtaggccaggtatagccgatacctggtactccatttcctacctgtactactccgcagtcggatgcttgggatgcatcgtggcaggggtgataatcagccttattactgggagacagcgcggtgaggatattcagcctctgctgatcagacccgtgtgtaacttgttctgcttctggtctaaaaaatataagacactgtgctggtgtggagtgcagcacgattcaggcaccgaacaggagaacctggaaaatggatccgctaggaaacagggagccgagtccgttctgcagaatggactgcgcagagaatctctggtgcatgtgcctggatatgatccaaaagataagtcgtacaacaacatggcatttgagaccacccatttctag

SEQ ID NO: 241732 - DNA, 834 bp, Artificial Sequence
  Description of Artificial Sequence: Synthetic coding sequence
atggtagtcatgattgttggcttcttgacagttctcattcaggggtctacacacgcgggaggattccataatgtattggaacagagtaccaacggcagtcgactccatattttcgactttgacgtcgatcccctgcgacggcacacattctggacaatcactgttggtggcacctttacttggctgggcatctacggcgtgaaccagtccaccatacagagatgtatcagctgcaagaccgaaaagcacgccaaactggccctgtactttaatctcttaggcctctggattattctggtttgtgccgtgttcagcggcctaattatgtattcccacttcaaggattgtgatccttggacctccggaataatcagcgctccagaccagctgatgccatactttgtcatggaaatatttgccactatgccgggtctgccagggttgttcgtggcatgcgctttctccggcacactaagtacagttgctagcagcattaacgccctcgccactgtgacattcgaggacttcgtcaagagctgtttcccacacctcagcgataagctgtctacatggatctctaaggggctctgccggtccctgatctggagggacgtgtacctctacggctgtggttgcatttgtcacgggcgatgttgcgcaggctttccccagcattctaggcatgtttggagaacaaacgccggactcattcttcctggaaacagagtccctttctgtgagcttgaggggtgtacccgtcggtcttcttattggaaccacctggtcattctcggcggacactggggactacacctcccgtgcactagcttgtag

SEQ ID NO: 241733 - DNA, 2019 bp, Artificial Sequence
  Description of Artificial Sequence: Synthetic coding sequence
atggaagagcataccgaggccggatctgcccctgaaatgggcgcacaaaaagcccttatcgacaatccagctgacatcctcgtgatcgcagcatattttcttctcgtgataggggtggggttatggtccatgtgtagaacaaacaggggcaccgttggagggtatttcttagcaggcaggtcgatggtgtggtggcctgtgggagcgtcactgttcgctagcaacatcggcagcgggcacttcgtgggcctggctggaaccggcgctgctagtggcctggccgttgcaggatttgagtggaatgccctgtttgtcgtgctgctcttgggatggctatttgccccagtgtacctgactgctggggtgatcaccatgccccagtacctgcgcaaacgattcggaggaaggaggatcagactctacttgtcagtcctgtctttgtttttgtacattttcacgaaaatctccgtcgatatgttctccggggctgttttcatccagcaagcccttggttggaatatctatgcatcggtcatcgctttgctgggtatcactatgatttataccgtaaccggtggactggcggcactgatgtataccgatacggtgcaaaccttcgttatactggggggagcttgtatcctgatgggatatgctttccatgaggtaggtggttattctggccttttcgataaatatctgggcgcagccaccagtctgacagtgtccgaggaccctgctgtgggtaacatttccagtttttgttacaggccgaggcccgattcttatcacttgctgagacacccggtgacaggcgatttgccatggcctgctctcctgttaggtttgaccatcgtctccggatggtattggtgttcagatcaagtgatcgtccagaggtgcctggctggcaagtcgctgacccacattaaagcagggtgtatcctgtgtggttatctgaagttgacccccatgttcttgatggtgatgcctggcatgattagtagaatcctttatcctgatgaggtcgcttgcgtggtgccagaagtttgcaggcgtgtgtgcggaacagaggtcggctgctccaatattgcatatcctaggttagtagtgaaactcatgcctaatggcttaagagggctcatgttggccgtaatgttggccgctctgatgtcgtcgctggcgagcatattcaactcatcttcaactctgtttacaatggacatctatacccgcttgcgcccacgggctggggaccgtgagctccttctagtgggcagactgtgggttgtgttcatcgtcgttgttagtgttgcttggttgcctgtggtccaggcagcccagggaggccaactgtttgactacatccaagcagtgtcgtcttacctggcccctcctgtctccgccgtcttcgttttggctctcttcgttccccgagtgaacgagcaaggagccttttggggtctaatcggtgggctgctgatgggactggccaggttaattcctgaattttccttcgggtccggctcctgcgtacagccaagtgcttgtcccgctttcctgtgcggtgtccattacctttattttgccatagtgctgttcttttgttcaggcctgcttactttgactgtttctctgtgtacagctccaatacctagaaagcacctgcatagactggtgttttccctcagacacagtaaagaggaacgggaggacctcgatgcagatgaacagcaagggtcgtctttgcccgttcagaatggctgtcctgagagcgccatggaaatgaatgagcctcaggccccagcgcctagtctgttccggcagtgtctgctctggttctgtggcatgtctagaggcggagtgggatcacctccacctcttacacaagaagaggctgcagccgcagccagacggttggaagacatctcagaggacccttcatgggccagagtcgtgaatttgaacgctctgctgatgatggctgtggcagtgttcctctgggggttctatgcttag

SEQ ID NO: 241734 - DNA, 1377 bp, Artificial Sequence
  Description of Artificial Sequence: Synthetic coding sequence
atggaagaacacactgaagccggaagcgcccctgagatgggtgctcaaaaggccctaatcgataaccccgcagatattctggtgatcgcggcatattttcttttggtgatcggtgttggtctgtggtcaatgtgtaggacaaaccgcggaaccgtgggtggatattttttagctggtaggagtatggtttggtggccagtgggcgcatctttgttcgctagcaatatcggttccgggcacttcgtcggccttgcgggaaccggcgcagcctcaggactggccgtggcgggatttgagtggaacgcgctgttcgtcgtgttgttgctgggttggctgtttgcccctgtctacctgaccgccggagttattacgatgccccaatatttaaggaagcgtttcgggggtaggagaatcaggctgtacttgagtgtgctttctttgttcctatatatctttaccaagataagtgtcgacatgttttccggcgctgtgtttatccaacaagccctgggatggaacatttacgcatcagtgatagccctcttgggcataacaatgatttacacagttactgggggtcttgccgctctgatgtacaccgacacagtgcagacatttgtcatcctcggcggtgcctgcatcctgatggggtacgcctttcacgaggtgggaggttactccgggctatttgacaagtacttgggagccgcaacctccctaactgtgagcgaagacccagctgttgggaacatctccagcttctgttaccggccacgacccgacagctatcaccttcttcgacatcctgtgactggggaccttccatggcccgcactcctgctgggactgacaatcgtgagtggctggtattggtgcagcgaccaagtaatcgtgcagagatgtctggctgggaagtcgcttacacacattaaggcaggttgtattttgtgtgggtatcttaaattgactccaatgttcctgatggtgatgccgggtatgatttctcgcattctgtacccagacgaagtggcctgcgtagtgccggaagtatgtcgcagagtgtgcgggacggaggtggggtgctccaacatcgcctaccccaggctcgtggtgaaacttatgccaaacggaaggctgcttggcacgcatcgcggacccgctgatggcccaggcacgccagattcacgcgtgctgcttagactcgggcagctgtgtgctgccttaggagtgcctagttttccactgcgcagggcacttccattgctgaggcattgtgccgtgctgcttctttggcccccacatcctcacggactgcccgttcacagggcccacccacagaaggcacccccacctccagggttgcaaagccctgcatag

SEQ ID NO: 241735 - DNA, 2157 bp, Artificial Sequence
  Description of Artificial Sequence: Synthetic coding sequence
atgcgagcagttctcgacaccgccgacatcgccatcgtcgctctgtatttcattctggttatgtgcatcgggttctttgctatgtggaagtcaaatcggagtacagtgtcaggatattttttagcaggtcgttcaatgacttgggttaccattggcgctagcttatttgtctctaatataggctccgaacatttcattggcctcgcaggctctggagcagcatccgggttcgccgtgggggcttgggagtttaacgcactgcttctgttgcaactgcttggttgggtgtttatccctatctatatcagaagcggggtgtacacaatgccagaatatctgagcaagaggttcggagggcatcggattcaggtttatttcgcagccctgtctctgatactatacatttttacaaaattgtccgtcgacctgtattccggcgctttattcattcaggagagcctcggctggaacctgtacgtcagtgtgattctgctgatcggaatgacagcactgttgacggtgacgggaggcctggtggcagtgatttatacggacacgttgcaggccctcctaatgataattggtgcactgaccctcatgattatctccattatggagatcgggggattcgaagaggtgaaacgcaggtatatgctggcgtcccccgatgtgacatctatcctgctcacctataacttgtccaacactaacagctgtaatgtgagccctaaaaaagaggccttgaaaatgctgcgaaaccccactgacgaggacgtaccatggcctggattcatactgggccagacaccggctagcgtgtggtattggtgtgccgaccaggttatcgtccagagggttttagccgcaaaaaacatcgcccacgccaagggcagtactcttatggctggcttcctgaaactgttgccaatgttcatcatcgtcgttccaggtatgatctcccggattctgtttaccgacgatatcgcctgcatcaacccagagcactgcatgctggtgtgtggcagccgcgctggttgcagcaatattgcatacccacgcctggtgatgaagcttgtccctgtgggcctacggggtcttatgatggccgtgatgattgccgctctgatgagcgacctcgattctatcttcaacagtgcttccacaatttttaccctcgacgtctacaagctgataagaaagagtgcgtctagtcgggaattgatgatcgttggcagaattttcgtggcatttatggtggttatctcaatagcatgggtgcctatcatcgtcgagatgcaggggggacagatgtatctctatatacaggaggtggccgattatcttaccccgcctgtggccgctctgttcctcctcgcaattttctggaagaggtgcaatgagcagggtgcattttacgggggtatggccggatttgttctgggggctgttaggctcatcctggcttttgcttacagagcgcctgagtgtgaccagcctgacaaccgtcctggcttcattaaggacatccattatatgtacgtggcaaccggcctgttctgggttacgggtctgatcacagtaatcgtttctttgctcaccccccctccaactaaagaacagattaggaccacaaccttttggtccaaaaagaatttggtagtaaaagagaattgcagtccgaaggaggaaccctaccagatgcaagagaagagcatacttagatgctcggagaataatgaaactatcaatcacatcatcccgaatggaaagtccgaagactcaatcaagggcctgcaaccggaagacgtaaatctgctcgtcacctgcagagaagaaggcaacccggtggcttcactcgggcattccgaagcagaaacccctgtagacgcctatagtaacggtcaggccgcattgatgggggagaaagagaggaagaaagaaactgacgacggcggacgctattggaaattcattgattggttttgcgggttcaagtcgaagagcctctcaaaacgcagccttcgcgacctaatggaggaagaggccgtttgcctgcagatgcttgaggagacaagacaagttaaggtcatcttaaacatcggtctgttcgcggtgtgtagtctgggtattttcatgttcgtgtatttctcactctag

SEQ ID NO: 241736 - DNA, 504 bp, Artificial Sequence
  Description of Artificial Sequence: Synthetic coding sequence
atggaagcgggtggattcctggactctttaatctatggggcatgcgtggtgtttacattggggatgtttagcgcgggactgagcgacctccggcacatgaggatgaccaggagtgttgataacgtgcagtttctgcctttcctgactactgaagtcaataatctcggctggttgtcttacggcgcactgaaaggagacgggattctcattgtcgttaacactgttggcgctgccctccagaccttatatatcctggcctatttacactactgtcccaggaaagccaaagtcattcagaccaagtccactcaatgcctgagttacccactgacaattgctacactgcttaccagtgcgtcatggtgcttgtacggatttaggttgcgcgacccctatattatggtctcaaatttccccggtatcgtaacgtctttcatccggttctggctcttttggaagtaccctcaagagcaggaccgaaattattggcttctgcagacatag

SEQ ID NO: 241737 - DNA, 501 bp, Artificial Sequence
  Description of Artificial Sequence: Synthetic coding sequence
atgcgtggcctccacccttggcatgtcctaagacgcccattagggcctcaggcccacgcgaatgatccagaatgcgggcagcgtccggtgccagctcttagtcaccatgggtctcaaagagtagtgttgctgcagaccgcaaccttgctgggagtgctccttctcgggtacggttatttttggctgctcgtcccaaatccggaagcgcgtctgcagcagctagggctcttctgctctgtctttactatatcgatgtatttaagccctttagcggatctcgctaaagtgatccagactaagtctacacagtgtctgtcctatcccctgaccatagcgacgttgcttactagcgcctcatggtgcctgtacggtttccgcctgcgggacccatatataatggtttcgaactttccaggcatcgttacgagctttatcagattctggttgttttggaagtatccccaggagcaagacaggaattactggctcctgcagacctag

SEQ ID NO: 241738 - DNA, 666 bp, Artificial Sequence
  Description of Artificial Sequence: Synthetic coding sequence
atggaggctggcggttttctggatagtctgatttacggagcctgtgtggtgtttaccctggggatgttctctgctggcctctccgacttgcggcatatgagaatgactcgatcagtggataacgtacagtttctgccttttcttactacagaggtgaataaccttggttggcttagttacggagctctgaagggtgatggcattctcattgtggtcaataccgtgggagcagccctgcaaaccctctacattttggcttacttgcattattgtcctcggaaacgcgtggtgctcctgcagaccgctaccttactgggcgtcttgctgttgggttacggatacttttggctactggtgcccaatcccgaggcccgactgcagcagctgggattattctgttctgtgttcacaatttctatgtacttgtcaccgctggcagacctggccaaggtgattcaaaccaagagcacacagtgcctgagttaccctctaaccattgctacactgttaacttctgctagctggtgtttgtatgggttcaggctgagggacccctacatcatggtgtcgaactttccagggatcgtgaccagcttcatcaggttctggttgttctggaaatatccacaggagcaggatcggaactactggttgcttcaaacgtag

SEQ ID NO: 241739 - DNA, 471 bp, Artificial Sequence
  Description of Artificial Sequence: Synthetic coding sequence
atggaagagctggggccacaggcgcacgccaatgatcccgaatgcgggcagcgccctgtgccggcattgtcccatcatgggtctcagcgagtcgttttgttgcagaccgcaaccctgttaggtgtcctgcttctcggatacggctacttttggctgttagtaccgaatcctgaggcgagactgcaacagctggggcttttctgcagtgtgttcactatctccatgtaccttagccctttagcagacctagctaaggtgattcaaacgaagagcacacagtgtctgtcttacccactgactatagctaccctgctgacaagcgctagctggtgcctatatggtttccgtttacgagacccctacataatggtgtccaactttcctgggatcgtgacaagcttcatccggttctggctgttctggaagtaccctcaggagcaggacaggaattactggctgctccagacatag

SEQ ID NO: 241740 - DNA, 1929 bp, Artificial Sequence
  Description of Artificial Sequence: Synthetic coding sequence
atggataaactgaaatgtccttcattctttaaatgcagagagaaagaaaaagtgagcgcgtcttccgaaaatttccacgtgggtgaaaatgacgagaatcaagatcgcggtaattggagtaagaaaagcgactacctcctgagtatgattgggtatgctgtcggtctggggaatgtgtggaggttcccttacctgacttactctaacggaggcggtgcttttctaataccatatgccatcatgctcgcactggctggactccccctcttcttcttagagtgcagcctggggcagtttgctagcctgggaccagtcagcgtctggcgtatcctcccactgtttcaaggagtgggcattactatggtgctgatctccatctttgtcacaatttactacaatgtgatcatagcgtactccttgtactatatgttcgcttcctttcagagtgagctgccatggaagaactgttcctcttggagcgataaaaattgttctcgttctcctattgtgacccactgtaatgtgtctacagtcaacaagggcattcaagaaattatccagatgaataagagttgggtagacattaataactttacatgcatcaatgggagcgaaatttatcagcctgggcaattgccctccgagcagtattggaacaaagtcgctctgcagcgctcctctggtatgaacgaaacgggagtgatcgtctggtacttggccctctgtctcctgctcgcctggttgatagtgggggcagctctctttaaagggataaaaagctcagggaaagtcgtgtatttcacagcactgtttccttatgttgtgctgttgattctgttggtgcgaggcgcaacactagagggggcaagcaagggtatcagctactacattggcgctcagtccaatttcaccaaactcaaggaggccgaagtgtggaaggatgccgctacccagatcttctacagcttgagtgtggcctgggggggtctggtagccctgtcaagctataataaatttaaaaataactgttttagtgatgcgattgttgtttgcctaaccaactgtctcaccagcgtgtttgcaggtttcgcaattttctctatactgggccacatggctcacatatccggaaaggaggttagtcaagtcgtgaagtccggcttcgatctcgcttttattgcgtacccggaagccctggcccaactcccaggtggccctttctggtccattttgttcttttttatgcttctcacccttggcctcgactcccagttcgcctccattgagacaattactactaccatacaggacctgttccccaaggtcatgaaaaagatgagagtaccgatcacactgggttgttgcctggttctgttcctgctggggctcgtctgcgttacacaagccggtatctattgggttcacctcatcgatcacttttgtgcaggttggggcatactgattgcggctatcctcgagctggtgggcatcatttggatatacggcggtaatcgattcattgaggataccgagatgatgatcggggcaaaaagatggatattttggttgtggtggcgggcatgttggttcgttattaccccaatcctcctcatcgctatatttatttggagcctcgtgcagtttcacagaccaaattatggtgcaattccgtatccggactggggggtcgcgttgggttggtgcatgatcgttttctgtattatctggatccctatcatggccatcatcaagatcatacaagccaagggcaatatcttccagcgccttatcagctgctgtcggccagcgagcaattggggtccctacctggagcagcatagaggcgagaggtacaaggacatggtcgatcccaaaaaagaggctgatcacgaaatccctacagtgagcggaagtcgcaaacctgaatag

SEQ ID NO: 241741 - DNA, 1539 bp, Artificial Sequence
  Description of Artificial Sequence: Synthetic coding sequence
atgggagttcagtggtggagccacacccagggcgaggtggccgtcggattaggtcttggggactcctacctcacaccatgtccatgccctggcgtggggtacgctgtaatcttaatcgcgctgtacgttggtttttactacaacgtgatcatcgcctggagtttatactacctgttctcttcctttacattgaacctgccttggaccgactgtggccacacatggaatagccccaattgcaccgatcccaagctgttaaatggctctgttctgggcaaccacactaagtattccaaatacaaattcacacccgctgcggagttttacgagagaggcgttctgcatctccacgagtcaagcggaatacacgatattggactccctcaatggcagctcctgttgtgcctgatggtggtggttattgtgttatacttttccctctggaagggcgtgaaaacctcgggcaaagtggtgtggatcacagccaccttgccttatttcgtgttgtttgtgctcttggtgcatggcgtcacactgccaggggctagcaacggaatcaatgcttacttgcacatagacttttatcggctcaaggaagctactgtgtggatagacgctgctacccagatcttcttttcattgggggcaggatttggtgttctgatcgctttcgctagctataacaagttcgataataactgctaccgggatgcccttttgactagcagtataaactgcataacaagctttgtgtccggatttgcaatattctctattctgggatatatggcacacgaacataaggtcaatatcgaagacgttgcaaccgaaggcgctggactggtgtttatcctataccccgaggctattagcacattatccggttccactttttgggcagtcgtgttttttgtcatgctgttggcgttgggtctggactcatcaatggggggaatggaagcagtgattacgggcctagccgatgatttccaggtgttaaagaggcataggaagctgttcacctttggcgtaacttttagcactttcttacttgcactgttttgtatcaccaaggggggaatttatgtccttaccctgttggataccttcgctgcgggaacaagtattctcttcgccgttctgatggaggccataggcgttagctggttctacggcgtagatcgcttctccaacgacatccagcaaatgatggggtttaggccaggcctgtattggcgcctgtgttggaagtttgtgtcacccgcatttctactctttgtggtcgtggtctcaatcattaactttaagcctcttacgtatgacgactacatcttccccccatgggctaattgggtgggctggggaatcgccctgtcttcgatggtcctggtgcctatttacgtgatttataagtttctaagtactcagggttccctctgggaaaggctggcatacggtattactccagagaatgagcaccacctggtggcccaacgtgacattaggcagttccaactccagcactggttggctatttag

SEQ ID NO: 241742 - DNA, 1845 bp, Artificial Sequence
  Description of Artificial Sequence: Synthetic coding sequence
atggacggtaaggtggctgtgcaggagtgtgggccacccgctgtttcttgggtaccggaagagggggaaaagttggaccaggaagacgaagatcaggtgaaggatagaggccaatggacgaataaaatggagtttgttctgagcgtggctggagagatcataggactgggtaatgtatggcggttcccttacttgtgctacaaaaacggtgggggagcatttttcatcccttactttattttcttcttcgtctgcgggatcccagtgtttttcctggaggtggcccttggtcaatatacatcacagggaagcgtgactgcctggcgcaaaatctgtccgctgtttcaagggatcggcctagccagcgtcgttattgaatcatacctaaatgtctattatataattattcttgcctgggccctcttctacctgttcagcagttttacaagcgaactgccctggaccacctgcaacaacttttggaataccgaacactgcaccgacttcttgaaccattccggcgcaggcactgtgactccttttgaaaattttacatctcctgtgatggaattctgggaacggagagtactgggcattacttccggcatccacgacttagggtctcttcgctgggagctggctctgtgtctgctcctggcctgggtgatctgttatttctgtatctggaagggagtgaagagcacgggaaaggtcgtgtactttaccgcgactttcccctatctgatgctggtgattctgcttatccgaggcgttacactccccggtgcctaccagggtattatctactatctcaaacccgatcttttccgactcaaggaccctcaggtctggatggatgcgggaacgcagattttcttttccttcgctatctgtcagggctgtttaaccgctctcggatcctataataaataccacaataattgttataaggactgcattgcattgtgcttcctaaatagtgccacatcctttgtcgcaggatttgtggttttctcgatactcggatttatgagccaggaacagggcgtgccgatctctgaggtggctgagagcggaccgggtctggcgtttattgcctttccgaaggccgttacaatgatgcctttgagtcagttatggagctgcctgttcttcatcatgctgattttcctggggttagatagtcaattcgtgtgtgtggagtgtctggtgacagctagcattgacatgtttccaagacagctccgcaagagcggccgtcgagagcttctgattttaactatagcagtaatgtgctatcttatcggccttttcctggtgaccgagggtggcatgtatatcttccaactctttgactactacgcaagctcggggatatgcctcctgtttctgtctctctttgaggtggtttgtataagctgggtttatggcgctgatagattctacgataacattgaagatatgattgggtacagaccctggccgctggttaaaatttcctggctgttcctgacacctgggctgtgcctggccacctttctgttttccctcagtaagtacacccccttgaaatacaacaatgtttatgtgtaccccccttgggggtactccattgggtggttcttggctctgagtagtatggtttgcgtaccgctctttgtggtgattacactgttgaagactcggggtcccttcagaaagagattgcgtcaattgattacccccgatagctccctgccacagccaaagcagcacccatgtctggacgggagtgcgggtcgtaatttcggcccttcaccgacgcgcgagggtttaatcgccggagagaaagaaactcatctctag

SEQ ID NO: 241743 - DNA, 1845 bp, Artificial Sequence
  Description of Artificial Sequence: Synthetic coding sequence
atggatggcaaagtggcggtccaagagtgtggaccacctgctgttagctgggttcccgaggaaggggaaaagctggatcaagaggacgaggatcaagtgaaggataggggacaatggactaacaagatggaatttgtgctgagcgtagctggggagatcatcgggctcggcaatgtctggcgctttccttatctctgctacaaaaacggaggaggggctttctttatcccatattttatcttcttttttgtctgtggcattcccgtcttttttctggaagttgcgttaggtcagtatacgtcacagggttcagttaccgcgtggcgaaaaatttgtccgctctttcagggtattggccttgccagtgtagtgattgaaagttaccttaatgtatattatattataatcttagcttgggcactcttttatttattttcatcttttactagtgaactgccatggacaacttgcaataacttctggaacacagagcattgcacagactttttgaaccattcgggagcgggaacggtgaccccatttgaaaactttacaagtcccgttatggagttctgggaaaggcgtgtcctcggtataacttccggcattcatgacctcgggtccctacgatgggagctggcactgtgccttctcctcgcgtgggttatttgctatttctgcatctggaaaggagttaaatccaccggcaaggttgtgtattttactgctacgtttccttacttaatgctggtgattctgctaattcgaggagtcaccttgccaggggcttaccaagggatcatatactatctgaagcctgatttgttccgcttaaaagatcctcaggtgtggatggacgcgggtactcagatctttttttctttcgcaatttgccagggctgcctgacggcactgggaagctataacaaataccacaacaactgctacaaggattgcatcgccttgtgttttctgaacagcgctacctcctttgtcgcgggattcgtcgtgttcagcattttgggttttatgagtcaggagcaaggggtcccaatttccgaggtggccgagtccggcccaggcctcgctttcatcgctttccccaaagcagtcaccatgatgccactctcccaactctggagctgcctattctttataatgttaattttcttgggcctggacagccagtttgtctgcgtggaatgccttgtaaccgccagtattgacatgtttccacgccagctcagaaagtcagggaggagagagctgttgatactgacgatcgccgtgatgtgctatcttatcggcctattcctggtgactgaggggggaatgtatattttccagctctttgactattacgcgtcctcaggaatctgtctgctcttcctgtccttgtttgaagtcgtgtgcatttcttgggtatacggagccgaccggttttacgataacatcgaagacatgattgggtatcgaccttggcccctagtcaagatcagctggctattcctgacccctggtctgtgcttggcaacgtttttattcagtctgagcaagtacacaccgcttaaatacaataatgtgtatgtctatcctccctggggctactcaatcggatggttcctcgccttgagttctatggtgtgtgtacctctattcgttgtgatcaccctgctcaagactcgcggtccattccggaagcggctccgccagctgatcacccctgatagctccctcccgcagcccaaacagcacccatgtctggacgggtctgccggtaggaatttcggcccatcccctacacgcgagggattgatcgccggagagaaagagactcacctctag

SEQ ID NO: 241744 - DNA, 1845 bp, Artificial Sequence
  Description of Artificial Sequence: Synthetic coding sequence
atggacggcaaggtggcagtccaggagtgcgggcctcctgcagtaagctgggtaccagaggagggagaaaagctagaccaggaagatgaagatcaggtgaaagatcgcggtcagtggactaacaagatggaatttgtcctctcagtggcgggtgagataataggtctcggaaatgtatggcggttcccctacctgtgctataagaatggagggggagcattttttatcccttattttatcttcttctttgtatgcggaatcccagtatttttcctagaagtggccctcgggcagtacaccagtcagggctccgttaccgcttggcgtaagatttgtcctcttttccaaggtatcggccttgcttctgtggtgatcgaaagttatctcaacgtgtactatattattattttggcttgggcactattctacctcttcagttctttcacctctgagctcccatggactacatgcaataacttctggaataccgaacactgcaccgactttctcaatcacagcggtgctggaacggtaacacctttcgagaacttcaccagtcccgtgatggaattttgggaacgcagggtcttggggatcacttccggtatccacgatctgggaagccttcgatgggaactagccctgtgcctgcttctggcctgggtgatatgctacttttgtatttggaaaggcgtgaagagcactggaaaggtggtttatttcaccgccacatttccatatctgatgctggttattttactaataaggggcgtgacccttcctggtgcttaccaaggaatcatttattacctcaaaccagacctgtttcggctgaaagatccacaagtgtggatggatgcaggcacccagattttcttctcttttgccatctgtcagggatgccttacggccctcggaagctacaataagtaccacaacaactgctacaaggactgtatcgccctgtgtttcctgaattctgccacatcttttgtcgctggctttgtagtgttcagcatcctgggatttatgtcgcaggagcagggtgtgcctattagcgaagtcgctgagtctggacccggtttggctttcattgcctttcctaaggctgtgacgatgatgccactctcacaactgtggtcttgcttgttctttattatgctcatttttctcgggcttgatagccaattcgtgtgtgtcgagtgtctggtgaccgcctccatagacatgtttcctcggcagctgagaaaatccggaaggagagagctgctgatactgactatcgctgtcatgtgctacctaataggactgtttctagtcactgaaggtgggatgtacatctttcagttgtttgattattatgctagttcaggtatctgtctgctgttcctgtctctgtttgaggtggtttgtatcagttgggtttatggagccgatcgattttacgacaacattgaagatatgatcggatacagaccttggcccctggtcaaaatcagttggctttttttgacacctgggttgtgtctggccaccttcttgttcagcctgagtaagtatacacctctgaaatacaacaacgtgtacgtgtacccaccctggggctactcgattgggtggttcctggcgttatcgtcaatggtgtgcgtgccactgtttgtcgttataactcttcttaagacaaggggtccattcagaaagagactgcggcaactgattacaccggacagctccttaccccagccaaagcagcatccctgtcttgatgggagcgcgggtagaaacttcggtccaagcccaacacgggagggcctgattgccggtgagaaggaaactcacctctag

SEQ ID NO: 241745 - DNA, 1845 bp, Artificial Sequence
  Description of Artificial Sequence: Synthetic coding sequence
atggatggcaaagtggccgtccaggaatgcggcccacctgccgtcagctgggtgcccgaagagggggaaaagctagaccaggaggacgaagaccaggtgaaggaccgagggcagtggaccaataaaatggagttcgtcctctctgtcgcaggggagattattgggctaggcaacgtctggagatttccatatctgtgttataagaacggaggcggagctttttttatcccatatttcatctttttcttcgtgtgtggcatcccagtattttttctggaagtagccctcggtcagtataccagccagggaagcgtgaccgcctggcgcaaaatatgtccgctgttccagggaattgggctggcctccgtggtcatcgagagttatctgaacgtctactatataataattctggcgtgggctctcttttacctgttcagcagcttcaccagtgagctcccctggaccacttgtaataatttttggaacaccgaacattgtacagatttcctgaaccactctggggcaggcacagtgactccttttgagaacttcacaagtcccgtcatggaattttgggaacggagggtcttaggaattacctcaggtatacacgatctggggagcctacgctgggaactggccctctgcctcctcctggcttgggtaatctgttacttttgtatttggaaaggcgtaaagtccacaggtaaggtggtctacttcaccgccaccttcccctatcttatgttggtgattctcttaattaggggggttacgctgccaggagcctatcagggcatcatatattatctgaagcctgatttgttccgtctcaaggacccccaggtatggatggatgcaggaacccagatatttttctcgtttgctatttgccaggggtgccttaccgccctgggcagctataacaaataccacaataattgctataaagactgtattgccctgtgttttctcaattctgctacgtccttcgtagccggtttcgtcgtattcagcatcttagggtttatgtcccaagagcagggggtgcccatttctgaggtggcggaaagtggcccaggattagctttcatcgcatttcctaaggcagtgacaatgatgcccttaagtcagctttggagctgtctctttttcatcatgctgatcttcctggggctcgacagtcagttcgtgtgcgtggagtgcctcgtgaccgccagtatagacatgttcccacggcagttacgaaagtctggcaggcgggagttacttatcctgaccatcgcggtgatgtgttacttaataggtctttttctggtgactgagggcggtatgtatatctttcagctttttgattattatgcatctagtggaatctgccttctttttcttagcttgttcgaagtggtctgcatctcttgggtctacggcgcagataggttctacgacaacattgaggatatgatcggataccgtccatggccacttgtgaagattagctggttattcctgacaccaggcctgtgtctggctacattcctgttttcactcagcaaatatacaccgttaaaatataataacgtgtatgtgtatccgccttggggctactcaatcggatggttcctggctctctcttcgatggtgtgcgttcctctctttgtagtgatcactctactcaagactcgaggcccattccggaagagattgaggcagctcatcactcctgattcctcgcttcctcagccaaagcaacatccttgcttggacggaagtgccggtaggaactttggtccaagcccaactagagagggtctgatcgcaggcgagaaagaaacgcatctctag

SEQ ID NO: 241746 - DNA, 1845 bp, Artificial Sequence
  Description of Artificial Sequence: Synthetic coding sequence
atggatggcaaagtcgcagttcaggagtgcggaccaccggctgtcagctgggttcctgaggagggagagaaactcgatcaagaagacgaagaccaagtaaaagaccgcggtcagtggacaaataaaatggaatttgtgctgtccgttgccggtgaaataatcggcctaggcaatgtctggagattcccttacctctgctacaagaatggaggaggagcgttctttattccttattttatattttttttcgtatgcggaattcccgtgttctttctggaggtagcactgggccaatacactagtcagggttcggtgacagcttggcgaaagatctgtcctttatttcaggggatcggtctggccagcgtggtgatcgagtcctacctgaacgtgtattacattatcatcctggcatgggccctgttctacctattctcaagtttcacaagcgagctgccatggactacgtgcaataatttttggaataccgagcattgcacagactttctgaaccatagcggggctggcacagtcacccctttcgaaaacttcacatccccagtcatggagttctgggagcggagggtgctcggcattacaagtggtattcacgatctcggtagcctcaggtgggaactggccttatgtttgcttctggcctgggtgatttgttacttctgcatctggaaaggcgtgaagagcacaggaaaagttgtgtatttcaccgccaccttcccctatctaatgctagtgatattgctgatcagaggtgtgaccctgcctggagcctatcagggtatcatttattacttaaagcccgacttgttcagactaaaggacccacaagtttggatggacgcagggactcagatatttttctctttcgcgatctgccagggttgcctcacagctcttggaagctataataaataccataataactgctataaggactgtatcgcactgtgtttccttaactcagccactagcttcgtggccggtttcgtggtgttttcaatcctggggtttatgtcacaggaacaaggcgtgcccatatcagaggtggccgagtctggcccagggctggcctttattgcttttcccaaagcggtcacaatgatgcctctgtcacaactgtggagctgtcttttcttcattatgctgatcttcctgggcctggactcccaattcgtttgcgtggaatgtcttgtcactgcttctattgatatgtttcccaggcagttacggaagagcggaaggcgggagctgctcatccttaccatcgcggtgatgtgttacctgattgggctcttccttgttaccgaagggggaatgtacatatttcagctgtttgattactacgcatcatctgggatttgcctcctgtttctttctctttttgaggttgtatgcatctcctgggtctacggcgctgaccggttttacgacaacatcgaggacatgataggataccgcccatggccactggtgaaaatctcatggctgtttctcactccgggactgtgcctggctacttttctgttctcgctgtctaagtacacacccctgaagtataataacgtctatgtttacccaccatggggatactccataggctggttcttagcccttagttctatggtttgtgtccccctattcgttgtgatcactctgttgaaaaccagagggccatttcgcaaacgcttgcggcagttgatcactccagattcctcactaccacagcctaagcagcatccatgcttagatgggtcagcaggtaggaatttcggacccagtccaacacgagagggccttatagccggtgagaaagaaactcacctctag

SEQ ID NO: 241747 - DNA, 441 bp, Artificial Sequence
  Description of Artificial Sequence: Synthetic coding sequence
atggacggcaaagtcgctgtccaggagtgtggaccaccagcggtgtcttgggtcccagaagagggcgagaaattggaccaggaagatgaggatcaagttaaagacagggggcaatggacgaacaaaatggaattcgtgctgagcgtggctggagagatcatcggtctgggcaacgtctggcgcttcccttatctgtgttacaaaaatgggggaggagcattttttataccatacttcatcttcttctttgtgtgcggaattccagtgttttttctcgaagtggccttggggcagtacacgagtcagggctctgtgaccgcttggagaaaaatctgtccattgttccagggcataggcctcgctagcgtagtcatcgaatcctatcttaatgtctactacattataatcctggcctgggcgctgttctatctcttttcttag

SEQ ID NO: 241748 - DNA, 1908 bp, Artificial Sequence
  Description of Artificial Sequence: Synthetic coding sequence
atggctaaaaaatccgctgaaaatggcatatactcagtctccggggatgaaaaaaaggggccactcatcgccccaggtcctgatggcgcacccgcaaaaggggatgggccagtaggcctgggaactcctgggggaaggctggctgtgccacctagagaaacgtggacccgccagatggatttcatcatgagctgtgtgggcttcgcggtcggcctgggtaacgtctggcggttcccttacctgtgttataaaaacgggggaggggtgttcctgatcccatacgtgttgattgcacttgtggggggtattcctatctttttcctggagataagcctgggtcagttcatgaaagctggaagcataaacgtttggaatatctgcccactcttcaaggggttgggatatgcatccatggtgatcgtgttctattgcaatacttactatatcatggttttggcctggggattctactacctcgtaaagtcattcacgacaactttaccgtgggcaacatgtggtcacacttggaatactcctgattgtgttgagatcttccgtcatgaggactgtgctaacgccagcttggccaacctaacctgcgaccagctcgccgacagacgaagccccgtaatcgagttttgggagaataaagtactcaggctgtctggcggactcgaagtgccgggagccctgaattgggaggtgaccctgtgtttgctggcatgttgggtcctggtttacttttgtgtttggaaaggggtgaaatctacaggaaaaattgtttacttcaccgcaacattcccgtatgtggtgttggtggtcctgcttgtccgtggtgtgctgctccccggtgcactggacggcattatctactaccttaagccagattggagtaagctgggaagcccccaggtgtggatcgacgcgggaactcagatcttcttcagctatgcaattggcctgggagctctcaccgcgctcggctcctacaaccgtttcaacaacaactgttacaaagacgctatcatactggcactaatcaatagcggaacaagcttttttgccggatttgtggtgttttcaatcctcggatttatggccgctgaacagggagtacacatcagcaaggtagccgagagtggcccaggtctcgctttcatcgcctacccacgcgcagtgaccctcatgccagtggcgccactatgggcagctctcttcttcttcatgctgcttttattgggactggattcacagtttgtgggagtggagggattcatcaccggacttctggatttgctgcctgctagctactatttccggttccagagggaaatctcagtggctctctgttgcgcgctgtgtttcgtgattgacctctcaatggtgaccgatggaggtatgtacgtgtttcagctcttcgattactactcagcctccgggaccacattgctctggcaggccttctgggagtgcgtcgttgttgcctgggtttatggcgctgatcggtttatggacgatattgcatgtatgataggctatcgcccttgtccatggatgaaatggtgctggtctttcttcacccccctagtctgcatggggatctttatctttaacgtggtgtattacgaacccctggtgtataataacacatatgtctatccctggtggggagaggcaatgggttgggcgtttgccctctccagtatgctgtgcgtgccgcttcacctgctgggatgcctcctgcgcgctaaagggaccatggccgagcgctggcagcatctgacgcagccaatatggggccttcatcacttggaatatcgagctcaagacgccgatgtcagaggactgacaacactaacccccgtgtcagagtcttcaaaagtcgtggtagtcgaatctgtgatgtag

SEQ ID NO: 241749 - DNA, 2190 bp, Artificial Sequence
  Description of Artificial Sequence: Synthetic coding sequence
atgctgcctacactgcagatacaggggccagccgcattcgctcccggagacagaggaccgggaagacactgtccgttcccagttcctatcacgcctactggagctcttctgcctgtctctgacagttgcgacagcctggtggacctagtgtggcccagtgtaacgtaccttgcgctggggacacagtcccgagtgtggcctcaccccttgggggctccagggcaggctggcgaatctcccgaacaaaggaggcaatgtctcgagctgtgggacatggcgtcatcccttggcgataaggtcccacgggctgcctgtgggaaaaggggtcagacagtgtggcagttgcacctggcttgcttgtgccttgcacaatttcatagcccccctgcccaaccgccaccccttagtcggcgagggggagggcctgaccctgatcctataagcagaagtctcccgggtccccctactcccgcactgcccacacacagctactcatcacatagcccacgggctccgcgtctgctctctcctctgagacgtgctccacgcggttccccggctccacaccgccacgcgtctctgcagacaaatgaggcccctagagagttgcctcactgcacttggccgggacttccgggacggagcctagcccctagcttcctgtggagggagccatggctgggtggacaatggggaccacttaacattcctgccaggaagggcgacaggcggcgttgggagtggggctgtgagggagggggagcaaccgctagtgccgagcagcctggaccacagattgtctattttactgctacattcccttacgtcgtgcttgtggttcttctcgtgcggggtgtgctactcccaggagccctggacggcatcatatattacttaaaacctgattggtcaaaactgggttctcctcaggtatggatagacgccggaacgcagatcttcttcagctatgctattgggctgggcgctttgactgcgctgggatcatacaatcggtttaacaacaactgttataaggatgcaatcattctggccctcattaactccgggacatcttttttcgctggcttcgtcgttttcagcatacttggcttcatggcagcggaacaaggtgtgcacatttcaaaagtggccgagtccggtccgggtctcgcatttatagcataccccagagctgtgacacttatgcctgtagctcctttatgggcagctttgtttttcttcatgctgctcctcctcggtctcgacagtcaggtttgtatgggcctctgggaccgagagcctgggggaggccgtagagagggttgccgacaagggaaaggatggaggagatgtggcgctagaccagaattgccttggcctcagttcgtgggtgtcgagggcttcattaccggcctgcttgatcttctccctgcttcatactattttcgtttccagcgcgaaatttccgtagcgctgtgctgtgctctgtgcttcgtaatcgacctttcaatggtgacagacgtctctggcgtcgggggacttccagttacttccgggggaaggctgccctcatctctgacaggactctgtccccaaggcggaatgtatgtcttccagctcttcgattattactcggcatccggaaccaccctgctctggcaggccttttgggagtgcgtggtagtggcttgggtctatgggcgttcctggctaagggcaggtcttggcgatgggggaggagaaggcaggtcgcccgcttggccggcttctccaaggggagccgatcggtttatggatgatatcgcatgcatgataggctataggccttgcccgtggatgaagtggtgttggtccttttttacacctttagtctgtatgggtatttttatattcaatgtcgtttactatgaaccccttgtgtataacaatacgtacgtctatccctggtggggagaggcaatgggttgggccttcgctctttctagcatgctatgcgtgcctttacatctgctcggttgcttattgcgcgcaaaggggaccatggctgagcgctggcagcacctaactcaaccaatctgggggctccatcacctagagtatagggcacaagatgcggacgtccgtgggctcaccactttgacccctgtgagcgagtcctcaaaagttgtcgtcgtcgaaagcgtaatgtag

SEQ ID NO: 241750 - DNA, 471 bp, Artificial Sequence
  Description of Artificial Sequence: Synthetic coding sequence
ctcctacactccccaacttggtcttggtcttgctgctggtgcgttgagtgttgctgcttggccccatggatggcttccttcaccatctcctcacttactggccagtcctggggtcctttatctcctggacaactccagccactgcagcagcagcttctgcagtgggaccaattactttgttggctgcggggactgcttcaccctggtctgcatgggtgccgcgctggacgggcacatctccaaggaggccgagtccgggagatctcggtagccctttgctgtgccctgtgcttcgtgatagatctcagcatggtgaccgatggcggaatgtacgtctttcagcttttcgactattactccgcatccggaacaacactgctctggcaggccttttgggaatgtgtagtggtggcatgggtttacggggctgaccgcttcatggacgacatcgcctgtatgatcggttattag

SEQ ID NO: 241751 - DNA, 339 bp, Artificial Sequence
  Description of Artificial Sequence: Synthetic coding sequence
tgattcaggcatgaagactgcgctaatgcctctctggccaacttaacctgcgatcaactggctgataggagatcccctgtgatcgaattctgggagaataaggtactaaggctatcagggggacttgaagtgccaggtgccctgaactgggaagttacactgtgcttattagcctgttgggtcctcgtatacttttgcgtctggaagggcgtcaaatctacgggtaaagtgcctttggaggcctgctctggagaaggcggtagtgctcttggcgcaggttgcttatgtcaagcgcacttatggcagcgagaggtgacccggcagtccctcgccttgtag

SEQ ID NO: 241752 - DNA, 1563 bp, Artificial Sequence
  Description of Artificial Sequence: Synthetic coding sequence
atgaaagctggcagcataaatgtgtggaatatttgcccattgttcaaaggcctaggatatgcttcgatggtgattgttttctattgcaatacatactacatcatggtacttgcatggggattctattacctggtgaagagcttcaccactacattgccatgggccacctgcgggcacacatggaataccccggattgtgtagaaatcttcagacacgaggactgcgccaacgcctctctggccaatctaacttgtgaccagctggccgataggcggtccccagtgatcgaattttgggagaataaagtcctcaggctgtccgggggactagaggtccccggagcgttgaattgggaggtgacactctgtctgctcgcctgttgggtcctggtctatttttgcgtctggaaaggcgtgaaatccactggcaagatagtttatttcactgccacgtttccctacgtggtccttgtggtcctgctggtaaggggagtactccttcctggagccttggacggaataatttactacttaaagcctgactggtcaaagctcggttcaccacaagtttggatagacgccggtacccagatttttttctcttatgctattggactcggcgcacttacagccctgggcagttacaatcgcttcaacaataactgttataaggatgctatcatcctggccctgatcaattctgggacctcattcttcgctggtttcgtggtattcagtatcctcggattcatggctgccgaacagggtgtgcacatttccaaggtagccgagtcgggtcctgggttggcctttatcgcataccctcgagcagtgactctgatgccggtggccccactgtgggcagctctgttttttttcatgctgctcctgctgggcctggattctcaattcgttggagtggaagggtttatcacaggcttactggatttgctgccggcttcctattactttcgcttccagcgagaaattagcgtggcactgtgctgtgctctgtgtttcgtcatcgacttgagcatggtcaccgacggtggcatgtacgtcttccagctgtttgattattattccgcatctggaacaaccctcttgtggcaagccttctgggaatgtgtggtcgtggcttgggtttatggggctgacaggtttatggatgacatagcctgcatgatagggtataggccttgcccttggatgaaatggtgttggagctttttcactcccctggtatgtatgggtatcttcatcttcaatgtggtctactacgagccccttgtttataataatacgtatgtgtacccctggtggggcgaggctatgggttgggccttcgccttgtcttccatgctgtgtgtccccctccacctattagggtgtctgcttcgggcaaaagggactatggcggagcgatggcagcacctcacccagccaatctggggccttcaccacctggagtacagggcccaggatgccgatgtgcgcggactgaccactctcacgcctgtgtctgaatcaagtaaagttgtcgtggtcgaatctgtgatgtag

SEQ ID NO: 241753 - DNA, 525 bp, Artificial Sequence
  Description of Artificial Sequence: Synthetic coding sequence
tgaatagacgccggaactcagatcttcttcagctatgctatcgggctgggcgctctgaccgcattgggttcctataacaggttcaataacaattgttacaatggcacctcttttttcgcagggttcgtagtgttctccattctcggattcatggctgcggaacagggagttcatatcagcaaggttgctgagagcgggcctggcctggcattcatagcttaccctcgtgctgtgactttaatgcccgtcgccccactttgggcagccctgtttttcttcatgctgttactgctggggttggatagtcaatttgttggagtggagggattcattacaggtctcctggacttactgcccgcatcgtactactttcggttccaaagagagattagcgtagctctgtgctgtgccctgtgctttgttattgatctgagtatggtaacggacggaggaatgtacgtatttcagttattcgattattatagtgcaagtggcaccaccctgttgtggcaggctttctggtag

SEQ ID NO: 241754 - DNA, 270 bp, Artificial Sequence
  Description of Artificial Sequence: Synthetic coding sequence
gggaggcaccaccctggctctcatcagcagtgggatcaactgttatgttggctgcggggtttattacatcccggattgcatggatgccgggctggacgagcccatctccagggcggaagagtccgggctggaccaggcctacacaggctccccgcaggctgtcatgcagacgcttcgggacctactctggggtgccctgtcttgcttcatgcagtggccgcttggtctcggcagccgggagtggagggctttatcaccgggctgctttag

SEQ ID NO: 241755 - DNA, 1863 bp, Artificial Sequence
  Description of Artificial Sequence: Synthetic coding sequence
atgagcaaaagcaagtgctctgttgggctcatgtcttcggtagtggcccctgcaaaggagccaaacgccgtcggcccaaaggaggtggaactgatcctagtaaaagaacagaatggggtgcagctgacaagcagcactctgaccaatcccagacagtcacctgtagaagctcaggacagagagacatggggcaaaaaaattgactttttgttgagtgttattggtttcgcagtggatctggccaacgtctggaggtttccttacctttgttacaagaacggaggaggcgcatttctggtcccctacctcttgtttatggtaatcgcaggtatgccccttttctatatggaattggctctcggccagttcaacagggaaggcgctgcaggcgtgtggaaaatatgtcccatactcaagggggtcgggtttactgtaatccttatctctctctatgtggggttcttctataacgtaataattgcttgggcattacactatctgttcagctcttttacaacagagcttccttggatccactgtaacaacagctggaactctccaaattgcagtgacgcccacccgggagactcctcgggcgattcaagcggacttaatgacacctttggaacgaccccagccgctgaatattttgagaggggtgtgcttcacctacaccaaagccacgggatcgacgatcttgggccacctaggtggcaactgactgcctgcctggtcctcgtaatcgtcctcctgtacttttcactgtggaaaggtgtgaagacgtctgggaaagtcgtgtggattaccgctaccatgccctatgtggttctaacagcccttctgttgaggggggttactctgcctggggctatcgatggaattcgggcttacctgtccgtagatttttatcggttgtgtgaggccagcgtttggatcgacgccgcaactcaagtgtgcttttccctgggtgttggattcggcgtcctcatcgccttcagcagttataacaagtttaccaataactgctatagagacgccattgtcaccacatcaatcaatagccttactagcttcagctccggcttcgtagtgttctcctttctgggatacatggcacagaaacatagcgtccctatcggagacgtggcgaaagatgggcctggactaattttcattatataccctgaggctattgcaaccctgccgctgagctctgcctgggccgtggtcttttttattatgcttctgaccttaggcattgattctgccatgggagggatggaaagcgtcattacaggcctaatcgacgaattccaactgctgcaccgacaccgagagctatttacattgtttatcgtcctggcgacatttttgttaagcctgttttgtgtgactaatggcggaatctatgtctttaccctcttggaccattttgctgctggaacatcaatcctatttggcgtcctcattgaggccatcggcgtggcctggttctatggcgtaggccagttcagtgacgacattcaacagatgacaggtcagcgaccttcgctgtactggcgcctttgttggaagttggtcagtccctgcttcctcctgtttgtcgtagtcgtgtccattgtcacttttcggcctcctcattatggtgcctacattttccccgactgggctaacgcactaggctgggtaattgctacgagtagcatggcaatggtgccgatctacgccgcatacaagttctgttctctgcccggtagctttagagaaaagctggcgtacgcaatagcgcctgaaaaagaccgggaactggtggaccgcggtgaggtcaggcaatttacactccgccactggctgaaagtgtag

SEQ ID NO: 241756 - DNA, 1863 bp, Artificial Sequence
  Description of Artificial Sequence: Synthetic coding sequence
atgtctaaatctaagtgctctgtgggactgatgagctctgtagtggcgcctgccaaagagccaaacgccgtcgggccaaaagaggtggaacttattctggtaaaagaacagaatggagtccaacttacctcctctaccctgacaaacccaaggcagtctccagtcgaggcacaagatagggaaacatgggggaaaaaaattgacttcctgctgagcgtcataggcttcgctgtggacctggccaatgtctggcgttttccctacctgtgttacaaaaatggcggaggcgcttttctcgtcccttacctcttgttcatggtcatcgccggaatgcccctcttctacatggagttggccctcggacagttcaaccgcgaaggggctgctggggtgtggaagatttgccccatcttaaagggagtgggttttaccgtcatcctcatcagtctctacgtgggtttcttttataatgtgatcatcgcatgggctttacattatctcttttccagcttcactactgaattgccttggattcattgtaacaattcttggaactctccaaactgcagtgatgctcatccgggagattcaagcggggattccagtggcttgaatgatacttttgggacaacgcccgctgccgagtacttcgaaaggggtgtccttcacctgcaccagagtcacgggatcgatgatctaggccctccgcgatggcagttgacagcatgtctcgtactcgtgattgttttgctgtacttctctctgtggaaaggcgtgaagaccagcggaaaggtcgtttggattaccgccactatgccttatgtggtgctcaccgcgctgctccttcgtggtgtgacgctgccaggtgccattgatggcattcgtgcctacctctctgtcgacttctacagactttgcgaagcctcggtgtggatcgatgccgctacgcaggtgtgtttttccctcggcgtcggcttcggggttctgatcgcatttagttcctataataaattcaccaacaattgctaccgcgacgctattgtcactacgtccatcaacagcctgacgagctttagttcaggatttgtggtctttagttttctcggatacatggcacaaaaacattcagtgccaataggcgacgtcgctaaggatgggcctggcctgattttcataatctatccagaggccatcgctaccctcccgctaagttcagcttgggccgtggtgttttttattatgctgttaactttgggcattgacagcgccatggggggaatggaaagcgtaatcactggactcatagatgagttccagcttctccaccgacatagggaattgtttacattgttcattgtactagctacattcctactgagtctgttctgtgtgactaatgggggtatctatgtgttcaccctactagaccactttgctgctgggacaagtatcctcttcggtgtgttaattgaggcgataggggtcgcttggttttacggtgtgggacagttctccgatgacattcagcagatgacgggtcagaggccatccctgtattggcgactctgttggaagctcgtgtctccctgtttcctgctgttcgtcgtggttgtgagcatcgtgacattccggcctcctcattacggcgcttatatcttccctgactgggcgaacgctctcggctgggtgatcgccacttcctcaatggcaatggttcccatctacgctgcatataagttctgctccttaccaggcagtttcagggaaaaactcgcctacgcaatcgcacctgagaaggacagagagcttgtggacagaggggaggtgcgccagtttaccttgcgccattggctgaaagtctag

SEQ ID NO: 241757 - DNA, 1800 bp, Artificial Sequence
  Description of Artificial Sequence: Synthetic coding sequence
atggctaccaatggatctaaagtcgcggacgggcagatctcgactgaagtatcagaggcacctgtggcaaatgacaagcccaaaaccttggtcgtgaaggtgcagaagaaggccgctgacctccctgaccgcgatacctggaaaggcaggttcgatttcttaatgtcctgtgtgggctatgcaattggcctgggaaacgtttggcgctttccttacttgtgtggcaagaacggcggaggagcattcctaattccctatttcctgaccttaatttttgctggggtgccattgttcctgctggaatgttcccttggccagtacacctcaatcgggggactgggagtttggaagctagctcccatgttcaagggcgttggacttgctgcagctgtgctgagtttctggctgaacatctattatattgttattattagctgggcaatctactatctgtacaacagctttacaacaaccctcccctggaaacagtgtgacaacccctggaataccgaccggtgcttttctaactacagcatggtcaataccaccaacatgacttctgcagtggtcgagttttgggagagaaacatgcatcagatgacagacggtctggataagcctggtcagatccgctggcctctggcaattaccctcgcaatcgcgtggatcctcgtatacttctgcatctggaagggggtcggatggaccggtaaagttgtgtatttcagcgcaacttatccctacatcatgttaatcatcctctttttccggggagtcacgctgcctggagctaaagagggcatactgttctacatcacgccgaatttcagaaagttatcagattcagaagtgtggcttgacgctgcaacacagatatttttctcctatggcctcggccttggcagtctgatcgctttagggagctataactctttccacaataatgtttacagagattctatcattgtttgctgtatcaacagctgcacttcgatgttcgccggatttgtcatattttccattgtgggcttcatggctcacgtaaccaagcggagcattgcagatgtggccgcttcgggtccaggtcttgccttccttgcctatccagaagcagttactcagttacctatatctcccctatgggcaattctcttcttcagtatgcttctgatgctaggcatcgattctcaattttgcacagttgaagggtttataacagctctcgtcgacgagtacccaaggctgttacggaatcggagggagctctttatcgcagcagtctgtatcatatcgtacctaattggtctgtctaatattacccaagggggaatctacgtctttaagctcttcgactactacagcgcatccggaatgtccctgctattcctggtcttcttcgagtgtgtgagcataagctggttctatggggtcaaccggttctacgacaacatccaggagatggtgggcagcagaccttgtatatggtggaaattgtgctggagtttctttaccccaatcatcgtggccggagtattcattttttcagctgtgcagatgacacccctcactatgggcaattacgtttttccaaaatgggggcagggtgtgggttggctaatggctctctctagtatggttctgataccgggttatatggcttatatgttcctgaccttgaagggtagtctgaagcagaggatccaggtcatggttcagcctagcgaggacatcgtgagacctgaaaacggccctgagcagcctcaagccggatcctctactagcaaggaggcctatatctag

SEQ ID NO: 241758 - DNA, 120 bp, Artificial Sequence
  Description of Artificial Sequence: Synthetic coding sequence
atggctaccaatggatcaaaggtagcggatggccaaattagtaccgaggtcagtgaggctcccgtggctaatgataaaccaaagaccctggtggtgaaagtgcagaaaaaggccgcatag

SEQ ID NO: 241759 - DNA, 1266 bp, Artificial Sequence
  Description of Artificial Sequence: Synthetic coding sequence
atggttaataccaccaacatgacaagtgccgtggttgaattctgggaaagaaacatgcatcagatgactgatggtctggacaagcctggtcagatccgatggcccctggcaatcacactggcaattgcttggatcctggtgtacttctgtatatggaaaggtgtcggttggaccggtaaggtcgtctatttctctgccacctacccctatattatgctgattattcttttcttcagaggagttacactccccggtgctaaagaggggatcctgttctatatcacccccaactttagaaagctgtccgatagcgaggtatggttggacgcagccacgcaaatcttcttttcttatgggctgggactgggttcactgatcgccctggggagctataacagttttcataacaatgtctatagggattcgattatcgtgtgctgtatcaatagctgtacctcaatgttcgccggtttcgttatattcagtattgtgggctttatggctcatgtgaccaagcggtccatcgccgacgtggcagcctccggacctgggctggctttcctggcctaccctgaggccgtgactcaactaccaatctcaccactctgggcaattctgttctttagcatgctgctgatgctcgggatagattcccagttctgtacagtggagggtttcattactgcactcgtggatgaataccccaggctgcttcgcaaccgcagggaattgttcatcgctgcagtctgtattattagctatttgatcggcttgtcaaatatcacacaggggggtatctacgtcttcaaactgttcgactattatagcgcctccgggatgtcactgctctttttggttttttttgaatgcgtctcgattagttggttctacggcgttaacagattctacgataatatccaggagatggtgggcagtaggccctgtatctggtggaagctttgctggtccttctttacgcccatcatagtagccggtgtgtttatttttagcgccgtgcagatgactcccttaacaatgggtaactacgtcttccccaagtggggacagggcgttggctggcttatggcgcttagtagcatggtgctgataccagggtatatggcatatatgttcctgaccctcaaaggcagcttaaaacaaaggatacaggtaatggtgcagcctagtgaagacattgtgcgtcctgagaacggccctgaacaaccccaggccggaagcagcaccagcaaggaggcttatatctag

SEQ ID NO: 241760 - DNA, 1899 bp, Artificial Sequence
  Description of Artificial Sequence: Synthetic coding sequence
atgactgcggagaaggctctgcccctgggtaatggcaaggctgcagaggaggctcgtgagagcgaagccccaggcggagggtgtagttcaggaggagcagctcctgcacgacaccctagagttaagcgtgacaaagccgttcatgaaagggggcactggaacaataaggtcgagtttgtgctctccgttgccggagaaattatcggccttggcaatgtgtggagattcccctacctgtgttacaagaatggaggaggagccttcctcatcccttatgtggtgttcttcatatgctgcgggattcctgttttctttttagagaccgcccttgggcagttcaccagcgagggcggtataacatgttggcgcaaggtatgccctctctttgaagggatcggttacgccactcaggtgatcgaggctcatctaaacgtctactacattattatactcgcctgggctatcttctatctgtcgaattgctttaccacagaactcccttgggcaacttgcggacatgaatggaacactgagaactgtgttgaatttcaaaagctgaacgtttcaaactactcacacgtatccctgcagaatgcgacaagtcccgtcatggagttttgggaacatagggtgctcgccattagtgacgggatcgagcacattgggaatctgcgctgggagctggcactgtgcctcctggctgcttggacaatctgttacttttgtatttggaaaggcaccaagtctaccggcaaagtagtgtatgtaactgcaacgtttccgtacatcatgcttctcatcctattgattaggggggtgactttgcccggagcgagtgagggcattaagttttacctctatccagatttgtcgcgcctaagcgatcctcaggtgtgggtggacgccggtacacagattttcttctcctacgcgatttgtcttggctgcctgacagctctgggaagttacaacaactataataataactgctacagggactgcattatgttgtgctgcctgaacagcggaacctcatttgtggctggtttcgcgattttctcagtcctgggtttcatggcatacgaacagggggtgcctatcgccgaggtggccgagagcggcccaggcttggccttcatcgcataccccaaggctgtgaccatgatgcccctctcgccattgtgggccacactgttctttatgatgcttatctttttggggttagacagccaattcgtgtgcgtggagagtctagtcactgcggtggtcgacatgtaccctaaggtgttccggagaggctatagacgggaactgctcatcctcgcccttagtgtcatttcatattttctcgggctcgtgatgctgacagaaggcggtatgtacatctttcagctctttgactcctacgccgcaagtggcatgtgcctgctatttgtggctattttcgagtgcatctgcatcgggtgggtatatggtagtaataggttctacgataacattgaggacatgatcgggtacagaccaccatcactgattaagtggtgttggatgatcatgacccccggtatttgtgcaggcatctttatcttctttctgatcaaatataaacctctgaagtacaataacatctacacctatcctgcttgggggtacggcatcggctggcttatggctttatctagtatgctttgtataccactttggatctgtatcactgtgtggaagacagagggaaccctccccgaaaagctccagaagcttacaaccccctcaacagacttgaaaatgcggggaaagctgggggtaagccccaggatggtgacggtcaatgactgtgacgccaagttaaaatcagatggaacgattgcagctatcacagagaaggaaacccacttctag

SEQ ID NO: 241761 - DNA, 627 bp, Artificial Sequence
  Description of Artificial Sequence: Synthetic coding sequence
atgaccgcagaaaaggcattgccgctgggaaacggaaaggccgcagaggaagccagagaatcagaagcccctggtggcggatgctccagcggtggggcagcgccagccaggcatccaagggtcaaaagagataaagccgtccacgagagagggcactggaacaataaagttgaattcgtcctgtctgtcgcgggagaaataattggcttgggcaatgtttggagatttccatacctgtgttataagaatggtgggggagccttcttaataccctatgtggtattctttatctgctgcggcatacctgtgttcttcctcgagaccgccctgggccagttcaccagtgagggaggcattacgtgctggcgtaaagtgtgtcctctgttcgaagggatcggttatgcaactcaggtgattgaggctcaccttaacgtgtattacattatcatactcgcctgggctatcttttacctgagtaactgcttcactacagagcttccatgggcaacttgtggccacgagtggaatacggaaaattgtgtcgagttccagaaattaaatgtaagcaactacagtcacgtaagtctgcaaaatgcgacatcacccgtcatggagttctgggagtag

SEQ ID NO: 241762 - DNA, 2394 bp, Artificial Sequence
  Description of Artificial Sequence: Synthetic coding sequence
atggattgcagcgctcccaaggagatgaataaattacctgcaaatagtccagaagctgcggctgctcagggacaccccgacggtccctgtgcgccaagaactagtcctgagcaggaactgccagccgctgccgctccaccccctcctagggtacccagatcggcatccaccggagctcagactttccaaagcgccgacgcaagggcctgcgaggccgagcggcctggggtaggatcctgcaaattaagctctcctcgggctcaggctgcctcggcggctttgagggatctgagggaggctcaaggggcacaggcctcaccccctcctggatcaagtggaccaggaaacgccctgcactgcaagatccccttcttgcgaggtccagagggagacgcgaatgtgtcagttggaaaaggaactctcgagaggaataacacacccgttgttggctgggtgaacatgtctcagtcaactgtggtgctggccacagatgggatcacctcggtcctacccggatcggtggctaccgttgccacacaggaagacgaacagggcgatgaaaataaggcgaggggtaattggtcctctaaactcgatttcatcctctccatggttggatatgcggtgggtctgggaaacgtttggcgttttccttacctcgctttccagaatggcggaggcgcatttctgatcccttatctgatgatgcttgctttagcagggttgcccatattcttcttagaggtaagcttaggccagtttgcgtcccaaggccctgttagcgtttggaaagcgatcccagccctgcaggggtgcggcatcgcaatgctgattatctcagtgctaatcgcaatctactataatgtaatcatttgctacacccttttttacctgtttgcaagctttgtgagcgtgctgccatggggaagctgcaacaacccctggaacacgcctgaatgtaaagacaagaccaaactgctgttggactcatgcgtcattagtgaccaccctaaaattcagatcaaaaatagcactttctgcatgacagcttatcctaacgtgactatggtgaacttcacaagccaggctaacaagacatttgtgagtggctcagaggaatacttcaaatacttcgtcctaaaaatcagcgctgggatagagtaccctggagaaattaggtggcccctggccctctgcttgtttctggcatgggttatcgtgtacgccagccttgcaaaaggcattaagacatctgggaaggtagtgtattttactgcaacctttccatacgtggtgctggtgattttgctaattaggggcgttacactgcctggcgcaggcgcaggcatctggtactttatcacgcccaaatgggagaagttaactgacgcgacagtctggaaagatgctgcaacacagatttttttcagtctgtctgcggcttggggtggcctgattacgttgagctcatataataagtttcataacaattgctacagagatacccttattgtgacatgtaccaactcagctacctccattttcgcaggcttcgtcattttttctgtgattgggttcatggccaacgagcgtaaggtcaacattgagaatgtcgcagaccagggccctggaatcgcgttcgtcgtgtatcccgaggcactcacacgcttgcccctgagtccgttttgggccattatattttttctaatgttgcttacactgggcctggacaccatgtttgcaacgattgagacaatcgtgacgtccattagcgatgagttccccaaatacctacgaacccacaagccagtgttcaccctcgggtgctgtatctgtttctttatcatgggtttcccaatgattacccagggtggcatatacatgttccagttagtggatacatatgccgcatcctacgctctggtgatcatcgccattttcgagcttgtcggaatttcttatgtctatgggctccagagattctgcgaggacatcgagatgatgataggctttcaacccaatattttctggaaagtgtgctgggcatttgtaactcctaccatcctgactttcatactgtgtttctcattctaccaatgggagccaatgacatacggaagctatcgctaccctaactggtctatggtgctcgggtggctgatgctggcatgttcggttatctggatcccgataatgtttgtgatcaaaatgcatctcgcccctggacgctttatcgagaggctcaagctggtatgttctccccagccagactggggcccattccttgcacaacacagaggggagaggtacaaaaacatgattgaccctttaggcacctccagcctaggcctgaagctcccagtcaaggacctcgagctggggactcaatgctag

SEQ ID NO: 241763 - DNA, 1959 bp, Artificial Sequence
  Description of Artificial Sequence: Synthetic coding sequence
atgagcggcggagacaccagagctgcgatagccaggcctaggatggccgctgcccatggtcccgtcgcaccatctagccccgaacagaacggagcagtaccttccgaggccactaaacgggaccagaatctcaagcggggtaactggggcaaccagatcgaatttgtgttgacaagtgttgggtatgccgtgggtctgggcaacgtgtggaggtttccctatttgtgttatcggaacggtggtggggcttttatgttcccatactttattatgcttatcttttgtgggataccactgttttttatggaactgagcttcggtcagttcgccagtcaggggtgtttgggagtttggaggatttctcccatgtttaaaggagttggttacggcatgatggtggtctctacctacatcggaatctactacaacgttgtgatctgcattgccttttattacttcttctccagcatgacgcacgtcctgccctgggcttactgtaataacccatggaacacccacgactgtgctggcgtcctcgacgcttctaacctgactaacggttcacgcccagccgctttaccttctaatctgtcccatcttctgaaccactcactgcagagaacctcgccctcagaagaatattggagactatacgttcttaagctttccgacgacatcggcaacttcggggaggtgagattacccctgctgggttgtcttggggtgtcctggctcgtcgtctttctgtgtttgatcagaggtgtaaaatcctccggtaaggtggtgtacttcaccgctacattcccttatgtggttctgaccatactgtttgtgcgcggtgttaccctggagggtgcctttgatgggattatgtattatctgaccccacagtgggataaaattctcgaagcgaaggtgtggggtgatgcagcctctcaaattttctactctctgggttgcgcctgggggggtctgattaccatggctagttataataaattccataataactgttatcgggatagcgtgataatctctattacgaactgtgcaaccagcgtctacgctggcttcgtgatcttttccatattgggcttcatggcaaatcaccttggcgttgacgtttctagagttgccgatcatggccctggcttggctttcgtagcttacccagaggcgctaacactgctgcccatttccccactttggtccctgctctttttctttatgttaatcctgttgggtctgggaacacaattctgcctgctggaaacgctggtcactgcgattgtcgacgaggtgggaaatgagtggatactgcagaagaagacgtatgtcacactcggagtggcggtggccggttttctactggggattcccttaacttctcaggccggaatttactggctgctcctgatggacaactatgcagcatccttctccctggtggtgatctcatgcattatgtgtgtggcaatcatgtatatctacggccatcgaaactatttccaagacattcagatgatgctgggttttccaccgcctctctttttccaaatttgttggcggttcgtttctccagcgatcattttcttcattctagtctttactgttattcagtatcagcccatcacttataaccactatcagtacccaggctgggcagttgcaatcggatttctgatggctctgagttctgtgctctgcatccctctttatgccatgttccgcctttgccggacagatggggacactctcctccaacggctaaaaaatgccacaaagccatccagggactggggaccagccctgctggaacacagaaccggtcggtatgcacccacaattgcaccctctccggaggatgggtttgaggtccagccccttcaccccgataaagcccagattcccatcgtaggatctaatggatcttcccggcttcaagactcccgtatttag

SEQ ID NO: 241764 - DNA, 2121 bp, Artificial Sequence
  Description of Artificial Sequence: Synthetic coding sequence
atgagcggaggagatacacgcgcagctatagccaggccccgaatggccgcagcccacggtcctgtggccccttcttctcccgaacaggtgacacttctgccagtgcaacggtcatttttcttgcccccattctcaggagccaccccctccacgagcctggccgagtccgttcttaaggtctggcatggagcatataactccggcttgctgccccagctcatggcccagcacagcctggccatggcccaaaacggcgcagtgccttcggaggccacaaaaagagatcagaatctgaagcggggaaattggggtaatcaaattgaatttgttctaacttccgtcggttacgcggtcggactggggaacgtctggcgctttccctacctgtgttacaggaacggcggaggggcattcatgttcccatacttcataatgctgatcttttgcgggatcccgctgttttttatggagttgagcttcggacagttcgcttctcagggctgcctgggggtatggagaatctccccaatgttcaaaggcgttggctacggaatgatggttgtcagtacatacattggcatctactacaacgtagtgatttgcattgcattctactattttttcagctcaatgacccacgtcctgccatgggcatactgtaataacccatggaacactcacgattgtgccggtgttctagacgcttctaaccttacgaacggtagccggcctgcagccctccccagtaatctgtcacatctgctaaaccactcactgcagcgtacaagtccctccgaggagtactggcgcctgtacgttcttaagctttccgacgacataggcaactttggagaggtgcgccttcctcttctaggctgtctcggcgtatcctggctcgtcgtcttcctgtgtcttataaggggagtgaagagctcgggcaaggtggtgtattttaccgctacatttccatacgttgtgcttactatcctctttgtccgcggagtcaccctggagggcgctttcgacggcatcatgtattatttgaccccccagtgggacaagatcctggaggcgaaagtgtggggcgatgctgcatcccagatattttattccctgggatgcgcctggggcggtctaattacaatggcttcatataacaagtttcataacaattgctatcgggactcagttatcatctccatcaccaactgcgcaacatccgtttatgcgggattcgtgatcttctccattttggggttcatggcaaaccatttaggcgtggacgtcagcagggtggctgaccacgggccaggattggctttcgtggcctatccagaggctctcacactactgcctatatcccccctctggagtctgttattcttctttatgctgattctgcttggtctcggcacacaattctgcctgctggagaccttggtgaccgcaatcgtcgacgaggtcgggaacgaatggattctccagaagaagacctatgtgaccctaggtgtcgctgtcgccggattcttgctggggataccacttacctctcaggcaggaatatactggctgctcttaatggacaattacgcagcgtccttttctctcgttgtcatctcctgcattatgtgtgtggcaatcatgtatatctacgggcacaggaactatttccaggacatccagatgatgttgggctttccaccaccgctcttctttcagatctgctggagattcgtgtcccccgcaattatttttttcattttagtgtttactgtaattcagtaccaaccgatcacatataaccactatcagtaccccggatgggcagtggccatcggctttctcatggccctcagcagcgtactgtgcattcctctgtatgccatgttccgcctctgtcgtaccgacggagacaccctgttgcagcgactgaagaacgcaaccaagccaagtcgggactggggtcctgccctcctggagcataggacggggcgatatgccccaacgattgcgccttcccctgaggatggatttgaagtgcaacccctgcaccctgataaagctcagatcccgatagtagggtccaacgggagttctcgccttcaagactcacggatatag

SEQ ID NO: 241765 - DNA, 1725 bp, Artificial Sequence
  Description of Artificial Sequence: Synthetic coding sequence
atgtttccttacttcattatgttaatcttttgcgggatcccattattcttcatggaacttagcttcgggcagtttgcgagccagggttgtctgggagtgtggcgaatttccccaatgttcaagggggttggatatgggatgatggttgtgtccacttatataggcatctattacaacgtagtgatctgcatcgcattctattacttctttagttcaatgacccatgtgctaccatgggcctactgtaataatccctggaatacccatgattgcgccggagtgctagatgcatcgaatctgaccaatggcagtcgcccagccgctctgcccagcaatttgagccacctactgaaccactccctccagagaacctcccctagcgaggagtattggcggctatacgtcctaaaactttccgacgacatcggaaacttcggagaagtgagactgcccttgctgggatgcttgggcgtttcttggctagtggtttttctgtgcctgatacggggtgtgaagtcctcaggtaaagtggtgtacttcacagccacatttccgtatgtagtgctcactattctgtttgtgcggggagtcacgctagagggagcgttcgatggcatcatgtactatctgacaccacaatgggataaaatccttgaggccaaggtgtggggcgatgctgcctcccagatattctattctctgggatgcgcttggggcggtttgattactatggcctcttacaacaagtttcataataattgctatcgcgattctgttatcatctcgatcacgaattgcgccacctcggtgtatgctgggttcgtgatatttagtatccttggatttatggccaaccatctcggcgtggatgtgtcacgggtcgccgaccatggaccaggccttgcatttgtggcctaccccgaggctctgaccctgttgcctatctccccgctctggtctctgctgtttttttttatgttgatcttactcggactgggcacgcagttctgtctcctcgaaactcttgtgaccgctatagttgatgaggtgggaaacgaatggattctccagaaaaaaacttacgtgaccctaggagtcgccgttgccggattccttctcggtattccgctgacctctcaggccggaatctattggcttctcctgatggacaattatgccgcttctttctctcttgtagtgatcagttgcattatgtgcgtcgccatcatgtacatatacgggcaccggaactatttccaggatatccaaatgatgctgggcttcccacctccactgttcttccagatttgttggaggttcgtctcccccgcaattattttcctgcaggctcaggtgcacagacggctaccacaaaatccactgcatttcgcttctctgcccgagcggaatgttttgttgcatcagttaccccagcgcggaggtgtcccagagcatgacccccctacgccaccgtcacccgcacggacctatggaccccaggtgcgcgttcgcgaggtccctagggctcgacgtcaacgatcacctaatcctgcgcctttgtgggcccctccatctcctaaaccacatccctgcagtgcagccggaccactgggatgggactgcccttttagaaactgccagtccttggctctgtccagtgcaaggctgttggcagattccgacgccggtgggcctgagacacgccaatgggagcctgggccatag

SEQ ID NO: 241766 - DNA, 1902 bp, Artificial Sequence
  Description of Artificial Sequence: Synthetic coding sequence
atggtggggaagggcgctaagggcatgttgaatggggctgtgcccagcgaggccacaaagcgtgatcagaatctgaaaagggggaactggggtaatcagattgagttcgtgctgacatcagtcgggtacgccgttggcctcgggaatgtttggagatttccctatctgtgttaccgcaatggtggaggggcattcatgtttccctactttataatgctaatcttctgcggaatccccctattttttatggaactgagcttcgggcagttcgcatcccaggggtgcctaggagtatggcggataagtcccatgttcaaaggcgtgggatacggaatgatggtggtcagcacctatatcggcatttattataacgtggtaatatgcattgccttctactattttttttctagtatgacacacgttctgccctgggcctactgcaataacccatggaacacccatgactgtgcaggagtgttggatgcctcaaatcttaccaatggatcccgcccagcagcgttgcccagcaacctgtcacacctgctcaaccattctttacagaggactagcccctctgaggagtactggagactgtacgtgctcaagctgtcagacgacattggcaacttcggcgaagtgagactgccactactcggctgtctgggcgtgtcatggctggtggtgtttctgtgcctgattcgaggcgtcaagtcctcaggtaaggttgtgtatttcactgccacattcccttatgttgtgctgaccattctgtttgtgcggggagtcacacttgaaggagcctttgatggtattatgtactatttgacaccgcaatgggacaaaatcttagaggccaaagtttggggcgatgccgcatcccagatcttctactccctcggttgtgcctggggcggactgattactatggcctcatataacaaattccataacaactgctatagggatagtgttatcatatcaatcactaactgtgccacaagcgtatacgccggttttgttatattttccatcctggggttcatggcaaatcacctgggggtggacgtgtcccgggtggccgaccacggccctggtctagcattcgtggcgtacccggaggctctcacgctcctgcccatctctcccctttggagtctgctcttcttctttatgcttattctcctgggcctgggaacccagttttgcctcctagagactctggtaacagctatcgtagacgaagtagggaacgaatggatcctccagaaaaagacctacgtaacactcggggtcgccgtagccggattcctgctggggataccattgacttcccaggccggaatttattggcttctgctgatggataattacgccgcttcttttagcctcgtggtcatcagctgtatcatgtgcgtggctatcatgtatatttatggccacaggaattatttccaggacattcagatgatgctgggcttcccccctccactgttttttcaaatctgctggaggttcgtctctcctgcaatcatcttctttattctggtcttcactgtgatccaatatcaacccatcacctataaccactatcagtaccccggatgggccgttgccattggattcctcatggctctgtccagcgttctatgcatccctctctacgctatgttccggttgtgtcgaacagatggagatacactgctacaacgactcaaaaatgccaccaaacctagtagagactgggggccagctctgctggagcacaggaccgggaggtatgcgccaactatcgccccatcccccgaggacggttttgaagtccagccattgcatccagacaaggcccagattccgatcgtcgggtctaacggctcatctaggcttcaggactcccgtatatag

SEQ ID NO: 241767 - DNA, 1569 bp, Artificial Sequence
  Description of Artificial Sequence: Synthetic coding sequence
atgatggtggtttcaacgtacattggaatttattataacgtggtcatttgtatagccttctactactttttctctagcatgactcatgtcctgccatgggcctactgcaataacccttggaatactcacgactgcgccggagtgctcgacgcctctaatttgactaatgggagcagacccgcagccctgcccagtaacttatcacatcttttgaaccacagcctgcaaaggacaagcccatccgaagaatactggcggctctacgtcctaaagctttctgacgacataggcaatttcggcgaagtaaggctgcctctgcttggctgtctgggcgtcagttggctcgtggtgttcctttgcttgattaggggtgtgaagtcctcaggcaaggtggtgtattttactgccacctttccgtacgtcgtgctgactatcctcttcgtgagaggtgtgaccttggaaggcgcttttgatggcatcatgtactacttgactccccagtgggataagatcctagaggctaaggtttggggtgacgctgctagccagatcttttactccttaggatgtgcctggggcggactgatcaccatggcctcctataacaagttccataataactgctaccgcgattcagttattatcagcatcacgaattgtgccactagcgtgtatgccggtttcgtgatcttctccattctgggatttatggccaaccatctgggggtagatgtttctagagtcgcagatcatgggcctgggctggcattcgtggcttatcccgaggccctaaccctgctgcctatttccccattgtggtcattgttgtttttcttcatgctgatcttactcggtctgggaactcagttctgtttacttgagactctcgtcaccgcgatcgtagacgaagtaggtaatgagtggatactgcaaaaaaagacatatgtgactcttggggtggctgttgctgggttcttactgggcattcccctcactagtcaggctgggatctattggctgttattgatggataactacgccgcttccttttccctcgtggtgatctcatgtatcatgtgcgtggccattatgtacatctatggacatcgaaactacttccaggatattcagatgatgttgggattccctcccccactctttttccaaatatgttggagatttgtgagcccggcaataatcttttttattctggtgttcacagtgatccagtaccagccgattacctacaatcactatcagtatccgggttgggccgtcgcaatcgggttcctcatggccttaagcagcgtactgtgtatccctctgtatgccatgttccgactctgtaggactgacggtgacactctgctccagcgcctgaagaatgctacaaaaccatccagggactggggtcccgcattgttggagcacaggacaggcaggtatgccccaacgatcgctcccagcccggaagacgggttcgaggtacagcctctccaccctgacaaagcacaaatccctatcgtagggagtaatggatcgagccgactgcaggactcacgcatatag

SEQ ID NO: 241768 - DNA, 405 bp, Artificial Sequence
  Description of Artificial Sequence: Synthetic coding sequence
atgtctggaggcgatacccgggctgccatagctcgcccacgcatggccgcagcccatggcccagtagctccaagtagtcccgagcagaacggcgcagtgccctccgaagcaacaaagagagatcaaaaccttaagcggggaaactggggaaatcaaattgagttcgtactcacatccgtgggctacgcagtaggcctgggcaatgtatggcgcttcccatacctatgttatcgaaacggcggtggcgcattcatgtttccctactttatcatgttgattttctgtggcatccccctcttttttatggagctgtctttcggacagttcgccagtcagggttgtctgggtgtatggcggatatcccctatgttcaagggagtggggtacgggatgatggtggtatag

SEQ ID NO: 241769 - DNA, 1161 bp, Artificial Sequence
  Description of Artificial Sequence: Synthetic coding sequence
atgtttccctatttcatcatgctcatattttgtggaatccctctgttttttatggaactgtccttcggccagtttgcatcccaaggttgtctcggggtatggcgtatttcacccatgtttaaaggagtaggatatggtatgatggtcgtcagtacctatatcggaatttattataatgtggtgatctgcattgcattttactatttcttctcatctatgacacacgtactgccttgggcatattgcaataacccctggaacacccacgactgcgccggtgtgctggatgcatccaacctcaccaacggctcaagaccagctgcactcccaagtaatctgagccatctcttaaatcattccctacaacgcaccagtccctcagaagagtactggcgcctgtacgtgctcaagttgtccgacgatataggcaattttggcgaagtcagactgcctcttctcggctgcctgggggtctcctggctcgtcgtgtttctttgcctgattcgtggcgtcaaatccagcggtaaggtggtgtacttcactgcaacttttccctacgtagtgctgacgatcctgttcgtccgaggtgtgacactggagggcgctttcgatgggattatgtactacctcacgccgcagtgggataagatcctggaagccaaagtatggggggacgccgcttcacagatattttatagcttgggctgtgcatggggcggactgataactatggctagctacaataagtttcataacaattgttatcgagactctgtgatcatcagtatcacaaattgtgccaccagcgtgtatgccggattcgtcatcttttcaatcctcggctttatggctaaccacctcggagtggacgtgtctagggtggcagatcatggaccaggattagccttcgtcgcgtaccccgaggccctgacactgctgccaattagccctttatggtctctgctatttttttttatgctgatcctgttgggtctgggtactcagttctgtctactggaaactctggtcacagccattgtggacgaggtgggcaacgaatggatactgcagaaaaagacttatgtgactttaggcgtcgccgtggccggtttcctcttgggcatacctctgaccagccaagctagcatcggctgctgctag

SEQ ID NO: 241770 - DNA, 1050 bp, Artificial Sequence
  Description of Artificial Sequence: Synthetic coding sequence
atgggggatatgggagacccacccaagaagaagcggctgatctccctgtgcgttggctgtggaaaccaaattcacgaccagtatatcctgcgggttagtccagacctcgaatggcacgctgcctgcctgaaatgtgctgaatgtaatcaatacctggatgagagctgtacttgtttcgttagagatgggaagacatactgtaaaagggattatatcagactttatggtatcaagtgcgcaaaatgttctatcgggtttagtaaaaacgacttcgtaatgagagctcggtcaaaggtatatcatatcgagtgctttcgctgcgtcgcctgcagcaggcagctcatcccaggagatgaattcgcattgcgggaagacgggttgttctgcagggccgatcatgatgttgttgaacgggcttcactcggtgccggtgacccgctcagtccattacaccctgcacgcccattgcagatggctgcggagcccatcagtgccagacaacccgcacttcgcccacacgtccacaagcagccagagaaaaccactcgcgtaagaaccgttttgaatgaaaagcaactgcacacgctgcgtacatgttacgcagcaaaccccaggcctgacgccctgatgaaggaacaactcgtcgagatgaccggtcttagcccgcgtgtcatccgggtgtggtttcaaaataaacgctgcaaagacaagaaacggtccatcatgatgaagcagcttcagcagcaacagccaaacgacaagaccaacatccagggaatgactggcacaccaatggttgctgcaagtcctgaaagacacgatggtggcctacaggctaatcccgtcgaagtccagagttatcagcctccctggaaggtactctctgactttgctctccagtctgatatcgaccagcccgcatttcaacagcttgtgaactttagtgaaggcggtcctggatccaattctacaggatctgaggtggcttccatgtccagtcagttgccggataccccaaatagtatggttgctagcccaatcgaagcttag

SEQ ID NO: 241771 - DNA, 2283 bp, Artificial Sequence
  Description of Artificial Sequence: Synthetic coding sequence
atgctgagtgatgaccacgtcaacgagattatcatacaggtggaaaatgtgtcaagtggggtgcagtctcaccctagctctaaccagatttttcaggaaaaagtgctgttagactcaagtatcaacatggtcctgtccatctccgatattgatgtaatcgatagccagacagtttccaaaaggaacgaccagaaggggaaccaagttctgcgcttttccactagtctcaatgagtctatgtctcaaaccctgcactccctcgaatgcatgggtatcgacactcctgggtcttctcacgagactgtgcaggggcagaaactaattgctagtttgatccctatgacttcaagggacagaattaaggctattaggaatcagcctcgaacaatggaggagaagagaaatctgagaaaaatcgtggataaggagaaatcaaaacaaacccaccggatactgcagctgaactgttgcattcagtgtctgaactcgatctcaagggcataccgccgttctaaaaattcgctctccgagattcttaatagcatttccttatggcagaagacgttgaagattattggcggaaaattcggtacctccgtgctcagttatttcaacttccttcgctggctgcttaagtttaatatattttccttcattcttaacttctcctttattatcatcccccagttcacagtcgccaaaaagaacaccctgcagtttacaggcctggagttcttcacaggtgttggttacttccgcgacactgtgatgtattatggtttctataccaattctactattcagcacggcaactccggcgcttcctataacatgcagctggcatatatttttacaattggcgcatgcctcactacctgtttcttctccctgttgttcagtatggccaagtactttcgcaataacttcataaaccctcacatctactcaggcggaataacgaaactcatcttttgctgggattttactgtcacacacgagaaggcagtaaagctcaaacagaaaaacttatccactgagatcagagagaacctgtccgaactccggcaagaaaactcaaaactgacctttaatcagctgctcactagattttcggcctacatggtggcttgggtcgtgtctacgggggtagctatcgcctgctgtgcggctgtgtattacctggcagagtataatttggaattcctcaagacgcattccaaccctggtgctgtcctgctcctcccattcgtggtctcttgtatcaatctggcagttccttgcatctattcaatgttcaggttggtggagcgatatgaaatgccgagacacgaggtgtatgtgctactcattcgcaatattttcctgaaaattagcataatcggcatcctgtgttactactggctgaacaccgtagcactgtcaggggaagagtgttgggagaccctcataggccaggatatctatcgtctgctccttatggatttcgtatttagtctggtaaacagctttttgggagaatttcttcgtcgcataatcgggatgcagttgatcacctccctgggccttcaggaattcgacatcgcaaggaatgtgttggagctgatatatgcccagactctcgtatggatagggatcttcttctgtcctctcctgccattcatccagatgatcatgcttttcattatgttctacagtaagaacatcagcctcatgatgaatttccagcccccttctaaggcatggcgtgcgtcccagatgatgactttttttatcttcctgctcttttttccctcttttaccggggtgctctgcaccctagctataactatttggaggctcaagccaagtgcagactgcggtccattcagagggttgccactgttcatccactcaatctactcgtggatcgacaccttaagcactcggccaggatacctctgggtggtttggatttaccggaacctgattgggagtgttcactttttcttcattttgaccctgattgttctcatcatcacatacctatactggcagattacagaagggcgtaaaattatgattcgcctcttgcacgaacagatcataaacgaagggaaggacaaaatgtttctgatagaaaaactaatcaaattacaagacatggagaagaaggccaacccatccagcctagttctcgagcgcagagaggtggagcagcaaggttttctccacctcggggagcacgacggaagcctcgatctccgctcacggagaagcgttcaagagggaaacccaagggcttag

SEQ ID NO: 241772 - DNA, 1854 bp, Artificial Sequence
  Description of Artificial Sequence: Synthetic coding sequence
atgctactggccaggatgaatccccaggtccagccggaaaacaacggtgccgacaccggacccgaacagccgttgagggctcgaaagacagccgagctgctggtcgtgaaggagcgaaacggagtgcaatgcctcctcgctccacgcgatggagacgcacagcctagggagacctgggggaaaaagattgacttcctcttaagcgtggtggggttcgcagtggacctggccaatgtgtggagattcccttacctgtgttacaagaatggaggcggagcctttcttataccctacacactgttcctgatcatagccggaatgcccttgttctacatggaattggcgctaggccaatacaatcgggagggcgcagcgaccgtttggaagatttgcccattcttcaagggagtcgggtacgcagtgatccttattgctctctacgttggattctattacaatgttattatcgcatggtcgctttattatttgttcagtagcttcaccctgaatctgccgtggactgactgcggccacacttggaactcccctaattgcaccgatcccaaactcttaaacgggagtgtacttggtaaccataccaaatatagtaaatataagtttactcctgccgcagagttttacgaacgaggagtgctgcatctccacgagtcatctgggatccacgatattggactgccacagtggcagctgctcttatgtcttatggttgtggtcattgtgttatatttttctttgtggaagggcgttaaaacaagtggcaaagttgtgtggataaccgccacacttccctactttgtgttgtttgtccttctggtgcacggcgttacattgcccggagcgtctaatggcattaacgcatacctgcacatcgacttctaccgactcaaggaggctacagtgtggattgacgccgcaacccagatctttttctcacttggcgctggattcggcgtccttattgcttttgccagttacaacaagtttgacaataattgctatcgggatgcactgctcactagctcaataaactgtattactagcttcgtgagcggctttgcaatctttagcatcctgggttatatggcccacgagcataaggttaatattgaggatgtggcgacagaaggcgcaggcctcgtcttcattctttatcccgaggctatttccacactgagtggctccaccttctgggcagtggtcttcttcgtgatgctccttgcactcggtctggactccagcatgggaggaatggaggcggtcattacagggctggccgacgacttccaagtgttaaagagacatcggaaactgtttacttttggtgtgaccttttctacatttctgctggccctgttctgcatcaccaagggaggcatctacgtgctcactctgttggataccttcgcagctggtacctcaattctgttcgctgtgctgatggaggcaattggcgtaagctggttctatggcgtggacagatttagcaatgatatccagcagatgatgggatttagacctggactgtactggcggctctgttggaaattcgtgtcccctgcgtttctcctgttcgtagtggtggtttctatcatcaacttcaagccactgacatatgacgactatatcttcccaccatgggctaattgggtggggtggggtattgccctcagcagcatggtgctggtgcctatctatgtgatctacaagtttttaagcacgcaggggtctctgtgggagcggcttgcttacggtattacccctgagaacgagcaccatctcgtggcccagcgggatatccgccagttccagctgcagcactggctggcaatctag

SEQ ID NO: 241773 - DNA, 1854 bp, Artificial Sequence
  Description of Artificial Sequence: Synthetic coding sequence
atgctcttagctcgcatgaatccccaggtgcaacctgagaataacggtgctgatactggaccagagcagcctctgcgagcacggaaaaccgccgaactgctggtcgtgaaagaaagaaacggagttcagtgcctgctggccccaagagatggcgacgcccagcccagggaaacttggggcaaaaaaattgactttttattgtcagtggtgggctttgccgtggacctcgccaacgtatggaggttcccctacctgtgttataagaatggtggcggtgccttcctgattccatacaccctgtttttaatcattgcaggaatgcctctgttctatatggaattggcactgggtcaatacaaccgggaaggcgctgccactgtctggaagatttgcccttttttcaagggggttggatatgctgtgatccttatagccctatatgtcggattttattacaacgtaatcatagcatggagtttatactacctgttttcatcatttacattaaatctcccttggaccgattgcggtcatacatggaattctccaaactgtacagatcccaaactgttaaacggcagtgttctcggaaatcatacaaagtactcaaaatataagttcacacccgcagcagagttctatgagcgcggagtgctccatctacacgagagcagtggaattcacgatattggtctgcctcagtggcagctactcttgtgcctcatggtggttgtgatcgtgctgtacttctctctgtggaaaggagtaaaaacctcaggaaaagtggtgtggataactgcgaccctgccctatttcgttctgtttgttctcctggtgcatggtgtgacgcttcccggagcatcaaatggaattaatgcttatcttcacatcgacttttatcgtttgaaggaggcgactgtgtggattgacgccgctacacagatttttttttctttaggtgccggattcggcgtactcatcgcctttgcttcctataacaagttcgataataattgttatcgcgacgcacttctcacaagcagcattaactgtattaccagcttcgtttctggttttgcaatcttctcaattctaggctacatggcccacgaacataaagttaacatagaggatgtggcaaccgaaggtgccggtctggtttttatcctctatcctgaggcaatttccaccctgtctggcagtacattctgggcagtggttttctttgtcatgttactcgcactcggactcgacagttccatgggcggtatggaggctgttataaccgggctggctgatgactttcaggtgcttaagcggcatcggaaactctttacgttcggggtgacgttctctacatttttactggccctcttttgtatcaccaagggcggaatttatgtgctcacactgctggatacattcgcagccggaacgtcaattctcttcgccgtgttaatggaagcaattggagtcagctggttctatggcgtcgatcggttcagcaatgacatacaacaaatgatgggatttcgacctgggctctactggaggctgtgctggaagttcgtgagtccagcattcttgctgttcgtggtagtcgtcagtataattaactttaaacccctgacctacgacgattacatcttccccccatgggccaattgggtgggatggggaattgcgctctctagcatggtgctggtgccgatttatgtgatttacaaatttctctctacccaggggtcactctgggaacgtctggcatatgggattactccagagaatgaacaccacttggtagctcagagggatatacgccaatttcaattgcagcactggctagccatctag

SEQ ID NO: 241774 - DNA, 996 bp, Artificial Sequence
  Description of Artificial Sequence: Synthetic coding sequence
atggtggtggtcatcgtgctctacttctccctatggaaaggcgtaaaaacctccgggaaagtctggattgacgcagcgactcaaatttttttcagcctgggcgcagggtttggggtacttattgcttttgcttcctacaataagtttgataataactgctaccgggacgccttactgacctcttccataaactgcatcacttcgttcgtttcaggctttgccatattttcaatattgggatacatggctcacgaacacaaagtgaacatcgaggatgttgcaaccgaaggggctggactggtgttcatcctgtatccagaggccatatcaacactttccggctccactttttgggccgtggtattttttgtaatgctcctggctctcggcctggattcctccatgggtggcatggaagcagttatcaccggattggcagacgactttcaggtgttgaagcggcaccgcaagctcttcacgttcggagtgacttttagtacttttctcctggcattgttttgcattaccaaaggcggaatttacgtgttgaccttattggataccttcgccgcaggtacctcgattctgtttgccgttcttatggaggctattggagtatcctggttttatggagtagaccgattcagcaacgacatccagcaaatgatgggatttcgacccggactctactggcgcctgtgctggaagtttgtctcaccagctttcctgcttttcgtcgtggtagtatccatcataaatttcaagccactgacctacgatgactacatttttcccccttgggctaattgggtggggtggggaatagcactatccagtatggttctggtaccaatatacgtgatctataaattcttgagcactcaaggctctctgtgggagcgccttgcctacggaataaccccggaaaacgaacaccacctggttgcacaaagagatatacgccagtttcagctgcagcactggctcgctatatag

SEQ ID NO: 241775 - DNA, 1893 bp, Artificial Sequence
  Description of Artificial Sequence: Synthetic coding sequence
atggagaccactccattgaattcccagaaacaactttccgcttgtgaggacggcgaggattgccaggagaacggcgtcttgcagaaagtggtgccaacaccaggggacaaggttgagtccggacagatctctaacggatattctgcagtgccaagtccaggggctggggatgacactcgacactccatccctgccacaaccacgacgctggttgcggaactccaccaaggtgaacgagagacatggggcaagaaagtcgacttcctgctgtcagtcatcgggtacgccgtagaccttgggaatgtgtggcggtttccgtacatctgctaccaaaacggtggcggagcatttctgcttccctacacaatcatggctatttttggcggaattcctctcttttacatggaacttgctttaggtcaataccacagaaatggctgtatatcgatttggcgaaaaatttgcccaattttcaagggtattggctacgctatatgcattatcgccttctacattgcgagctactacaataccatcatggcatgggccctctattacctgatctcctcatttaccgaccagctaccctggacttcatgcaaaaacagctggaacactgggaattgtactaattattttagtgaagacaatattacctggactctgcacagtacctctcccgctgaagaattctacaccaggcacgttctgcagattcacagaagtaaaggtctccaagacttaggcggaatcagctggcagttggcgctctgcatcatgctgattttcactgttatttacttctccatctggaaaggcgtcaagacaagtggtaaagttgtatgggtcactgctacgtttccgtacataatattatccgttctcctggtgcggggtgccacgcttccgggagcctggcgaggggtgctattctatctgaaacccaactggcagaagctgctggagactggagtgtggatagatgccgctgctcagatcttcttttcccttggccctgggtttggtgtcctgctagcgtttgcatcatacaacaagttcaataacaactgctatcaggacgccctcgtcacgtctgtcgtgaattgcatgactagcttcgtaagcgggttcgtgattttcaccgttctgggatatatggcagagatgcgcaatgaagacgtgtcagaggtggccaaggacgccggtccctcacttctattcattacgtacgctgaggccattgcaaacatgccggcatctacattttttgccattatattctttctgatgcttatcactctgggcctggattccaccttcgccggactggagggcgtgatcacagctgtgctcgacgagttcccgcacgtgtgggcaaaacggcgagagcggtttgtgttagccgttgtaataacttgcttttttgggtccctcgtcaccctgacgttcggaggcgcatacgtagttaaactgcttgaggagtacgctactggacctgccgtcctgaccgtggcgctgatagaagcggtcgcggtcagctggttctatggtatcacacagttttgtcgcgatgtcaaggaaatgctgggattcagcccgggatggttttggaggatctgttgggtagcaatttctcctttgttcctgctgtttatcatctgtagctttctgatgtcgccaccacagctgcggctttttcagtataactatccgtactggagcatcatcctggggtattgcatcgggacctcgtcttttatctgtatccctacttacatcgcctaccgtcttattataactcctggtacattcaaggaaaggataattaaaagcataacacctgagaccccaacagagattccctgcggcgatattcgcctgaatgcggtgtag

SEQ ID NO: 241776 - DNA, 2019 bp, Artificial Sequence
  Description of Artificial Sequence: Synthetic coding sequence
atgagccagagtagacgcgtgaatcccgatgacagggagttggggggagatccacagatccaagctcctagagaccagcttggttccctggcagacggtcatcagtgtcatttactgacgagtaggatggagacaactccacttaattctcagaagcagctgagcgcatgcgaggacggggaagattgccaggagaatggggttctacagaaggtagttcctactccaggggataaggtcgagagtggtcagatatctaacgggtactctgccgtgccctccccgggtgccggtgacgataccaggcacagtatccccgcaacaactactacactcgtcgccgagcttcatcagggcgagagagaaacctggggcaagaaggtggacttccttttgtctgtgattggctatgccgtcgacctggggaatgtatggcgcttcccttacatctgttatcagaatggagggggtgccttcctgctcccttatactattatggcaatattcggcggtattccccttttttatatggagctcgctctcggccagtatcatcgaaacggctgcattagcatctggcgcaaaatatgccctatttttaagggaatcggatatgccatctgcattattgccttttatattgccagctattacaataccattatggcttgggcactgtactacctaataagcagtttcacagaccagctgccctggacaagctgcaagaacagctggaataccggcaactgtactaactacttcagcgaggataatatcacgtggactcttcacagtacatcacccgcagaagagttctatacaagacacgtcttgcaaatacacagatcgaaaggcttgcaggacctggggggaattagttggcaattggcgctgtgtatcatgttgatcttcacagtgatctatttctctatttggaagggcgtcaagacctccggcaaagtcgtttgggttaccgctacgttcccctatattatcctttccgttttacttgtcaggggggcaacgctccctggcgcttggcgcggagtgctgttctatctcaagccaaactggcagaaactgcttgaaacaggggtgtggatcgacgctgctgcccaaattttcttctctcttggccctggatttggcgttctacttgcgtttgcgtcgtacaacaaatttaataataactgctatcaagacgcgctggtcacatctgtggtcaattgcatgacttctttcgtgtccgggttcgttattttcaccgtgcttggatacatggcggagatgcggaatgaagacgtaagcgaagtggccaaggatgccggaccttcgcttctcttcatcacctacgccgaagccattgccaatatgccagcttcgactttttttgctatcatcttctttctcatgctaattaccctaggcctggacagcacttttgccggtctggaaggcgtcatcacagccgtgttggacgagtttccccacgtgtgggcaaagaggagagagcgctttgtcctcgctgtcgttatcacatgctttttcggttccctcgtgacgctcacgttcggcggagcctacgtggtcaagcttttggaggaatacgctacgggacccgctgtgctgacagtagccttaattgaggctgtggcagtctcctggttttacggaatcacccaattttgccgagatgttaaggagatgctcggcttttccccgggatggttttggcggatatgttgggtcgccatttcacctctattcctcttgttcataatctgctcattcttgatgtcgcctcctcagctgcggctgtttcagtacaactacccttattggagcatcatacttggctactgtatcggcaccagttcttttatttgcatacctacctacatagcctaccgcttaattatcactccgggtacctttaaggaacggatcatcaaatcaatcaccccggagactcctactgagattccttgtggggacattcgccttaacgctgtatag

SEQ ID NO: 241777 - DNA, 1893 bp, Artificial Sequence
  Description of Artificial Sequence: Synthetic coding sequence
atggaaacgacacctttaaattcccagaaacagctgtccgcttgcgaggacggagaagattgtcaggagaatggcgtgctgcaaaaagtggtgcccactcccggagataaagtggagagtgggcagatttccaatggctatagtgcagtgccctcccccggagctggagatgacactaggcacagtattcctgcaacaactaccaccctcgttgcagaattgcaccaaggcgaaagggaaacctgggggaagaaagtggattttctgctctccgtgataggatatgctgtagacctcgggaacgtgtggagatttccctacatctgttatcagaatgggggaggcgcttttcttctgccctacacaatcatggctatattcggaggcatccctttgttctacatggaactcgcattagggcaataccacaggaacggatgcatcagtatatggaggaaaatctgcccaatcttcaaaggcattgggtatgcaatatgtatcatcgcgttttacatcgcatcttactacaacacaattatggcctgggcactgtattacctgatatcatcattcacagaccagcttccctggactagttgcaaaaactcttggaacacaggtaactgtactaattatttttcggaggataacatcacatggaccctgcattcaacgtccccggctgaggaattttacactagacatgtgctgcagatccaccgctcaaaaggcctccaggaccttggcggtatctcttggcagctggctctctgcataatgctcatctttaccgtcatctacttcagcatctggaagggggtaaaaacgagtggtaaggtcgtctgggttaccgccaccttcccatatatcatcctctcggtgctcttggttcgtggggctacattacccggtgcttggcggggtgtcctattctatctcaaacccaactggcagaagttgcttgagacaggggtctggatcgatgccgcagctcagatttttttttcattaggccctggattcggcgtgctgctagcctttgcgtcctataacaaatttaataacaattgctaccaggacgcgctggtgacaagcgtcgtcaactgcatgactagctttgtgtcaggattcgtaatttttactgtgttaggatacatggccgaaatgcggaatgaagacgtttctgaggttgctaaagatgccggtccctctttgctattcatcacatacgcagaagctatcgccaatatgcccgcatctaccttttttgcaatcatcttctttctgatgctgatcactctgggactggacagcacatttgcgggactggagggagttatcactgccgttttagacgaatttccgcatgtgtgggccaaaaggcgggagagatttgtcttggcggtggttattacatgtttcttcgggagtctagtgactctgacctttggcggagcctacgttgtgaaattgctcgaagagtacgctaccgggccagctgtgttgacagtagcgttgatcgaggcagtggccgtcagctggttctatggcatcactcagttttgcagagatgttaaggaaatgcttggcttttcccccggatggttttggcggatctgctgggtggcgatttcaccgctttttctcttgttcattatctgcagctttctaatgtctccaccccagctcagactgtttcagtataactacccctactggtctatcattcttggttattgtatcgggacctctagtttcatttgtataccaacgtatatagcctaccgtctcattatcactcctgggacctttaaggagcggattataaagtcaatcacaccggagactccaaccgagattccatgtggcgacatcagacttaatgcggtgtag

SEQ ID NO: 241778 - DNA, 1863 bp, Artificial Sequence
  Description of Artificial Sequence: Synthetic coding sequence
atggctaccaaagaaaagctgcagtgccttaaagacttccacaaagacatcttgaagccatcgcccggaaaatctcccggtacgcgtccagaggacgaggcggaagggaaacccccacaacgtgaaaagtggagctctaagatcgacttcgttctgtctgtggcaggcggtttcgtcggactcggcaatgtatggcgctttccttatctgtgctacaaaaacgggggaggcgctttcctcattccatatttcatttttcttttcggatccggactgcctgtgtttttcctagagataattatcggccagtacacgtctgaaggcggaattacatgttgggagaagatttgccccctttttagcggcatcgggtacgcctcagtggttattgtgtccttactgaacgtgtactatattgtcatccttgcatgggcaacttattacttgtttcagagtttccagaaagaattgccctgggcccattgtaaccacagctggaacacaccccattgtatggaggacacaatgcgaaagaataaatcagtttggatcacaatctccagtactaatttcacttcaccagtcattgaattctgggagcggaatgtgctgtctctctcccccggtattgaccatcctggttccctaaaatgggaccttgccctgtgcctgttgctagtgtggctagtctgcttcttctgtatttggaaaggagtaaggtcaacaggaaaggtggtgtacttcacggctactttcccatttgccatgctcttggtcctattggtaagagggctgacgctgccgggtgccggtgccggaataaaattctatctttacccagatatcacgaggctcgaggatcctcaggtatggatcgacgctggaactcagatattcttttcctacgccatctgcctgggcgctatgacttctctcggcagctacaataaatacaagtataacagctatagagactgtatgcttctcgggtgcctgaattcaggcacctcgtttgtcagtggtttcgccatcttttccattttaggattcatggctcaggagcagggagtagatattgctgatgtggccgagtccggtccaggcctcgcattcatcgcttaccccaaggcggtgacgatgatgcctctgcccacattctggagtatcttattcttcattatgctgctccttctggggctggactctcagtttgtggaggtcgaggggcagatcaccagcctggtggacctctatccaagcttcctcagaaaaggttatcgaagggagatctttatagccttcgtgtgttccatatcatacttacttggtctaaccatggtgacagaaggcggaatgtacgtgttccagctcttcgactactacgcagcaagtggagtgtgcctcctgtgggtggcattttttgaatgcttcgtgattgcttggatctacggcggagataatctttacgacggcatagaagatatgataggatacagaccaggcccttggatgaaatacagctgggctgttataacaccagtcttgtgcgtaggttgttttatctttagcctggtgaagtatgtgcccctgacttacaacaagacgtacgtttaccccaattgggcaatagggctgggttggagcttagctcttagctcaatgctctgcgtgcccctggtgattgtgattcgactatgccagaccgagggcccttttctggtgagggtgaagtacctgctgacaccgagggagcctaataggtgggcggtcgagagagaaggtgcaaccccctataattctcggacagtgatgaacggagccttggtaaagccaacccacatcatcgtagagacgatgatgtag

SEQ ID NO: 241779 - DNA, 603 bp, Artificial Sequence
  Description of Artificial Sequence: Synthetic coding sequence
atggccactaaggagaaattgcagtgtcttaaagacttccacaaagacattctaaaaccttcccccggaaaatcccccggtaccagaccggaggatgaggccgaaggcaagcctccccagcgggagaaatggagctccaaaattgactttgtcctgtccgtggccggagggtttgtgggactcggcaatgtgtggcggtttccctacctgtgctacaagaatgggggaggggctttcctcataccctatttcatctttcttttcggctcggggttacctgtgttcttcctcgaaattataatcggccaatacaccagtgagggagggatcacttgctgggagaagatttgtccactcttctccggcattggttacgccagtgtggtgatagtgagcctgctgaacgtttactatattgtaatactggcttgggcaacatattacctttttcagtctttccagaaagagttgccttgggcacattgtaaccacagctggaacaccccacactgcatggaggataccatgcggaagaataagtctgtttggatcacaatttcgtctacaaatttcacatctcctgtgatcgagttttgggagtag

SEQ ID NO: 241780 - DNA, 1080 bp, Artificial Sequence
  Description of Artificial Sequence: Synthetic coding sequence
atggcaactaaggagaagcttcagtgtcttaaagattttcataaagacatcttgaagcccagcccaggcaagagtccaggtactcggcctgaggatgaagccgaaggaaaaccccctcagagagaaaagtggagctcaaagatcgacttcgtgctgagtgtggccggtggcttcgtaggactgggtaacgtgtggagattcccttacctctgttacaaaaatggcggtggcgctttcctgattccgtactttattttcttgttcggctccggcctgcccgtgttctttctcgagattatcattgggcagtacaccagtgaggggggtatcacctgctgggaaaagatctgcccacttttcagtggaattggctacgcctcagttgtcattgtttcccttttaaacgtatactacatcgtgattttagcttgggcaacttattacttatttcagagctttcagaaggagcttccgtgggcacattgtaaccactcctggaacaccccacactgtatggaggacactatgagaaagaataaatctgtttggattacaattagttcgacaaactttacctccccggttattgaattctgggagcgcaatgtgcttagcttgtcccccggaattgaccaccccggatccctgaaatgggatctcgctttgtgcctgcttctggtctggctggtgtgctttttctgtatttggaagggagtgcggtccacaggtaaggtggtgtacttcacagcgacgtttccatttgctatgcttctcgtgcttctggtcagagggttaacactccccggagccggagcgggtataaagttctacctctaccctgatatcacccggcttgaggatccccaagtgtggattgatgctggcactcagattttcttttcctacgctatttgcctgggtgctatgacatctttgggcagttacaacaagtataagtacaatagttaccgctcctggcctggattgcattgtcttccaaagtcatgtgataacgacgcagcagcccacattctcgtacacagcttcttttactacgcaagccttgcttggacgggttag

SEQ ID NO: 241781 - DNA, 330 bp, Artificial Sequence
  Description of Artificial Sequence: Synthetic coding sequence
atggcaacaaaggaaaagctgcaatgcctgaaagacttccataaggacatacttaagccctccccaggaaagagcccaggaactaggcctgaggatgaggctgagggaaagcccccacagcgggagaaatggtcctccaagatcgattttgtgctctctgtcgcaggtggatttgtgggcctggggaatgtctggcgctttccttacctatgttataaaaacggaggaggagccttcctaatcccatacttcatatttctctttggatcgggattaccggtcttttttctggagataatcatcggccaatacacctccgaagggggatag

SEQ ID NO: 241782 - DNA, 1863 bp, Artificial Sequence
  Description of Artificial Sequence: Synthetic coding sequence
atggctactaaagaaaagctccaatgtctcaaggacttccataaagacattctgaaaccgagccccggaaaaagcccaggaactaggcccgaagatgaggctgaaggtaagccaccacaaagagagaagtggtcctcaaaaatcgactttgtgctgtccgtagccggaggatttgtggggctggggaatgtttggcgcttcccttacctgtgctacaaaaacggcggaggcgctttcctcatcccatattttatctttctcttcggctcgggcctccccgttttctttttagaaatcatcatcggccaatatacatctgaaggcggaatcacttgttgggaaaagatctgtccactgttttcaggtattgggtatgcttccgtcgtgatcgtcagtctcctgaacgtgtactacattgtgatccttgcatgggctacatactatctgttccagtccttccagaaggagctcccatgggcacactgtaatcactcttggaatactccccattgcatggaggataccatgagaaagaataaatccgtgtggattaccatttcatcgactaactttactagccctgtcatcgaattttgggaacgcaatgttctgagtctgagccccggaatcgaccatcccggttccctcaagtgggatctggctctgtgcctgctactcgtctggctggtatgcttcttttgtatttggaaaggggtgcgatctactggcaaagtcgtttactttacagcgacgtttccgtttgccatgctccttgtgttgctcgtgagaggcctgaccctgcctggggctggggcaggcatcaagttctacctttacccagatattactagactcgaggaccctcaagtgtggattgacgccggtacccagattttcttctcatacgccatttgtttgggtgctatgacttccctcgggtcttacaacaagtacaaatacaactcttacagggactgtatgctgctggggtgtctaaacagcggcactagtttcgtctccggcttcgccatcttttccattttagggtttatggcgcaagagcaaggcgtagatattgcagatgtggctgagtcaggacccggtctcgccttcatcgcttacccaaaagcagtcacaatgatgccattgccaaccttctggagcatattgttcttcatcatgctgctattgcttggattggactcacagtttgtcgaggtcgaaggccaaatcacttccctcgtagatctgtatccttcctttcttagaaagggctatcggagagagattttcatagcgtttgtctgtagcatctcttatctattgggccttacaatggttaccgagggcggaatgtacgtatttcagttgttcgactattacgctgcaagcggcgtctgtctactatgggtggcatttttcgaatgcttcgtcatcgcctggatctacggtggcgataatctctacgacgggatcgaggacatgatcgggtaccgccctgggccatggatgaaatattcttgggcagtgataactccggttctctgtgtaggatgttttattttttccctggtcaagtatgtccccctgacctataataagacctacgtctatcccaattgggcgattggattgggctggtctcttgccttgagctcaatgttgtgcgtccctttagtaattgtgatacggctctgtcagaccgagggaccattcctggtgagagtgaagtatctgctgacaccaagggaaccgaatagatgggctgtggaacgggaaggagccaccccttacaactctcggacggtcatgaatggggctcttgtgaagcccacccatattatcgtagaaacaatgatgtag

SEQ ID NO: 241783 - DNA, 1080 bp, Artificial Sequence
  Description of Artificial Sequence: Synthetic coding sequence
atggccaccaaggagaagttacagtgcctaaaggattttcacaaggatattcttaaaccgtctccgggaaagtccccgggaactcgaccagaagatgaagccgagggcaaaccccctcagcgcgagaagtggagttcaaaaatagactttgtgctaagtgttgcgggtggtttcgttggactggggaacgtctggagatttccttacctctgttacaagaatggaggaggtgcctttcttatcccttactttatatttctgttcggctcaggtctgcctgtattttttctggagattattatcggtcagtacacaagtgaaggtggaattacatgctgggagaagatttgccctttattttcaggcattgggtacgctagcgtagttatcgtgtccctactgaacgtatactacattgtgatcctggcatgggccacatattacctctttcagagttttcagaaagagttaccatgggcccattgtaaccactcatggaatactccacactgcatggaagataccatgaggaagaacaaatccgtgtggatcaccatctcatcaacaaactttacctcacctgtgatcgagttttgggagagaaatgtcctgtcattgagtcctggcatagaccatccaggctccctaaagtgggatctggccctctgcctcctgctggtgtggctcgtgtgtttcttctgcatctggaagggggtccgcagtaccggcaaagtagtgtactttacagctacttttccatttgcaatgctcttggtgcttttggtgcgaggcctgaccctccccggagcaggggctggaattaaattttacctgtacccagacatcactcgcctcgaagacccacaggtgtggatcgacgccggaacgcagatcttctttagttacgccatctgtctgggtgcaatgacttccttgggctcgtacaacaagtataaatataactcgtatcgctcttggccagggctgcactgtctcccgaaaagctgcgacaatgacgctgccgctcatatcctagttcacagcttcttttactatgcctcactggcttggaccgggtag

SEQ ID NO: 241784 - DNA, 1905 bp, Artificial Sequence
  Description of Artificial Sequence: Synthetic coding sequence
atggtgcggctggttttgcctaatcccggtttggacgcgcgaatcccttcccttgccgagctcgagaccattgaacaggaggaggcctcttctcggcctaagtgggacaataaggcacagtacatgctgacctgcctgggcttttgtgtgggattgggcaacgtctggcggtttccctacttgtgccagagccatggtggaggagctttcatgattcccttcttgatactgctcgtgctggagggaattcctctgctgtatttggaattcgcaataggtcagcgcttgcggagggggtccctaggagtctggtcgagcatacatcctgctctgaagggtctgggcctggccagtatgctgacttcatttatggtgggattgtactacaatactatcattagttggatcatgtggtatctattcaactcattccaggagccgctcccctggagcgactgtccgctcaacgagaaccagaccggatacgtcgatgaatgcgccagatcatctcccgtggactatttttggtaccgggaaactctgaatatctctactagtattagcgatagtggttcaatccagtggtggatgctgctgtgcttggcctgcgcatggagcgttctgtatatgtgtacaataagagggattgaaacaacaggtaaggccgtctacatcactagtacgctcccttatgtcgtcttaacaatcttccttatacgtggtcttactcttaagggcgctacgaatggaattgtgtttttattcacccccaacgtgactgaattggcccagcctgacacttggctggatgccggagcccaagtttttttcagtttcagccttgcgttcggcggtctcatcagcttcagcagctataattccgttcacaacaattgcgagaaggacagtgtgattgtgagtatcatcaatggcttcacctcagtgtacgtcgccattgtagtatatagcgtaataggtttccgagccacccaacggtacgacgactgtttcagtacaaacatcttaacccttattaatggcttcgatctgcccgagggcaacgttacccaggagaattttgtggatatgcagcagaggtgcaacgcatcagatcccgctgcttatgcccagttagtgttccagacatgtgacattaatgcctttctctccgaagctgttgagggtacaggcctcgcatttatcgtgttcaccgaggccatcaccaaaatgccactttctcctctctggtccgtactcttcttcataatgctgttttgcctcggcctctcttcaatgttcgggaacatggaaggggttgtcgtgccacttcaagatctccgtgtgataccccctaaatggcccaaagaggtgctgactggcctgatctgcctgggaaccttccttattgggtttatctttacactgaactcagggcaatattggctaagcctgttggattcttacgccggtagcatacctctgctcataattgccttctgcgagatgtttagcgtggtgtatgtgtatggtgttgaccgttttaacaaggatatcgagttcatgataggccataagcctaacatcttctggcaagtgacctggcgggtggtgtctcccctgctaatgcttatcatcttcctctttttcttcgtggtggaagtgtctcaagaactgacttacagcatttgggatcccggttacgaggaatttcctaagtcgcagaagatctcataccctaattgggtgtacgttgtagtggtcatcgttgccggagtgccttcgctgaccatccccggttacgcaatatataagctcatacgcaatcattgccagaagcctggcgaccatcaaggcctagtcagtacattgtcaaccgcatcaatgaatggcgacttgaaatattag

SEQ ID NO: 241785 - DNA, 1668 bp, Artificial Sequence
  Description of Artificial Sequence: Synthetic coding sequence
atggagaaagccagacctctgtgggcaaactccctccagtttgtgtttgcttgtatctcctacgccgtcggtctgggaaatgtgtggaggttcccctacctctgtcagatgtacgggggtggaagcttccttgtgccttacattattatgctgattgtagaggggatgcccctgctatacctagaactggccgtggggcagcggatgcggcaaggcagtataggggcttggagaaccatttcaccttacttgtctggcgtcggagtcgcatcggttgttgtgagtttcttcctcagcatgtattataatgttataaatgcctgggcgttttggtaccttttccacagctttcaggaccccctgccatggtccgtgtgccccctgaacggcaatcacacaggatatgacgaagagtgcgagaaggcctcctcaacccagtacttctggtatagaaagacactcaatatttccccgtccctgcaggagaatgggggagtccagtgggagcccgctctgtgtctgctgctcgcttggctcgttgtgtacttatgcatccttcggggaacagagtcaaccggtaagatagaacaattggctaatcccaaggcttggattaacgccgctacccagatcttcttctcactcgggctgggatttgggtccctaattgcgttcgcgagctataacgaaccgtccaataattgccagaagcacgcgattatcgtgtctttaattaattcatttacctcgatatttgcttctatcgtgaccttctcgatatatgggtttaaggccactttcaattacgaaaactgccttaagaaagtctcccttttactcactaatacgttcgacttggaggacggctttttaaccgccagtaacctggagcaagtcaaagggtatttggcctccgcttaccccagtaaatacagtgagatgttcccgcaaattaagaattgttccctggaatcggagctggatactgctgtacaggggacgggactggcctttatcgtctacaccgaagcaattaaaaatatggaggtctcacagctgtggagtgtcctttactttttcatgctgctgatgctcggtatcgggtccatgttgggaaacactgcagctatactaacaccgctcaccgattcaaagatcatatcatcacaccttccaaaagaagccatttcaggcctggtctgcctagttaattgcgctatcggcatggtctttacaatggaggctgggaattattggtttgatatttttaatgactatgcagcaaccttgtccctgctgctgattgtactggttgaaaccattgcggtgtgctatgtgtacggcctgcgcaggttcgaatctgacctcaaggccatgaccggcagagcagttagttggtattggaaagtcatgtgggccggagtctctcccctcctcatcgtgagccttttcgtgttttacctctccgattacatcctcacaggcaccctgaaataccaggcatgggacgcatctcagggtcaactggtgacaaaggattatcctgcctacgcactcgcagtgataggcctgctagtggcctcgagcacaatgtgcatcccactcgccgctctcggaacctttgtccaacggaggctgaagaggggcgatgcagacccggtggcttag

SEQ ID NO: 241786 - DNA, 1779 bp, Artificial Sequence
  Description of Artificial Sequence: Synthetic coding sequence
atggaaaaggctaggcccctctgggccaattccctgcagtttgtatttgcatgtatatcttacgctgtcggcctaggtaacgtgtggcgctttccttacttgtgccagatgtacgggggaggctcattcctggtcccttatataattatgctgatcgttgaaggcatgcccctgctgtacctcgaactagcagtgggccagaggatgaggcaggggtctatcggagcatggagaaccattagtccctatctatccggagtgggtgtggcctcagtcgtggtgtctttcttcctgtctatgtactacaatgtcatcaacgcctgggctttctggtatttgtttcatagttttcaagatccgttgccttggagcgtatgccccctgaatggaaatcatactggctatgacgaggagtgcgagaaggcttcctcaacccagtacttctggtataggaagactttaaacataagtccgtcgctgcaggaaaacggcggtgtgcagtgggaaccagctctttgtctgctacttgcatggctcgtggtgtacctttgtatcttgagaggcactgagagcacgggcaaagttgtctatttcacggcctctctgccatactgtgtcttgatcatataccttattcgtggacttaccctgcatggagcaacgaacggtctgatgtatatgtttaccccaaagattgagcagttagcaaaccccaaagcttggattaacgctgcaacccagatttttttcagtctggggctgggtttcggctcactaatcgctttcgcttcttacaatgaaccaagtaacaattgtcaaaagcacgccatcatcgttagcctgatcaacagttttacttccatctttgcctccatcgtgacattttcaatctacggctttaaagcaacctttaactatgagaattgcctgaaaaaagtgagcctgttactcaccaacacattcgacctcgaagacggcttcctgacagcctcaaaccttgaacaggtgaagggatacctggcttcagcgtatcccagtaaatacagtgaaatgtttccacaaattaaaaattgttccctggaaagtgaattggacacggcggtacaggggacggggttggcatttatcgtgtatacggaggctataaagaatatggaagtcagccagctctggagcgttctctacttctttatgttacttatgttggggatcggaagcatgctcggaaacactgccgcaatactgacacctctaacggactccaagatcattagcagtcatctccccaaagaagctattagcggcctggtgtgcttggtcaactgcgcaattgggatggtattcacaatggaagccggtaactactggttcgatattttcaacgactatgccgcaacactttcgctgctgctaatcgtgttagttgagactattgctgtctgttacgtctacggtctcagacgatttgagagtgaccttaaagccatgacaggaagagctgtcagttggtattggaaggtgatgtgggctggggtgtctcccctcttaatagtgtctctgttcgtattttatctctctgattatattctcacggggacactgaagtaccaggcctgggatgctagccaagggcagctggtcacaaaagactaccccgcttacgcacttgctgtgatcgggcttctcgtcgcaagcagtactatgtgcatacctctcgctgcactcggaacctttgtacagagacgcctcaagagaggtgacgccgatcctgtggcctag

SEQ ID NO: 241787 - DNA, 1644 bp, Artificial Sequence
  Description of Artificial Sequence: Synthetic coding sequence
atggaaaaagcccgtccgctttgggccaactcactgcaattcgtcttcgcctgcatatcgtatgctgtgggattaggcaacgtgtggcgatttccatacctttgccaaatgtatggcggtggatctttcctcgttccctatattatcatgctgattgtcgagggaatgccactgctgtatcttgaactcgcagtcggccagaggatgcgacaaggttcaattggtgcgtggaggacaatatccccatatttgtccggggtcggagtggcttccgtggtggtctctttcttcttatccatgtactacaacgtcatcaatgcatgggcattctggtatttgtttcacagctttcaggatcccctgccttggtctgtctgtcctctgaatggaaatcacacaggctatgatgaagagtgcgaaaaggctagttccacacaatacttttggtaccgcaagactttaaacatctccccttccttacaggaaaacggaggcgtacagtgggaacctgcgctgtgcctgttgcttgcctggctggttgtttacttgtgcattctccgaggcacggaatccacagggaaggtggtttattttacagctagccttccctactgcgttttaatcatctacctcatcagaggtctcactcttcacggagccacaaacggtctaatgtacatgtttacccctaagattgaacagctggcaaaccccaaagcgtggatcaacgcggcaactcagatttttttcagcttaggcttgggcttcggtagcttaattgcttttgcttcttacaacgagccatctaataattgtcagaagcacgccattattgtgtcactgattaattcctttacaagtatatttgctagtatcgtgaccttttccatttacggatttaaagccacattcaattatgagaactgcctgaaaaaagtttcactgcttctaacgaacacatttgatctggaggatggcttcctgaccgccagcaatctggagcaggtgaagggataccttgcctccgcatacccctcaaagtatagcgagatgtttccgcaaatcaaaaactgttccctggagtctgagctggacactgcagtgcagggcactggactggcgtttatcgtatacactgaagccattaagaacatggaggttagtcagctctggagcgtcctctactttttcatgcttttgatgttaggaatcggctctatgttgggcaacacagcagctatcctgacacccttgacggattcaaaaattatcagttcccacttgcccaaggaagcaatatccggtctggtctgcttggtgaattgcgccattggaatggtgtttaccatggaggccggtaattattggttcgatattttcaacgattatgctgcaaccttgtccctgctgctcatcgttctggtcgagacaatcgctgtctgctatgtatatggattgcgcagattcgaaagcgacttgaaggccatgaccggacgcgcagtgtcttggtattggaaggtgatgtgggccggagtatccccactgttgatcgtgagcctgttcgtgttctacctgagtgattatatactgaccgggaccctcaaatatcaggcatgggacgcttcccaggatgacaagctctag

SEQ ID NO: 241788 - DNA, 1194 bp, Artificial Sequence
  Description of Artificial Sequence: Synthetic coding sequence
atggctcacgcccctgaacctgatcccgctgcatgtgacctgggcgatgagaggcccaaatgggataataaagcacaatatcttttaagctgcactggatttgccgtgggactgggcaatatctggcggttcccttatctctgccagacatacggaggtggtgcattcctaattccatatgtgatagccctagtgtttgaaggtatccccatcttccacgtcgaactggcaatcggacagcgactgcgaaaggggtccgtcggcgtgtggacggctatttcaccctacctgtccggggtgggtcttggctgcgttacactcagctttctcattagcctctactacaacactatcgttgcctgggtgctgtggtacctgcttaattcgttccaacatcctctgccctggtcctcttgtccccctgatcttaaccgtaccggatttgtagaagagtgccagggcagcagtgctgtgagttatttttggtaccggcagacgctgaacattacagctgacattaacgacagcggatcaatccagtggtggctgctcatctgcctagccgcttcctgggctgtggtctacatgtgcgtcattcgcggaattgaaactaccggaaaggtgatctacttcaccgctttatttccctatctggtgctcacaatattccttatcagaggcctgacactccccggtgctactaaaggactgatttatctgtttacccccaacaaccccagagtttggctggatgcagcaacccagatttttttcagtctctctttggcattcggcggacacatcgctttcgcatcatataacagcccgagaaatgactgccagaaggatgctgtggtgattgcactggtgaataggatgacctccctttacgcatctattgccgttttcagcgtgctaggtgcttcaggcccaggcctcgctttcgtggtgtttacggagactgatctgcacatgcctggggctcccgtatgggctatgctgtttttcggtatgttgttcactctgggcctgagtaccatgttcggaaccgttgaggcagtgattacgccgctgctagatagcggcaattattggctggaaatctttgataacttcgcggcatcaccgaatctcctgatgctggcctttctggaggttgtaggggttgtttacgtctatgggatgaaacgttag

SEQ ID NO: 241789 - DNA, 1887 bp, Artificial Sequence
  Description of Artificial Sequence: Synthetic coding sequence
atggctcacgcacctgagccagacccagctgcctgcgaccttggggatgaacgaccaaaatgggataacaaagctcaatatttactctcatgcacaggcttcgctgtcggcttagggaacatatggcgctttccttatttgtgccagacctatggaggcggagctttcctgatcccttatgtcatagctctggttttcgaaggtatcccaatctttcacgtggaactggccattggtcagcggttgcgcaaaggcagtgtaggggtatggaccgctatctctccctacttatcaggggtagggctaggctgtgtcactttgagcttcttaatcagcctgtactataataccatcgtggcatgggtgttgtggtatctcttgaactcatttcaacatccactcccctggtcttcctgtcctccggatttgaaccggacgggcttcgtagaggaatgtcagggaagttcggcggtgagctacttctggtataggcagacgctaaacatcacagctgacatcaatgattcgggctccattcagtggtggctcctcatttgcctggccgcttcttgggctgtcgtttacatgtgcgtcattcggggaatcgagaccactggcaaggttatttactttaccgccctgttcccatacctggttttgactatctttcttattagggggcttacactgcccggtgccaccaaaggactgatttatctcttcacccctaatatgcatattttgcaaaaccctagagtgtggctggacgcagccacccagatctttttttctctgtccctggcatttggcggtcacattgcctttgcatcatataatagcccgaggaacgattgccagaaggatgcggtggtgatagcgttagttaaccgtatgacatcactgtacgccagcattgctgttttttctgtgctgggattcaaagctacaaatgactatgagcactgtctcgataggaatattctctcgctgattaacgactttgacttccccgaacaatcaatcagcagggacgactaccctgctgtcctcatgcacctgaatgccacctggcccaagcgggtagcacagctgcccctaaaagcatgcctcctcgaggatttccttgataagtccgcctcagggcctggattagctttcgtagttttcactgaaaccgatctccacatgccaggtgcccctgtgtgggcaatgcttttttttggcatgctgtttactttgggcctgagcacgatgttcggcacagtcgaggccgtgattacccctcttctagacgtaggagtgctgccccgttgggtccccaaggaggccctgacaggcctggtctgccttgtgtgttttcttagtgcgacttgtttcaccctgcagtctggcaattattggctggagattttcgacaacttcgcagccagtcccaacctactgatgcttgccttccttgaggtggtgggtgtggtgtacgtctacggcatgaagcgcttctgtgacgatattgcttggatgaccgggagacgccctagcccctactggaggctgacctggcgggtagttagccccctgcttctgaccatctttgtagcctacattatactcctcttttggaaaccgttacgttacaaagcctggaaccccaaatatgaattatttcccagcagacaggagaagctctacccaggctgggctcgcgctgcatgtgttctgttgagcttgttaccagtgctgtgggtgcctgtggccgctctcgcccagttgctgacccggagaaggcgcacgtggcgggacagagacgctcggccagatacagatatgagaccagacaccgacactagaccagacacagacatgaggccagatacagatatgagatag

SEQ ID NO: 241790 - DNA, 1548 bp, Artificial Sequence
  Description of Artificial Sequence: Synthetic coding sequence
atggaggctagggaacctgggagacctacacctacctaccacttagtgcctaatacatcccagtcccaggtggaggaggatgtgtcgagtcccccacagagatcatcggaaactatgcaacttaagaaggagattagcctgctcaatggggtgagtctcgtggtcggaaacatgattggtagcggaattttcgtgagtcctaaaggagtgttggttcacacagcgtcctacggcatgagtctgatagtctgggccataggtggattattttccgttgttggtgcactctgttatgcggagctggggacaactattacaaagagcggagcgagctatgcctatatcttagaagccttcggtgggtttatcgcgttcatccggttgtgggtcagtcttctggtggtagaaccgactggacaagccattatagccatcacctttgctaactatatcattcagccctccttcccaagctgcgacccaccgtacctggcctgtaggctgttggctgctgcctgtatatgcctgctaacattcgtcaactgcgcatacgtgaagtggggcacacgcgtacaagacacatttacctatgccaaggtcgtcgctctcatcgctatcatagttatgggcctggttaagctgtgccaaggacattccgagcactttcaggatgcatttgagggaagctcatgggacatgggtaacctatccctcgcactctacagcgccctgtttagctatagcgggtgggacacactaaactttgtgactgaagagatcaaaaatccggagcggaatttgcccctggcgattgggatctctatgcctatcgtgacacttatttatatattaacaaacgtggcctactacacagtcctaaacattagcgatgttctctcttctgatgctgtcgcagttacctttgcagaccagacattcggaatgtttagctggaccattcctattgccgtggctttaagctgttttggcggtctgaatgcaagcattttcgcgtcctcacgtctgttctttgtggggtccagggaggggcacctgcccgacttactgagtatgatacatatcgagaggtttacgcctatccctgcactcctgttcaactgtacaatggctctgatctatttgatcgtagaagacgtgttccagctcattaactacttctccttttcatattggtttttcgttggtctcagtgtggtggggcagctctatttgaggtggaaggagccaaaaagacccagaccgctcaaactgtcggttttttttccgatcgtcttctgcatttgcagcgtcttcctcgtcatagttcccctttttacagacaccattaattctctcatcggcattggtatcgcgctgagtggcgtccccttttacttcatgggtgtgtacttgccggagagtcggaggcccctgttcatcaggaacgttttggccgctattacacgcggaactcagcagctctgcttctgcgttcttaccgagctggacgtcgcagaggagaagaaggacgaacgcaagacagactag

SEQ ID NO: 241791 - DNA, 1524 bp, Artificial Sequence
  Description of Artificial Sequence: Synthetic coding sequence
atggctggggctgggcctaagcgcagggctctggcagccccagccgctgaggaaaaagaggaagccagagagaaaatgctggcagctaagtccgccgacgggtccgcacccgctggagagggagagggggttaccctgcagagaaatatcaccctgcttaacggtgtcgccatcatagtgggcactattattgggagcggcatattcgtaacccccactggagtattaaaagaagcgggtagtcccggacttgccctagtggtctgggcggcttgcggggtcttttctattgtgggcgctctctgttatgcagaactgggcaccacaatttctaaaagcggaggggactatgcctatatgttggaggtatatggctcccttcccgctttcctgaagctatggattgagctgcttataatcagaccttcatctcaatatatcgtcgcacttgtcttcgcaacttaccttctgaaacccttatttccaacttgtcctgtgcccgaagaggccgcaaaactggtcgcttgtctctgcgtgttgctactgaccgctgtgaattgctacagcgtgaaggccgctacccgggtgcaggacgcttttgcagccgctaagctgctagccctggccttgatcatcctgttggggtttgtgcaaataggcaaaggcgatgtgtcaaatctggaccctaactttagctttgaaggtaccaagcttgacgtaggcaacatagtgctggctctgtactctggcttgtttgcatacggtggctggaactatcttaatttcgtgacagaggaaatgattaatccctacaggaatctgccccttgctatcataatttctttacccattgtgacactcgtatatgtcctgacgaatttagcctatttcacaaccctatcaaccgagcaaatgttgtcatccgaggctgtggccgtggactttgggaattaccatctaggcgtcatgagctggatcattcctgtatttgtgggactgtcctgcttcgggagcgttaatggcagcctgtttaccagctctcgcctgttcttcgtgggctctcgggaggggcatcttccaagcattctctccatgatacatcctcaactgttgactcctgtgccatcactggtgttcacttgcgtgatgacgctcctctacgcttttagtaaggatatatttagtgtgataaactttttttcgttctttaattggctgtgcgtggctctggcaattataggcatgatttggctccgacacagaaaacctgagctggaaaggcccatcaaggtcaatctggcccttcctgttttctttattctggcctgcctattcctaatcgctgttagcttttggaaaaccccagtggagtgcggtattggatttacgataattctttccggactcccagtttacttcttcggcgtgtggtggaagaacaagccaaagtggctgctccaaggcatattttccactaccgtcctgtgtcagaaacttatgcaggttgtcccacaggaaacttag

SEQ ID NO: 241792 - DNA, 846 bp, Artificial Sequence
  Description of Artificial Sequence: Synthetic coding sequence
atgtcccacggcacctactacgagtgtgaacctcgcggaggacagcagcctctcgagttcagcggaggaagagctggtccaggcgagctgggggatatgtgtgagcacgaagcctcaatcgacttaagcgcatatatcgaaagtggagaggagcagcttctgagcgatctgttcgctgtcaagcctgctcccgaagccagagggttaaagggaccagggaccccagcctttccacactacctgccccctgatcccagaccatttgcctacccaccccacactttcggacctgacagaaaggcgctgggacctggtatctatagctcaccagggtcctacgatccccgagccgtagccgtcaaagaagagccgagagggccagaagggtcccgtgcagccagtagaggctcttacaatccacttcagtaccaagtggctcattgcggacagactgcaatgcacctgcccccaaccctggcggcaccaggacagcctttgcgagtgttaaaagctccgctggctactgcggctccaccgtgtagtcctctgctcaaagctccaagccctgcaggcccactgcacaagggaaaaaaggccgtaaataaggattctttggaatataggctgagacgagagcggaataatattgcagttaggaaaagtcgggacaaagccaagaggcgtattttagaaacacagcaaaaagtgttggagtacatggcggagaacgagcgactgcgtagccgagttgagcagttaacccaggagctggacacactccgtaacttattccgccaaataccagaggccgcaaatttgatcaagggggtaggaggatgcagctag

SEQ ID NO: 241793 - DNA, 1608 bp, Artificial Sequence
  Description of Artificial Sequence: Synthetic coding sequence
atggaggagggggctcgtcaccggaacaatacagaaaagaaacacccgggtggcggagaatctgatgcaagcccggaggctggtagcgggggaggcggagtggcactcaaaaaagagattggactggtcagcgcctgtggcataatcgtaggcaatataataggatctggcattttcgtgtctcctaagggcgtgctcgaaaatgctggtagtgtgggactggccctgatagtgtggatcgtcacaggctttattactgtggtgggggcactttgttacgccgagctgggagtgaccatacctaaaagcgggggagactattcttacgtgaaagacatcttcggcggactcgctggcttcttacgactatggatcgcggtgctagtgatatacccgaccaatcaggctgttatcgccctcacattcagtaattatgttctgcagcccctattccctacctgtttcccacccgagtctggcctccgcctactggccgcaatatgtttgctgcttctgacctgggtgaactgctctagtgtccgctgggctacaagagtgcaggatatattcaccgctggaaaactgctggccctggctttaataatcataatgggcatcgtgcaaatttgtaagggggagtatttttggctggaacctaaaaatgccttcgaaaacttccaggagcctgatattgggctggtcgccctagctttcctccaaggcagctttgcctacggcggttggaattttttgaattacgtcacagaggagcttgtcgacccttacaagaatcttcccagagcaatattcataagcattcccttggttactttcgtgtacgtcttcgccaatgtcgcctatgtcactgctatgtcccctcaggagttactcgcttcgaacgcagtcgccgtgacattcggtgaaaagctacttggtgtcatggcatggattatgccaatctccgtcgcactctcgaccttcggtggagtgaatggatcactgttcacctcctctcgcctgttctttgcaggagcacgcgagggccatctgccctctgtgctcgctatgatccacgtgaagcggtgtaccccgatccccgctcttctgtttacctgtatttcaacgctcctgatgctggtaacgagtgacatgtacactctcataaattatgtagggtttatcaattatctcttctacggtgtgaccgtagcaggacagattgtgctgcgctggaagaaaccagatatccccagaccaattaaaattaaccttcttttccctatcatttacttgctattctgggcgtttttgctggttttcagtctctggagcgaaccagtggtttgtggaataggtttggctattatgctgacaggggttccggtgtatttcttgggagtctattggcagcataaacccaagtgtttctcagacttcattgagctcctcactctagtatcacagaagatgtgtgtggttgtttatccggaggttgagcgtggctcagggacggaagaagcgaacgaagacatggaggaacagcagcagcccatgtatcagcctaccccaaccaaagataaggatgttgctggccaaccgcagccatag

SEQ ID NO: 241794 - DNA, 633 bp, Artificial Sequence
  Description of Artificial Sequence: Synthetic coding sequence
atgggaattgtgcagatttgtaagggggaatatttttggctggagccgaagaacgccttcgagaattttcaggagcctgatatcgggctcgttgctctagcattcctgcagggttccttcgcgtatggcggatggaacttcctgaactacgtgaccgaggagctggtcgatccatataagaacctcccccgagctatatttatctccatcccacttgttacttttgtatatgtgttcgcaaatgtggcctatgttactgctatgtctccccaggagctcctggcttcaaatgcagtggccgtgaccttcggcgaaaagctgttgggggtcatggcatggattatgcctatatctgtggcactgtctactttcggcggagtgaacggaagccttcacctgctgtcagctgtgctcaggtggagtcccagaggcccaccctcccaatgtgtcggtcatgatccacgcgaggcattgcatccaaatccttcacctgctctccatatgcacttgcaccccgctgatgccggacaccagagacacgtgcacacgcaccagctgtgcgggctgcatcagttacccttgctttggggccacggctgttggacagactcccctagccttgaagaagcgtag

SEQ ID NO: 241795 - DNA, 693 bp, Artificial Sequence
  Description of Artificial Sequence: Synthetic coding sequence
tgatgcctgcaggagcacagccaaccctcacagcttctgtgtacactgttgctgtgctggtgcgtgctgggccgtgagcggccattcaggaaggcccagtccacaagcagccccctcgagggagttcctaggttcctgaagaggctcttgcttacctgggtgaactgcagctccgtgcggtgggctacccgcgtgcaggacatttttacagcaggaaagctgttggccctagccttgattatcatcatgggaatcgtgcagatctgcaagggagaatacttctggctggagccaaaaaacgccttcgaaaactttcaagagcctgacattggtctagtagcattagcctttctgcagggctcttttgcttatggtggctggaatttcctgaactacgtgactgaggagctcgtggacccgtacaagctgttcttcgcaggcgctagagaggggcacttgcccagcgtgttagctatgatacacgttaaacggtgtaccccaatccctgccctcctctttacatgtatctcaactctgctgatgcttgtaacttcagacatgtacaccctgattaactacgttgggttcatcaactatctgttctacggagttaccgtcgccggacaaatagtgttacgttggaaaaaaccagacatacctcggcctatcaagcctctaccatatcaagggtag

SEQ ID NO: 241796 - DNA, 936 bp, Artificial Sequence
  Description of Artificial Sequence: Synthetic coding sequence
atgggacagctctttcaatgcgccgtggggcaccctggctccagacaccttcatagctgggaggctccgggtctagggccagactaccatcacggggattgtacagacatgcagcgtaatctgcctagggccattttcatcagtattcccctcgttacattcgtgtacgtgttcgctaatgtggcctacgtgactgctatgagcccccaggagctcttagccagtaacgccgtggccgttacattcggcgagaagctgctgggagtaatggcctggatcatgccgataagtgtggctctgtccactttcggcggagtgaatggttcactcttcacatcaagcaggctgttttttgctggagctagagagggtcacctgcccagcgttctggccatgattcacgtgaagcgctgcacacccatccctgccctgttgtttacctgtatttcaactctccttatgctggttacaagcgacatgtatactctcattaactatgtgggatttattaattacctgttctatggagtcactgtcgccggacaaattgtgttaagatggaaaaagccagatataccaagaccaattaagatcaatttgcttttcccaattatttatctactgttctgggccttcctcctggtgtttagtctctggtcagaacctgtagtttgcggaatagggctcgcgatcatgcttaccggggtaccagtgtatttccttggcgtctactggcagcacaagccaaaatgtttcagtgacttcattgagcttcttactctggttagccagaagatgtgcgtagtggtctatccagaggttgagagaggaagcgggacagaagaagccaatgaggatatggaggagcaacagcaacccatgtaccagccaacccccactaaggacaaagatgtggctgggcagcctcagccatag

SEQ ID NO: 241797 - DNA, 999 bp, Artificial Sequence
  Description of Artificial Sequence: Synthetic coding sequence
atggggattgtgcagatttgcaagggcgagtacttttggcttgaacctaaaaatgcgtttgagaactttcaagaacctgatatagggctcgttgctctggcattcttacaaggctcattcgcctatggaggttggaactttctcaactatgtgaccgaagagcttgtcgacccctacaagaacctccctagggccatctttatctccatacctttggttacttttgtgtacgtcttcgcaaatgtggcctacgttacagccatgagtccgcaggagttattggctagcaacgcggtggcagttacctttggggagaagttgctcggcgtcatggcttggattatgccaatttcggtggcgctgtctacattcggtggcgtgaatggatcactgttcacctccagtcggctgttttttgcaggagcccgagaaggccacttgcctagtgttctggccatgatacacgttaaacgatgtacgccgattcccgcattgttatttacctgcatatcgaccctgctcatgttggtgactagtgacatgtacacgttaattaactatgtcggctttataaattacctgttctatggcgtcactgttgccggtcagatcgttttacggtggaaaaagccggacatacctcgacccatcaagatcaaccttctcttccccataatatatctgctcttttgggcatttctcctggtgttcagcctgtggtctgaaccagtggtatgcggcatcgggttggccatcatgctgacaggcgtgcccgtatattttctgggcgtctattggcaacacaagcctaagtgtttttccgactttatcgaattactcactttagtcagccagaaaatgtgtgtggttgtgtaccctgaagttgaaaggggatctgggacagaagaagccaacgaggatatggaagagcaacagcagcccatgtatcagccaactccaaccaaagacaaagacgtggcgggacagccacaaccatag

SEQ ID NO: 241798 - DNA, 285 bp, Artificial Sequence
  Description of Artificial Sequence: Synthetic coding sequence
atggaggagggggctcgccacaggaataatactgaaaagaagcatcctggcggaggagaatccgacgcatcacccgaggcgggttcaggaggcggtggagtggccctgaaaaaagaaattggcttggtgtcagcctgtggcataattgtgggaaacatcattggctcaggtatattcgtttcacctaagggagttttggagaatgcagggagcgtgggcctagctttgatcgtttggattgtgaccggtttcattaccgtcgtgggtgccctgtgctacgcgtag

SEQ ID NO: 241799 - DNA, 237 bp, Artificial Sequence
  Description of Artificial Sequence: Synthetic coding sequence
atggaagaaggggcaaggcatcgcaacaacacagagaaaaagcaccctggaggaggggagtctgatgccagccctgaagctggctccggaggcggaggtgtcgcgctgaagaaggagatcgggctggtttccgcttgcgggatcatcgtgggcaacatcattggcagcggtatcttcgtcagccctaaaggggtacttgaaaatgccggatccgtcgggctcgccctgattgtctag

SEQ ID NO: 241800 - DNA, 1293 bp, Artificial Sequence
  Description of Artificial Sequence: Synthetic coding sequence
atgggtcaatatgggcaggagctttcctggaaatgccttgtaaaagccgtatgtctgcaggagcactctcaaccctctcagcttctgtgcactttactcttgtgttggtgtgttctcggcagggaacgaccctttagaaaagctcagtccacttcctcgccacttgaaggagtacctcggttcctgaagaggctgctattgacgtgggtgaattgttcctccgtccgctgggctacccgggtacaagatatttttaccgccggaaagcttttggctctggcgctaattattataatgggtattgtgcagatttgtaagggcgaatacttctggttggaacctaagaacgcgttcgagaactttcaggaaccagacatcggcctcgtagcactcgcgttcctccaaggatccttcgcttatgggggatggaattttctaaattacgtgactgaagagttggtagatccgtataagaatcttcctagagccatcttcatctccatcccactggtgacgtttgtatatgtgttcgctaatgtggcttacgttacggctatgtcccctcaggagctactggctagtaatgctgtggcagttacgttcggcgagaagctcctgggtgtgatggcctggataatgccaatctccgtcgccctgagcacctttggtggagttaatggatctctcttcacttcaagtcgtttattctttgcgggtgccagagaaggacatctccccagtgtccttgcgatgattcatgtaaaaagatgtacgcccatccctgctctgctgtttacatgcatctctacgctgctgatgctggtcacaagcgacatgtacacgctcattaactacgtgggttttattaactacctattttacggtgtaaccgtcgcgggacagatcgttctccggtggaagaagcctgatatcccccgacctatcaagatcaaccttttgtttccgattatctacctgttgttttgggcgttcctgctggtcttcagcttgtggagtgaaccagtagtgtgtgggattggactggcaattatgctgacaggcgtcccagtgtatttcttaggagtttactggcagcataaaccaaaatgtttcagcgacttcatagaactgttaaccctggtatcacagaagatgtgcgtggttgtatacccggaggtggagcgaggaagcggcaccgaggaggccaacgaggatatggaagagcagcaacagccaatgtatcagccaacacctactaaagacaaagacgttgctggacaacctcagccatag

SEQ ID NO: 241801 - DNA, 1968 bp, Artificial Sequence
  Description of Artificial Sequence: Synthetic coding sequence
atggtgctgtacacaacaccctttcctaatagttgcctcagtgctcttcattgtgtgtcctgggcgctcatctttccttgctattggctggtggacagactggcagcatcttttattcctactacctacgagaaacggcaacgcgcagacgacccttgctgcctgcagctcctgtgcacggcgctgtttacgcccatttatctggccctcctcgtggcaagcctgccatttgccttcctcgggtttctcttctggtctcctttgcaatctgccagacggccatacatctattcgcggctcgaggacaagggcctggcaggcggtgcagcactgctgtccgagtggaaaggtacgggcccaggaaagtctttctgctttgcaaccgccaacgtgtgcttgctcccagattctcttgccagggtaaataatcttttcaatacgcaggccagggccaaagaaatcggacaacgcattagaaacggagccgctaggcctcagattaagatatatattgattcacccactaataccagcattagtgccgcatcttttagcagtctggtctctcctcagggtggcgatggcgtagcgagggccgtccctggaagcataaaaagaacggctagcgtggagtataagggagacgggggacggcatcccggtgatgaggctgctaacggccctgcctctggcgacccagttgactccagcagcccagaggacgcttgtatcgtgaggatcggcggtgaggaaggcggtcggcctcctgaagctgacgatccagtgcctggcggacaggcgaggaacggggctggaggtggcccacggggacagactcccaaccacaatcagcaggacggagattcgggtagcctgggctctccaagtgctagtagagaatcattggtgaaaggtcgggctggtccagatactagcgcctctggcgaacccggtgctaatagcaaactcctctacaaagcatccgtggtaaaaaaggcagcagctagacgcaggaggcaccccgatgaagcatttgaccacgaggtgtctgccttcttcccagcaaacctggacttcctttgtttacaagaggtctttgacaagagagcagcaaccaaactcaaggagcagttgcacggctacttcgaatatatcctctatgacgtgggcgtatacggatgtcagggctgttgtagttttaagtgcctgaattctggcctacttttcgcttcaagataccctattatggatgtggcctatcactgctatccaaataaatgcaatgacgatgccctggcaagtaaaggcgctttgttcctcaaagtgcaggtgggtagcaccccccaggatcagaggatcgtgggttacatagcctgcacgcatttacacgcaccccaagaagattccgccatccgctgcgggcagcttgatctacttcaggattggctggccgactttagaaagtccactagttcatcatccgccgcaaacccagaggagttggtcgcctttgatgtcgtgtgtggtgatttcaatttcgataactgttcgtcggacgataaattggaacagcagcactctctttttacgcactatcgtgacccgtgtaggttgggcccaggggaggaaaagccttgggcaattggtactctgctcgacaccaatgggctctacgacgaagacgtgtgtactcctgataatctgcagaaagtgctcgaatccgaagaaggacgacgggaatatctggcgttcccaacttccaagtcctcaggacagaagggacgcaaagaactgctgaaaggtaacgggagacgtattgactacatgctacatgccgaagagggtctctgtccggactggaaggccgaagtggaagagttcagtttcataacccagttgagcggactgaccgaccacttgcccgtagccatgaggctgatggtgtcaagcggagaggaggaggcttag

SEQ ID NO: 241802 - DNA, 690 bp, Artificial Sequence
  Description of Artificial Sequence: Synthetic coding sequence
atggaagcccgagaacccggaaggcccacacccacataccacttggttcccaacacaagccagtcccaagtcgaggaagacgtgtcaagcccccctcaaaggagctccgaaaccatgcagctcaaaaaagagatatccctgctcaatggggtgtctctcgtggtgggtaacatgatcggttcaggaattttcgtgtccccaaagggcgtgcttgttcataccgccagttatgggatgagtctgatcgtgtgggctataggtggcctgttcagcgtggtcggtgcactgtgttacgccgagctaggcactaccattactaagagtggggctagttacgcctacatactcgaggccttcggaggtttcatcgcattcatccggctgtgggtgagcctgcttgtggttgaacccacaggccaagcaatcatagctataaccttcgcgaactatatcattcagccgtcatttccatcctgcgatccaccttacctggcctgtcgcctgctggcggctgcttgtatctgtctccttacattcgtcaactgtgcatacgtaaagtggggaacgagagtgcaggacacttttacctacgccaaggtggtggccctgattgccatcatcgtcatgggactcgtgaagttatgtcaagaaatttgcccgtggcctctgggtttcctgtgccagctctag

SEQ ID NO: 241803 - DNA, 1536 bp, Artificial Sequence
  Description of Artificial Sequence: Synthetic coding sequence
atggtggactctaccgagtatgaagtggcctcgcagcccgaagtagagacctcacctctgggggacggagccagtccaggccctgagcaagttaaactgaagaaagagatttccttattaaacggtgtgtgtctgatcgtcggaaatatgataggatccggtattttcgtaagccccaagggggtcctcatttattcggcctcctttggcctgtccctcgtaatatgggccgtcggcggtctctttagcgttttcggggcactgtgctacgccgagttaggcacaacgataaagaagagtggagcgagctacgcttatattcttgaggcattcggcggttttttagccttcataaggttatggacgagtttgctaatcatcgaaccaacaagtcaggctattattgccatcactttcgctaattatatggtacagcctttgttcccaagctgttttgccccttatgccgcaagccgattactggccgctgcttgtatatgtttgctcaccttcataaattgtgcctatgtcaaatggggcacactcgtgcaagacatctttacgtacgcaaaggtgctcgctctgattgccgtaatcgtggccggaatcgttaggctgggtcagggtgcatccacgcatttcgagaactccttcgagggctcctccttcgccgtcggcgatatcgctctggccctgtatagtgcactgtttagctatagcggctgggacacactgaattatgtgaccgaggagataaagaaccccgagagaaacttaccgctgagcatagggatttccatgccgattgtgaccatcatctatatactgacaaatgtcgcctactataccgtccttgatatgcgcgatatcctcgcctctgacgcagtggcagttacattcgccgatcagatcttcggcatcttcaactggattatacccctgtcagtggccctgagctgtttcgggggactaaatgcttcaattgtggcagcatcacgcctcttcttcgttgggtcccgggagggtcatttaccagacgccatttgtatgatccacgtcgagaggttcacaccagtgcccagcctgctctttaatgggataatggccctgatttatttatgcgtggaagatatatttcaactcattaattattacagtttcagttattggttcttcgtaggattaagtatcgtcggacaattatacttgcggtggaaggagccagatcggcctcgcccactgaagttgtcagtgtttttccccatcgtgttctgtttgtgtaccatattccttgtggccgtcccactatatagtgacactattaatagtctgattggcattgccatcgccctcagtggcctacccttctactttctgattattagagtaccagagcacaagagaccactctaccttaggagaattgttggctccgctacccgctaccttcaagtcctatgcatgtctgttgctgcggagatggacctcgaagacggaggggaaatgcctaaacagcgtgaccccaagagcaattag

SEQ ID NO: 241804 - DNA, 1536 bp, Artificial Sequence
  Description of Artificial Sequence: Synthetic coding sequence
atggttgatagcactgagtacgaggtcgcgagccagcccgaggtcgagacatcaccactgggcgatggcgcaagtccaggccctgagcaggtcaaactcaaaaaggaaattagtctgttgaatggcgtgtgtctgatcgtcggtaacatgattggcagcggcatttttgtctcaccaaagggcgtcctcatttactctgcatcattcggtttgagccttgtcatctgggctgttggaggcctcttcagcgtatttggcgcattatgctatgcagaactggggacaacgatcaagaagtccggagccagttacgcatacattctggaagcctttgggggatttctggccttcataaggttatggacaagtctgctcattattgaacccacaagtcaggccattattgcaataactttcgcaaactatatggtgcagccattgtttccctcatgctttgctccatatgcggcatccaggctcttggccgctgcatgtatatgtttgctgacctttatcaactgcgcctacgttaaatgggggactctcgtccaggacatctttacatacgctaaagtgttagctctgatcgcagtgatcgtggcgggtatcgtgcggctcggacagggagccagcacccacttcgaaaactcattcgagggatcgagttttgccgtgggtgatattgcgctggctctctacagcgcacttttctcatacagcgggtgggacacattgaactacgtgaccgaggagattaagaaccccgaacgaaacttgcctttgagcattgggatctcaatgccaattgtcacgataatctatatacttaccaatgtggcatattacacagtcctcgacatgcgggacatccttgcatctgacgcagttgccgtcacttttgccgaccagattttcggcatattcaactggattattcctctaagtgtcgccctgtcctgtttcgggggtttgaacgcaagcattgtggccgcttcccggctcttcttcgtggggagcagggaaggccatctgccagatgccatatgtatgatccatgtcgagcggtttactcccgtgccaagcctgctctttaacggtatcatggcccttatctatctgtgcgttgaagacattttccagctgatcaattactactcattcagttactggttctttgtgggacttagcatagtgggacagctctatttaagatggaaggagcccgacagaccccgaccgttaaaactttctgttttttttcctattgtgttctgcctgtgtactatttttctggtggccgtacctctgtacagcgacacaatcaattccctgatcgggatagccatcgcactttcaggcctcccattttacttcttaatcatccgcgtccctgagcacaagcgtccactctacttgcgacgcattgtggggtctgcgacacgctacctccaggtgctgtgcatgagcgtggccgctgagatggatcttgaagatggaggagaaatgcctaagcaaagagatccaaagtccaattag

SEQ ID NO: 241805 - DNA, 1536 bp, Artificial Sequence
  Description of Artificial Sequence: Synthetic coding sequence
atggttgactccaccgagtacgaggtggccagtcagcctgaggtggagacctcgcctctgggtgacggtgcttcacctggtcctgaacaggtaaagctcaaaaaggagatctctctgctaaatggggtgtgtctgatagtgggcaatatgatagggtccgggattttcgtgtctcccaagggcgtgctgatttatagcgcaagttttgggctgtcactcgtcatatgggccgtgggcggattgttctccgtgtttggagctctgtgttacgctgagctgggcacaaccataaaaaagtcaggcgcatcctacgcgtatatcttggaggccttcggcggtttcctggcttttattagactgtggactagtctgctaatcatcgaacctacttctcaggccatcattgccatcacatttgccaactacatggtacagcctttgtttccctcttgcttcgccccatacgctgccagtcggcttctggctgccgcttgtatttgcctgcttacgttcattaactgtgcttacgtgaaatggggtacccttgttcaggacatcttcacgtacgcgaaggttctggcgctcatcgctgtcatagtcgccggaatagttcgcctaggacagggggcttctacccatttcgagaatagcttcgaagggagttccttcgctgtgggcgacatcgctctcgctctctactcagccctgttctcctattccgggtgggatacccttaactatgtgaccgaggaaattaaaaatccagaacgaaatctgcccttatctattggaatatccatgcccatcgtgactatcatctacatccttacgaatgtggcatattatacggttttggatatgcgtgatatcctagccagcgacgcagtagctgtgactttcgcagaccaaatttttggcatcttcaactggatcattccgctttcagttgctttaagctgcttcggaggactcaacgcctctattgtggccgcaagtcggcttttctttgtgggttctagagaaggtcaccttcctgatgccatctgtatgatccatgttgagagatttaccccggttccgagcctcctcttcaatggcattatggcgctgatttacctgtgcgtggaggacatcttccagctcattaattactacagctttagctactggttttttgtagggctgtccatagtgggacagctctatctacgttggaaggagcccgacaggcctcgacccctcaaactatcagtgttctttccaattgtcttctgtctctgcacaatcttcctggtggccgttcctctgtattctgacactatcaactcgttaattgggatcgcaattgctctgtctggtctgcctttctattttcttatcatcagagtgcccgaacacaagcgcccactgtatctcaggcggattgtcgggagcgcaacgagatacctacaagttctttgtatgtctgtagcagcagaaatggatctggaggatggcggagaaatgcccaagcagcgagatccaaaatcgaattag

SEQ ID NO: 241806 - DNA, 1536 bp, Artificial Sequence
  Description of Artificial Sequence: Synthetic coding sequence
atggtggattccacagaatacgaagtggcctcacagcccgaagtggaaacaagcccacttggagacggtgcttcgcccggacccgagcaagtgaagctgaagaaagaaatttctctgctcaacggggtgtgcttgatcgtgggtaacatgatcggttcaggcatcttcgtctcccctaagggggtgctgatctatagcgcctcctttggcttgtcactggtgatctgggccgtgggaggtctatttagcgtatttggagctctgtgttacgcggagctgggaacgactatcaagaaatccggcgcttcttatgcgtacatcttagaggctttcgggggtttcctggccttcatccggctgtggacttcccttctaatcattgaacccaccagccaggccataattgcaattacattcgctaattatatggtgcagcccctgttcccatcatgctttgctccctatgccgcttctagactactggctgctgcctgcatttgcctgctgacatttatcaactgcgcttatgtcaaatggggaactctggtccaggatatttttacctatgccaaagttctcgcgctgattgcagtgatcgtggctggaattgtccggctgggacagggtgcctccacccatttcgaaaattctttcgaggggagttccttcgcggtgggggatatcgcactggctctgtacagtgccctgttctcatatagcggctgggataccctgaactacgtgactgaagaaatcaaaaatcctgagagaaatctacccctgagcatcgggatctctatgcctatcgttactatcatctatattctcactaacgtagcctactacactgtgctcgacatgcgtgatattcttgcttcagacgcagtcgctgtgacctttgcagatcagatctttggcatttttaattggatcattcccctttctgtggccctgagttgctttgggggactgaatgcctccatcgtagccgcttccagactgttctttgtggggagccgggagggtcacttgccagatgcaatatgcatgattcacgtagaacgtttcacccctgttccttcactcctgttcaacgggatcatggctctcatttacctttgcgtggaggatatctttcagctaatcaactattattccttcagttattggtttttcgtggggctgtcaatcgtgggacagctctatctacgctggaaggaacccgaccgccctcgaccactgaagttatctgtcttctttccgatagtcttctgtctatgcaccatttttctggtggcggtgccactgtatagtgatacgattaactcactcattggtatcgccatcgccctctcggggctgcccttttacttcctgataattcgggtgcctgaacataagcgccctctgtacctgcgaagaattgttggctccgctactcggtacctccaagtgttgtgcatgagcgtggctgcagaaatggatcttgaagacggcggtgagatgccaaagcagcgggaccctaagtcaaattag

SEQ ID NO: 241807 - DNA, 1455 bp, Artificial Sequence
  Description of Artificial Sequence: Synthetic coding sequence
atggtggactcaacagaatacgaggtggccagccagcccgaggttgagacttcgccactcggagacggagccagcccgggaccagaacaggtaaaactgaaaaaggagatctactcagccagcttcggtctttccctcgtcatttgggccgtaggcggtctattttctgtatttggtgccctctgctatgcagagctggggacaaccatcaagaagtctggtgcttcttacgcatacattttggaggccttcggcggatttcttgcgttcatcaggctctggacaagcttgctcattattgagcccacatcacaggcgattatcgcaattacgttcgctaattacatggtacagcccttattcccttcctgttttgcgccttatgcagcttcccgccttttggcagctgcttgtatctgtttactgacatttataaattgcgcgtatgtcaagtggggcactcttgtgcaggacatcttcacatatgcaaaggtacttgcgctcatcgccgtgatcgttgctggcatcgtgcggttagggcagggcgcatcaacccacttcgagaactcgttcgagggatcctcattcgctgtgggggacatcgccctcgccctgtattccgccttattcagttatagtgggtgggacactttaaactatgttactgaagagattaagaatccagagcgtaacctgccgctcagtatagggattagtatgcctattgtgacaataatctacatcctcactaatgtggcttactatacggttctcgatatgagagatatcttggcctctgacgccgtcgctgtgactttcgcagaccagattttcgggatcttcaactggataatccctttgtccgtcgccttgtcatgcttcgggggactgaatgcaagtattgtggcggcatcacggctgttcttcgtggggagtcgtgaagggcacctgccagatgccatatgtatgatccacgtggagcgctttaccccagttccctctctgttattcaacgggattatggcgcttatatacttgtgtgtcgaggacattttccaactgattaactactactcattcagttattggttcttcgttggcctgtccatcgttggccaattatacctccgttggaaggaaccagatcgccctagacccctaaagttgtccgtttttttcccaattgtgttttgcctctgtactatctttctggtcgctgtgcctctatactcagacactataaactcactcataggaatcgcaattgcattaagcggactccccttctattttctgattatcagagtgccagaacacaagagacctctctatctgcgcagaatcgttggctctgccacaagatatcttcaggtcctgtgtatgtccgtggcagctgagatggatttagaagatggtggggagatgcctaagcaaagggaccccaaatccaattag

SEQ ID NO: 241808 - DNA, 426 bp, Artificial Sequence
  Description of Artificial Sequence: Synthetic coding sequence
atggtggattccacagaatatgaggtggctagccagcctgaagtagagaccagtccacttggagacggtgcctcacccggtcccgaacaggtcaaacttaagaaggagatctctctgctcaacggggtttgtctcatcgtcgggaatatgattgggagtgggatttttgtgtcccccaagggcgtattgatttactctgcctccttcggactgtccttggtgatctgggcggtgggcggactgttcagtgtatttggagccctttgctacgcggaactcgggaccaccattaagaagagtggtgccagttacgcatacattctggaggcttttgggggatttctcgccttcattaggctctggacatccctactaataatcgaaccgactagccaggctatcatcgccatcacgttcgcaaattag

SEQ ID NO: 241809 - DNA, 135 bp, Artificial Sequence
  Description of Artificial Sequence: Synthetic coding sequence
atggtcgatagtacagagtacgaggtcgcttctcaaccggaggttgaaacaagccccttaggggacggcgcatcacctggaccagagcaggtgaagctgaagaaggaaatctccttacttaatggggtgtgctag

SEQ ID NO: 241810 - DNA, 495 bp, Artificial Sequence
  Description of Artificial Sequence: Synthetic coding sequence
atggttgacagcaccgaatacgaggttgcgtcccagcccgaagtcgagactagccctctgggtgatggggcatcccctggtcctgagcaagttaaactcaagaaagagattagcctcctcaacggtgtctgtctcatcgtgggtaatatgatcggttcagggatctttgtgtcgcccaaaggcgtgcttatttactctgcgagctttggactttctctagtgatttgggcagttgggggtcttttctccgtcttcggagctctatgttacgcagaactcggtaccactatcaagaaaagcggtgcgagttacgcctacatcttagaggccttcggaggcttcttagcctttattcgtctgtggacctctctcctaataatcgaacctacaagccaggcaatcatcgccattacctttgctaactacatggtgcagccactcttcccttcctgcttcgcaccatacgctgcttcaagactgctggctgccgcttag

SEQ ID NO: 241811 - DNA, 369 bp, Artificial Sequence
  Description of Artificial Sequence: Synthetic coding sequence
atggtggatagtaccgagtatgaagtggcaagtcaacccgaagtggagaccagtccacttggcgacggagcatctcctggacccgagcaggtgaagctgaaaaaggagatctcactccttaacggagtctgtttaatcgtgggaaatatgattggaagcggtatctttgttagccccaaaggagtgctgatctatagtgcaagtttcggattgtcgctcgtaatctgggctgtgggcggactgttctctgttttcggggctctctgttacgctgagctcgggaccaccattaaaaagtcaggagcctcctatgcctatattttagaagcttttggcggtttcctcgccttcatccggttatggacttag

SEQ ID NO: 241812 - DNA, 1536 bp, Artificial Sequence
  Description of Artificial Sequence: Synthetic coding sequence
atggtggatagcaccgagtatgaggttgcaagccaacctgaggtagagaccagccccctgggcgacggggcatcaccaggacccgagcaagttaaactaaaaaaggaaatcagcctgctaaatggcgtgtgcctgattgtcggcaacatgattggctcgggcattttcgtctcaccaaagggcgttctgatttactccgcctcatttgggttgtctttggttatctgggcggttggcggtctcttttctgtctttggagctctctgctacgccgaactggggaccacaatcaaaaagtccggtgcctcttacgcatatatactggaggccttcggcggattcttggctttcatccgactctggacctcgttgctcataatcgagcctacatctcaggccataatcgcaatcacttttgccaattacatggttcagcctctgttcccgtcctgttttgcaccctacgccgcttcacgcctactcgccgcagcctgcatctgcttattgacttttattaactgtgcttatgtaaaatggggcactcttgtacaagatatctttacatacgctaaggtccttgcactgatcgccgtaatcgtggctggcatcgtccgcctggggcagggagcaagcacccatttcgagaattccttcgagggaagttcctttgcagtcggagacatcgcactggccctgtatagtgcactgttctcctacagcggctgggacacccttaattatgtcactgaagaaatcaaaaaccccgagagaaacctgcctttgtcaatcgggatctccatgccaatcgttacaatcatttacattctcacaaacgttgcttattatacagttctggatatgagagatattctggccagtgatgcagtggccgtgacatttgccgaccagattttcggaatctttaactggatcatacctttgagtgtggcattgtcctgcttcggcggtctgaatgcctctattgtggcagcttctcggttgttttttgttgggagccgggagggccaccttccagacgcaatttgtatgatccatgtggaacggtttacacctgtgccaagcctgctattcaatggaatcatggcactcatctatctgtgcgtggaagatatcttccagttgatcaactactacagcttttcttattggttcttcgtcggactgagcattgttggccaactttatctgagatggaaggaacccgaccggccacgtccgctgaaattaagcgtcttttttccaattgtattttgcctctgcacaattttcctcgtggccgtgcctttgtatagtgacaccattaactctctaatagggattgcaatcgcactctctggcctccccttctatttcttaattatacgtgtgcccgagcataagcggcctttgtacctacggcgaatcgttggcagtgcaacgaggtatctgcaggtactttgcatgtcagtggccgctgaaatggatctcgaagacggtggcgagatgcctaaacaaagagacccaaagtctaattag

SEQ ID NO: 241813 - DNA, 348 bp, Artificial Sequence
  Description of Artificial Sequence: Synthetic coding sequence
atggtcgactccacagagtatgaggtcgcttcacagcctgaggtggagactagccctctgggtgatggcgcaagcccaggacctgaacaggtgaaattgaaaaaggaaatctcacttctgaatggggtgtgtctgatcgtaggaaacatgatcgggagcggcattttcgtttctccaaagggtgtccttatttacagtgcctcttttggcttgagcttagtgatatgggcggtaggagggttgttctccgtgttcggagcgttgtgttacgctgagctcggcactacgatcaagaaatctggggcatcttatgcgtacattctagaagccttcggcggatttctctag

SEQ ID NO: 241814 - DNA, 93 bp, Artificial Sequence
  Description of Artificial Sequence: Synthetic coding sequence
atggtggatagcacagagtacgaagtagcgagccagcccgaggtggagacatcgccgctaggtgacggtgcctcccctggacctgagcagtag

SEQ ID NO: 241815 - DNA, 933 bp, Artificial Sequence
  Description of Artificial Sequence: Synthetic coding sequence
atggtcgacagtaccgagtatgaagtggcttcccagcccgaggtggagaccagtcccctcggggacggcgcatctcccggtcctgagcaggttaaattgaagaaggaaattagcctgctcaacggagtatgtctcattgtcggtaacatgattggcagcgggattttcgtgtcacccaagggagttttaatttattccgcgtccttcgggctctctctggtcatttgggccgtcggcggactcttcagcgtgtttggcgctttatgttatgcggaactcgggactacaatcaagaaaagtggcgcttcttacgcgtatattctggaagcttttgggggatttctggctttcattcggctgtggacaagtttgttgatcattgagccgacttcccaagcaattatcgctatcacctttgcaaactatatggtccaaccgttgtttcccagctgttttgcgccttacgctgcctcccggctgttggcagccgcatgcatctgtcttctgactttcatcaattgtgcctacgtgaaatgggggacactcgtacaggatatctttacgtatgcaaaggtgctcgccctcatcgccgtgatcgtcgctggaatcgtccgcttaggtcagggggctagtacacattttgaaaattcattcgagggttcatccttcgccgtgggagacattgctcttgcgctctacagcgcgttgttcagttatagtggatgggacacactgaattatgttaccgaggaaataaaaaatcccgagcggaacttgcccctcagtatcggtatttctatgccgattgtcaccatcatttacatccttaccaacgtggcgtactacacggtcttggacatgcgagatatcctggcctccgacgctgtggccgtggcattcctttgtggtctgaagcgccgtcctagcccctag

SEQ ID NO: 241816 - DNA, 321 bp, Artificial Sequence
  Description of Artificial Sequence: Synthetic coding sequence
atggtcgatagcacggaatatgaagtggcgtctcaaccggaagtggagactagtcccctgggtgatggggcatcacccggtccggaacaagtgaaactgaagaaagaaattagcttgttaaacggtgtgtgcctgattgtgggaaatatgatcgggtccggtatttttgttagtcctaagggggtgttaatttatagcgcctccttcggcttgtccctggtaatctgggccgtaggaggcctctttagtgtgttcggtgctctgtgttatgccgagctgggcaccacaatcaagaaaagcggagccagttatgcatattag

SEQ ID NO: 241817 - DNA, 351 bp, Artificial Sequence
  Description of Artificial Sequence: Synthetic coding sequence
atggtggattccactgagtacgaggtggcctcacagccagaagttgagacctcacctcttggcgacggcgcatctccaggcccagagcaggtcaagctaaaaaaagagatatcgttacttaacggggtgtgcctcatcgtcggcaacatgatcggctctggaatcttcgttagtccaaagggagttcttatttatagcgcatctttcggcctgtccctcgtgatttgggcggttggcggactgttcagtgtctttggggctctctgctacgctgaattgggcaccactatcaagaagagtggcgctagctatgcctacattctggaagcattcggcggatttctggcatag

SEQ ID NO: 241818 - DNA, 1890 bp, Artificial Sequence
  Description of Artificial Sequence: Synthetic coding sequence
atggggtgcaaagtgctgctaaacattggacagcaaatgctccgccgaaaagtagtggattgcagccgtgaggaaacccgcttgagccggtgcctgaatactttcgacttggtcgcattgggtgtgggtagcaccttgggggcaggagtgtatgtgcttgcaggcgctgttgcacgtgaaaatgccggtcccgctatagtcatctctttcctgattgctgcgctcgccagcgtcctagcaggcctttgttatggagagttcggtgccagggtcccaaagaccggctctgcgtacctgtacagctatgtaacagtaggggaactctgggctttcatcaccgggtggaacctgatcttatcatatattattggcaccagcagcgtggctcgcgcttggtccgccacttttgacgagctgattggtaggcccatcggagagttctccaggactcacatgactctgaatgctcccggtgtgttagctgagaatcccgatatcttcgccgtgattattatcctcattttgacgggtcttttgactctaggggtgaaagaatctgctatggttaacaagatttttacttgcataaatgtgctcgttcttggctttatcatggtgtccggtttcgtcaaaggttccgtgaagaattggcaactgaccgaggaagattttggaaacacctccgggcgactgtgcctgaataatgatactaaagagggcaaacctggcgtcggcggatttatgcctttcggatttagtggagtgttatctggagccgcaacctgcttttatgcctttgtgggctttgattgtatcgccaccaccggggaagaggtcaaaaacccccagaaagctattcccgtgggcatagttgcaagtctgttgatttgcttcatcgcgtatttcggagtctcagcagctctgacccttatgatgccttacttctgccttgacaataattcacccctcccagatgcattcaaacatgtgggatgggagggcgcaaagtatgctgtagcagtgggttcattgtgtgccctgtctgcgtctttgttggggtccatgttccctatgcccagagttatctatgccatggccgaagacgggttgctttttaaattcctggcaaatgtgaatgataggacgaaaactcctattattgccacccttgcaagtggagcagtggcggctgttatggctttcctgtttgacctaaaagacctggtggatttaatgtctatcggaaccttgctggcctactctctggtggccgcttgcgtccttgtgctgcgttatcagccagaacagccaaatctggtataccagatggcctcaacctctgacgagctagaccctgccgatcagaatgagctagcatcgacgaatgattctcagctcggtttcctccctgaagctgagatgttctctctgaaaaccattctcagccctaagaatatggaaccctccaagatctccgggttgattgtcaacattagcacatctctgattgctgtgttgatcatcacattctgtatcgtcacagttttaggtagagaggcactgacgaaaggggcactctgggcggtgttcttactggcagggagcgcacttctatgcgctgttgtgactggtgtcatttggagacagcccgaaagcaagaccaagctctcttttaaggtgccattcctccctgttttgccgatcctgtccatcttcgtaaacgtttatctcatgatgcagttagaccagggcacgtgggtgcgctttgctgtatggatgcttattgggttcatcatttactttgggtacggactgtggcactcagaggaagcttctctggatgctgatcaggcgagaactcccgacggcaatctggatcagtgcaagtag

SEQ ID NO: 241819 - DNA, 366 bp, Artificial Sequence
  Description of Artificial Sequence: Synthetic coding sequence
atgggatgcaaggtgctgctcaatattggccagcagatgctgcgccgaaaagtggtcgactgctcacgagaggaaaccaggctgtcccgctgtctgaatacattcgacctcgtcgcactgggggttggatcgactctgggagcaggggtgtacgttctggccggtgcggtggcacgcgagaatgcagggcctgccatcgtgatttccttcctgatcgccgcattggctagtgtgctcgctggtctttgctacggagaatttggcgctcgggtgcctaaaactggttctgcatacctctactcttatgtgacagttggggagctctgggctttcataacaggttggaatctcatcctgagctactag

SEQ ID NO: 241820 - DNA, 2097 bp, Artificial Sequence
  Description of Artificial Sequence: Synthetic coding sequence
atgaagattgagaccagtgggtataatagtgataagctcatttgcaggggcttcatcgggacacctgcccctcccgtctgtgactcaaaattccttctgagcccatcctcagacgttagaatgataccatgtagagcagccctaacatttgctagatgcctgatcaggaggaaaattgtcacactcgacagcttagaggataccaagttgtgcagatgcctctcaactatggacctgatcgccctgggcgtgggcagtacattgggcgcaggcgtgtatgtgttggccggagaagtggctaaagctgactctggcccaagcatcgtggtgagctttctcatagccgcactggcttccgtcatggctggcctctgttacgctgaattcggtgccagggtaccaaagaccgggagcgcctatctctacacttacgtcactgtgggcgaattgtgggctttcatcacaggctggaatctcatcttatcttacgtgatcgggacatcttctgtagccagagcctggtctggcacattcgacgagctgctgtccaaacagataggccagtttctcaggacctacttcagaatgaactacactggtctggctgagtacccggacttctttgctgtttgtctgatcctcctgctggccggactcctctcttttggagtaaaagaatccgcatgggttaataaagtgtttactgccgttaatatactggtactgttgtttgtcatggtggctgggttcgtcaagggcaatgtggccaactggaagatttctgaggaattcctgaagaacatttccgctagcgcgagagagcctccttctgagaatggcactagtatctatggggcaggaggcttcatgccttatggttttacagggaccttggcaggagccgcaacctgcttttacgcctttgttggctttgattgtattgccacgaccggtgaagaagtccgaaatccgcagaaggcaattccaatcggcatcgttacaagtttactcgtgtgcttcatggcctacttcggcgtgtcagccgctttgacactgatgatgccatattaccttctggatgaaaaaagcccattgcctgttgccttcgagtacgttggatggggcccagctaagtacgtggtggcggcaggctccctctgcgctctcagtacaagcctcctcggcagcatttttcctatgccacgagtgatctatgcgatggctgaagacggccttctattcaaatgtctggcacagattaatagcaaaactaagaccccaattatcgctacgctttccagcggagctgtggctgcgctaatggcttttctctttgacttaaaagccctggtggatatgatgtctattggtaccctgatggcgtattctcttgtggccgcttgtgtcctgatccttcgatatcagcccggactcagttacgatcaacccaagtgcagtcctgagaaagacggcctcggatcctcgccgagggtgacttccaagtctgagtctcaagtaaccatgctgcagaggcaaggcttttcaatgaggaccctgttctgcccttcacttttaccaacacagcagagtgcaagcctggtctcctttctcgtgggtttcctcgccttcctggtcctgggtctgagcgtactcaccacgtatggggtccatgccattacacgcctagaagcatggagtctagcgttgctggcactatttttggtcttatttgtggccatagtgttaacgatctggcggcagccgcaaaaccaacagaaagtggcttttatggtgccattcctgcccttcctgcccgcattctctatcctggtgaatatttacctgatggtacagctgagtgcagatacatgggtgaggttttccatttggatggctatcggctttctgatctactttagctatgggatcagacactcgcttgagggccacctgcgcgacgaaaataacgaggaagatgcataccctgataatgtgcatgcagccgcagaagagaagtccgcaattcaggcaaacgaccatcaccccaggaacctgagctctccctttatttttcacgagaagacttccgaattttag

SEQ ID NO: 241821 - DNA, 2094 bp, Artificial Sequence
  Description of Artificial Sequence: Synthetic coding sequence
atgaaaatcgaaaccagtgggtacaactcggataagctgatttgtcggggatttattggcactccagcccctccagtgtgtgattcaaaatttcttctgagcccatctagcgacgtcagaatgatcccatgtcgcgcagctctgacattcgccagatgcctgatcaggaggaaaatagttacactggacagtctagaggacacgaagttgtgccgatgtttgtctacaatggatctgatcgcccttggcgtgggaagcaccctgggcgcaggcgtgtacgtcttagccggagaagttgctaaggcagatagtgggccttcaattgtggtgagttttctcatcgctgctctggcttctgtgatggccggattgtgctacgccgagtttggtgccagagtgccgaagaccggctctgcttacctgtacacctatgttacagtcggagagctctgggccttcataaccggctggaatctaatcctgagctacgtcataggaacctcttctgtcgccagggcttggagcggtacattcgatgaacttctgtctaaacagattggtcaattcctgcggacatactttaggatgaactataccggactggccgagtatccagacttcttcgctgtgtgcctgatactgttgcttgctggactcctgtcctttggcgtgaaggagagcgcttgggtgaacaaagtgttcactgccgtcaacatactggtcctactgtttgtgatggtggctggctttgtgaagggaaatgttgctaattggaaaatcagtgaggagtttttgaaaaacatcagcgcatccgcccgtgagcctccttctgagaatgggacctctatatatggagctggaggtttcatgccgtatgggttcaccggcacgctcgctggagccgctacctgtttctacgcctttgtcggatttgattgtattgccaccacaggggaagaggtccggaatcctcaaaaagctatccccatcggaatcgtgacatcacttttagtgtgctttatggcttacttcggcgtaagtgctgctctaaccctgatgatgccttactatctcctcgatgaaaagagccctctccctgtggccttcgaatatgtcggctggggacccgctaaatacgtggtggccgcaggcagcctgtgtgccctgagcacctctctgctcggaagcatgttcccactgccgaggatcctcttcgcaatggccagagacgggcttctgtttcgattcctggccagagtgagtaaaagacagtcgcccgtagcggctaccctgaccgcgggagtgatctctgcactgatggctttcctgttcgatttaaaggctctcgttgatatgatgtcaatcgggaccctaatggcctactcactcgtagcagcatgcgtcctaattctgcgctatcaacccggactgtcctacgaccagccaaagtgcagtcccgaaaaggacggactgggaagttccccgagagttacttcaaagagcgaatcgcaggttaccatgcttcagcgccagggctttagcatgcgtacccttttctgcccttcactgctcccaacccagcaaagcgcttccttagtgtcctttctggtgggattcttggctttcctcgtgttagggctgtcggtcctcaccacttacggggtccacgcgattacccgcctggaggcctggagcctggcccttctcgccctttttctagtcctgtttgtggcaatcgtgctgactatctggagacagccacaaaatcaacagaaggttgcatttatggtcccattcttaccattcttgcctgcgttctcaattttggtgaatatctacctcatggttcaattaagtgccgacacttgggtaagatttagcatttggatggcgattggcttcctgatctatttctcttatggtataaggcactccctggaaggccacttgcgcgatgagaacaacgaggaagatgcatacccagataacgtccatgcagccgcagaggagaaatcagcaattcaggctaacgaccaccaccctcgcaacctctcctccccgtttatatttcatgagaagacttctgagttctag

SEQ ID NO: 241822 - DNA, 2094 bp, Artificial Sequence
  Description of Artificial Sequence: Synthetic coding sequence
atgaagatcgaaactagcggctacaatagcgacaaactgatttgtcggggttttatcggcactcctgcgccaccagtgtgtgattcaaagtttctcctgtccccatcctctgacgtcaggatgattccctgtagggcagccctgacattcgcacggtgcctgattcgccgaaagatcgtcacacttgactctttggaggacactaagctatgccgttgtcttagcacaatggacctcattgcgttgggcgtaggctccacgctgggggcaggagtctatgttctcgctggcgaggttgctaaggccgattctgggccaagtatcgtagtgagtttcctgatcgccgcactggcgtcagtgatggctggtctttgctacgccgagtttggcgcacgggtgcccaaaactgggtccgcctacctgtacacttatgtgaccgtgggagagctgtgggccttcattaccggctggaacctgatactgtcctacgttatcggaacctcatcagtagcccgagcttggagcgggacttttgatgagttgctgtcaaaacaaataggacaatttttaaggacatactttcgcatgaactacaccggactggcagagtaccctgatttctttgcggtgtgtcttattctgctgttggccggtctgttgtcttttggcgtcaaggagtcggcatgggtcaataaagtcttcacagccgttaacatcctcgtgctgctctttgtgatggttgcagggtttgttaagggcaacgtcgcaaactggaagattagtgaagagtttttaaaaaatattagcgccagcgcacgggaacctccgtcagagaatgggacctctatctatggagctggagggttcatgccgtacggttttactggcacactggccggagccgctacatgcttctatgccttcgtaggatttgattgcatcgccactaccggagaggaagtgaggaacccccagaaagctatcccaattggcatagtaacatccttgctcgtttgctttatggcctatttcggagtaagtgcggcactgacattgatgatgccctattatctgctcgatgaaaagagtccgctccccgtggcattcgaatacgttggctggggacctgccaagtatgttgtggccgcaggatcactgtgcgcgctgtctaccagtttgctgggatctatgtttcccctgcctcgcatactgttcgcgatggccagggatgggctcctcttcaggttcctggcgagagtgtccaaacgccagagtcccgtcgccgctaccctcacggcaggagttatcagtgctctgatggcttttctgttcgacctgaaagcccttgtagatatgatgtccatcggcacactgatggcatactccctggtggccgcatgcgtgctgatcctgcggtaccaacccggactgtcatacgatcagccaaagtgttccccagaaaaggacggactggggtcctcaccccgtgtgacgtcgaaatccgaatcacaagtcacgatgctgcagagacaaggcttcagcatgcgaacacttttctgtccgtcactgctacccactcagcagagtgccagtctcgtgagcttcctcgtggggttcctagcttttttggtcctgggtttgtccgtactcaccacatacggagtgcacgcgattactagactggaggcctggtcacttgccttgctggctctgtttctggtcctgtttgtggccattgtgctgaccatttggaggcagccccagaaccagcaaaaagtcgcattcatggtcccatttctcccttttctgcctgccttttccattcttgtcaatatatacctgatggtccagctgtctgccgatacctgggtcaggtttagcatttggatggcgattggattccttatttacttttcctatgggatccgacacagtctggagggccatctacgcgacgaaaacaatgaagaggacgcctatcccgacaacgtccacgccgcagctgaagagaagagcgccatacaggcgaacgaccaccatcccagaaatttatcaagcccattcatcttccacgaaaagactagcgagttttag

SEQ ID NO: 241823 - DNA, 1977 bp, Artificial Sequence
  Description of Artificial Sequence: Synthetic coding sequence
atgattccgtgcagggcggctttgacattcgctagatgtttgataagaaggaaaatcgttacactggacagcctcgaggataccaagctttgtcggtgcctgagcacgatggacctgattgccctcggtgttggcagcacactgggggctggcgtgtacgtcttggcaggtgaggttgctaaagcagactcaggaccatctatcgtcgtatccttcctcatcgctgctctcgcatctgttatggcgggattgtgttacgcggaattcggcgcaagagtaccaaaaactggctccgcatatctgtacacttacgtgaccgtaggagagttgtgggctttcataaccggatggaatctcatcctgagttacgtcattggcacatcatctgttgccagagcatggtctggcacatttgatgagctgttaagcaaacagatcggccaattcctgagaacttacttccgcatgaactacacgggtttagccgagtaccccgactttttcgccgtatgcctcatcctgctcctagccggactgttgtcatttggggttaaagaatctgcctgggtgaataaagtgtttaccgctgtgaatatcttggtgcttctcttcgtcatggtggctggctttgtcaaagggaatgttgccaactggaaaatctccgaggaatttctgaaaaacatctccgcttcagcgcgtgaacctccctcagagaatggaacttctatctacggggcaggaggctttatgccatacgggtttactgggactctggcaggcgcagctacatgcttctacgcattcgtagggttcgattgcatcgcaacaaccggagaggaggtccgaaatcctcagaaagccataccaattggtattgtaacatctctgctggtgtgcttcatggcttacttcggcgtttctgcagcacttactctgatgatgccgtattacctgctggacgagaaaagtcccctgccagtggcatttgagtacgtgggctggggcccagctaaatacgtggtagctgccggatcactttgcgctttgtctaccagcctgcttggaagtatctttcccatgccacgagtgatctacgctatggccgaggacgggttactctttaagtgccttgctcagattaattccaagacaaagacgcctataattgccaccttatccagtggagcagtcgcagctctgatggcttttctattcgacctgaaggcactggtggacatgatgtccatagggaccctgatggcttactctctggttgccgcttgtgttcttattcttaggtaccaacccggactatcctacgatcagcctaagtgttcgcccgagaaagacgggctcggctcttctccaagggtgacctcaaagtccgagagtcaagtgacaatgcttcagcggcaaggcttcagcatgagaacactgttctgtccgagcctattacctacccagcaatcagccagcctggtgtccttcctggttgggtttttggcttttctagtcctgggcctgagtgtcctgaccacctacggagtacacgcaattacgcggctggaagcgtggagcttagcgctactcgccttgtttttagtacttttcgtggcaattgtgctgaccatctggaggcagccccagaaccagcaaaaagttgctttcatggttcccttcctcccctttctgcccgctttttctattctggtcaacatctatctgatggtgcagttatccgctgatacctgggtaaggttcagcatctggatggccatcggctttcttatctatttttcttatggaattcgccatagcctcgaaggacacctgcgagacgaaaataacgaagaggacgcctatcccgataatgttcacgcagccgcagaggagaagtccgccatccaagccaacgaccatcaccctcgcaatctctcgtccccatttatatttcacgaaaagacgagtgagttttag

SEQ ID NO: 241824 - DNA, 1977 bp, Artificial Sequence
  Description of Artificial Sequence: Synthetic coding sequence
atgattccatgcagagcggctctgactttcgctagatgtcttatccgaaggaaaatagtgaccctggattccctggaagatactaaactgtgccggtgtctcagtacaatggatctgatcgccttgggggttggtagcactctgggcgcaggcgtctacgtgctagcgggagaggtagcaaaggctgacagtggcccttccatcgtggtgtcctttttgatagcagccctcgcaagcgtgatggccggattatgctatgccgaatttggagctcgggtccctaagactgggagcgcctacttatatacatatgtcactgttggcgagttatgggcattcatcaccggctggaaccttatcctgagttatgtaatcgggacctcttctgttgcgagggcatggagcggcaccttcgacgaactcctgtcaaagcaaattggccagttcctacgcacctactttaggatgaattacactggactagctgaataccccgatttcttcgccgtttgtctgatcctgttgctggccggtctcctttcctttggtgtgaaggagagtgcgtgggtgaataaggtttttactgcggtgaacatactcgttctgctgtttgtcatggtggccggattcgtgaaagggaatgttgctaattggaagatcagcgaagagttcctgaagaatatttccgcctcagcacgagaaccaccgtcagagaacgggacgtcaatatacggagcagggggattcatgccttacgggttcactggcacactggccggtgcagcaacctgcttctacgccttcgtgggattcgactgcattgccacaactggcgaggaggtgaggaacccccagaaggctatcccgattgggatcgtaacctcattgctggtttgtttcatggcctacttcggagtatctgctgccctgactcttatgatgccatactatctcctcgacgaaaaaagccccctcccagtcgcttttgaatatgtcggctgggggccagcaaagtatgtcgtggccgctggcagtctttgtgctctttccacctccctgctgggaagcatttttcctatgcctagagtgatatatgcaatggccgaggacggactgcttttcaagtgtctggctcagattaattccaagaccaagacccccattatcgcgaccttgtcctccggcgcagtggccgctcttatggccttcctatttgatcttaaagcgctggtcgacatgatgtcaatcggcactcttatggcctatagcctcgtggccgcatgcgtgcttatcttaagataccagcctggactgtcttacgaccagcctaagtgttcgcctgagaaagacggactaggaagcagtcctagagtgactagtaagagcgagagtcaagtcacgatgttgcaaagacagggctttagcatgaggacccttttttgcccaagtctccttccgactcagcagtctgctagcctggtctcctttttggtgggcttcctcgccttcctagtcctgggtctgtccgtgcttactacttatggtgtccacgccataacccggctcgaggcgtggtccctggcgctgctggccctgttcctcgtgcttttcgttgcaattgttttgacgatctggagacagccccagaatcagcagaaggtcgcatttatggtgccctttctgccgttcttgccagccttttcaattctggtgaatatctacctcatggtgcagttgagcgctgacacatgggtcaggttctctatttggatggccatcggcttcctcatttatttctcatacggtataaggcatagtctggaaggccacctacgggacgagaataacgaggaggatgcatatcctgacaatgtgcacgcagctgctgaagaaaagtctgccatccaggcgaatgaccatcaccccaggaatctgtctagtccattcatcttccacgaaaagacctccgagttttag

SEQ ID NO: 241825 - DNA, 1464 bp, Artificial Sequence
  Description of Artificial Sequence: Synthetic coding sequence
atgggcgatacaggactgaggaaacggcgagaagacgaaaaatccatccagagccaggagcctaagaccactagtcttcagaaggagctggggctcatttcagggatttccattatcgtcgggacaataattgggtccggtattttcgtgagccctaaaagtgtgctgtccaacactgaggccgtcggaccctgcctgatcatttgggcagcctgtggcgtgctagcgactcttggggcattgtgttttgcagagttgggaactatgataaccaagagcgggggtgaatatccgtacctcatggaagcttacggccctataccagcataccttttttcatgggccagcctgattgtcatcaagcccacctccttcgccatcatatgcctgtcgttttcagagtacgtctgtgcccctttttacgtcggatgtaagcccccacaaatagtagttaaatgtctggcagcagcagctatattgtttattagcactgtaaattctctgtccgttcgccttggaagctacgtccagaatattttcaccgccgcaaaactggtgatagtagctatcatcattatatcaggattggtcctacttgcacaggggaataccaagaacttcgacaacagttttgagggcgctcagctttccgtgggagcaatctccctggccttttacaacggcctttgggcctatgacggctggaaccagcttaactatattactgaagagctacgaaacccttaccggaatttacctcttgccattataattgggatccccctggtgaccgcctgttacatcttgatgaatgtgtcttacttcaccgtgatgacagcaactgagctgctgcagtcccaagcggtggccgtgacattcggggaccgcgttctgtaccctgcaagctggattgtgccactcttcgtggctttctcgacaatcggcgctgccaacggtacatgcttcactgccggtcgcctaatctatgttgccggtcgggaaggacacatgctgaaagtactgagctatatctcggtccggcgactcacccccgcaccggctatcatattctatggaatcatcgcaaccatttacatcatccctggggacataaactccctggtgaactactttagtttcgccgcttggttattttacggactgacgatactgggactgatcgtcatgcgattcactagaaaggaactggaacgcccaatcaaagtgccagtggtgatccctgtcctgatgacccttatctccgtctttttagtgctggccccaattatctcgaaacctacctgggagtatctgtattgcgttcttttcatcctcagcggcttgctcttctatttcctgtttgttcattataaattcggttgggctcaaaaaattagcaaacctataactatgcacctgcagatgctgatggaggtcgtgcctccagaagaggatcccgagtag

SEQ ID NO: 241826 - DNA, 1464 bp, Artificial Sequence
  Description of Artificial Sequence: Synthetic coding sequence
atgggcgatacaggcctgcgtaaacggagagaggatgagaaaagcatccagtcccaggagccaaagacgacctccttgcaaaaagaactgggccttatcagtgggatatccatcatcgtcgggaccatcatcgggtccggaatttttgtgagccctaagagcgtcctttcgaataccgaggcagtgggaccctgtttgatcatatgggctgcctgcggggttctggcaacactgggtgcgctatgttttgctgaactcgggactatgattacgaagagtggcggagagtatccgtacctcatggaggcttacgggcctattccagcatacctcttttcctgggcgagtctgattgtgataaaacctactagctttgctataatatgcctgagtttctcagaatacgtgtgtgcccctttttacgtgggatgtaagcccccacagatcgtcgtcaagtgccttgctgccgcagctatcctgttcataagcaccgtaaattcactgtctgtgcgacttggaagctacgttcagaacattttcacggcggcaaagctcgttatagtggccattattattattagtggattggtgctgctggcgcagggtaacactaaaaatttcgacaactcttttgaaggggctcagctgtctgtaggcgcaatctcactggctttctacaacggcctctgggcctatgatggctggaaccagctcaactacattaccgaggagctgcgcaacccctacagaaatctgcccctcgccattatcattggcatcccattggtgacggcatgctatattcttatgaacgtctcgtattttactgtcatgacagctaccgaattgttgcaaagccaggccgtggccgtcacattcggtgacagggtcctttatccagcctcttggattgtccccctgttcgttgcgttttctacaatcggcgctgccaacggaacatgctttactgccggaaggctcatttatgtggcaggcagagagggacatatgttgaaggtcctcagctacatatctgtgcgcagactgaccccagctccagcgatcatcttctacggaatcatagccaccatctatatcattcctggcgatattaacagtctcgttaactacttctctttcgccgcatggctcttttacggcttaaccattctgggcttgatcgtaatgcggttcacgcggaaggagctggagagacccattaaagtgcctgtcgtcatcccggtgctgatgactctcattagcgtgtttctcgtcttggccccaattatatctaagcccacctgggaatacttgtattgtgttctatttatcctatcgggcctcctgttttactttctgttcgtgcactataagtttggctgggctcagaagatttctaaacctattaccatgcacctgcaaatgctgatggaagttgtgccccctgaggaggatccagagtag

SEQ ID NO: 241827 - DNA, 1908 bp, Artificial Sequence
  Description of Artificial Sequence: Synthetic coding sequence
atggccagagggctccccacaattgcctcacttgccagattgtgtcagaagcttaacagactaaaacctctagaggattctacgatggagacaagcctccggaggtgtctgtcaactctagatctcacgctcctcggcgtcgggggaatggttggcagcggcctctacgtacttaccggggctgtggctaaagaagtcgccggtccggcagtgttgctatcctttggggtcgctgcagttgcctccttattagccgcactctgctatgcagaatttggagcacgtgtcccccgaacaggcagcgcatacctgttcacatatgtctccatgggggagctatgggcctttctcattggttggaacgtgttgctagaatacataattggaggggctgctgtcgcaagggcttggtccggatacctggattcaatgttctcacattccatcaggaacttcactgagacgcacgttggttcctggcaggtgccattgctgggacactatcccgattttttagctgcgggaattattctgctggcctcagcctttgtaagctgcggagctcgggttagcagctggttaaaccatacattcagcgccatatctctcctggttattctctttatcgtgatcctgggattcattctcgcccaaccgcacaattggagcgcggacgagggaggattcgccccttttgggttcagtggagtcatggctggaactgccagctgcttctacgcttttgtcggcttcgacgtgatcgctgctagtagcgaggaagcccaaaacccacgacgcagcgttcctcttgccattgcgatctctcttgctatagccgctggcgcatacatcttggtgtctaccgtgctcaccttgatggtgccctggcacagcttagatcccgacagcgccctcgcggatgcgttttaccagaggggctacaggtgggccggttttattgtggcagccggaagtatttgcgccatgaatacggtgctgctgtctctgctgttctccttacctaggatagtgtatgctatggctgcagatggattatttttccaggtattcgctcacgtgcacccgagaacccaggtgcccgtagccggtaccctagcattcgggctgctaaccgccttcctggccctgctgctggacctagagtcccttgtgcaattcctgtctttgggaaccttgctggcctatactttcgtcgctacatcaatcattgtgctccgcttccagaaatccagcccaccctccagtcccggacctgcctcacctggacctttgacaaagcaacaaagcagcttttccgatcacttgcagctggtgggcaccgtgcacgcttccgtccccgagccgggagaacttaagcccgctttaaggccctatttgggctttctggatggatactcacccggagctgtggttacgtgggccctcggcgtcatgctggcatccgcgatcactatcggctgtgttctggtcttcggtaacagcaccctgcacctgccacactgggggtatatcctgctgctcctcctgacctctgtgatgtttttgctatccctcttggtcttaggcgcacaccagcagcagtaccgcgaagacctatttcagatccccatggtgccactcattcctgccctatctatagtgctgaacatatgtctgatgctgaagcttagctacctgacctgggtgaggttctctatctggctactcatgggcctggccgtgtattttggttatggaatccgacattcaaaggagaaccaacgtgaacttcccggtttaaactccacgcactatgtggtctttcccagaggcagcctcgaggagactgtgcaggcaatgcagcctccgagtcaagctcctgcacaggatccaggacacatggagtag

SEQ ID NO: 241828 - DNA, 1908 bp, Artificial Sequence
  Description of Artificial Sequence: Synthetic coding sequence
atggccagagggctgcctaccatagcttctctagcaaggttgtgccaaaagctcaatcgattgaaacccctcgaagactctacgatggaaaccagcttgaggcggtgcctgagcactttggacctaacactgctgggcgttggcggaatggttgggtccgggttatacgtactgacgggagccgtggcaaaggaagtggctgggccagctgttctgttgtctttcggagtggccgctgtcgccagcctgttagccgctctgtgttacgcggagtttggcgctcgcgttcctcgcacagggtccgcttatttattcacatacgtttccatgggtgagctgtgggcttttctgattgggtggaatgtgctgctggagtatattatcggcggtgcggctgtcgccagagcgtggtctggatacttggatagcatgttctctcacagcatcaggaattttaccgagactcacgtcgggtcttggcaggtgcccctgctgggacattatcccgacttcctcgccgcaggcattatcctgctggcatctgctttcgtgtcatgtggggctcgagtaagctcttggctcaatcacaccttctcagccatcagtctcctggtgatactcttcatcgttatccttggctttatcttggctcaaccgcataactggagcgctgacgaaggaggtttcgccccattcggattctccggggtgatggcgggaaccgctagctgcttctacgcattcgtggggttcgatgtcatcgcagcaagctccgaggaagcacagaatccccgtcgatcagtgcccctggccatcgcaatttcactcgccattgccgctggcgcttacatactggtgtccaccgtgctgacacttatggtgccatggcactccctcgatccggattcagctctggcagacgctttctaccagcgtggctatagatgggcgggttttatcgtggcagccggaagcatatgtgctatgaatacagtgcttctgagtctcttattcagccttcctagaattgtttacgcaatggcagccgacgggctcttcttccaagtgttcgctcatgtccatccaaggacacaggtgcccgtggccggaaccctggcttttgggctgctgactgccttcctcgcactcctgctcgacctggagtctcttgtccaattcctcagcctcggaacactgctggcatatactttcgtggctactagcatcatagttctccggtttcagaaaagctcacctcctagctccccaggccctgcctctcctggaccgctgactaaacagcagtcatccttctcggaccacttacaactggtgggtactgtgcacgcttctgtaccagagccgggagaactgaaaccagccttgcggccatatttaggttttctggatggatacagtccaggcgctgtggtgacctgggcccttggcgttatgctcgcaagtgccattaccatcggatgcgtgctggtgttcggcaattctaccttgcatcttccccattggggctatatccttcttttgttattaacatccgtgatgttccttctgtccctgctggtactcggagcacaccagcagcagtatagggaggacttattccagattccaatggtgcccctcataccagcgctctcgatcgtgttaaacatatgtctaatgttgaaactgtcctatttgacatgggttagattctcaatctggctgctgatggggcttgccgtgtactttggctatggtatacgacatagtaaggaaaatcagagggagctccccggactgaactccacccactacgtagtgttcccaagagggagtttagaagaaactgtgcaagcaatgcagccaccgtcacaggcacccgctcaggatccaggacatatggagtag

SEQ ID NO: 241829 - DNA, 249 bp, Artificial Sequence
  Description of Artificial Sequence: Synthetic coding sequence
atggccagaggcctgccaactatagcctccctggcaaggctgtgccaaaagctgaatagactaaagccccttgaggattccaccatggaaactagcctccgtcggtgtctttcaacactcgacttaaccctgctgggcgtgggtggaatggttggctctgggttgtatgtgctgacaggcgctgtggctaaagaagttgccggacccgctgtactgctctccttcggcgtagcagcagtggcctcttag

SEQ ID NO: 241830 - DNA, 2922 bp, Artificial Sequence
  Description of Artificial Sequence: Synthetic coding sequence
atgtataacatgcgaagactcagccttagcccaaccttttcaatgggattccatttgctcgtaaccgtttccctgctgttcagccatgtcgatcatgttatcgctgagactgaaatggaaggcgagggaaacgagactggagagtgtaccggatcctactactgtaagaagggagtgatccttccaatatgggagccacaggatccaagttttggggataagatcgccagagctacggtctactttgttgcaatggtgtatatgttcctgggcgtgtctataattgccgacagattcatgtctagcatcgaggtgataacctcccaagagaaggagatcacaattaagaagcccaatggagagactacaaaaacgacagtccggatctggaacgagactgtgagcaatctgaccctcatggcccttggctccagtgcccctgagattctgctgagtgttatcgaagtgtgcggtcacaacttcactgccggagacctggggccttccacaatcgttggaagcgccgcatttaacatgtttataatcatagcattgtgcgtttatgttgtgcccgacggagagacacgaaaaattaagcacttgcgcgtctttttcgtgacagcagcctggtccattttcgcttacacatggctgtatataatcttgagcgttattagcccaggcgttgtcgaggtgtgggaaggcctgttgactttctttttcttcccaatctgcgtcgtgttcgcttgggttgcagaccggagactgttgttctacaagtacgtatacaaaagatacagggccggtaagcagaggggaatgattattgagcacgaaggcgatcgtccctcaagcaaaaccgaaatcgagatggacggcaaggtagtgaacagtcacgtagagaatttcctggacggcgctctggtcctcgaagttgatgaacgggaccaggacgacgaggaggcgcgtagagaaatggcaaggatacttaaggagttaaagcagaagcaccctgataaggagattgagcagctgattgagttagctaactatcaggttctcagtcagcagcagaaaagcagagctttttatcgaatacaggctaccagactcatgaccggcgctggcaacattctgaagagacatgccgcagaccaggctcgcaaggctgtgagtatgcatgaggtcaacactgaagtgactgaaaacgaccccgttagtaagatctttttcgagcagggtacctaccagtgcttggaaaactgcgggacagtggctttaacaatcatcaggcgcggaggcgatctaacaaataccgttttcgtcgattttaggactgaagatggcacagcgaacgctgggtctgattatgagttcactgaggggactgtggtctttaagcccggtgacactcagaaagagatacgggtgggcattatcgatgacgatatatttgaagaggatgagaacttccttgtccacctcagtaacgtcaaagtttcttccgaggcatccgaggatggtatcctcgaggccaaccacgtgagtacactggcatgtttgggctcaccgtcgactgcaaccgtcacgatttttgatgacgaccacgccggtatattcactttcgaagagccagtcacacacgtttccgagtctataggtatcatggaagtaaaggtgcttagaacaagtggagctcggggaaatgtgatcgttccttacaagaccatcgagggcacagctcgtgggggtggcgaggacttcgaggacacgtgtggagagctagaattccaaaatgatgagatcgtcaagaccatatctgtaaaggtaatcgacgacgaggagtatgagaagaacaagactttctttctcgagattggcgagcccagactggtcgaaatgtcggaaaagaaagctcttctactgaacgagctgggcggtttcacgataacgggcaaatatctgtttggtcagcccgtgttcaggaaggtgcacgcaagggaacaccctatactgagcacggtcattacaatcgccgatgaatatgacgataaacagcctctgaccagcaaggaggaggaagaacgcagaatcgccgaaatgggccgtccaatcctgggcgaacacactaagctggaggtgatcattgaggaatcttatgaattcaagagtacagtagacaagctgataaaaaaaactaacctggccctggttgtcggaactaacagctggcgggaacaatttatcgaagccatcaccgtgtctgcgggagaggatgacgatgatgatgaatgtggagaggagaagctgccctcttgtttcgattatgtcatgcacttcttaaccgttttctggaaagttcttttcgccttcgtgccgccaaccgaatattggaatggctgggcatgctttatcgtttcaatccttatgatcggcctgctcacagccttcatcggggatttggcttcacacttcggctgtaccataggcttaaaagattcagtgactgccgtcgtgtttgtggccctgggcactagtgtcccggataccttcgcctctaaagttgccgcaacccaagaccagtacgccgacgcttcaatcggcaacgtcactgggtccaacgcggtgaatgtcttccttggtattggcgtggcctggagtatagctgcgatttaccacgccgctaacggagagcagttcaaggtgtcccccggtactcttgcatttagcgtgacactatttaccatttttgcatttatcaatgtcggagtacttctgtacagacggcgtccagagatcggtggggagctcgggggacctcggaccgctaaactcctcaccagctgcctgtttgtgctcctgtggttgttgtacatttttttttcatccctggaagcttactgccatatcaagggcttttag

SEQ ID NO: 241831 - DNA, 2922 bp, Artificial Sequence
  Description of Artificial Sequence: Synthetic coding sequence
atgtataacatgcgcaggctgtctctttcaccgacatttagcatgggattccatcttctggtcacagtgtccctcctcttctcccatgtcgatcatgtgatcgccgagacagaaatggagggcgagggaaacgaaactggggagtgcactggatcttactactgcaaaaaaggagtcattctcccaatctgggagcctcaggacccctctttcggcgacaaaatcgccagagctaccgtatacttcgttgccatggtttacatgttcttgggagtgtctattatcgccgataggtttatgtcctcgattgaggttatcacatcccaggagaaggagataaccattaagaagcccaacggggagaccaccaagactactgtccgaatttggaacgaaaccgtcagtaatctcacactcatggcactcggatctagtgccccagagattcttctgtccgtaattgaggtgtgtggccataacttcacagccggagacctgggcccatccactattgtgggcagcgccgcttttaacatgttcatcatcatagcactgtgtgtgtatgtagtcccagacggtgagaccagaaagatcaaacatctgagagtgttctttgttaccgccgcttggtcaatcttcgcctatacctggctctatatcatactatcggtaataagccctggcgtggttgaggtctgggaaggcctgctaactttcttcttcttccccatctgcgtagtgtttgcctgggtagcagatcgtcggcttcttttttataaatacgtgtacaaacggtaccgcgcaggcaaacagagaggcatgatcatcgagcacgaaggtgatcggccatcaagtaaaacagaaatcgagatggacgggaaagttgttaactcccatgtagaaaacttcctggacggggctctggtcctggaagtggatgaacgggaccaggacgatgaggaggccaggagagaaatggccaggattctcaaggaactcaagcaaaaacatcccgataaggagattgagcaactcattgaattagctaattatcaggtgttatcccagcaacagaaaagccgcgctttttacagaatacaagcgacgagactcatgacaggagcaggaaatatcctcaaacgtcacgctgccgaccaagctcgtaaagctgtgagcatgcatgaggtgaacacagaagtgaccgagaacgacccagtttccaaaattttttttgaacagggaacttatcagtgcctagaaaattgtggtacggtagcgctgactattatccgcaggggcggagatcttacaaacactgtattcgtggacttccggacagaagatggcactgcaaacgctggatcagactatgaattcactgaaggaacagttgtgtttaagcctggggatactcagaaggagatacgggtcggaatcattgacgatgacatctttgaagaggacgagaatttccttgtacatctctctaacgtgaaggtgagcagcgaggcttccgaagatggcatcttagaagccaaccacgtctctacccttgcatgtttgggttccccatctactgccacggtaacgatctttgatgacgaccacgccggaattttcaccttcgaggaacccgttacccacgtatctgagagcattgggatcatggaggtgaaggttctgcgcacttccggagcaaggggaaacgtcatagttccttacaaaactatagaagggactgctcgaggcggtggcgaagatttcgaggacacgtgcggagagcttgagtttcagaacgatgagattgtcaagaccatctctgtgaaggtcatcgacgacgaggagtacgagaaaaacaaaaccttcttcctcgaaattggcgaacccaggctcgtggaaatgtcagagaaaaaagcactattgctgaacgaactgggtggctttacaatcactgggaagtacttgtttgggcagcctgtcttccgcaaggttcacgctcgggaacaccctattcttagcactgtcatcacgatcgcggacgagtatgatgacaagcagcccctaacgagcaaggaagaagaggagcgccgtattgccgagatggggcgaccgattctgggggagcacactaagttagaagtcataatcgaagaatcctacgagtttaaatctactgttgataagctgatcaagaagaccaatctggcgctcgttgtaggcaccaattcctggcgtgagcagtttatagaggccattaccgtctcagccggagaagacgacgatgacgacgaatgtggggaggagaaactaccctcgtgctttgactatgttatgcacttcctaacggtattttggaaggtactcttcgccttcgtgccccctaccgaatactggaatggctgggcctgctttatcgtgtctatcttaatgatcgggctgttgaccgctttcatcggggacttagcttcacatttcgggtgtaccatcggactaaaagatagtgtgaccgccgtagtattcgtggccttgggcactagtgtacctgacacctttgctagcaaggtggccgctactcaagatcaatatgctgacgccagtatcggaaacgtgaccggctcaaacgccgttaacgtttttctggggattggagtggcttggtccatcgccgcaatctatcatgcagctaacggagagcaatttaaggtgagccctggaactctggcgttttcagtgaccctcttcacaatctttgcttttatcaacgtcggcgtcctcctgtatcgtaggcggcctgaaatcggtggcgaacttggcggaccgagaaccgccaaactcctaacgtcttgtctattcgtccttctctggctgttgtatatattcttctcaagtttggaagcttattgtcatattaaaggcttttag

SEQ ID NO: 241832 - DNA, 2814 bp, Artificial Sequence
  Description of Artificial Sequence: Synthetic coding sequence
atgtacaacatgcgacgtcttagcctgagcccaacatttagcatgggatttcacctgttagtcaccgtctccctgctgtttagccacgtggaccacgtgatagcggagactgagatggagggcgaggggaatgagaccggagaatgcacgggcagctattattgtaagaaaggagtgatcctacccatctgggaaccccaggaccccagcttcggggacaagattgccagggccacggtgtactttgtggccatggtgtatatgtttttaggtgtgtccatcatagctgacaggtttatgagttctatcgaagtgattacatcacaggagaaggaaattacaattaaaaagccgaacggggagactactaagacgacggtgagaatatggaacgagactgtttccaacttgaccctgatggcattaggcagcagtgctcccgaaatacttctttcggtcatcgaagtctgtggccacaactttactgctggagacttaggcccttcaactatagtggggtccgccgcatttaacatgtttataatcatcgcactgtgtgtgtatgtggtacccgatggggagactcggaaaataaaacacctgagggtgttcttcgtaacagccgcttggtctatttttgcttatacttggctttacataattctttctgtaatttccccaggcgtcgtggaggtgtgggaaggccttctcacgttttttttttttcccatttgcgtcgtgttcgcctgggtcgcagacagacgtctcctcttctacaaatatgtatacaaacggtatagggccggaaagcaacgtggcatgattatcgagcacgaaggcgacagaccttcatctaaaacagagatcgagatggacggtaaggttgtgaacagtcatgtggagaactttcttgacggcgcacttgtgctcgaagtagacgaacgtgaccaggacgatgaagaggccagacgcgaaatggcccgtattctaaaggagcttaagcagaagcaccccgacaaggagattgagcagttaattgagttagccaactaccaggtgctaagccagcagcaaaaatcaagggccttctacagaatccaggctacacgtctgatgacaggtgcgggaaatattttgaaaagacatgccgcagaccaggcaagaaaagctgtctcgatgcatgaagttaatactgaggttactgagaatgatcctgtatcaaagatattttttgagcaaggcacgtatcagtgcttagaaaactgcggtactgtggccttgacgataatcaggcgcggtggcgatctgactaacactgtgtttgttgactttaggacggaagatggtactgccaacgccggaagtgattatgaattcaccgaagggacagtggtattcaagcctggcgacacccaaaaggaaattcgggtgggaataatcgatgacgatatctttgaagaggatgagaactttttggtccatctgtcaaacgtgaaagttagtagtgaggcatctgaagatggcatcctggaggctaaccatgtgtctacgctcgcttgccttggcagtccaagtaccgctaccgtcaccattttcgacgacgaccatgccggtatctttaccttcgaggagcccgtgactcatgttagcgagtcaattgggatcatggaagtgaaggttctgagaacttccggcgctaggggcaatgttattgtgccctacaagactatcgaggggacggctcgcggaggcggagaggacttcgaggatacctgcggggagctcgagttccaaaacgacgaaattgtaaaaatcattacgatcaggatcttcgaccgggaggagtacgagaaggagtgctctttctctttggtacttgaggagcccaagtggatccgacggggtatgaaagggggtttcaccattacggacgagtacgatgacaagcaacccttgacctctaaagaggaggaggagcggagaattgctgagatgggtagacctattttgggcgaacataccaaactggaagttattattgaggagtcatatgaatttaaaagtaccgtagataagttaataaaaaaaacaaacctggctctggtcgtgggcaccaacagctggagggagcagtttatcgaggcaattacagtcagtgccggagaagacgatgatgacgatgagtgcggagaagaaaagctgcccagctgttttgattatgtgatgcattttttaaccgtcttctggaaggtgttgttcgcgttcgtgccccctacagagtactggaatggatgggcatgcttcatcgtgagcatcctgatgatcggactccttacagcatttattggagatctagccagccatttcggatgcaccatcggcctcaaagattccgttacagctgtggttttcgtggctcttggcacatcggtcccagacaccttcgcgtctaaagttgccgctacccaagatcagtacgccgatgccagtattggcaacgtgacaggctccaacgccgtcaatgtttttctgggaatcggcgtggcctggagcatcgcagcaatttaccatgccgcaaacggggaacagtttaaagtcagtcctggaaccttggccttcagcgtaacattattcaccatattcgcttttattaatgtaggtgttctcctctacaggagacgcccagaaattggcggagaactgggcggtccacggacagcaaagttgctgacgtcctgcctgttcgtcctgctgtggttgctatacatattttttagctcactcgaagcctattgtcatataaaaggcttctag

SEQ ID NO: 241833 - DNA, 2922 bp, Artificial Sequence
  Description of Artificial Sequence: Synthetic coding sequence
atgtacaacatgcgaaggctgtctctctcaccaacctttagcatggggttccacttattagtcacggtttcacttctgttctcacacgtggatcacgtgattgcagagaccgagatggaaggcgaaggcaatgaaaccggggagtgcaccgggtcttattactgcaagaagggcgtaattctccccatctgggagccacaggatccttccttcggcgataagatcgcccgtgccacggtgtatttcgtggcaatggtgtacatgttcctgggggtatccatcattgcagatcgctttatgtcttcaatcgaagtaatcacttctcaagagaaagagatcaccatcaaaaagccgaacggagaaaccacgaaaacaacggtgcgcatatggaatgagaccgtgtctaatctaacgctgatggccttgggctcctccgcccctgaaattctacttagcgtgatagaagtctgcggccataactttaccgcgggagatctaggtccttctaccatcgtcggctcagcagcgttcaatatgtttataattatcgctctgtgtgtctacgtcgtgcctgacggtgaaactcgaaaaattaaacatctccgtgtgttctttgttacagcagcctggtcaatttttgcctatacctggctctacattatcttatccgtcatcagccctggtgtggtcgaggtctgggaaggcctgcttacttttttcttttttcctatctgcgtggtctttgcatgggttgcagataggcgacttttattttacaagtacgtctacaagcggtaccgcgctgggaaacaaagggggatgattatcgaacacgaaggcgataggccctccagcaagacagagatcgagatggatggaaaggtagtcaactcccacgttgagaattttctggacggagctctagtcctggaagtagatgaacgcgaccaggacgacgaagaagccaggcgtgagatggctcggatactgaaagaactgaaacagaaacatccggacaaggaaatcgagcagctgatagagctggccaactaccaggttctctcccagcagcaaaaatccagggccttctatcggattcaagcaactcgccttatgacgggggctgggaatatcctcaagagacatgcggcagatcaggcgaggaaggccgtttcaatgcacgaagtgaacactgaggttaccgaaaacgatcctgtaagcaagatctttttcgagcaaggcacataccagtgcctcgaaaactgcgggactgttgccttgaccataattagacgcggaggcgacttgactaatactgtgtttgtggacttccgtactgaggacggcactgcaaacgcaggttctgattacgaattcacagagggtactgttgtgttcaaacccggagacacacagaaggagattcgcgtggggattatagacgacgatatctttgaagaggacgagaatttcctggttcacctcagtaacgtaaaggtcagttccgaggcaagtgaggacggcatccttgaagccaaccacgtttccaccttagcctgtcttggctctccttctactgccacagtcacaatcttcgatgacgatcacgcaggcatctttacgtttgaggaacccgtgacccacgtgtccgaaagcattggaatcatggaggtcaaggtcttgagaacctcaggggcacgcggtaacgttattgtgccttataagaccatcgaggggaccgccaggggtggcggagaggactttgaagacacatgtggcgaacttgagtttcaaaatgacgagatagtgaaaacaatttcagttaaagtgatagatgatgaggaatacgaaaagaataaaaccttcttcttggagatcggtgagcccaggcttgtggaaatgtccgaaaagaaggcactgctcctgaatgagctcggaggatttaccattaccgggaagtatttgttcggccagcctgtgtttcgcaaggtgcacgccagagaacaccccatcctgtctacggttatcacgattgcggacgaatacgatgacaaacagccgctgacctcaaaggaggaagaagagaggagaattgctgagatgggaaggcctatccttggcgagcataccaagcttgaagtcattattgaggagtcttacgaattcaagtctaccgtcgacaaactgatcaaaaaaactaacctggcattagtggtcggaacaaacagctggagggaacaatttatcgaggcaatcaccgtcagcgcaggcgaagatgacgatgacgatgagtgtggagaagaaaagctaccctcttgcttcgattatgtgatgcactttctgactgtcttctggaaagtcctctttgccttcgtgccccctactgaatactggaacggatgggcctgtttcatcgtctcaatactgatgatcggccttctcactgcgtttattggcgatctggcaagccatttcggctgtaccattgggctgaaagacagtgttaccgccgtcgtgttcgtggccctggggacgtcagtccccgacacatttgctagtaaagtggcagcgacacaggaccagtacgcagatgcctcgatcggaaatgtaaccggatcaaatgcagtaaacgtttttcttggcatcggcgtggcctggagtattgcagctatctatcatgctgctaatggtgagcaattcaaggtgtctcccggaacactggccttcagcgtgacactctttacgatattcgcttttatcaatgtaggtgtgctgttatatcgaagacgccctgagatcggaggcgagctaggaggccctcggacggccaaattgctcactagctgcctgttcgtgcttctctggctgctgtacattttcttctctagcttggaggcatattgccatatcaagggcttttag

SEQ ID NO: 241834 - DNA, 2814 bp, Artificial Sequence
  Description of Artificial Sequence: Synthetic coding sequence
atgtacaacatgcgtagactatctttgagcccaacattctcaatgggattccatttgttagtgacggtatcactgttattttcccacgtggaccacgtgattgctgagacagagatggagggagaaggaaacgaaaccggtgaatgtacagggtcttactactgcaagaagggagtgatactgcctatttgggagccgcaggacccttctttcggggataagattgccagagccacagtctattttgtggcaatggtgtacatgttcttgggggtcagcatcattgccgatcgctttatgagtagcattgaagttatcacctcacaagagaaggagatcacgatcaagaaaccgaacggagaaacgaccaagactaccgtccgtatttggaacgagaccgtttcaaacctgacactcatggctctgggaagttcagcccctgaaatcctgctaagcgtcatcgaggtctgtggtcacaacttcacggccggagacctgggcccatcaacaattgtcggctcagccgcttttaatatgtttatcatcatcgccctctgcgtctacgtggttcccgatggggaaactagaaagattaagcaccttcgtgtgttcttcgtgacagcggcatggagcatttttgcgtacacctggctgtacatcatcttatcagttatcagtcccggagtggtggaagtgtgggagggtctcctcacctttttcttcttccctatatgcgtggtgttcgcctgggtcgcggacagacggcttttgttctataaatatgtgtacaagcggtatcgggctggcaaacagcggggtatgattattgagcacgagggagaccgaccatcatcaaaaacagaaatcgagatggacggcaaggtcgtcaacagtcatgtggagaactttctggatggtgcgctggtgctagaggtggatgagagagaccaagatgacgaagaggcacgccgagagatggctcgcattctgaaggaactcaagcagaaacatcccgataaggaaattgaacaactgatcgagctggccaattaccaggtgctgagccaacagcagaagagcagggcattctatagaattcaagccacacgcctgatgacaggggctggtaacatcctgaagaggcatgccgcagaccaggccagaaaagccgtctctatgcacgaagtgaatactgaggtgaccgaaaatgatccagtgtccaagatcttcttcgagcaggggacgtaccaatgcctcgaaaactgcggcaccgtcgcactcactataatacggaggggtggcgaccttaccaatactgtctttgtggattttcggaccgaagacggaaccgccaatgctggcagcgactacgaattcactgagggaacggtggtctttaagccgggagacactcagaaagaaattcgggtcggtatcattgacgatgatattttcgaagaggatgaaaattttctggtgcacctcagcaatgtcaaggtcagcagcgaggcatccgaggatgggattctggaggcgaaccacgtctcgactctggcctgtctgggctcacccagtacagctaccgtgaccatatttgatgatgatcacgccggtattttcacgttcgaggaacccgtgacacatgtcagcgagtctatcgggattatggaggtgaaagtcctacgcaccagtggagcacgcggtaatgtgattgtgccatataaaacaatcgaggggacggccaggggaggcggagaagactttgaagacacttgcggagagttagagtttcaaaacgatgaaattgtgaagatcattacgattaggatttttgaccgtgaagagtacgaaaaggagtgtagttttagcctggttctcgaggagcccaagtggattcgtcgaggcatgaagggagggttcacaatcacagatgagtatgatgacaaacaacctttaacatccaaagaagaggaagagcgcagaattgccgagatgggtcggccaatcctgggggagcacaccaaactcgaggtgattatcgaggaaagttatgaattcaagtccacagtggataagctgatcaagaaaaccaacctggccctagtcgtaggaacaaatagctggagagaacagttcatcgaggcaattactgtcagtgctggtgaggacgacgacgacgatgagtgtggcgaagaaaagttaccgagttgttttgattatgtgatgcacttcctgacagtgttctggaaggtcctcttcgctttcgtccctcccactgaatactggaacggctgggcatgttttatcgtgtcaatcttaatgattggcttacttacggctttcattggcgacctggcatcccacttcggctgcaccataggcctgaaggactcagttacagcagtggtcttcgtagctctgggcacctctgtgcctgacacattcgcttcaaaggtggccgctacacaggaccaatatgctgacgcctcaattggcaacgtgacaggcagcaacgccgtcaacgttttcctaggtatcggagtcgcctggtctatcgctgccatataccatgccgcaaacggcgagcagttcaaagtttcacccggaacactcgccttttctgtgaccctgttcacaattttcgccttcataaacgttggggttttactctacaggcgtcggccagaaatcggcggtgaattgggtggaccccgtacagccaaactgctcaccagctgcttgttcgttttgctctggctgctctatatcttcttctcttccctcgaggcatattgtcacatcaaaggtttttag

SEQ ID NO: 241835 - DNA, 2907 bp, Artificial Sequence
  Description of Artificial Sequence: Synthetic coding sequence
atgtataacatgcggagattgtccctgtctcctaccttctccatgggctttcatctgctcgttaccgttagcttgttattcagccacgttgatcatgtcatagcggagactgaaatggaaggcgaagggaacgagaccggcgagtgtaccgggtcatattactgcaaaaaaggggtcattctgccaatttgggagccgcaagacccaagctttggagacaagatcgcccgtgctacggtgtactttgtcgccatggtctatatgttccttggtgtttccatcatagctgataggtttatgtcttcaatagaggtcattacttctcaggagaaggaaatcacaatcaaaaaacctaacggggaaacaaccaagaccacggtccggatttggaatgagacagtaagtaacctgacattgatggctctaggttccagtgcccctgagattttgctttctgtaatcgaagtgtgtggacacaactttaccgctggcgatttaggcccatcaacaatcgtaggcagtgctgccttcaatatgtttattatcatagctctttgcgtctatgtagtgcccgacggcgagacaagaaagattaagcacctgcgggtgttcttcgtaactgccgcatggtccatattcgcttatacgtggttgtacattattctctccgtaatctcaccaggggtagtagaggtgtgggagggcctactgacctttttcttcttccccatctgcgtcgtatttgcctgggtcgccgacagacggctgctgttttacaagtatgtttacaaaaggtaccgcgcaggcaaacaacgcggaatgattatcgaacatgagggagacagaccatcatccaagactgaaatagaaatggacgggaaggtagtgaactcgcacgttgaaaactttttggatggagcactggtacttgaggtggacgaacgggatcaggacgacgaagaagcaaggcgggagatggccaggatacttaaagagctaaagcagaagcacccagataaagagatcgaacagctgattgagttggccaattaccaagtcctgtcacagcagcaaaagagccgagcattctaccggatccaagccacaaggctgatgacgggtgcgggaaacattttgaaacgacacgctgcagatcaggcaagaaaagccgtgagtatgcacgaagtaaatactgaggtgacggagaacgacccagtgagtaaaattttctttgagcaaggcacgtatcaatgccttgagaattgtggcacagtggcgcttacgataatcaggcgcggtggggacctaacgaacaccgtgtttgttgattttcggacagaggacggcaccgccaatgcagggtccgactatgagtttaccgaagggacagtagtttttaagcctggggatacacagaaggaaatcagagttggtatcatcgatgacgatatttttgaagaagacgaaaacttcctggtgcacctgagcaatgtcaaggtgtcctccgaagccagcgaggatggcatacttgaagctaatcacgtctccaccctggcctgtttgggaagtccctcgacagctacagtcaccatcttcgatgacgaccacgctgggatcttcactttcgaagaacccgtgacccacgtcagcgagagtattggaatcatggaagtaaaagtactgaggacatctggtgccagaggcaatgttattgtcccgtacaaaactattgagggaacagctcgcggaggcggagaggactttgaagatacatgtggggaacttgaatttcagaacgacgagatagtcaaaaccatttccgtcaaggtgatcgatgatgaagagtatgaaaagaataagaccttcttcctggagatcggcgaacctcggctggtcgagatgtctgaaaaaaaggcccttctgcttaacgaactgggcggatttacaatcaccggacaaccagtctttcgaaaagtccatgcgagggaacaccccattctgtcaactgtgataaccattgcagacgagtacgatgataaacagccattgaccagtaaggaggaggaagagcggagaattgctgaaatgggcaggcccatacttggcgaacatacaaaacttgaggttattattgaggagagctatgagttcaaaagcacagtggataaactgattaaaaagactaatcttgccctggtggtgggcactaactcctggcgagaacagtttattgaagcaatcacagtgtccgccggagaagacgatgacgacgatgagtgtggtgaagagaagctgccctcatgtttcgactacgtgatgcacttcctgaccgtgttttggaaggtgttgttcgcatttgtcccgcctacagagtactggaacggatgggcatgcttcattgtgtccatattaatgattggcctcctaaccgcttttattggggacctggcgagccatttcggctgcaccattgggctaaaggacagtgttaccgccgttgtgttcgtagcactgggaacaagtgtccccgacactttcgccagtaaagtcgccgctactcaagaccaatacgccgacgcttccatcggaaatgtcaccggcagtaacgcggtcaacgtgtttctggggatcggggttgcttggtcaatagccgctatctatcatgccgcaaatggcgagcagtttaaagtgtcacccggaacgcttgcgttctccgtgacactctttaccatcttcgccttcattaacgtgggcgtgctgctgtatagaagacggccagagattgggggagagcttggcggaccacgtacggctaaacttcttaccagttgtctatttgttctcttgtggctgttgtacattttttttagcagcctcgaggcctactgtcacatcaagggattttag

SEQ ID NO: 241836 - DNA, 2814 bp, Artificial Sequence
  Description of Artificial Sequence: Synthetic coding sequence
atgtacaacatgcgacgtctctcactgtcaccaacgtttagtatgggctttcacctgctggtgacagtgagcctactgttttcccacgtcgatcacgttattgctgagaccgagatggagggcgagggcaacgaaaccggagagtgtacgggctcttattattgtaaaaagggtgtgatcctgcccatctgggagcctcaggaccctagcttcggagataaaatcgcacgtgcaacagtatattttgtcgccatggtatacatgttcttaggtgtgtccatcattgcagaccggttcatgtcctccatagaagtcatcactagtcaggaaaaagagatcactattaagaagccaaacggggaaacaactaagacaactgtgcgcatttggaatgagacagtcagcaatctcacattgatggcactgggttcttccgcccctgaaatactgctgagcgtcattgaggtgtgtgggcataattttaccgctggagatctggggccaagcacaatcgtggggagcgccgcattcaacatgtttatcattattgccctctgtgtgtatgtcgtgccagatggggaaactagaaagattaaacatctgagggtgttcttcgttacagctgcatggagcatcttcgcctacacctggttgtatatcatcctctccgtcatttcaccgggagttgttgaggtgtgggagggtctactgactttctttttctttcctatttgcgtggtgttcgcctgggtcgcagacaggcgcttgcttttttataagtacgtttataagagatatagagcaggcaagcagcgcggtatgataatcgagcacgaaggggacaggccctcgagcaaaacagagatagagatggacggcaaggtggtcaactcgcatgtggaaaacttcctggatggagccctggtgctagaagtcgacgagagggatcaggacgacgaggaggctcggcgtgaaatggcgcgaattctgaaagaattaaaacaaaagcaccccgataaagaaatagagcagctcatcgaactggcaaattatcaggttttgtcacagcagcaaaagagcagagcattctaccggattcaggcaaccaggctgatgactggtgctggcaatatcctaaaacgccacgcagccgaccaggctcggaaagctgtctcaatgcatgaggttaataccgaggtgaccgaaaatgaccctgtgagcaagatcttttttgagcagggcacatatcagtgcctagaaaactgcggtacagtcgctctgacaataatcaggcgaggtggtgatctgacaaacaccgtgtttgtggactttcgtactgaagatggaaccgcaaatgcaggatccgattacgaattcaccgaggggacagtggtgttcaaacctggggatactcagaaagagattcgcgtcggtataattgacgacgatatttttgaggaagacgaaaattttctggtgcatctctcaaacgttaaagtgtcctctgaggcgtccgaagacggaatcctggaggctaatcatgtgagtactctggcatgtctgggctccccttccacagcgaccgtgactatcttcgacgacgaccatgccggtatctttaccttcgaggagcccgtgactcatgtgtcggaatccataggaattatggaagtaaaggtgctgcggaccagcggtgcacggggtaatgtgatcgttccgtacaagacgatcgaaggtacagcgagagggggaggggaagacttcgaggatacctgcggcgagttggagttccaaaacgacgagattgtgaagattataacgatccgcatatttgaccgcgaagagtacgagaaagaatgttccttcagcctggtgctggaagagcccaagtggattcgccgtggaatgaagggagggttcaccataacagatgaatatgacgacaagcagccactcacctctaaggaagaggaggaacgcaggatcgcggaaatgggacgcccaatcctgggcgagcacaccaagcttgaggtgataatcgaagagagctacgagttcaagtccaccgttgataaattaatcaagaaaaccaacttggccctcgtggtcggaaccaattcttggcgcgagcagtttatcgaagccattacagtgtcagcgggtgaagatgatgatgatgacgagtgcggagaagaaaagttgccttcttgtttcgactacgtaatgcactttctgacagtcttttggaaggtactgttcgcctttgtacctccgacagagtattggaacggttgggcctgcttcattgttagtattcttatgatcgggctgctaaccgcattcattggagacctggcgagtcacttcggatgcacaatcggactcaaggactctgtcactgctgtggtgttcgtcgccctggggacaagcgttccagacacttttgcctccaaggttgcggcaacacaggaccagtacgctgatgcctccattggcaatgtgaccggaagcaacgctgtaaatgtattcctcggtatcggcgtagcctggtcgatagccgcaatctaccacgcagccaacggagaacagtttaaagtgtcgccgggtaccctggctttcagtgtgactctttttacgatctttgccttcattaacgtgggtgtgctcttgtacagaaggaggccggagataggcggtgagctgggaggcccacgcacggccaaactcctgacctcctgtctcttcgtgttgctgtggctactttatatttttttttcctcactggaagcttactgtcatatcaaggggttttag

SEQ ID NO: 241837 - DNA, 2814 bp, Artificial Sequence
  Description of Artificial Sequence: Synthetic coding sequence
atgtacaatatgaggcgcctctcactgtcccctacattcagcatgggattccaccttctggtgaccgtatctctactgttttcccatgtcgatcacgtgatagctgagacggagatggaaggtgagggcaatgaaaccggtgagtgtactggttcatactactgcaaaaagggggtcattctgccaatctgggagcctcaggaccccagcttcggggataagatcgctagagctaccgtatactttgtggcgatggtttacatgtttctgggcgtgtctattatagcagacagattcatgagctccatagaagtgatcacttcgcaggaaaaggagattacaatcaaaaaacctaacggagaaactacgaaaaccaccgtgagaatatggaatgagacagtgtccaacctgacattaatggcccttgggtcttccgctccagagatattgctgtctgtcatagaggtgtgcgggcacaattttaccgcaggagacttaggccctagcactattgttggcagtgccgcattcaacatgttcataatcatcgctctgtgtgtgtacgtggtaccggacggggagacccggaagatcaagcacttacgggtgttctttgtgacagctgcatggagtatttttgcttatacctggctgtacatcattctttctgttatatccccgggagttgtcgaggtctgggaaggccttttgaccttcttcttcttccctatctgtgtggtcttcgcctgggtggccgacagaaggttgctgttttacaagtacgtttataaaaggtatcgagcagggaaacaaaggggaatgattatagagcatgagggagacagaccttcttcaaaaacagaaattgaaatggatggaaaagtcgtcaactcgcacgtggagaacttcctggacggtgctctggtcctggaagtagatgagcgcgaccaggacgacgaagaagccaggagagaaatggctcgtatcctgaaggagctgaagcagaagcaccccgacaaagagatcgagcagctgatagaactggccaactatcaggtgttaagccaacagcagaagagcagggccttttaccggatccaggccacaagactgatgacgggcgcagggaacattctgaagcggcatgctgctgaccaggctcgcaaggcagtgagtatgcacgaggtgaacacagaggttaccgagaatgaccccgtcagtaaaatcttcttcgaacaggggacttatcagtgtttagagaattgcggcacggtggcgttgaccatcatccgcagaggaggggacctgactaataccgtgttcgtcgatttccgtaccgaagatggcacggcaaatgccggatcagactatgagtttaccgaaggaactgtggttttcaagccgggagacactcagaaagaaatacgcgtgggcatcatagacgacgatatatttgaggaggacgagaacttcctggtgcatctgagcaacgtcaaagtctccagcgaggctagtgaggacggcattctcgaggcaaatcacgtgagtacactggcctgcctggggtctcccagcactgcaaccgtcactattttcgacgatgaccatgctggcatcttcacctttgaagaaccagtaacacatgtgtctgagtcaatcggtataatggaagtcaaggtattacgtacgtcaggagctaggggtaatgtcattgttccctataagacaatcgaaggaaccgcacgagggggaggtgaagatttcgaggacacatgcggggagctggaattccagaacgacgaaatcgtgaagattataaccattcgcattttcgatagggaggaatacgagaaggaatgcagcttctcactcgttctggaagaaccaaaatggatccgcagagggatgaaaggcggattcactattaccgatgaatatgacgataaacagcctctcaccagcaaggaagaagaggagaggagaatcgctgaaatgggacggcctatactcggagagcacacaaagctggaggtgattatcgaggagagttacgagtttaagtctaccgtagacaaactaattaaaaaaaccaacctggctctggttgtgggcacaaattcatggagagaacagttcattgaagccattacggtgtctgcgggagaggacgacgatgatgacgagtgcggtgaggaaaagctgccatcttgtttcgattacgttatgcatttccttaccgtgttctggaaggtgcttttcgccttcgtgcctccaactgaatactggaacggttgggcatgctttattgtgtccatactgatgataggactactgaccgcatttatcggcgacctcgctagccactttggatgcacgatcggccttaaggattcagtgactgcggtagttttcgttgcgctggggacaagcgtccccgacacctttgcctcaaaggttgcagctacgcaggaccagtacgctgacgccagcatcggtaatgtaacgggaagcaatgccgtgaatgtgttcctcggaatcggggtcgcctggtccatagccgctatctaccacgccgctaatggcgaacagtttaaagtctcacctgggacgttagctttctccgtcacattgtttacaatttttgcgttcatcaatgtgggtgtcttgctatacagacggagaccagagatcggcggagaacttgggggacctcgcacggcaaagctgctgacttcttgcttatttgtcctgctgtggctcctgtacatctttttctcttccctggaggcttactgccacatcaagggattttag

SEQ ID NO: 241838 - DNA, 1995 bp, Artificial Sequence
  Description of Artificial Sequence: Synthetic coding sequence
atgagaaggctgtcgctgtctccaacttttagcatgggatttcacttgctggtgactgtctcactgctgttctcacacgttgatcacgtcatcgccgagaccgagatggaaggagagggcaatgaaacaggggagtgcaccggaagctactactgcaaaaagggcgtcattctgcccatttgggaaccacaagatcccagcttcggagataagattgcgagagcaactgtctattttgttgccatggtgtacatgttcttgggcgtgagtatcatcgctgaccgattcatgagtagcatagaagtaattacctctcaggaaaaggagattacaattaaaaaacccaacggcgagacaactaaaactaccgtcagaatttggaatgaaacggtcagtaacctgacattgatggctttgggctccagtgctccagagatcctgctgtctgtcattgaagtctgcggacataactttacagcgggagacctaggaccgtctactatcgtcgggtctgccgctttcaatatgtttatcatcatagccctgtgcgtgtatgtggtcccagacggcgaaaccaggaagattaaacacctgcgggtcttctttgtgacagctgcttggagtatctttgcatacacctggttatatattattctctcagtgattagcccaggggttgtggaagtgtgggaggggttgctgacttttttcttcttccctatctgcgtcgttttcgcatgggttgctgaccgcaggctgttgttttataagtacgtgtacaaaaggtaccgagcaggcaagcagagagggatgatcatcgaacacgaaggggatcgtccgagcagcaaaaccgaaatcgaaatggacggcaaggtagtgaacagccacgtagaaaatttccttgatggtgccttagtgctggaggtagacgagagagaccaggatgatgaagaggctaggagggagatggccaggattctgaaggagctaaaacagaaacacccagacaaggagatcgagcaattaatcgagcttgccaactaccaagtgctgtcacaacagcagaagtccagagccttttatcgtattcaagctacacgccttatgactggggcagggaatattctgaaacggcatgccgcagatcaggccagaaaagctgtatcaatgcacgaggttaatactgaggttacggaaaatgaccctgtaagcaaaatcttctttgaacagggaacataccagtgtctagagaattgtggtacggtagcattgaccatcatcagaaggggcggtgacttaacgaacacagtttttgtggacttccggaccgaagatggcaccgcaaatgccggatcagattacgaatttacagagggaactgtggtctttaaacctggagatacgcagaaagaaatccgcgtgggaatcattgacgacgacatcttcgaggaggacgaaaatttcctggtgcacctcagcaacgtgaaagttagcagcgaggccagcgaggatggcatcctggaagccaatcacgtgagtaccctggcttgcctcggctctccatccacagctaccgtgacaatctttgacgatgaccatgcgggaatcttcacgtttgaggagcctgtgacccacgtgtctgagagcattggaataatggaggtcaaggtgctgaggaccagcggtgccagaggcaatgtgatcgtcccgtataaaaccattgagggaacagccagaggaggaggcgaagattttgaagatacctgtggagagttggagtttcagaatgatgaaatcgttaaaacgatctcggttaaagtgatagacgatgaggagtatgagaagaataagacctttttcttggaaatcggggaaccaagattggtggagatgagtgaaaagaaggggagatcgctgcccttagaatacctcaccgtgcgaaatatgcggaaaagcgccgtgtcgccactgtgtctccggaaccagaacggctag

SEQ ID NO: 241839 - DNA, 2898 bp, Artificial Sequence
  Description of Artificial Sequence: Synthetic coding sequence
atgtacaacatgaggagacttagtctgtctccaacgttctctatgggattccacttactggtgacagtaagcttgctgttttcccacgtggaccatgtgatcgccgaaaccgagatggagggggaagggaatgagacaggggaatgtactggctcctactactgcaagaaaggagtgatccttccaatttgggagccccaagacccctcatttggcgacaaaatcgcacgagccacagtttacttcgtcgcgatggtgtacatgttcctgggagtttcaatcattgccgaccgctttatgagttcgattgaggttataacctcccaagagaaagagattacaattaagaagccaaacggcgagacaaccaagactacagttcggatttggaatgaaaccgttagcaatctaactctaatggcactggggtcgtctgcccctgagatcctcctatccgtgatagaagtgtgtggacataattttactgccggagatctaggcccttccacgatcgtcggttccgcggctttcaatatgttcatcattatcgccctttgcgtgtatgtggtgccagatggcgagaccaggaaaataaaacatctgcgtgtattctttgttactgccgcatggagcatctttgcctatacatggctttacatcattctttcagtaattagcccgggtgtggtcgaggtctgggagggcctcctaaccttcttctttttccccatctgcgtggtgtttgcctgggtggcagaccgcagactgctgttctacaagtatgtgtataagcgttatagggctgggaaacaaagaggcatgataattgaacacgagggcgatcgcccatcgtcaaaaaccgagatcgagatggatggtaaggtggtcaatagccatgtcgagaatttcctcgacggcgctctggttcttgaggtagacgagcgggatcaagacgacgaagaagctcgaagagaaatggccaggattctgaaggaactaaaacagaagcaccctgacaaagaaattgagcagctgatcgagcttgcaaactaccaggtacttagtcagcaacaaaagtccagagcattctacaggatccaggcaacccggctgatgaccggcgcaggcaatatcctgaaacgtcacgcggctgaccaggctcgtaaagctgtatccatgcatgaagtgaacacagaggtgaccgagaatgaccccgtttctaagatttttttcgaacaggggacgtaccaatgcctggagaactgtggtaccgtggcattgacgatcatacgtagggggggtgacttgacaaataccgtgttcgtggattttcgcaccgaggacggcactgctaatgccggaagcgactacgaatttacagagggcaccgtggtgtttaaacccggagatacccagaaagagattcgcgtaggcattatagatgatgacatctttgaagaggacgaaaactttctcgtccacctgtctaatgtcaaggtttcttctgaggcctctgaagatggcatcctcgaggcaaatcacgtatctactctggcctgcttgggtagtccgtccaccgccacggtcacaatcttcgacgacgaccacgccggtatcttcacttttgaagaacccgtgacccatgtgagtgagagtattgggatcatggaggtgaaagtattgagaacttccggagctcgtggtaatgtgatcgtgccctacaaaaccatcgaagggacagctcgagggggaggagaggattttgaggacacctgcggcgagctcgaatttcagaatgacgaaatcgttaaaattataacgatcaggattttcgaccgcgaagagtacgaaaaggaatgtagcttttcactggtgttagaagagcctaaatggataaggagagggatgaagggaggctttacaatcactggaaagtacttatttgggcagcccgtcttccggaaagtacatgcgagggagcaccctattctgtccaccgttattaccatcgccgacgaatacgacgataagcagccactgacgagcaaggaggaggaggagcgccgaatcgcagaaatgggcagaccgatcctcggagaacataccaagctggaagtaatcatcgaggaaagctatgagttcaagagcacggtcgacaaactgatcaaaaaaaccaatctggccctcgtggtcggcacaaattcctggcgggagcagttcattgaggccatcacagtgtctgccggtgaggatgatgacgacgacgagtgcggcgaggagaaactcccctcgtgctttgactacgtgatgcactttcttaccgtgttttggaaagttctttttgcatttgtgcctcctaccgagtattggaacggctgggcttgctttattgttagcattctcatgattggtctccttactgcattcattggcgatcttgcctcgcacttcggctgcacaataggactgaaggactcagttaccgccgttgtgtttgtggctctgggaactagtgttcctgatacttttgcctcgaaggtcgccgcaacacaggatcaatacgctgacgcctctataggcaacgttacagggagcaacgccgtgaacgtcttcctgggcattggggtggcttggtcaattgccgctatctatcacgcggctaatggagagcagtttaaggttagtccaggcaccttagccttttctgtgacgttgtttacaatttttgcctttatcaacgtgggggtcctgctttaccgccgtcggccagaaattggaggggagttaggagggcctcgcactgccaaactactgacttcttgtttatttgtgcttctgtggctcctctacatttttttctcctccctagaagcttattgccatattaaagggttttag

SEQ ID NO: 241840 - DNA, 222 bp, Artificial Sequence
  Description of Artificial Sequence: Synthetic coding sequence
atgtataatatgagacgactctccctctctcctaccttttccatgggcttccatctactcgtcactgtaagtctgctctttagccatgtagaccacgtcattgcagaaactgagatggagggagaaggtaatgagacaggggaatgcaccggaagctactattgcaagaaaggcgttatcctcccaatctgggaaccccaggatccaagcttcggggactag

SEQ ID NO: 241841 - DNA, 264 bp, Artificial Sequence
  Description of Artificial Sequence: Synthetic coding sequence
atgtacaacatgcggagactcagcctgtctcctaccttctcaatgggttttcatttgctagtgactgtatctctcttgttctctcatgtggaccatgtcatcgccgagacggagatggagggagagggaaatgaaactggtgagtgtacaggttcctactattgtaaaaaaggtgtcatcctgccgatttgggagcctcaggatcccagtttcggcgataaaatcgcaagggcaaccgtctactttgttgctatggtgtactag

SEQ ID NO: 241842 - DNA, 264 bp, Artificial Sequence
  Description of Artificial Sequence: Synthetic coding sequence
atgtacaatatgcggcgtctcagcctgtctccaacattctctatggggtttcacttacttgtcaccgtgagcctgctgttttctcacgtcgaccacgtgatcgccgagaccgaaatggagggtgagggaaatgagaccggggagtgtactgggagctactattgcaagaagggtgtaatcctaccgatctgggagccacaggatccctctttcggcgacaagatagccagggcaacagtatacttcgtggcgatggtatactag

SEQ ID NO: 241843 - DNA, 2883 bp, Artificial Sequence
  Description of Artificial Sequence: Synthetic coding sequence
atgtacaacatgcgcaggttgtccttgagtccaacatttagcatgggctttcacctgctcgtgactgtgagcctgctgtttagccatgtggaccatgtcatcgcagaaacagagatggagggagagggaaacgagaccggagagtgcactggctcttattactgcaagaagggggtcatcctgccaatatgggaacctcaagatccttccttcggcgacaagattgcaagggccaccgtgtattttgtggcaatggtgtatatgttcctgggagtttcgatcattgcggacagattcatgagttctatagaagtcatcacctcccaagaaaaagagataactataaaaaaaccaaatggggaaacaaccaaaacaacagtgagaatctggaacgaaacagtttccaatctgactttgatggcactgggatcctctgccccagagatcctgctcagcgtcatcgaggtctgcggacacaattttaccgcaggtgatctcgggccttccactatagtggggagcgctgcattcaacatgttcatcattatcgccctttgcgtgtacgtggtgcccgacggtgagactcgcaagatcaaacacctgagggtgttcttcgttactgcagcgtggagcattttcgcctatacatggctctatattatactctcagtaatctctcccggagttgtcgaggtgtgggagggattactcacattctttttcttccctatctgcgtcgtgtttgcttgggtggcagaccgcaggctgctgttctacaaatatgtgtataaacgataccgcgctggcaaacaaaggggaatgattattgagcatgagggcgatagaccaagtagcaagacagagattgaaatggacggtaaggttgtgaattcgcatgttgagaattttcttgacggcgctttagtgttggaagtggatgagagagaccaggacgacgaggaggccaggcgggagatggccagaatccttaaagaattaaagcagaaacaccctgataaggagattgagcagttgatcgagctggcaaattaccaggtactttctcagcagcagaagtcccgggcattctatcgaattcaggccacccgcctgatgaccggagctggtaatatcctaaagcgccacgccgctgaccaagcgaggaaagctgtcagtatgcacgaggtgaatacagaagtcactgagaatgatccagtgtccaaaatcttttttgaacagggaacctaccaatgtctcgagaactgcgggacagtagcactgacaatcatccgaagaggtggcgatctcaccaataccgtgtttgtggattttagaacggaggatggcacagccaatgcaggctcagactacgagtttaccgaaggcacagtggtttttaaaccgggagatacccagaaggagattcgagtcggtatcatagacgatgacatctttgaagaagacgagaacttcttggtgcacctttccaatgtgaaagtgtcatccgaagcttcagaagatgggattcttgaagcaaatcacgtaagcaccctggcctgcctcggatctccatcaactgccacagtgacaatattcgacgatgaccacgcgggaatctttacgtttgaagaaccagtgactcacgtgtcggaatccataggaattatggaggtaaaggtgctgcgcacctccggtgcgaggggcaacgtaatagttccgtacaaaaccatcgagggcacagccaggggcggtggggaggacttcgaggacacatgcggtgagctggagttccagaacgacgagatcgttaagatcattaccatcagaattttcgatcgagaggagtacgagaaagagtgtagctttagtttggtgctggaagaacctaaatggataagaaggggaatgaaggagggattctggttgtcgtcccagccggtgtttcgaaaagttcacgcacgcgaacaccctatcctgagtacagtgatcacaattgctgacgaatacgacgacaagcagccattgaccagtaaggaagaagaagagagaaggatagcagaaatgggcagacctattctcggcgagcacaccaaactggaggtaataattgaagaatcgtacgagtttaaaagcaccgtggacaaactgattaagaagactaaccttgcacttgtcgtgggcaccaatagctggagggagcagttcatcgaggctatcaccgttagcgctggagaggacgatgacgatgacgagtgtggcgaggagaaacttccatcatgtttcgattatgttatgcattttttgaccgtgttctggaaagtgctctttgcctttgtcccccctactgagtattggaatggatgggcctgctttatagtcagcattttaatgatcggactgctgacagcctttatcggagatctggcctctcatttcggctgtactataggacttaaggatagcgtcacagctgtcgttttcgtagctctcggaacttctgtgcccgatactttcgcttccaaggttgcggctacccaggatcagtatgccgatgctagtattggaaacgtgactggatctaatgcagtcaacgtcttccttggaatcggcgtcgcatggagcattgccgcaatttaccacgccgctaacggcgaacaatttaaggtgtcgccaggcacactggccttcagcgtcactttgtttacaatttttgctttcattaacgtcggagttctcctatacagaagacgccctgagatcggcggagagctggggggtccgaggacggcaaagctcctgacctcttgcctatttgtactgctgtggctgctgtacatcttttttagctctttagaggcatattgccatatcaagggcttctag

SEQ ID NO: 241844 - DNA, 2814 bp, Artificial Sequence
  Description of Artificial Sequence: Synthetic coding sequence
atgtacaacatgagaagactgagcttgagccctactttctccatgggctttcatcttctagtaaccgtgtcccttctgttttcacacgtagatcacgtaatagcagagacagagatggagggtgaagggaacgaaaccggagaatgcaccgggtcctattattgtaaaaaaggggtcattctccccatctgggaacctcaggatccttcctttggtgataagatcgccagagcaaccgtgtacttcgtagccatggtgtacatgttccttggagtcagtataattgctgaccgttttatgtcaagcatcgaggtcataactagtcaggagaaagagatcacgatcaaaaagcccaacggcgagaccactaaaacaactgtaaggatctggaatgagactgtaagcaaccttacattgatggccctgggatcgtcagcacctgagatactcctatccgtgattgaggtctgcggccacaactttacagcaggggatctcgggccttcaaccattgtcgggtctgctgcatttaatatgtttatcattattgctctatgtgtgtatgtggtaccagatggcgagacacgcaagatcaagcatctgagggtgttcttcgtgactgctgcgtggtcaatttttgcgtatacctggctgtatattatactttccgtgatatcccccggagtggtggaagtgtgggaaggcctcctaacgtttttcttctttccaatctgcgtcgtgttcgcctgggttgccgaccgcagactgctcttttataagtacgtgtataagagatatagggccggtaaacagcggggtatgattattgaacatgaaggcgacaggccttcctccaaaacagaaattgagatggacggtaaagtagtgaattcccacgtcgaaaactttctggacggcgcattggttctggaagtggatgaacgggatcaagatgatgaggaagcacgccgagagatggctagaatcctgaaagagctgaaacagaagcatccagataaagagatcgagcaactgatcgaactggccaattaccaggtcctgtcccagcaacaaaagagccgcgcattttaccgcattcaggctacaaggttgatgactggggctggtaacattcttaagagacacgcggctgatcaggcaaggaaggcagtgagcatgcacgaggtcaacaccgaggtaactgagaacgatccggtatctaagatctttttcgagcagggtacttaccaatgcttggaaaactgcggcaccgtcgctcttaccatcatcaggcgcggtggggacctgacaaatacagtgtttgtggacttccgcaccgaagatggcacggccaatgcaggctccgattatgagtttactgagggaaccgtggtcttcaagccgggagacacacaaaaagaaatccgggtaggtataatcgacgacgatatttttgaggaggacgagaatttcctggtccatctcagcaacgttaaggtctccagcgaggcctcagaagatgggatcctggaggcgaatcatgtcagcactctggcatgtctgggatccccttcgacagctacagtgacaatctttgatgatgaccacgcaggcattttcacattcgaagaaccagtgactcatgtgagtgaatcaattggcatcatggaagtcaaggtccttcggacttctggcgcaaggggcaatgtgatcgtgccctacaagaccatagaagggacagccaggggtggcggagaggactttgaagacacgtgtggcgaactggaatttcagaatgacgaaattgttaaaataattaccattcgaatttttgaccgcgaggaatatgaaaaagaatgcagtttcagcttggtgctggaggagcccaagtggatccgacgcggtatgaaagaagggttttgctttaccgatgagtacgatgacaagcagcccctaacctcaaaggaggaagaggagcgaagaattgctgagatgggacgccctatcttgggagagcacacgaagcttgaggttattatcgaggaatcttacgagtttaagtcaaccgttgacaaactgataaagaaaactaatctggctttggtggtgggcactaactcatggcgcgaacagtttattgaagccattaccgtgtcagccggagaagacgacgacgatgacgagtgcggcgaggagaagctccccagttgcttcgactatgtgatgcattttctcaccgttttttggaaggtgctgttcgccttcgtcccaccaacagagtactggaacggatgggcttgttttattgtgagcattctcatgatcggccttctcacggctttcattggcgacctcgctagccacttcggttgtaccattggcttaaaggacagtgtcaccgccgttgtcttcgttgccctgggaaccagtgtgcccgatacctttgcttctaaagtggctgccacacaggatcagtacgccgacgcctctatcgggaatgtcacaggcagcaacgccgtcaacgtgttccttggtataggcgtcgcgtggtcgattgcagccatttaccatgccgctaacggcgaacaatttaaagtgagcccgggaacattggccttctccgtaaccctttttacaattttcgcatttatcaatgtgggggtgcttctgtatcgcaggcgaccagagattggcggagagttggggggaccaagaactgctaaacttttgacatcgtgcctctttgtgctgctatggctgctatacatattcttctcatccctggaggcctattgccatatcaaggggttctag

SEQ ID NO: 241845 - DNA, 417 bp, Artificial Sequence
  Description of Artificial Sequence: Synthetic coding sequence
atgtacaacatgagacggttgagcctgagccccaccttttccatggggttccatttgctggtgacagtttcattgctcttttcacatgtggaccatgttatagcggagactgagatggagggagaaggcaacgaaacaggggagtgtaccggctcttattactgcaagaaaggagtcatactgcccatctgggagcctcaggatccaagttttggtgacaagatagcacgcgcaacagtgtattttgtggcaatggtttatatgtttttgggcgtatccatcattgctgatcggtttatgtcgagtattgaagttataacaagtcaagagaaagaaatcacaataaaaaaacccaacggcgagaccaccaaaaccaccgtgcggatatggaacgagactgtgtccaacctcacctag

SEQ ID NO: 241846 - DNA, 2907 bp, Artificial Sequence
  Description of Artificial Sequence: Synthetic coding sequence
atgtacaacatgcggaggctgtcactcagccccaccttttctatgggctttcatctgctggttaccgtcagccttctgttcagccacgttgatcacgtcatagcggaaactgagatggaaggcgaaggaaacgagacaggggaatgcaccggaagttactactgcaaaaagggcgtgatactgccgatatgggagcctcaggaccctagcttcggcgacaagatcgctagagctacagtttattttgtcgctatggtctatatgttcctgggcgtgtcgataatcgccgatcgcttcatgagcagcatcgaagtgataacaagtcaggaaaaagagatcacgatcaaaaaacctaacggagagaccacaaaaacgacagtgagaatctggaacgaaaccgtgtcaaatctaactctaatggccctgggctcatctgcgccagaaatcctcctgtccgtcattgaagtctgcggccacaatttcacagctggggacctagggccaagcaccatagtgggtagcgcagctttcaatatgtttatcatcattgccctgtgtgtgtacgtggtgcccgatggggagacccggaagataaaacatttgcgcgttttttttgttacagccgcttggtccatattcgcctacacctggctatatattattctctccgtgattagcccaggagtggtcgaggtttgggagggccttctcactttctttttctttcccatctgcgttgtcttcgcctgggtggcagatagacgcctgcttttttacaaatacgtgtataagagatacagggccggaaaacagcggggtatgatcattgagcacgagggtgaccgcccatcaagcaaaacagagattgaaatggatggaaaagttgttaatagccacgtggaaaacttccttgacggcgctttggtgctggaagtcgatgagagagaccaggatgatgaggaagctaggcgcgagatggctcgaattctgaaggagcttaagcaaaagcatcctgacaaagaaattgaacagttaattgaactcgccaactatcaagtcctctcacagcagcaaaagagccgtgccttctataggatccaagccacacgtctcatgacaggagcgggaaacatcctgaagagacacgccgctgaccaagctcgtaaagccgtatcaatgcatgaggtgaacacagaggttactgagaacgaccccgtttccaagatcttctttgaacagggaacatatcagtgcctagagaactgcggaactgtggctctgaccatcattaggcgaggcggagatctcacgaacacagtgttcgtcgatttccgcactgaggatggaaccgcaaatgccggttccgactacgagtttacagaaggcacagttgtgtttaaacccggtgatacgcagaaggaaataagggttggaattattgatgatgacattttcgaagaagatgaaaacttccttgttcacctaagtaacgttaaggtctcttcagaggcatccgaggatggcatactggaggcaaatcacgtcagtaccttggcatgtttgggatctccttccaccgctacagtcacaatttttgatgacgaccacgctgggatcttcacctttgaagaaccggtgactcacgtgagcgaaagtattggaattatggaagtgaaggttttgcgtacatccggcgcacgtgggaacgtcattgtgccatataagaccattgaaggaaccgctcgcggtgggggagaggattttgaggatacgtgcggcgaactagaatttcaaaatgacgagatcgtcaaaactatctcagttaaggtgatagatgatgaggaatacgaaaagaacaagacattctttctggagattggagaaccccgactggtggaaatgagcgagaagaaggcactacttctgaacgagctaggcggatttacaataacgggccagccagtctttcgcaaagtgcacgcacgcgagcaccccatcttgagcactgtgatcacaatagccgacgagtatgacgacaagcagcccctcaccagtaaggaggaggaggagcggaggatcgctgaaatgggcaggcctatcctcggcgagcacactaagttggaagttattatcgaggagagctacgaatttaaatcgactgtcgacaaactgatcaagaagactaacctcgccctggtggtcggcaccaacagttggagagagcaattcatagaagccatcaccgtgtcagcgggtgaagatgacgacgatgatgagtgcggtgaagagaagctgccaagttgttttgattatgtaatgcactttctgaccgtattctggaaagtattatttgccttcgtgccacctactgagtactggaacggttgggcttgttttatcgtcagtatcctgatgattgggttattgacagccttcatcggggacttggccagccacttcggttgcaccatcggcctgaaggatagcgtaacagctgtggttttcgtggccttgggcacttcagtcccagacacttttgcttcgaaggtcgctgctacccaggatcagtacgccgacgccagcatcggcaacgtcacaggaagcaatgcagtcaacgtgtttctgggtatcggagtcgcttggtcaattgcagcgatataccacgccgcaaacggtgaacagttcaaggtctctcccggaacattggctttctcggtgactctcttcactattttcgcctttatcaatgtgggcgtgctgctttataggaggcgcccagagattggtggcgaattaggaggacccaggactgccaaactgctcactagctgtctgttcgtactgttgtggctactgtacatcttcttttcatctctagaagcctattgtcacattaaaggtttctag

SEQ ID NO: 241847 - DNA, 2766 bp, Artificial Sequence
  Description of Artificial Sequence: Synthetic coding sequence
atggcgcctttggctctcgtgggtgtcaccttgctgcttgccgctcccccttgttcaggggcagcgacgcctaccccttcattgccacctccccctgctaatgactcagatactagtaccggcggttgtcaggggtcctatcgatgtcagcccggagtactgctccccgtgtgggagccagacgacccctctctcggggataaggcagcccgtgctgtggtctacttcgtcgctatggtatacatgttccttggggtgagcattattgccgatcggttcatggctgctatcgaggtcataacatccaaggagaaagagatcactatcactaaggcaaacggcgagacatccgtaggcaccgtaagaatttggaacgagacagtgagcaatctgactttgatggcactcggcagttccgctccagagattctcctcagcgtgatcgaggtgtgtggacacaacttccaggcgggtgaactcggtcccggtacaatcgtagggtcggctgccttcaacatgtttgttgttattgctgtgtgcatctacgtcataccagccggtgagagcaggaagatcaagcatcttagggtgtttttcgtgactgcttcttggagcattttcgcctatgtttggctgtatctcattctggccgtcttctcccccggagtggtgcaggtttgggaggcgctgctcactctggttttttttcccgtttgcgtcgtgtttgcttggatggccgacaaacggctgctgttttataagtacgtgtacaagcggtatagaaccgatccccgatctggcatcatcataggggctgagggcgacccccctaagagtattgagctggacgggaccttcgtgggtgctgaggctccaggtgagctggggggacttggaccaggacccgctgaagctagagagcttgacgctagccgcagagaggtcatccagatcctgaaagacctcaagcaaaagcaccctgataaggatcttgaacagctggtaggcatcgccaattattacgccctgctgcaccagcaaaaatctcgggctttctatcgaattcaggctaccagactcatgaccggagccggtaatgtgttgcgcaggcacgccgcagatgcatcgagacgcgctgcccctgctgagggagcaggcgaggatgaggatgacggagcatctcggatcttcttcgagccgtctctgtatcattgtctggagaactgcggttccgttctcctgtctgttacctgtcagggcggagagggaaattcgaccttctacgttgattatcggaccgaagatggctcagcaaaagcgggtagcgattacgagtactctgaggggaccctggtgtttaaacctggtgagacccagaaggaactgcgaatcggcattatagacgacgacatctttgaggaagacgaacacttctttgtccggctgttgaatttgagggtgggtgacgcccagggaatgttcgaacccgatggcggtggccgtcccaaagggcgacttgtcgcccctcttctggccacagtgactattcttgatgacgaccacgccggtattttcagttttcaggatcgactgctgcacgtaagcgaatgcatgggcaccgtagacgtcagggtggtgcgctcttctggcgcacgcggaacggttcgattaccttacagaacagtagatggcactgcaagagggggaggcgtgcactatgaggatgcatgcggcgagttggagttcggggacgatgaaacaatgaagaccctgcaagtaaagatcgtagatgatgaggagtacgagaagaaggataacttcttcatcgagctcggacagccccaatggttgaagcgcggaatctcagcactgctgctcaatcagggtgatggtgataggaagctaactgctgaagaggaggaagctcgcaggatcgccgaaatgggtaaaccggtgctaggcgagaactgcaggctggaggtcattatcgaggagagttacgattttaaaaacaccgtcgataagctgatcaaaaagaccaacctggccctggttattgggactcatagctggcgtgaacagttcctcgaagccattacggtctcagctggggatgaggaagaggaagaggacggaagccgggaagagagattgccttcttgcttcgattatgtgatgcacttcctaaccgtgttctggaaagtactgtttgcatgcgtacctccaacagagtactgccacggatgggcctgttttggagtgagtatattagttattggcctgcttaccgcactgattggagacttggctagccactttgggtgcacagtaggtctgaaggatagcgtgaacgcggtggtgttcgttgctttaggaacctctattcctgatacgttcgcctcaaaagtggcggcactgcaagaccagtgtgctgacgcttcaatcggcaatgtcaccggttcaaatgccgtgaacgtcttcctcgggttgggagtcgcttggtccgttgctgctgtgtattgggctgtgcagggcaggccgttcgaagtgcgaaccggtaccttggccttctcagttacgcttttcactgtgttcgcatttgtagggatcgccgtcctgctctaccgcagacggccacacataggtggcgagctgggcggaccaagaggtccaaaacttgccactacagctctgtttctgggattgtggctgctgtacatcctgttcgcctccctcgaggcgtactgccacatcaggggcttctag

SEQ ID NO: 241848 - DNA, 2478 bp, Artificial Sequence
  Description of Artificial Sequence: Synthetic coding sequence
atgtttgtggtgatcgccgtgtgtatctacgtcattccagccggagagagcaggaaaattaaacacctgagagtgttcttcgtcacagcttcctggagtatttttgcatacgtttggctttacctgatccttgctgtgttctctcctggagttgtgcaggtgtgggaggccttgctgacactggttttcttccccgtgtgtgtggtctttgcctggatggcagataagcggttactgttctacaagtacgtgtataagagatacaggacagaccctagatccggtattatcattggagcagagggtgatccgccaaaatccatagaactggacggtacattcgtaggggcagaggcacctggtgaacttggagggcttggacccggacccgcagaggcgagagagctcgacgcctcgagacgggaagttattcagatactgaaagaccttaagcaaaagcaccccgacaaagaccttgaacagttggtcggaatagccaactattacgcactcctgcaccagcagaagtcgagggctttctaccgaatccaagccacaaggctaatgacaggtgctgggaacgtgcttcgtagacatgcagctgacgcctctagaagagcggctcccgctgaaggtgccggagaggacgaagacgatggtgcaagccgcatcttctttgagccttctttatatcactgtcttgagaattgtgggagcgtgcttctcagcgtcacatgtcagggtggtgaaggtaattccacattctatgtagactataggactgaagatggatcagctaaggcaggcagtgattacgagtactccgagggaactttagtatttaaacccggagagacacagaaggagctccggattgggattatagatgacgatatttttgaggaagatgagcacttcttcgtgcggcttctaaacctgcgtgtgggcgacgcccaaggcatgtttgaacctgatggaggcggtagacctaagggcagactcgtggcaccattgttagcaaccgtgacgatcctcgacgatgatcacgccggaatcttctcatttcaggacagactgctccacgtctcagagtgcatgggaaccgtcgatgtgagggtggtgaggtcctcgggggctcgcggtaccgtgagactcccgtatcgaacggttgatgggacagcacggggtggaggagtgcactatgaggatgcctgcggagagttagagtttggcgatgacgaaaccatgaagacattacaggtcaaaatcgtagatgatgaggagtatgagaagaaggacaacttctttatcgaactggggcagccccagtggctaaaaagaggtatttctgcactactgttgaatcagggggatggcgataggaaacttaccgcggaagaggaggaagcacgaaggatcgccgaaatgggtaagcccgtacttggcgaaaattgtcgcttagaggtcatcatagaggaatcttacgactttaagaatacagtggacaagttgataaagaagacgaacttggctctggtgatcggcacgcattcctggcgggagcaattcctggaggctataactgtgagcgcaggggacgaagaagaggaggaggacgggtcaagagaagaaagactgccaagttgctttgattatgtgatgcatttccttaccgtcttttggaaagtcctattcgcctgcgtgccgccaacagaatattgtcacggctgggcatgtttcggcgtctccatcctcgtgattggactccttacagctctgatcggtgatctcgccagtcactttgggtgcactgtaggtcttaaagatagcgtgaacgcagttgtattcgtggccctgggtacatccattccgggaaataccctgggcgattttggaggcgtgggctcacaaatgagccaggccggagctacacaagatccggcaaagatgcgacacgtaaggcagcagggtgggggagctgccggtccagtccgtcgcagggtgcaccgacagcgggatcgactacagaggggcgaacgtgtcccttggccaggacggagacttgtatgcgggagacgcgtgctgggaggagctggtccaccccttagaggagcacactggcacgcaggcctgcttcgccatgccttgcaccgccttcgtttgagaggacattgtagagctgccgttcctgcgccagccgcacatcggaggagagccggtcgacccgcacggacacaagccagacaccacagggcattacctgggccactggcccctgtgcatcccctaaggcagccaggcggtgtattaccacaccctggactgcttgggccacgggcagagacacggcctcaccggccaccgggtgctcgggattcagccgcaccagccctgggaccttggtcaccttttccccctagactgggtttactttcctgggactccgccagtctgctgagaccactcccttggttgtag

SEQ ID NO: 241849 - DNA, 1155 bp, Artificial Sequence
  Description of Artificial Sequence: Synthetic coding sequence
atggggacggtcgatgtcagggttgtgcgttcctctggcgcaagaggcaccgttcggctcccgtacagaactgttgacggcacagccagagggggaggcgttcactatgaggatgcttgcggcgagctggagttcggcgacgacgaaaccatgaagactctccaagttaagatcgtggatgacgaagaatatgaaaagaaagacaacttctttatcgaacttgggcagcctcagtggctgaagcgagggatctccgccctgctgctgaatcagggcgatggggatcgtaaactgaccgcagaggaggaggaggcgcgaaggattgccgaaatgggcaagcctgtcttgggggagaattgccggcttgaagtaatcattgaggagtcatacgattttaagaatacagtcgataaactgatcaaaaagactaacctggccttggtgatcgggacgcatagctggcgcgaacaatttctagaggctataactgtatcagccggagacgaggaggaggaggaagacggctcccgggaggaaaggctccccagttgttttgactacgttatgcactttctgaccgtgttttggaaggtgttattcgcgtgtgtcccccctaccgaatactgtcatgggtgggcctgctttggggtctcaattttagtgatagggctacttacggccttaatcggcgatttggcctctcactttggctgtaccgttggtcttaaagactctgtaaacgccgtcgtcttcgtggccctgggcacatcgatccctgatacattcgcctccaaggtggcagctctgcaagatcaatgcgccgacgcttcgatcgggaacgtgacaggtagcaacgccgtgaatgtgtttctgggattgggagttgcttggagcgtcgcagccgtctattgggcagtgcagggtcgaccctttgaggtgcgcacgggaaccctagccttttctgttacattgttcactgtgtttgcctttgtcgggatagctgtgttactgtaccgtcgtcgacctcatattggcggagaactggggggtccaagagggccaaagcttgccacaaccgccctgttcctgggtttgtggctgctgtacatcttgttcgcatcgctagaggcgtactgtcacatccgcggattctag

SEQ ID NO: 241850 - DNA, 2034 bp, Artificial Sequence
  Description of Artificial Sequence: Synthetic coding sequence
atggccgataagcgcctactgttctataaatacgtgtacaaacgctataggactgaccctcggtccggaattatcattggggctgagggcgacccacctaaatcgatcgagttggatgggactttcgtaggggcagaagcgcctggcgaactgggcggattgggcccaggccctgctgaagcgagagaactggacgcaagcaggcgagaagtcatccagattctcaaagaccttaaacagaaacatccagacaaggatctggaacagttagttgggatagccaactattacgccctgcttcatcagcagaaatctagagctttctacaggatccaggccaccagactaatgaccggggcaggaaatgttcttagacgacatgccgcagacgcctcaaggcgcgcagcaccagcagagggtgctggagaggatgaggatgatggcgcaagtcggatattcttcgaacctagtctgtatcattgtctggaaaattgcggctccgttctgctgtctgtaacatgccaaggtggtgagggaaattcaacattttatgtggactacagaacagaagacggtagtgcaaaagctggatccgactatgagtatagcgagggcaccttagtgttcaaacctggagaaactcagaaggaactgaggattggcatcatcgacgatgatatcttcgaagaggatgagcacttctttgttcgcctcttgaatctgagggtcggggatgctcagggcatgtttgaaccagatggagggggaagacctaagggacgattggtggcaccccttctggccacggtgacaattttagacgatgaccacgctggcatcttttcattccaggaccgattgttgcatgtgagcgagtgcatgggtaccgtggatgttagagtggtccgttcctcaggcgcacgaggcaccgtaaggctgccttaccggactgtcgacggtaccgcaagaggcggtggggtgcattacgaagatgcctgtggggaactcgaattcggtgacgatgagactatgaaaaccctccaggtgaagatcgttgacgacgaggaatacgagaagaaagataatttctttatagaactgggacaaccacagtggctcaagcggggaatctccgccctgcttctcaatcagggtgacggggacagaaagctgacggccgaggaggaagaggcgcgacgtattgccgagatgggcaaaccggttcttggtgagaattgtagacttgaagtgatcatcgaggagtcttatgattttaagaatacagtggataaattaattaaaaaaaccaacttggcactcgtcattggtacgcattcctggagggaacagtttctggaggccattacagtgtcggcgggagacgaagaagaagaggaggatggttcccgggaggaaaggctgccgagctgtttcgactacgtaatgcatttcttgacagtgttctggaaagtgctgtttgcatgcgtgccccctaccgaatactgtcacggttgggcatgttttggcgtgagtattttagtgataggactacttaccgcacttattggagacctggcttcgcacttcggatgcaccgtggggctgaaagacagcgttaatgccgtcgtgtttgtggccttaggcacatcaatacctgacacgttcgcctctaaagtggctgccttgcaggaccagtgtgctgacgcatctattggcaacgtgactggttcaaacgctgtaaatgtgtttcttgggctaggagtggcgtggagcgtggctgctgtttactgggccgtgcagggcagacctttcgaggtcagaaccggtacgctcgccttcagcgtcaccttatttacggtgttcgcctttgtgggtattgcggtgctgctgtaccggaggcggccacacattggtggtgagttgggaggacctcggggtcctaagctggccacgacagcactgtttctagggctgtggctcctgtacatactattcgcaagcttagaggcttactgtcacatcagaggcttctag

SEQ ID NO: 241851 - DNA, 2448 bp, Artificial Sequence
  Description of Artificial Sequence: Synthetic coding sequence
atggttttgaggagtggtatatgtggactctcccctcacagaatttttccgtccttgctcgtggtggttgctctagtgggcttactccctgtactgaggtctcacggcctccagctctccccaaccgcttcaaccatccggtctagtgagccaccacgggaacgaagcatcggcgacgtgaccactgcaccgccagaggttacgcccgagtccagaccggtaaaccactcagttactgaccatgggatgaaacccagaaaagcctttcctgtcctgggaattgattatacccacgtgaggactccattcgagataagcctgtggatcctgctcgcttgccttatgaaaattggcttccatgtgatacccacaataagctcgatcgttccagaatcatgtctgctgatagtcgtcggccttttggtgggaggcctgataaaaggcgtaggcgagacaccgccttttctgcagtccgacgtctttttcctgttcctgctgccccctatcattctagacgccggttactttctgcccctgcgtcagtttactgaaaatttgggaaccatactaatttttgcagtcgtaggcactctttggaatgctttttttctcggaggattgatgtacgctgtatgtctcgttggcggagagcaaataaataatattggcctgctggataacctgctctttgggtctatcatttccgccgtagacccagtggccgtcttggccgtgttcgaagagatccacattaatgagctactgcacatccttgtcttcggggaatccttattaaatgacgccgttactgtcgtcctgtatcacctgtttgaagaattcgcaaactatgaacacgtagggattgtagacatttttctggggttcttgtctttttttgtggtcgcccttggtggcgttctagtgggtgtcgtgtatggcgtcattgctgcttttacaagtcgttttacatcacatattagggtcatcgagcccctgttcgtgtttctctacagctacatggcttaccttagcgcggaactgtttcacctgagcggcataatggccctgatcgcgtccggcgttgtgatgcgaccttacgttgaggctaatatatcacacaaatcccatactacaatcaagtatttcctgaagatgtggtcgtccgtttcagagaccctcattttcatctttttgggcgtttcgactgtggccggtagccaccattggaattggaccttcgttatttcaaccctcctgttctgtctcatcgctcgcgttttgggtgtcctaggtcttacctggtttattaacaagtttcggatcgtgaagctcacgcctaaggaccagtttatcatcgcttatggaggattgagaggcgctatcgcattttctctgggctatctgctagataaaaagcacttcccaatgtgtgatctgttcctgactgctattatcaccgtgatcttctttaccgtatttgttcagggaatgactattcggccactggtcgacctgttagctgtaaaaaagaagcaggagacgaagaggtccataaatgaagaaattcatacgcagtttctggatcacctgctcacaggcatcgaagacatttgcggccattacggccaccaccactggaaagataaactgaataggttcaataagaagtatgtaaaaaagtgcttaattgccggagaaagaagcaaggaaccacaactgattgcattttatcataagatggaaatgaaacaggcaattgaattagttgagtctggcggaatgggcaaaattccaagcgccgtgagcacggtcagtatgcagaacatacatcccaagagtttgccgtccgagaggattctgcctgccctgtccaaagataaagaggaagaaattcgcaaaatattacggaacaacctgcagaaaacacggcagcgcttaagatcttacaaccgccacacattggtggcagacccttacgaggaagcctggaaccagatgctgctgcggagacagaaagccagacagctggaacagaagattaacaactacctgactgtgcctgcccataagcttgattcacctacgatgtcacgggctcgtattgggtctgatcccttagcgtatgaaccaaaagaagatctccccgtcatcactatagatccagcgtctccccagagccctgagagtgtagaccttgttaatgaggagctgaaggggaaagtactgggtctgtccagagatcctgcaaaggtcgcagaggaagacgaggatgacgacggcggtatcatgatgaggtccaaggagacctcgagtccaggcacagacgatgtgttcacccccgctccctctgatagcccatctagtcagcggatccagagatgcctgtccgacccgggtccacatcccgagcctggagagggggaacccttttttcccaagggtcagtag

SEQ ID NO: 241852 - DNA, 408 bp, Artificial Sequence
  Description of Artificial Sequence: Synthetic coding sequence
atggtgctgcggtccgggatctgcgggttatcaccacatcgtattttccctagcctcttggttgtggtcgccctcgtcggccttcttcctgtgctacggtcgcatggcctacagctgtctcccaccgccagtactataagaagttcagaaccccctcgtgagcgaagcattggtgatgtaaccactgccccaccagaggtaacgccagaatcacgcccagtgaatcactctgtcactgaccacggaatgaaacctcggaaggcctttccggttcttggaattgattatacccacgtacggacgccctttgagatttctctatggattcttctggcctgcctcatgaagataggcttcccttgcgatccacattacttgaagcaccggccaggcgagttacccgcttag

SEQ ID NO: 241853 - DNA, 1668 bp, Artificial Sequence
  Description of Artificial Sequence: Synthetic coding sequence
atggtcctgagatccggcatttgtggcctctctccccatagaatctttccctcgctacttgtggtggttgctctcgtcggacttctcccggtgctcaggtcccatgggctacaactgtcacccaccgcctccacaatcagaagcagcgaaccccctagggaaaggtctattggagatgttaccaccgcccctcctgaagtcacaccagagtctcgacctgtaaatcattctgtgacagaccacggtatgaaacccagaaaggctttccccgtacttggcatcgattacacccacgtccgcaccccttttgagatcagtctgtggattctgctggcctgtctaatgaagattggattccacgttatcccaacgatcagcagcattgtgccagagtcttgtctgctcatcgtggttggcctcctagttggaggcctgatcaaaggcgtcggcgagactccgccatttcttcaatctgatgtgttttttctcttcctgctgccacccattattctggacgcagggtatttcctgcctctgcggcagtttaccgaaaatctggggacaattctcatatttgccgtggttggcaccttatggaacgctttttttctcgggggattgatgtacgccgtgtgtctcgtgggcggagaacaaattaacaacatagggctcctggataatctgctctttggttcaattatttccgcagtggatcccgtggccgttctagcagtgttcgaggaaattcacattaacgagctgctccacattcttgtgttcggagaatcgttgctaaacgatgccgtcactgtcgttctgtaccatctgttcgaagaattcgccaattacgaacatgtaggcatcgtggacatcttcctgggcttcctgtcatttttcgttgtggcactaggtggcgtgctggtgggcgtggtgtacggcgttattgcagctttcacatcacgctttacttcccatatccgtgtgatagagcctctgtttgtattcttgtactcctatatggcttatctgtccgccgagctctttcatctgagcgggataatggctctaatcgccagcggtgtggttatgcgtccctatgttgaggcaaacattagccataaaagtcacaccacgatcaaatactttctgaaaatgtggtcctccgtcagcgagactctgatcttcattttcctaggagtctcaaccgtagctgggagccaccactggaactggaccttcgtgatatccaccctgctgttctgtctgatcgccagggtgctgggggtgctgggtctcacctggttcattaacaagtttcgcatcgtgaaactaacgcctaaagaccagttcatcatcgcgtatggtgggttaagaggcgctatagcattctccctggggtatctgctggacaagaagcatttccccatgtgtgacctgtttttgacagcaattataacggtgattttcttcacagtgttcgtccaagtattgggccagggacgtgccggaccttgtttgggcgaccctcaccgcctgttcccgtggaaggaaaggaaagcttgcgatctgaagtgcgactcatctccatcctcgaccacgaatctcctgtgcgaccttgggagggctacacccccattttgggcttctgtgtcgtcaattgtcaaatag

SEQ ID NO: 241854 - DNA, 960 bp, Artificial Sequence
  Description of Artificial Sequence: Synthetic coding sequence
atgaccattcggccactagttgacctcctagcagtgaagaaaaaacaggaaacaaagcgatcgataaatgaagagattcatacccagtttttagaccaccttctaaccgggatcgaggacatttgtgggcactatgggcatcaccattggaaggataaactgaaccgctttaataaaaagtacgttaagaagtgtctgattgctggtgaaaggtcgaaagaacctcagctcatcgcgttttaccataagatggaaatgaagcaagccatagagttggtcgagtccgggggaatgggaaagatcccttctgctgttagcaccgtgtctatgcagaacatccatcccaagtccctaccttccgaacggatcctgcccgcattgagtaaagacaaggaagaagagattcggaagattcttcgaaacaatttacaaaagactcggcagcgactccgtagctacaaccgtcataccctagtggctgacccctatgaggaggcctggaatcaaatgctgctaagacgccagaaagcaaggcaactcgaacagaagatcaataattatctcacagtgccggctcacaagcttgacagtcccacgatgtccagggccaggattggctctgacccattagcctacgagcctaaggaggatcttccagttatcaccattgaccccgcatcccctcagtccccagagtcggtcgatttggttaatgaagaactcaaaggtaaggtcctgggacttagtcgcgatcctgctaaagtcgcagaggaggacgaagatgatgacggcggaattatgatgcgatcaaaggaaacctcatctcccggtaccgacgacgtgttcacccccgctccttcagatagtcccagttcacagcggatccagagatgtcttagcgaccctggacctcatccagagcctggcgaaggagagcccttcttccccaagggacaatag

SEQ ID NO: 241855 - DNA, 675 bp, Artificial Sequence
  Description of Artificial Sequence: Synthetic coding sequence
atggaaatgaaacaagcaattgaactggtagagtctggcggtatgggaaaaatcccaagtgctgtaagcactgtctctatgcagaatattcacccaaaatcgcttccttctgaacgcatcttacccgctctgagcaaggataaggaagaggagattcggaaaattttgaggaacaacctccaaaagaccagacagcgcctgagaagttataataggcacactctcgtcgccgacccctacgaagaggcatggaatcagatgttattgcgcagacagaaggctcgccagctcgagcagaaaattaacaactatcttacagtccctgcccacaagctggatagccccacgatgtctagagcacgtatcggctctgaccctcttgcatacgagcccaaggaagacctccctgtcatcactattgacccagctagtcctcagtctcccgagtctgtggacctcgtcaacgaggaacttaaaggcaaagtgttagggttatctcgcgacccagctaaggtcgctgaagaggacgaggatgacgatggcggaattatgatgaggagcaaggagacctccagtccagggaccgatgacgttttcactccagcgcctagtgacagtccctcttcgcaacgcattcaaagatgcctctccgatcctggacctcatcctgagtag

SEQ ID NO: 241856 - DNA, 1431 bp, Artificial Sequence
  Description of Artificial Sequence: Synthetic coding sequence
atggcatatttaagtgccgagctattccacttgtctggaattatggctttaatagcctcaggggtcgtgatgaggccatatgtggaggctaacatttctcataagtctcacacaaccatcaagtatttcctgaagatgtggagtagcgttagcgaaacactgatattcatattcctaggtgtgtccactgtagccggtagtcaccactggaactggactttcgtgatcagcacactgctgttttgcttgatcgcacgggttctgggggtgctcgggctgacgtggtttatcaataaattccgcatcgtgaagctcactcccaaagatcagttcatcatcgcctatggagggctccggggtgccatagcattttctctcggatatcttctggacaaaaaacatttccctatgtgcgatctgttcttgactgcaattattacagtcatcttcttcaccgtgttcgtacagggcatgacaatccggcctcttgtggacctgctggccgtgaagaagaagcaggaaactaagcggtctatcaatgaagagatacatactcaatttctggaccatctcttgaccgggatcgaggatatatgcgggcattatggccatcatcactggaaggacaagctcaacagattcaacaaaaaatacgtcaaaaagtgcctgatagccggtgaacgctccaaggaaccacagctgatcgcgttctaccacaaaatggaaatgaagcaagccatcgaacttgtagagagcgggggaatgggtaagatcccatctgccgtgtccactgtgtcaatgcagaacattcatccaaaaagcctgcctagtgagcgcatcttgcctgccctctctaaggataaggaagaagaaatccggaaaatactgagaaacaacctgcagaaaactcgtcagcggctgcgcagctataaccgccacaccctcgtggcggatccttacgaagaggcatggaaccagatgttgctgaggcgacagaaggcacgccagctggagcaaaaaatcaacaattatctcactgtcccggctcacaagctcgactccccaacaatgtctcgggcaagaatcggttccgacccacttgcgtatgagccgaaggaagacttgcccgtcataactatcgacccagccagccctcaaagcccagagtccgtagacttggtgaatgaagagctcaaaggaaaggtgcttggtctgtccagggatccggctaaagtggccgaagaagatgaagatgatgatggagggattatgatgcggtctaaagaaacatctagccccggtaccgacgacgtcttcacaccagccccaagcgattccccaagctcacagcggatccagcgctgcctgtctgatcccggtcctcatccggagccaggagagggggaacctttcttccctaaaggccagtag

SEQ ID NO: 241857 - DNA, 1626 bp, Artificial Sequence
  Description of Artificial Sequence: Synthetic coding sequence
atgaactgtcgcgaacttcccctgactctatgggttctgatctccgtgagtactgccgaatcctgtacctccaggcctcacattacagtcgtagagggtgagccgttttacctgaagcactgtagctgctcactggcacatgaaattgagaccactaccaagtcctggtacaaatcaagcggttctcaggaacatgttgagttaaacccgagatcgtcgtcaaggatcgctctccacgactgcgtactcgagttctggccggtagaactcaacgacactggctcctatttttttcagatgaagaattatactcagaagtggaagctcaatgtcatccgacgcaacaagcactcttgcttcacagagagacaggttacctccaagattgtggaggttaagaaattcttccagattacatgtgagaacagttactaccagactcttgtcaacagcacctctctgtacaagaattgtaagaaactgctgctcgaaaacaacaagaacccgaccataaagaaaaatgctgaattcgaagaccagggctattatagctgtgtgcattttctgcatcataatgggaaactgttcaatatcacgaaaacttttaacatcactatagtggaagaccgcagtaatatcgtgccagttctcctgggccctaaactgaatcacgtggccgtggagctaggcaaaaatgtgcggctcaactgctccgcccttctgaatgaggaagacgtgatttactggatgttcggcgaagagaatggtagcgatccaaacatccatgaggagaaagagatgagaataatgacccctgagggaaaatggcatgcatcaaaggtcctgagaatagaaaacatcggagaatccaatttaaatgtgttatataactgcaccgtggcctccacggggggaactgacactaagtcatttattctcgtgcgaaaggctgatatggccgacataccaggccacgtgttcactaggggaatgattatagcagtgttgatcctggtagcagtcgtttgcttggtaacggtatgcgtgatttaccgggttgatctcgtattgttctaccgacatctaactcggagggatgagaccttaaccgacggcaagacttacgacgcatttgtgtcctacttgaaggagtgtcgcccagaaaacggcgaggaacatacctttgccgttgagattttgcctagagtcctggaaaaacactttggatataagctgtgtatcttcgaaagggacgtggtcccaggcggagccgtcgttgacgaaatccactccctgattgagaaatcacgcaggctgataatcgtgctcagcaagtcctacatgagcaacgaagtcaggtatgaactggagagtgggctgcacgaggccctggtggaacggaagataaagataatcctaatcgaatttacaccggtgaccgatttcaccttcctccctcaatcactgaagttgctcaaaagccatcgagtccttaagtggaaggctgacaagtcattatcctacaacagtagattctggaagaatctactctatctcatgccagccaagaccgtgaagccaggaagggatgagccagaagtgctaccagttctgtccgagagttag

SEQ ID NO: 241858 - DNA, 2505 bp, Artificial Sequence
  Description of Artificial Sequence: Synthetic coding sequence
atgtggggactcggagcgcgtggacctgaccgaggactgcttctagcacttgcgctagggggtctggctcgcgctggaggggtggaagtggaacccggaggagcccatggagagtccggcggatttcaagtcgtgacttttgagtgggcacatgtgcaagatccatatgtaatcgctctttggatcctcgtggcttccctggccaagatcggtttccatttaagccataaagtgacgtctgtcgtgcccgaaagcgcactgctgattgtgcttggcctagtgctcggtggcatcgtgtgggctgccgatcacatcgccagcttcacacttacccccaccgtcttctttttctatctgttaccacctattgtcctcgatgccggatatttcatgcccaatagactgttcttcggtaatctaggcaccatcctactttacgctgtcgttgggactgtgtggaatgctgcgaccacgggactgagcttgtacggggtatttctaagcggcctaatgggggatctccagatcggactgctcgacttcctgctgttcggtagtttaatggcggcagtggatcccgtggcggtactggccgtttttgaagaggtccacgtgaatgaggtcctgttcattatcgtgtttggtgagtctcttctgaatgatgccgttaccgtggttctgtacaatgtatttgagagttttgtggctctaggcggtgataatgtgacaggcgtcgattgtgtgaaaggcatagtgtcattcttcgtagtctcattagggggaacccttgtcggggtagtcttcgccttcttgctgtctctggttacccgattcacaaagcacgtgagaatcatagaacctggattcgtgtttattatctcttatctgtcctacctaactagcgagatgctgtccttatcagctatactggctattaccttttgtgggatctgttgtcagaagtacgtgaaggctaacattagtgaacaaagcgcaactaccgtcagatacactatgaaaatgttggccagttccgccgagacgatcatctttatgtttctgggcatctccgcagttaacccattcatctggacttggaacactgcatttgtgctgctgacactcgtgttcattagcgtctacagggccatcggcgtggtcctccagacttggttactgaatcgttataggatggtgcaacttgagcctatagaccaggtggtgctgagttacggtggcttgcggggagctgttgcatttgctcttgtggtgctacttgacggtgacaaagttaaggaaaagaatctattcgtgtctaccactattattgtcgtgttcttcacagtcatctttcaggggctcaccatcaaaccactcgtccagtggctcaaggttaaacgatctgagcatagggaacccagactgaatgagaagcttcatggcagagcatttgaccacatactctccgcaattgaggacatctcaggccagatcggccacaattatttacgggacaagtggtcccactttgacagaaaattcctcagccgggtgctgatgcggcgtagtgcccagaagtcccgggaccgtattctgaacgtgtttcacgaactcaatctaaaggatgccatcagttatgttgcagagggagaacgaagaggatccttagcttttattcgttctcctagcactgataacgtcgtgaacgtggattttaccccccgaagcagcacagtggaggcctctgtgtcttacctgctccgcgaaaatgtgtccgcggtatgtctagacatgcagtcgttggaacagaggagacgcagcattagggacgctgaagacatggttacgcaccacacattgcaacagtacctgtataaaccacgccaggaatataagcatctttattccagacatgagcttaccccaacagaagatgaaaagcaggatagagaaatctttcatcggactatgcggaagcgcttggaatccttcaaatcgaccaaactgggcttgaatcaaaacaagaaggccgctaagttgtataagagggaaagagcccagaagcggagaaatagttcaattccgaacggaaaactccccatggagagccctgcacagaactttacaatcaaagaaaaagatctggaattaagcgacactgaggaacctcccaattacgatgaagaaatgtctggagggattgagttcttagcctctgtaactaaggatactgcctcggatagtcctgctgggattgataaccccgttttcagtccagatgaggccctggaccgtagcctcctcgctagactccccccttggctttcgccgggtgagactgtggtgccctctcagagggccagaacccagatcccctatagcccaggaactttttgtagactgatgccatttcgattgagtagtaagagtgtggacagcttcctgcaggcggatggacctgaagaacgaccgccagccgctctgcctgaatctacacacatgtag

SEQ ID NO: 241859 - DNA, 1077 bp, Artificial Sequence
  Description of Artificial Sequence: Synthetic coding sequence
atgtcagccgacgccgctgctggcgcacccctgccgaggctttgctgcctcgaaaaagggccaaatggctatggcttccaccttcacggcgagaagggtaaactgggacagtacattcgtctggtcgaacccggtagccccgctgaaaaggctggccttctggcaggggacaggttggtggaggtcaatggcgagaacgtggagaaggaaacccatcagcaagtggtgagccgaatacgcgctgcactgaatgccgtgcggctgctcgtggtggatcctgagacagatgaacaactgcaaaagctgggagtccaggtcagggaggagttgctgcgagcgcaggaagcccctggccaggctgagccccctgccgcagccgaggtgcagggtgcaggcaatgaaaacgagccacgggaagctgacaaatcccatcccgaacagagagagctaagacctagactgtgtacaatgaagaaaggccctagcggatatggattcaatctgcacagcgacaagagcaaaccaggccagttcattagatcagtagaccctgactcccctgcagaggcctccgggctccgtgctcaggataggatcgtggaggtaaacggggtctgcatggagggcaagcagcacggagatgtggtctccgcgattcgagctggaggggacgagaccaaactgctcgttgttgaccgggaaaccgatgagttctttaagaaatgccgtgttatccctagccaggaacacctcaatggaccattaccggttcctttcactaatggtgagatccagaaggaaaatagtcgggaagccctggcagaggccgcactagaatctcccagacctgctctcgttagaagtgctagcagcgacacttccgaagagctaaattcccaggactcccctcccaagcaggactccaccgcccctagttccacgtcaagttcagatcctatactggattttaacatttccctcgctatggcaaaggagcgggcacatcagaaaaggtctagtaaacgcgcacctcaaatggactggagcaagaaaaatgaactgttttctaatttgtag

SEQ ID NO: 241860 - DNA, 822 bp, Artificial Sequence
  Description of Artificial Sequence: Synthetic coding sequence
atgtcggctgacgcggctgcaggcgctcccttgcctcgcttgtgctgcctggagaaggaaacccaccagcaggtggtaagcagaattagggctgcgctgaacgctgtgcgcctcctagtcgtagaccccgaaaccgacgaacaactacagaagttgggagttcaggttcgggaagaactgctaagagcccaggaggcgcctggtcaggccgaacctcctgcggcagccgaggtgcaaggtgcaggcaatgagaacgaacccagggaggccgataagagtcatcccgagcagagggaactgaggccacggttgtgtaccatgaagaaggggccaagcgggtacggtttcaacctgcactctgacaaatccaaacctggacagtttattcgttccgttgaccccgactcccctgctgaagctagcggacttagggcccaggataggattgtcgaggtcaacggggtgtgcatggaaggcaagcaacacggggacgtcgtatcagccattcgggcaggaggcgatggaagtggagggggaaaccagcgaggtgccgaattcccaagacagccaccgaagacaggacttcacagtgcactggtctacctcctattgagaccccaccccaggctccagcacctgcccggacacgggcagcgcgaaggacccccagaaacacaacagcagaccgggccagccgacgggctcgaacaggagaagcgtacactgcaacaaccactttccgccctgttgccaccgagtgactggcaggggagggcctctatcccgccacacctgtttccatccccccagttactcccttag

SEQ ID NO: 241861 - DNA, 1014 bp, Artificial Sequence
  Description of Artificial Sequence: Synthetic coding sequence
atggccgctccagagcccctgcggcctaggctatgtaggcttgttcgcggagagcagggctacggatttcacctccacggtgaaaagggtagaaggggccaatttattcgcagagtcgagcctggctccccagctgaagccgctgcgctcagagctggcgacagactagttgaggtgaacggtgtcaacgtggagggtgagacgcatcaccaagttgtgcagcgtatcaaggccgtggaaggccagacacgcctgctggtggtggaccaggagaccgatgaagaacttcgcagacgtcagttgacctgcactgaagagatggctcaacgtggactgccaccagctcatgacccatgggagccaaagcccgactgggcacataccgggagtcattctagcgaagcaggaaagaaagatgtcagtggccctctgcgggagctccgccctcggctttgtcacctgcgcaaaggaccacagggctacgggtttaacctgcactctgataaatcccggccaggacagtacatccggtcagtggaccctgggagccccgcagcccgatcaggattgagggctcaggacagattaattgaggtcaatgggcaaaacgtggaagggctccgccatgccgaagtggtggcttccattaaggcgcgtgaagacgaagctaggttgctcgtcgtggatccagaaaccgacgagcattttaagcgactccgagtcacacctacagaagagcacgttgagggaccgttaccaagccctgtcaccaacggcacaagtcccgctcaactcaacggcggttctgcttgctctagccgctctgatcttcccggatcggataaggacaccgaggatggatctgcctggaaacaagacccctttcaggagtctggactgcatctctctccgacggccgcagaagccaaagaaaaagcaagggccatgagagtgaacaaaagagctccgcagatggactggaatcgcaagagggaaatcttctccaatttttag

SEQ ID NO: 241862 - DNA, 981 bp, Artificial Sequence
  Description of Artificial Sequence: Synthetic coding sequence
atggctgcgccagagccactgagaccacggttatgtcgccttgtgcgcggagagcaagggtacggatttcatttacatggggagaagggaagaaggggccagtttatcagacgtgtggagccaggaagcccagctgaggcagccgctctccgggcaggggacaggctggtcgaggtgaacggggttaatgtggagggcgagactcatcaccaggtcgtgcagaggatcaaggccgtcgagggacagacaagacttttagtcgtggaccaagaaacggatgaggaactccggaggcgccagttaacttgcacagaagaaatggcgcagagagggttaccacctgcccacgatccttgggagccaaagcctgattgggcacacactggctcacactcatcggaagccggtaaaaaggacgtctcaggccctctgcgtgagctgagacctaggctgtgtcacctgagaaaaggacctcaggggtacgggttcaatctgcacagcgacaagtctcgacccggacagtacatcagatctgtggatccaggaagtccagccgcacgttccggattgagagcccaggacagactgattgaagtcaacggtcaaaacgttgaaggtctccgacatgctgaagtcgtggccagtattaaggcgagagaagatgaggcacgcctcttggtcgtcgatcccgaaactgatgagcacttcaaaagactgcgagtgacccctaccgaagaacatgtggagggaccgctgccaagcccagtaaccaatggaacgtcccccgcacagctgaatgggggatcagcatgttcaagccggtccgatttgcctgggagtgataaggacaccgaagagtccggattgcacctgagtcccaccgccgcagaggccaaagagaaagccagggccatgcgcgtcaacaagagggctccccagatggactggaaccgcaagcgggaaatcttttctaatttctag

SEQ ID NO: 241863 - DNA, 2397 bp, Artificial Sequence
  Description of Artificial Sequence: Synthetic coding sequence
atggccttgcagatgttcgtcacttatagtccctggaattgtctattgttgcttgtggctctggagtgttcagaggcaagcagtgaccttaacgaatcggctaattcaactgctcagtatgcatccaatgcgtggtttgctgctgcatcctctgaaccagaggaaggtattagcgtgttcgagctggactacgattacgtccagataccctatgaggtcacactgtggatcttattggcttcattggctaagatagggtttcatctgtatcacaggcttcccggactaatgcctgaaagttgtctcctcatactggttggggctctggtgggagggataatttttggaacagaccacaagtcccccccagtgatggatagttccatctactttctgtacctcctaccgccaattgtgctcgaaggaggctacttcatgcccacaagacccttcttcgaaaacatcggttcaatcttgtggtgggctgttcttggcgctctgatcaacgccctgggtatcggtctgtcactctacctgatttgccaggtgaaggcgttcgggctgggggatgtgaacctgcttcagaacctcctctttggatcgttaatatcagcagtcgatccagtggccgtgcttgccgttttcgaggaagctagagtgaacgaacagctatatatgatgatttttggtgaggccttgctgaacgacggcatcactgtggtcctttacaatatgttgattgccttcacaaagatgcacaagttcgaggacatagagactgtcgatattcttgcaggctgcgcacgcttcatcgtcgtgggcctcggcggagtgctattcgggatcgtcttcggattcatctcagcttttataacgcgattcacacagaatatctctgccattgagcctctcattgtttttatgtttagttacttgagctatctggccgcagaaactttgtatttgagcggcattctcgcaattacagcttgcgccgtgacgatgaagaaatatgtagaggagaacgtgtcccagacatcttacactaccatcaagtatttcatgaagatgttgtcgtcggtctcagaaacactcatattcatattcatgggagtctctacagtgggcaaaaaccacgagtggaactgggcctttatctgcttcacactcgctttttgtcaaatttggcgggcaatcagcgtttttgcactcttttacatcagtaaccagtttcgtacctttccattcagtatcaaagatcagtgcataattttttattcaggagttcgcggagccggaagcttttctttagcattcttgctccctcttagtctcttcccaagaaagaaaatgtttgtaacagccacgctcgtggtcatctatttcaccgtgttcatccaagggattacagtgggaccgctggtccggtatctggacgtcaaaaaaacaaataagaaggaatcgatcaatgaagagctgcacatccgtcttatggatcacctgaaagcaggcatcgaggatgtatgcggtcattggagccattaccaagtgcgtgataagttcaagaaatttgatcaccgatacttaagaaaaattctcattagaaagaacctccctaagagtagtatagtgtccctttataaaaaactggaaatgaagcaggccattgagatggtagagactggcattctctcctccactgccttctcaattccgcatcaggcacaaagaatacagggcataaagagactgtctcctgaggacgtggaaagtattagagatatcctaacgtccaacatgtaccaagtgcgacagcgaacactgtcctataataaatacaacctcaagccccaaacctccgagaagcaggccaaagagattttgatccgcaggcagaacacgttaagagaatctatgcgcaaaggccattcgctcccatggggaaagccagcaggaaccaagaatattcgctaccttagctatccttacggtaacccccaatccgccggtcgggatacaagggccgcaggattttctgacgatgactcttctgatcctgggtcaccgtctatcaccttcagcgcgtgtagtaggatcggcagccttcagaaacaggaggcacaggagatcatccccatgaagagcctccaccggggacgaaaagccttttctttcggctatcagcgcaacaccagccaggaggaataccttggcggagtgcggagggttgctctgcgccctaaacctctctttcacgccgtggatgaagaaggggaatctgggggagaatccgaaggcaaggcgtcacttgtggaagtgcgctcaagatggactgctgaccatggccacggcagagatcaccatcggagccacagccccctgttgcaaaaaaagtag

SEQ ID NO: 241864 - DNA, 2691 bp, Artificial Sequence
  Description of Artificial Sequence: Synthetic coding sequence
atgctccgtgctgctttgagtctgcttgctctgcctttggctggagccgctgaagagccaacacagaaacctgaatcccctggtgagccaccgccagggctcgagctgtttaggtggcaatggcacgaggtggaagcgccttacctcgtggctctctggatcctggtggcttccttagccaagatcgtgtttcacctgagccggaaggtcaccagcttggtcccagaatcctgcctgctgatcttactagggttagtgctggggggtatagttttagccgttgccaaaaaagctgaataccagttagagcccggaaccttcttcttattccttttgccccctatcgtgctcgacagtggttactttatgcctagtaggctgttctttgataacctgggagctatcctgacatacgccgttgtgggcaccctatggaatgcctttactaccggggctgccctatggggcctccagcaggctggcctggtggctccaagggtgcaggctggtttgcttgacttcctactgtttggctcattaatttcagcagtcgatcccgtcgcagtcctggctgtgtttgaggaagttcatgtgaacgagactctgttcatcatcgtcttcggggagtctcttctcaatgatgcggtgaccgtggtcctatacaaagtgtgtaattcttttgttgagatggggagcgcaaacgtgcaggctacagactatctcaagggcgttgcctctctatttgtggtcagcctcggaggcgctgccgtagggttggtgttcgctttccttctggctctgactacgcgatttactaaaagagtgcgaatcattgagcccttactcgttttcctcctggcctatgctgcctacttaactgctgagatggccagcctgtctgccatattggcagtgacaatgtgtggcttaggatgcaaaaaatacgtcgaagcaaatattagccacaagtctcgtaccactgtcaaatatactatgaagactctggcatcttgcgcagaaaccgtcatcttcatgctgttgggaatttccgcagtcgacagctcaaagtgggcctgggacagcggacttgtcctgggaaccctgattttcatcttattcttcagagctcttggagtcgtgctgcagacctgggttcttaaccagtttcggctggtgcccctggataaaatagatcaggtcgtgatgagctatggcggactacggggagccgtggcattcgccctggtgatcttgttggatcgtacgaaagtccctgctaaggactacttcgttgcaacaacgattgtagttgtgtttttcacagtgatcgtgcaagggctgacaataaagcctctcgtgaaatggctgaaggttaagaggagcgaacatcataaacctaccctcaaccaggagcttcacgaacacactttcgaccatatactagcggcagtggaggacgttgtgggccaccatggctaccattactggcgcgaccgttgggagcagtttgacaagaaatatttaagtcagctcctcatgcgccgatcagcatacagaatccgggatcagatttgggacgtatattatcgcttgaacattagggacgcaattagctttgttgaccaggggggtcatgtcctcagcagcaccggactgacactcccttctatgccttcccggaattctgtagctgaaacatctgtgactaatttgttgcgcgaatctggtagcggggcttgcctggacctccaagtgatcgatacagtaaggagtggaagagaccgggaagatgctgtgatgcatcacctgttgtgtggcggactgtacaagccccgaagacgatacaaggcatcatgctccaggcacttcataagcgaggacgctcaggagaggcaggacaaggaagtctttcaacagaacatgaagaggcggttggagtcctttaagagtaccaaacacaatatctgtttcactaagagcaagccaagaccaaggaagaccggaagaagaaaaaaagacggtgttgccaacgcagaagctacaaacggaaagcatcgaggcttgggctttcaggatactgcagcggtgatcttgactgtggaatctgaggaggaagaggaagaatcggactctagtgaaacggaaaaggaggatgacgaagggattatcttcgtggctcgggcaacatcagaggttctgcaggaagggaaagtgagcgggtcactggaggtttgtccttcacctcgcattatacctccctcgcctacgtgtgccgagaaagagctgccatggaagtccggccaaggcgacctcgccgtatacgtctcctccgagaccactaagatcgtacccgtagacatgcagaccggatggaaccagtctatttcctcattagagagtttagccagccccccatgcaatcaggcacctattctaacttgcctccctcctcaccctcggggtacagaggagccccaagtacccctgcacttgccttccgatccgaggagttcattcgcctttccgcctagtcttgctaaggctggacgaagccgatctgaaagctctgctgatttgccccagcagcaggagttgcaacccctcatggggcacaaggaccacacacacttgtcacctggaactgcaacatctcattggtgcatccagtttaacagaggatccaggttgtag

SEQ ID NO: 241865 - DNA, 1308 bp, Artificial Sequence
  Description of Artificial Sequence: Synthetic coding sequence
atgcgtaggtcagcctaccgtattagagatcagatctgggacgtctactaccgtctgaacatcagggacgccataagcttcgtcgatcaaggagggcacgtgctctcctctactggcctgaccctgcccagcatgcctagcagaaactctgtggcagaaaccagcgtgaccaacctgcttagggagagtggcagcggagcttgtctagacctgcaagtaatagacaccgtacgctcagggcgagatcgcgaagacgccgtgatgcaccacttactgtgtggtggattgtataaacctagacgaaggattgagctcaggacagaaccatgcggcatgctactgaaaaccttcctacagacagacatggatcaggccttcctggggacgaagcctgctgctgtggccacatctagtcagcgcatgcgcagaagtggtaggactcggagatcgtcttcacggatgaaaaggcgtctcgagtctttcaagagtacaaaacataacatttgttttactaagtctaagccacgccctcgaaaaaccggaaggcgcaagaaggacggggtggctaatgccgaagccacgaacggcaaacaccggggtctgggcttccaggatactgccgctgttattctcacagtagaatccgaagaggaggaagaagagagcgacagcagtgagactgagaaagaagatgatgagggcattatttttgtggcccgagcaacgtctgaagtgctgcaggagggaaaggtttccgggagcttagaggtgtgtccaagccccaggataattccaccaagccccacatgcgccgagaaggaattaccctggaaatccggacaaggagacctggcagtgtacgtgagtagcgaaacaacaaaaatagtgccagtggacatgcagaccggctggaatcagtctatttcttcacttgagagccttgcaagcccaccttgtaatcaggctcctattctcacctgcctccccccacaccctcgaggaaccgaggagccccaagtgcccctgcatttaccatccgacccgcgaagctctttcgcgttcccaccctcactggcgaaagcagggctggccgtgcgggcagctctgacttctcctagtagtcgatcttgtagtccttcttgggcaaccaggaccacacccataagcgcacaggctcctctgcccccaactggagcttcctctagtaccgaggctgccggatgttcgagccggccaagagggggtgcgggagggggaattcctgtcggttcagccccatgggtgatgggtcgagctctggaaacttag

SEQ ID NO: 241866 - DNA, 2106 bp, Artificial Sequence
  Description of Artificial Sequence: Synthetic coding sequence
atggctagaagaggatggcgcagggcaccgctgaggcgaggggtcgggtcttccccaagggcccgacgattaatgagaccgctttggctgctacttgccgttggagtttttgactgggccggagcttctgacggaggcggaggggaggcgcgtgccatggatgaagagatcgtaagtgagaagcaggctgaagaatctcatcgccaagattccgctaaccttctgatattcattctgctgcttaccctgacaatcctgactatctggctgttcaagcaccgaagggcacgctttttgcatgaaacaggcctcgcaatgatctacggcctgctggtcggcctcgtcttgcgctatggaattcacgtgccatccgacgtaaacaatgtcaccctgtcatgcgaggtgcagtcgagccccaccacactgctagtgaatgtatccgggaaattttacgagtatatgctcaagggcgagatctcctcacacgaactaaataacgtgcaggataatgagatgttgaggaaagtgacattcgaccccgaagttttctttaacatcctgctgcctccaatcattttttatgcagggtactcactaaaacgcagacactttttcaggaatcttggcagcattttggcctatgccttccttggcactgccatttcttgcttcgtaatcggatctataatgtacggctgtgtgactctgatgaaagtgaccgggcaactagcaggggacttctatttcactgattgtctgctgtttggtgctatcgtctctgcaaccgacccagtgacggtactcgctatcttccacgaattgcaggttgacgtggagctgtatgccctccttttcggagagagcgtcctgaacgacgctgtggcaatcgtcctctcctctagtatcgtcgcttatcagccagctggtgataattctcacacctttgacgtgaccgctatgtttaagtcgatagggattttccttggaatcttttcaggctccttcgccatgggcgctgcaaccggggtggtcactgcacttgtgacaaaatttaccaagcttcgggaatttcaactcttagaaactggtctgttcttcctgatgtcttggagtacatttttactcgccgaagcatggggcttcactggcgtggttgccgtgctcttttgtggcataactcaggcccactacacctataataacttaagcaccgaatcccagcaccggacaaaacagctgtttgagttgctcaactttctcgctgaaaacttcattttctcgtatatggggttgactctctttacttttcaaaatcacgttttcaatccaacgtttgtggtgggggcattcgtggctatctttctcgggcgtgcagctaacatctatcccctgtctttgctgcttaacttgggaaggcggagcaaaattggcagcaactttcaacacatgatgatgttcgctggtctgaggggtgcgatggcattcgcactagcaatacgcgacactgccacatatgcccgtcaaatgatgttttccacaactctgttgatcgttttttttaccgtttgggtgtttgggggagggactactgcaatgttgagctgcctccacattcgggtgggggtagatagtgaccaagaacatctaggcgtacccgagaacgagcgcagaactaccaaggctgagagcgcctggctttttcgcatgtggtacaattttgaccacaactacttgaagcctctcttgacccattccgggccaccattaaccactacgctcccagcttgttgtgggccaatcgcgaggtgccttacgtcccctcaagcatacgaaaatcaggagcagttgaaggacgacgacagcgacctcattcttaatgacggcgatattagcctgacttacggcgatagtacggtcaatacagagcctgccacaagcagcgcacctagaaggttcatgggcaattctagcgaagatgcgttagaccgcgagctggcctttggagaccacgaactggtgattaggggcacgcgcctcgtgctccccatggacgattctgaacctcctctgaatctcctggataatactcggcatggcccagcctag

SEQ ID NO: 241867 - DNA, 2010 bp, Artificial Sequence
  Description of Artificial Sequence: Synthetic coding sequence
atggcacggcgtggctggagacgggctcccttacgtcgcggagtagggtccagccccagagcgagacgattgatgcgcccactatggctcctgctggcagtgggcgttttcgactgggcaggtgctagtgacggcggtgggggagaggctagagctatggacgaagagattgtgtccgaaaagcaggccgaggaaagccatcgtcaggatagcgctaatctgctgattttcatactactcctcactctgacgattttgaccatctggctgtttaaacaccggcgtgcgaggttcttacacgagaccggacttgctatgatttatggcttgctggtggggctcgtgcttcgctacgggatccatgtgccaagcgacgttaataacgtaactctaagctgtgaggtacagagttcccccactacactgcttgtcacatttgacccggaggttttctttaatatccttctgcctccaattattttctatgccggttacagtttgaaacggagacacttcttcaggaatcttggatcaatactagcttatgcttttcttgggacagcaatcagttgttttgtcattggcagcatcatgtatgggtgtgtgactctaatgaaggtcactggacagttggctggggatttctacttcactgattgtttattatttggggctatagtcagtgctactgaccccgtgaccgtgttagccatctttcacgaattgcaagtggatgtggagctatatgcacttctttttggggagagcgttctcaacgatgcggttgcgattgtcctgagctccagtattgttgcttaccagccggctggcgacaactctcatacattcgacgtgacagccatgttcaagtcaatcggcatcttcctcggaatcttctccggatccttcgctatgggcgctgcaaccggcgtagtgactgcgctggtgactaaattcactaaactacgagaatttcagcttctggaaacgggtctcttttttttgatgagttggagtacatttttactcgctgaggcatgggggttcacgggcgtggtagccgtattattctgtgggataacccaggcccattacacttacaacaacctgtcaactgaatcacagcatagaacgaagcaattgtttgagctcctgaatttcctggctgaaaatttcattttctcttacatggggttaactctattcacttttcaaaatcacgttttcaatccaacctttgttgtgggagcttttgtagctatctttctcggcagggcggcaaacatctaccccctatctttgcttctgaacttgggccgtcgaagcaagataggctcaaacttccagcatatgatgatgtttgcaggccttcggggagccatggcgttcgctctggcaattagagataccgctacttatgctcggcagatgatgttcagcacaacactcctgattgtgttttttacagtatgggtgttcgggggagggactacagctatgttatcatgtcttcacattagagtcggcgtggatagcgaccaggaacatctgggagtgccggaaaatgagagaagaaccactaaagccgagagcgcatggctgtttcgcatgtggtacaattttgatcacaattacttaaagccactcctgacgcattccggccctccattgaccacaacactaccagcctgctgcgggcctattgcacggtgtctgacatcacctcaagcctacgaaaaccaggagcagctcaaagacgatgacagtgatctcattctcaatgacggagacatttcacttacttatggggattctactgtaaatactgagccagcaacttcatctgcaccgaggcgatttatgggcaactcttctgaggacgctctcgaccgagagctagctttcggagatcatgaactggtcatccgcggtacacgtctcgtgctgcctatggacgatagtgagcccccactcaatcttcttgacaacacacggcatgggccagcttag

SEQ ID NO: 241868 - DNA, 1950 bp, Artificial Sequence
  Description of Artificial Sequence: Synthetic coding sequence
atggacgaggagatcgtcagtgagaaacaggcggaggaatctcatcggcaggactccgctaacctgctgatctttatcctcctactcacactcaccatcctaacaatctggctctttaagcatagaagggcccgtttcttacacgagaccggcctggcgatgatatacggcctgttggttgggctggtcctgcgttacggaatccacgtcccatccgatgtcaataatgttacactgagttgcgaggtgcagagttctccgaccacccttctcgtaaacgtcagcggtaagttttacgagtatatgctcaagggagaaatcagttcgcacgagctaaacaatgtacaagacaacgaaatgctcagaaaagtgacatttgatccggaggtcttttttaacattcttcttccacccatcatcttttacgccggttacagtctcaaaagacggcacttcttccggaatctcgggtccattcttgcgtacgcatttctgggtaccgcaatatcttgtttcgttataggctctatcatgtacggctgtgtgacgctgatgaaggtaacgggtcagttggcaggagatttttattttaccgactgcttgttgttcggggctatcgtgagtgcaacagacccagtgacagtcctagccatcttccatgagctgcaggtggacgtggagctttacgcgctcctgtttggagagtccgtgctaaacgacgcagtggccatcgtgctcagctcttcaatcgtggcttatcaacctgctggcgataattcccatactttcgatgttaccgccatgtttaagtctatcggcatcttcctaggcattttctctgggagctttgccatgggagcagctaccggggtggtgaccgccctcgtgaccaaattcactaaactgcgcgaatttcaactgctagagacaggcctgttcttcctgatgagctggtctacgtttctgttagccgaggcctggggtttcactggcgtggtggcagtgctgttctgcggcattacccaggcccactatacttataataacctgagcacagaaagtcagcaccgtacaaaacaacttttcgagctgctgaacttcttggcggagaactttatcttcagttacatggggctgaccctattcacttttcagaaccatgtttttaatcccacctttgtcgtgggcgctttcgtggccatcttcctggggagagcggcaaatatctatcctctgtctctcttgctgaatctcggcagacgcagtaaaattggctccaatttccaacatatgatgatgttcgccggattgcgcggagctatggcctttgctttggccatacgcgacacagcaacctatgccagacagatgatgttttccaccacactcctaatcgtgttctttactgtctgggtgtttggcggaggaactactgctatgctgtcttgcctccatattagagtgggggtggattccgatcaggaacatctgggagtgccagaaaatgagcgaagaactacgaaagccgagtctgcgtggctctttcgcatgtggtacaattttgatcacaactacctgaaacctctcttaacacactcaggtcctccgctaaccaccacacttcctgcctgttgcgggcctattgctcggtgtctgacttccccccaggcatacgaaaaccaggagcagctcaaggacgatgactccgatctgatcctgaatgatggggatattagcttaacttatggagattctacagtcaacactgagccagctacttcttcagcccctcgtagatttatgggcaattctagtgaagacgcgctggacagagagctggccttcggggaccacgagttggtcattcgcggaacaaggcttgtattacctatggatgattccgaaccccctcttaatctgttggataatacaagacacgggccagcctag

SEQ ID NO: 241869 - DNA, 2178 bp, Artificial Sequence
  Description of Artificial Sequence: Synthetic coding sequence
atggaacccggagatgctgccagaccaggttctggcagagcaaccggcgctccaccgcctcggctgctcctcctgcccctgttgctcggctggggcctgagggttgcagcagcagcatctgcgtctagtagcggcgcagccgctgaggactcctctgccatggaggaattggctaccgaaaaagaggctgaggagtctcaccggcaggacagcgtgagtttactcacgtttatcctcctgctgaccctgacaatcctgactatctggttgtttaagcaccgcagagttaggtttctgcatgaaacagggttggcgatgatctatggcctgatcgtgggcgtcatccttcgatacggaactcccgcaacaagcgggcgagataagtccctttcttgtacccaggaggacagagcattttccaccttgctggtgaacgtgtctggcaagtttttcgagtacacgttgaagggagaaatttcacccggtaagattaacagtgttgaacaaaatgatatgcttagaaaggtcaccttcgaccccgaggtcttttttaacatcctattaccgcctatcattttccacgccggttactcactcaagaagcgacacttctttaggaatctgggatccattctggcctacgcgtttctgggtaccgcagtgtcttgttttattatcggaaacctcatgtacggagtggtgaaattgatgaagattatgggacagctttctgataaattctactacacagattgtctcttctttggggcaatcatctccgcgaccgatcctgtgaccgtgttagctatctttaatgaactccatgcagatgtggacctgtatgcccttctgtttggcgaaagcgtgctcaacgacgcagtcgcgattgtgcttagctctagtatcgtggcctaccagcctgccggactgaacactcacgcctttgacgctgcagccttctttaaatccgtgggcatatttctgggcattttctccggatcttttacaatgggcgctgtgactggcgtgaatgctaacgtgaccaagtttacaaagctccattgcttcccgctgttggagaccgccctgttctttcttatgtcatggagtactttcctcttggccgaggcttgtggattcacgggagttgtcgctgtcctgttttgtggaattacccaggctcattacacatacaataacctgtctgtggagtcccgcagtcggaccaaacagctgttcgaggtgctgcacttcctcgcagagaatttcatttttagctatatgggactggccctttttacatttcaaaagcacgtcttttccccaatcttcattattggcgcttttgtggccatatttctcggcagagctgcacacatctatccgttgagcttcttcttaaacctgggaagacgccacaagataggctggaattttcaacatatgatgatgtttagtgggcttcggggtgctatggcattcgctctcgccattcgcgatacagcctcatacgcaagacaaatgatgtttacaacaactctgctgattgtgtttttcactgtttggattatagggggagggacaactccaatgctgtcctggttgaatatacgggtcggggtagaagagccaagcgaggaggaccagaatgagcatcactggcaatattttcgcgttggcgtggaccctgaccaggacccacccccaaacaatgattcattccaggtgctccagggtgacgggcctgacagcgcccgaggcaataggaccaaacaagaaagtgcatggatttttcgcctgtggtatagcttcgaccataactatctgaagccaatcctgactcattccggaccgccactgacaactactctccctgcctggtgtggactgttagctagatgcctcacctcccctcaggtgtatgacaaccaggaacctttgcgggaagaggactcggatttcatcctgactgaaggagacttgaccctgacatacggcgacagcactgtgacagctaacgggtcaagctcctctcacactgcctccacttcactcgagggttctcgcagaaccaaaagctctagtgaagaggtgttggagcgcgacctaggaatgggcgatcagaaagtgtcttcacgcggaacacggctggtgttcccgctggaagacaatgcttag

SEQ ID NO: 241870 - DNA, 1746 bp, Artificial Sequence
  Description of Artificial Sequence: Synthetic coding sequence
atgggggagaagatggccgaagaggagaggtttcccaatacaacacacgagggcttcaacgtgacactacacactacacttgttgttacaacaaagcttgtactgccaactccgggtaagcccatcctgcccgtgcagaccggggaacaggctcagcaggaagaacagtcaagcgggatgaccatctttttttcccttctggttctggcgatctgcattatcctggtgcacctgctaatcaggtatagactgcacttcctgcctgaatcggtcgccgtcgtcagtctgggaatcctgatgggcgctgttatcaaaataatcgaattcaagaaactggctaattggaaagaggaagagatgtttcggcctaacatgtttttcctcctattgctgccacccataatcttcgagagtgggtactctctgcacaagggtaacttcttccaaaacattggcagcatcacactgtttgccgtgttcggaaccgctatcagcgcattcgtagttggcggtggcatatacttcctgggacaggctgacgtcataagcaaactgaacatgactgacagctttgcattcggcagtctgatctctgcggtcgatcctgtggctactatagctatcttcaacgcgttacacgtcgaccccgtacttaacatgctggtctttggagaatctatactgaacgacgcagtgtccattgtgctgacaaataccgccgagggcctgactaggaagaacatgtctgatgtgtcaggatggcagacattcctgcaggcacttgattattttctgaaaatgttttttggctccgccgctctgggaactctgaccggactaatcagtgccctcgtgcttaaacatatcgacctgagaaagacaccctccctcgaatttggtatgatgattatttttgcatacctgccgtacggtctcgctgaaggcatctcactgtcaggaattatggccattcttttctcaggaattgtgatgtcacattacacgcaccacaatctcagtccagttacacagatcttaatgcagcagaccttgcgcacagtggcattcttgtgcgagacatgtgtgttcgctttcctcggcctgagcattttctcctttccccataagtttgaaatatcgttcgtgatctggtgcattgtactggtgttgtttggaagggccgtgaatatctttcccttgtcatatcttctcaatttctttcgggaccataagattacccctaaaatgatgttcattatgtggttcagcggcctacgtggagcaattccttatgccctcagccttcacctggatctggaacctatggagaagcgccaattgataggtaccactacaatcgttatcgtcctgtttacaattctgctgctggggggatctacgatgccacttattcgtctaatggacatcgaggatgcgaaagcacaccgaaggaacaagaaggacgtgaacctatcgaagacagaaaagatgggcaacacagtggagtctgagcacctctccgagctaacagaggaagagtatgaagctcactacatcaggcgtcaagacctgaaaggatttgtgtggctggatgcaaagtatctaaaccccttcttcactcgcagattgacccaggaagatctgcaccacgggagaatacagatgaaaaccctgacaaataagtggtacgaagaggttcggcagggcccaagtggatcagaagacgacgagcaggaactgctatag

SEQ ID NO: 241871 - DNA, 1794 bp, Artificial Sequence
  Description of Artificial Sequence: Synthetic coding sequence
atgggagagaagatggcggaggaagagcggttccctaataccacgcatgaaggatttaatgtcacattacacaccacgctggtggtgacaactaagttggtgctgccaacacccggtaagcccattcttccagtgcagacgggagagcaggcccaacaagaagagcagagctctggtatgacaattttcttctcactgttagtgctcgctatttgcatcatactggtacacctgcttatccgttataggttacatttcctgccagaatcagtggctgtggtcagcctcggtattttgatgggtgcagtaatcaaaattatagaattcaagaaattggcaaactggaaggaagaagagatgtttagaccaaatatgttttttttactgctgcttccaccaattatcttcgaatctggctactctctacacaaaggtaacttttttcagaacattggcagcataactctgttcgcagtattcggaaccgccataagtgctttcgtcgttggagggggtatttatttcctcgggcagggcttcttcttcgtgtgtgtgtgtgtcttcgtatgtttcattcttcaggccgacgtaattagcaagctcaatatgaccgattcctttgccttcggtagtttgataagcgcggtggatcctgtcgccacaatcgccatattcaacgcacttcatgtggatcccgtgttaaacatgctggtctttggagagagcattctcaatgacgcagtatccatcgtgttgacaaatactgctgagggactcacccggaagaatatgagcgatgtgagtggatggcagaccttccttcaggcgctggattatttccttaaaatgttcttcggatcagctgctctcggcacactgactggcctaatctccgctctggtcctgaaacacattgacctccgtaaaacacccagcctagagtttgggatgatgatcatcttcgcttacctgccttacggcctagctgagggcatttcattgtccgggattatggcaattttgttctctggcatagtgatgagccactacactcaccataatcttagccccgttactcagatcttgatgcagcagacactgaggacagtggcattcctgtgtgagacatgcgtgtttgccttcctggggctatctatattctctttcccccataaatttgagatttcttttgtgatctggtgcatcgtcctggtactttttggccgtgctgtgaacatatttccattgtcctacctgctaaacttttttcgggatcacaaaatcacacccaagatgatgtttatcatgtggttctcaggcttgcgcggagctattccttacgccctaagtctgcatcttgacctagagcccatggaaaaaaggcagttaatcgggacaaccacaatagtgatcgtcctgttcacgatcctgctgcttggaggtagcactatgccactgatacgcctaatggatatagaggacgccaaagcgcataggcgtaacaaaaaagatgttaatttatctaaaaccgagaagatgggcaatacagtggagtcagagcacctctcagaattaaccgaagaagagtatgaagcccactatatccgacggcaggaccttaaggggtttgtgtggcttgatgccaaatatctgaaccccttcttcacccgcaggctgacccaggaagacctgcaccacggacggatccagatgaagacactcaccaataagtggtacgaagaagttagacaggggccatccgggtcagaagacgacgagcaggaattactgtag

SEQ ID NO: 241872 - DNA, 1089 bp, Artificial Sequence
  Description of Artificial Sequence: Synthetic coding sequence
atgctggtgtttggtgaaagcatcctcaatgacgcagtttctatcgtcctgacaaacaccgccgaaggtctgacacgcaaaaatatgtcagacgttagcggctggcagacctttctgcaggccttagattacttccttaaaatgtttttcggcagcgctgctttggggacactgacgggtctgatttccgcgctggtccttaaacacatagatttgcggaagacgccgagcctggagtttggaatgatgatcatcttcgcctaccttccatacggactggctgaggggatttcactttctggtataatggctatcctgtttagcggcatcgtcatgtcccattacactcatcacaatctgagtcccgtcacccaaattcttatgcagcagacactgagaacagtggccttcctgtgtgaaacctgcgtctttgctttcctcggactcagcatcttttcgttcccccataaattcgaaatttctttcgtgatttggtgcattgtgttggtcctcttcggcagggccgttaatatcttccctctgagctatctgttgaacttcttcagggaccataagatcacccccaaaatgatgttcatcatgtggttttctggcttgagaggcgctataccgtatgccttatccctgcatctcgacctggagccaatggagaagagacagctcatcggaactaccactatcgttattgttctcttcaccatcctccttctgggaggatccaccatgccactgataagactgatggatatcgaggatgcaaaggctcaccggcgtaataaaaaagacgtgaacttatctaagacagaaaagatgggcaacacagtcgagagtgagcacctatctgaattgaccgaggaggaatatgaggcccactatattaggcggcaggaccttaagggattcgtctggctggatgctaaatacctgaatccctttttcacaagacggctgacccaggaggacctgcaccacggaaggatacagatgaaaaccctgactaacaaatggtacgaggaagtgcgacagggcccatccggatcagaggacgacgaacaggaactgttgtag

SEQ ID NO: 241873 - DNA, 846 bp, Artificial Sequence
  Description of Artificial Sequence: Synthetic coding sequence
atgatgatcatattcgcttatctaccctacgggctcgctgaaggaatttctctgagcgggataatggccatcctgttctccggaatagtcatgagccactacacacatcataacctttctcctgtcacccagatccttatgcagcaaaccctaagaactgtggcatttttatgcgaaacctgcgttttcgcttttctggggctttcaatattttctttccctcacaaatttgaaatctcatttgtcatctggtgtatcgtcctggtactattcggacgagctgtaaacatttttccactgtcatacttactcaatttctttcgggaccataagattacaccaaaaatgatgttcatcatgtggtttagcgggctgcgcggagccattccgtatgcattatcactccatctggatctggagccaatggagaagcgacagctgattgggaccaccaccatcgtcatagtcctgtttacaatcctcctgctaggcggaagcaccatgccccttatccgactgatggatatagaagacgcgaaagctcacaggagaaataagaaagatgtaaatctgtccaagactgaaaaaatgggcaatactgtcgaaagtgaacacctaagcgagctgacggaagaggaatacgaggctcactacatcagaaggcaggatctgaagggatttgtatggctggacgcaaagtatctgaatcctttcttcacccggaggctcacccaggaggacctacaccatgggcgaattcagatgaagaccctcaccaataaatggtatgaagaggtgaggcagggcccaagtgggtccgaagacgatgagcaggaactcctgtag

SEQ ID NO: 241874 - DNA, 1938 bp, Artificial Sequence
  Description of Artificial Sequence: Synthetic coding sequence
atggaaaggcaatctcgagtgatgagtgaaaaggatgagtaccagttccagcatcagggtgctgtcgaactgctggtctttaattttctgctcatccttacgatcctgactatttggctgttcaaaaaccaccggtttcgatttttgcacgagactggcggagccatggtgtacggcttgatcatgggtctcatcctacgatatgctacagcgcctactgacatcgagagcggcacggtctacgattgtgttaagctgaccttttcaccaagtacactgcttgttaacatcaccgaccaggtttatgagtacaaatataaaagggaaattagccagcacaacattaacccccaccagggtaatgctatcttagaaaagatgactttcgaccctgagattttctttaacgtattactgcctccgattatcttccacgcaggatatagcctaaagaagcgtcacttttttcagaatttggggtccatactaacctatgcctttctagggactgccatcagttgcatagtgatcggtctgatcatgtacgggttcgttaaggcaatgatccacgccggacagttgaaaaatggtgactttcattttaccgattgtctgtttttcggctccttaatgagcgccacagatcccgtaactgttctcgccatttttcatgagcttcacgtcgacccagacctctacacgctactgtttggagaaagtgtcttgaacgatgccgttgctattgtgctgacttactctattagcatttacagccctaaggaaaacccgaatgccttcgatgctgctgccttttttcagtcagtgggaaatttcctgggaatatttgctggatctttcgccatgggtagtgcctacgcgattatcacagccctgctgacgaaattcaccaaactctgcgagtttcctatgttagaaactggtttattctttctgctaagctggtcagcgttcctgtccgccgaggcagccggactgactggaattgttgccgtgctgttttgtggagtcactcaagcccattacacctacaacaacctctcttctgatagcaagattcggaccaaacagttgtttgaattcatgaattttctggccgaaaatgttattttttgctatatggggctcgccctgttcactttccaaaatcacatattcaacgccctgtttatccttggcgcattcctagccatcttcgtggcgcgtgcttgcaacatctacccgcttagctttttgttaaacctgggacgcaagcaaaaaatcccatggaactttcagcatatgatgatgttcagtggacttaggggggctatcgcgtttgcccttgctattagaaatactgagagtcagcccaagcagatgatgttcaccacgactttgctgctcgtgtttttcactgtttgggtctttggcggtgggacaactccaatgctgacttggctgcaaataagggttggagtggatcttgatgagaatctgaaggaggatcctagcagccagcaccaggaggcgaacaacctggacaagaatatgacgaaagctgagtctgccagactcttcaggatgtggtacagcttcgaccataagtacctgaaacccatcctcacccactccggccctcctcttactacaacattgccggaatggtgtggccctatatctagattactcacctctccccaggcctatggagagcagctcaaagaagatgacgtggaatgcatcgtgaaccaggacgagctggctatcaattaccaggagcaggccagcagcccatgttcacccccagcgaggttggggctggatcagaaggcctcgcctcagactccaggaaaggaaaatatctacgagggcgacttgggactgggcggatacgaactgaagctagagcagacccttggacagtctcagctaaactag

SEQ ID NO: 241875 - DNA, 978 bp, Artificial Sequence
  Description of Artificial Sequence: Synthetic coding sequence
ctgcgcctgcagagttcctgggaacagatgacttttgacccagagattttttttaatgttttgctgcctcctataattttccatgccggttactccttaaagaaacgacacttctttcagaacctaggctccatccttacatacgcattcctggggaccgcaatttcgtgcatagtaatcggcctcatcatgtacgggtttgttaaggctatgatccatgcagggcagttgaagaatggggacttccatttcaccgattgccttttctttggttctctgatgtccgcgactgacccagtgacagtactggccatcttccacgaattacacgtcgacccagacctgtacactttgctgtttggcgagtccgttcttaatgacgctgttgctattgtactcacatatagtatttccatttattcacccaaggagaatcccaacgcctttgacgctgccgctttttttcagtcagtcgggaacttcctgggaatttttgcaggcagtttcgctatgggtagtgcctacgccatcattactgcattgttaaccaaattcacaaagctgtgcgagttccccatgctcgaaaccgggttattcttcctgctcagctggagtgctttcctgagtgcagaggccgcaggactgacaggcattgtggccgttctgttttgcggggttacccaggcccactatacctacaacaatctaagttccgacagcaaaatacggaccaagcaactcttcgaatttatgaattttctggccgagaatgttatcttttgctacatgggactggccctttttacgtttcagaatcacatattcaacgctctgttcatcctgggcgcattcgtttccatcttcttagcaagagcacatactgagctcaaaaaccttttattcttcttagcgtcattcctctgctactttagtcaccgctcaaaaggactcccaatggctggctgtgccctgccatag

SEQ ID NO: 241876 - DNA, 3534 bp, Artificial Sequence
  Description of Artificial Sequence: Synthetic coding sequence
atggccggaatcttcaaggaattttttttctcgactgaagatctgccagaggtcatactgaccctgtctctgatatcatcgatcggtgccttcctgaatcggcacctggaagacttccctatacccgtgcccgtcattctcttcttgctgggctgctcctttgaagtcctcagctttactagtagtcaggtccagcgctatgctaacgccatccagtggatgagccccgatctgttttttcggattttcacacccgtagtcttcttcactaccgcgttcgacatggacacttacatgctgcagaaacttttctggcagatcctgctgattagtattcccggatttctagtaaactacattctcgtactgtggcacctcgcaagtgttaaccaattgcttttaaagcccacccagtggctgctcttcagcgccatcctagttagttccgatccaatgctaactgctgccgcaattcgggatttggggctgtcccggagtttgatttcgttaatcaatggggagagtctgatgacatctgttatttcgctcatcactttcacttccattatggactttgatcagcggttgcagtctaagcgtaatcacacactagccgaagagatagtcggcggtatatgttcctacatcatcgcctcattcctgtttgggatcctttcttctaagttaattcaattctggatgtccactgtgttcggcgacgacgtcaaccacattagtttaattttctccatcctgtacctgattttttacatatgcgagctagtaggtatgtcaggcatattcaccctcgcgatagtgggcctcttgcttaatagcacaagcttcaaggcggctatcgaagagacactgctcctggaattctggaccttcttgagccgcatcgcatttcttatggtgttcaccttcttcggtctgctgatcccggctcacacctacctgtacattgaatttgtcgatatatactattccctcaatatttacctgaccttgatcgtgctgagatttttaaccttgctgctaatctctccagttctgtctagggtaggacatgagttttcttggagatggatattcatcatggtgtgcagtgaaatgaaaggaatgccgaatatcaatatggccctactattagcctatagcgatttgtacttcggttcggacaaggagaaaagccaaattctcttccacggtgtgctcgtgtgtctgatcaccctagtggtgaaccggttcatacttcccgtggccgtgaccatcctggggctgagggatgccacctcaactaagtacaagagtgtgtgctgcacttttcaacacttccaggaattgacaaagtcagccgcttcagcccttaagtttgacaaggacttagctaacgccgactggaatatgatcgaaaaagctataacactggagaatccctacatgcttaacgaggaggaaactactgagcaccagaaggtgaagtgtccccactgcaacaaggaaatcgatgagattttcaacactgaggctatggaactcgctaataggcggctgctgagcgcacagattgcttcttaccaaaggcaataccgaaatgaaattctatctcagtccgcggtgcaggtcctggtgggagctgccgagtcttttggcgagaagaaggggaagtgtatgtcgctggatacgataaaaaactattcggaatctcagaaaaccgtgaccttcgccaggaaactgctcctcaattgggtgtataacactcgcaaagagaaggagggaccttctaagtacttctttttcagaatatgccacactatagtgtttactgaagagtttgagcatgtgggctacctggtgattctcatgaatatctttcctttcattatcagttggattagccagctcaatgtgatctaccactccgaacttaaacacactaactactgtttcctcactctgtacatcctcgaagctctcctgaaaattgcagcaatgcgcaaagactttttctcacatgcctggaacatctttgaactagctataaccctgattggcattctgcatgttatcctgattgaaattgacacgatcaagtacattttcaatgaaaccgaggtcatcgtcttcatcaaagtcgtgcagttctttaggatcctacgtatattcaagctgatcgccccaaaactgcttcagatcatcgacaaacggatgagtcaccagaagactttctggtacggcattttgaagggttacgtccagggcgaagcagacatcatgacgattattgaccagattacgtcaagtaagcagattaaacagatgctgctgaagcaagtgatcagaaatatggaacatgccattaaggagctgggttatctggagtatgatcaccccgagattgccgttactgtgaaaacgaaagaagagatcaatgtgatgctgaacatggcaaccgaaatcctgaaggcctttgggctgaagggcattatctccaaaaccgaaggcgctggaataaataagctaattatggctaagaaaaaggaagttcttgactcacagtcgattattagacccctcacggttgaagaggtcctgtaccacatcccttggttggacaaaaataaagactacattaacttcatacaagaaaaggctaaggttgttacctttgactgcggtaacgatatctttgaagagggtgatgagccaaagggaatctacatcatcatctcgggcatggtcaaattggagaagtccaagccaggtctcggaatcgatcagatggttgagagtaaagaaaaggattttcctattatcgacaccgattacatgctgtcgggcgaaatcatcggggagataaattgcctgaccaacgagcctatgaaatacagcgcaacttgcaaaaccgttgtggaaacatgttttatccctaaaacgcatttatatgacgcatttgagcagtgttcgccccttattaagcaaaagatgtggctaaaactggggttggctattacagccagaaagatccgtgaacacctgtcctatgaagactggaactacaatatgcaactcaagctgtcaaacatttacgtagtggatatcccgatgagcaccaagaccgacatatatgacgagaacctcatatatgtgatcctgatccacggcgctgttgaggactgcctcctgcgaaagacttaccgggcacctttcctcattccaattacatgccaccagatccagtccattgaagactttaccaaggtagtaataattcagactccaatcaatatgaagaccttccggagaaatattcggaagtttgtacccaagcataagagctatctgacgccaggattgatcggctctgtgggcacattagaagaagggatccaagaagagaggaacgtgaaagaggatggcgctcattctgctgcgacagctcggagcccccaaccttgttccttgttaggaacaaaatttaattgtaaagagtcaccaaggatcaacctgagaaaggtgcgaaaagagtag

SEQ ID NO: 241877 - DNA, 3390 bp, Artificial Sequence
  Description of Artificial Sequence: Synthetic coding sequence
atggccggaatctttaaggagttcttcttttccaccgaagacctaccagaagtcatcctgacactttctctcatttccagcatcggtgccttccttaacaggcatcttgaagactttcccattccggtaccagtgattctttttctgcttgggtgcagttttgaggtgctttcattcactagttcacaggtacagcggtacgctaatgccatccaatggatgtccccagatctctttttccggatttttacccccgtggtattctttacaactgcattcgacatggatacatacatgcttcagaagctcttctggcagattctcctcattagcatacccggtttcctggtgaactacatccttgtactatggcaccttgcaagcgtcaatcagttgctgctgaaaccgacacagtggctgctgttttctgctattctcgtttcctcggatccgatgttaaccgccgcagcaattcgagatctggggctgagccggtcactgatctccctaatcaacggcgaatctttgatgacctccgttatttcactgatcacctttacgtctattatggatttcgatcagagactccaaagcaaaagaaatcacacccttgctgaggaaattgtagggggaatttgtagctacatcatcgccagctttctttttggaattttgtcctctaaactcatacaattttggatgagtacggtctttggagacgacgtgaaccatattagtctgatcttcagcattctgtatctgattttttacatctgtgagttggtgggaatgtcgggaatcttcaccctggcaattgttgggctgctcctaaacagcacatccttcaaggcagccatcgaagaaactctgttgctggagttcctcaccctgttgctgatttcacctgtgctctctcgcgtgggccatgagttctcctggcgatggatattcataatggtgtgctccgagatgaagggtatgccaaacatcaacatggccctcttgctggcgtacagtgatctttattttggatctgataaggagaagtcccagattttgtttcacggagtgctggtctgtctgatcaccttggtggtcaatcgatttattctgcccgtcgctgtcacgatcctggggctccgcgacgccacaagcacaaaatacaagagtgtgtgctgcaccttccagcattttcaggaactgacaaagagcgcggcaagcgcacttaaatttgacaaggatctggctaacgcggactggaatatgatcgaaaaagcaattaccctggagaatccatatatgctgaatgaagaagagacgaccgagcatcagaaagtgaaatgtccgcattgcaacaaagagatcgatgaaatctttaataccgaggccatggagctcgccaatagaagactcttatcggcacagatagcatcctatcaacgacagtatcggaacgagattttaagccagtctgcggtccaagtcctcgtcggggctgccgagagcttcggcgaaaagaagggtaaatgtatgtctctcgacacaataaagaactactccgaaagtcaaaaaacagtgaccttcgcacggaaactcctgctaaattgggtatacaacacgaggaaggagaaggagggcccttctaaatacttcttcttccgcatctgtcacacaatcgtgtttaccgaggaattcgaacatgttggatatctggtgattttgatgaatatctttccttttatcatctcttggattagccagttgaacgttatctaccatagcgagctgaaacataccaactattgctttctaacgctatatattttggaagccctcctaaaaattgctgctatgagaaaagatttcttcagccatgcttggaatatttttgaacttgccatcacactgatcggaatcttgcatgtaatcctgatcgagatagacaccatcaaatacatattcaacgagaccgaagttattgtttttatcaaagtggtccagttttttagaattcttaggatcttcaagttgatcgcaccaaaacttctccaaatcattgacaagcgtatgtcccaccaaaagacattttggtacggtatccttaaaggctatgttcaaggggaagccgatattatgactataatcgaccaaatcaccagcagcaagcagatcaagcagatgctcctgaaacaggtgattaggaatatggagcacgccataaaggaactcggctaccttgagtacgaccatcccgaaatcgctgtgactgtgaagactaaggaagagatcaacgttatgctcaacatggccaccgaaattttgaaggcattcggccttaagggtatcataagcaagaccgagggggcaggcataaataagcttatcatggcgaagaagaaggaggtattagattcacaaagcattatacgcccactcaccgtagaggaagtcctgtatcacatcccgtggctcgacaagaataaagattatatcaatttcatccaggaaaaggctaaagtagtgacctttgactgcggtaatgacatttttgaagagggagatgagcctaagggaatttacatcattatttcgggcatggtgaagctggagaagtctaaacctggcctcggcatagaccagatggtggaatctaaggaaaaggacttccccatcatagacacagactatatgctctccggagagattatcggggagatcaattgtctgaccaatgagcccatgaagtactcagcgacgtgtaagaccgtggtggaaacctgctttattcccaaaactcatctgtacgatgcgtttgaacagtgctctcctttaatcaagcagaagatgtggcttaaactgggattagctataactgccaggaagattcgagaacatctcagttacgaggactggaattataatatgcagctgaaactatccaacatctatgttgtagatatccccatgtccactaagaccgatatctacgacgaaaaccttatatatgtaatccttatccacggtgcagtagaggattgtttgcttcgcaagacatatcgagccccttttctgatccccatcacctgccatcagatccagtccatcgaggacttcaccaaggtagtgatcatccaaactccaatcaatatgaagacgttcagacggaacattcgcaaattcgttcccaagcacaagtcatacttgacccccggtctgataggctctgtcgggactctggaagaaggcattcaggaagaaaggaatgtaaaagaggacggagcacacagtgcggctactgctcggagcccccagccatgcagcctgttgggcacaaaatttaactgtaaagaatcaccacgaatcaatctgcgaaaggttcgcaaggagtag

SEQ ID NO: 241878 - DNA, 2079 bp, Artificial Sequence
  Description of Artificial Sequence: Synthetic coding sequence
atgcaggggaagaaacctggtgggtcgtcagggggaggaagaagcggtgagctgcagggggacgaggcacagcggaataagaagaagaagaaaaaagtgagctgtttctccaatataaagatttttcttgtctcagagtgtgctcttatgctggcacaagggacagtgggagcatacttggtctcagtcttaacaaccctggagagacgatttaacttacagtcagccgacgttggagtgattgctagctcctttgagattggaaacctggcactcatcctgttcgtctcttattttggggctcggggacatcgacccaggctgattggttgtggaggcatcgtcatggccctgggtgctctcctgagtgctctgccagagttcctgactcaccagtataaatatgaggctggggagatccgatggggcgcagaaggcagggacgtgtgtgcagcgaacggcagcggaggggacgagggcccagaccccgacttgatctgcaggaatagaactgctacaaacatgatgtatctcctgcttataggtgctcaggtgctgttaggcataggtgcaaccccagtccagcctttaggtgtctcttatatcgacgatcacgtgcgcaggaaggacagcagcctctacatcggaatactctttacgatgctggtgttcggccctgcttgcggatttattctgggaagcttttgtacaaagatctatgtggatgctgtcttcattgatactagtaacctcgacatcacccccgacgaccccaggtggatcggtgcttggtggggagggttcctcctctgcggggctctgctgttcttttccagcctcctcatgttcggctttcctcagagcctccctcctcactccgagccggctatggaatcagaacaggccatgctttctgagcgcgagtacgaaagacccaagccaagtaacggggtccttaggcaccccttagagccagacagctccgctagttgtttccagcagctaagagtcatcccgaaggtaactaagcacttactttccaatccagtcttcacgtgtatcattctggccgcatgtatggagattgccgtggtcgctggattcgctgcatttctcggaaagtacctcgaacagcaattcaacctgactactagctctgctaatcagctgctcggtatgaccgccataccatgtgcatgcctcgggatttttctaggaggcctgctagtcaaaaagctgagcttgagtgctcttggcgcaatcagaatggctatgttagtcaacctggtctccaccgcatgttacgtgtcctttttgtttcttggctgtgacaccgggccagtcgccggagtgacggtgccatacggcaactcaaccgccccaggctccgcattagatccgtacagcccctgtaataataactgtgagtgtcagacagactcgtttacccctgtttgtggtgcagatggtattacctacctttctgcatgttttgccggttgtaactctacaaatcttaccggatgtgcatgcctgacaactgtccctgctgaaaacgctaccgtggtgccaggcaaatgcccttccccaggctgtcaggaagcctttttgacttttctctgcgtcatgtgtatatgttccctgatcggagcaatggcccagaccccatctgttatcatcctgatacgaaccgtctctccggagctgaaatcctacgccctcggtgtcctgtttttgctgctccgactcctgggattcatccctcccccactgatcttcggtgccggaatcgattcgacttgcctcttctggagcaccttctgcggtgaacaaggtgcctgtgtgttatacgataacgtcgtatatagatacttgtatgtcagtattgcaattgcactgaagtcctttgctttcatcctttacacaactacctggcagtgcttaagaaagaattataagcggtatattaagaaccacgagggaggactcagtacctctacagaataccaggatatcgagacagagaagacatgtcctgaatcccactcccccagcgaggactccttcgtgaggagttag

SEQ ID NO: 241879 - DNA, 2076 bp, Artificial Sequence
  Description of Artificial Sequence: Synthetic coding sequence
atggaccaaaatcagcatttgaacaaaacagcggaggctcagcccagcgagaataaaaaaacgagatactgtaacggactcaaaatgtttctggctgcattatctcttagctttatcgcgaagaccttgggggcaatcattatgaaatcttccattattcacatagagcgcaggtttgagatcagctcatcccttgtgggattcatcgatgggagtttcgagattggaaatctgctagtgattgtgttcgtgagctattttggaagtaaattgcatcgccctaagttgatcgggattggttgtttcataatgggaatagggggagtcctgaccgccctcccacatttttttatgggatattaccggtactctaaggagaccaacatcaatagtagcgagaattctactagcaccctgagtacctgcctgattaaccagatcctgtccttgaaccgtgctagccccgagattgtcgggaagggatgcctgaaggagtctggtagctacatgtggatttacgtctttatggggaacatgttacgtgggataggggaaaccccgatcgtgcctctgggactaagctatatcgacgacttcgcgaaggaaggtcattcctctctctatctgggaattctcaatgctatcgccatgatcggcccaataattggattcacactgggatcactgttttccaaaatgtacgtagacatcgggtacgtggacctgtctactatccgtatcacccctaccgatagccggtgggtcggggcatggtggctgaacttcttagtctccgggctgttttcgattatttcatctattccctttttctttctccctcagacgcccaacaagccccagaaggagcgaaaggccagcttgagtctgcacgttttagagaccaatgatgagaaagatcagaccgctaatctgaccaaccagggcaaaaacattactaagaacgtgacaggctttttccagtcttttaaatctatcttaactaacccactgtacgtgatgtttgtgctgctgacactcctacaggtgtcatcttatatcggcgcttttacctatgtatttaaatacgtggagcagcaatacggtcagccaagttcaaaagcgaatatcctgctgggggtgattaccatccctatatttgcgtccgggatgtttctgggcggatacatcatcaagaaatttaagctgaacactgtcggtatcgccaagtttagctgcttcacagccgtgatgagcctttctttctacctcctgtactttttcatcttatgtgagaataaaagcgtggcaggcttaaccatgacctacgatggaaacaaccctgtgactagtcaccgcgatgtccctcttagttattgtaacagtgactgcaactgcgatgaaagtcagtgggagcctgtatgcggcaacaatggtatcacctatatcagtccttgtctcgctgggtgcaagagctccagtggcaataagaagcctatagttttttataattgctcctgtctcgaggtgaccggcctacagaatcgtaactattcagcacatctgggcgaatgccctagggatgatgcctgcactcggaaattctacttctttgtggccatacaggtcctcaacctgttttttagcgcattaggcggaacttcccacgttatgctgattgttaaaattgttcagcctgagttaaaatccctggccttagggtttcactccatggtaatcagagcactcggtggcatcctggctcccatctatttcggcgcacttattgacacaacttgcattaagtggtctaccaacaactgcggcacccgaggatcatgtcgaacttacaattccacttccttctcgcgcgtctacctgggtctctcatccatgctcagggtatcatctctggttctatatattatcctcatatatgccatgaagaagaaataccaagaaaaggacattaacgcctccgagaatggatcggtgatggatgaggcaaacttggagtccctgaataaaaacaaacattttgtcccatcagcgggagcggacagcgaaacacactgctag

SEQ ID NO: 241880 - DNA, 2109 bp, Artificial Sequence
  Description of Artificial Sequence: Synthetic coding sequence
atggatcagcatcagcaccttaataaaaccgccgaatccgccagctctgaaaaaaaaaaaacacggagatgtaacgggttcaagatgttcctggccgcactgtcttttagttatattgctaaagcgctggggggaatcatcatgaagatcagcatcacacagattgagaggagattcgacatctcgtcaagcctggctggcttaattgatggctctttcgaaatcgggaatctgcttgtgatcgtgtttgtgagttattttggcagcaagctccatcgtcctaagctgataggaataggatgtctgctcatgggaacgggctccattttaacatcattgccccacttcttcatggggtattataggtactccaaggaaacccatattaacccttccgaaaattctacaagctctctaagcacttgccttatcaaccagacgctcagtttcaacgggacctccccagaaatcgtcgagaaagattgcgttaaggaatctggttctcatatgtggatctacgtgttcatgggaaacatgctgcgcggtatcggagaaacccctattgtacctttggggatatcttacattgacgactttgccaaggagggacatagttctctttacttgggatccctgaatgctattgggatgatcgggcctgttataggatttgcgctggggtcactattcgccaaaatgtacgtggatatcgggtatgtggacctgagcacgatcaggattacgcctaaagactctcgatgggtcggcgcttggtggctgggattcctggtatccggcctgttctcaataattagttctataccctttttctttctcccaaagaatcccaataaaccccagaaggaaagaaagatttccctgtctctgcatgtgctgaagacgaacgatgaccggaatcagacggctaatctaaccaatcaggggaagaacgtgactaagaatgtaactggatttttccagtccctgaagtccatcctaacaaatccactgtatgtcattttcctgctgctgactctgctgcaggtgagctcctttatcggttcctttacttacgtgtttaaatatatggagcagcagtatggccagtctgcgtcacatgctaacttcttgcttgggatcatcactattcctacagttgccaccggaatgttcctgggaggttttattattaagaagttcaagcttagccttgtcggaattgcaaagttctcatttctcacgtcgatgatttccttcctctttcagttgctatattttcccctcatctgcgagagcaagagcgtggcagggctcaccctgacttatgatggcaataattctgtggcgtcccatgtggacgtgccgctcagttattgtaattccgaatgcaattgtgacgagtcacagtgggagccggtctgtggaaataacgggatcacatatctgagtccttgcctggccggatgcaagagctcatctggaatcaagaaacatactgtcttttacaactgttcctgcgtggaggtaactggactgcagaaccgtaactattctgctcacctcggggaatgtccgagggacaatacctgtacacggaagttttttatttatgtcgcgattcaggtgatcaacagtctgttcagcgccaccgggggaactaccttcatcctgttgaccgtaaaaattgtgcaacctgaattaaaagctctggcgatggggttccagagcatggtgatacgcactctcggtggaatattggctcctatctacttcggggctctgatcgataagacctgcatgaaatggagcacaaactcatgtggcgctcagggcgcatgtcggatctataacagcgtgttctttgggagggtctatctcggcctgtccatcgcactcaggtttcccgctttagtactctatattgtttttatcttcgccatgaagaagaagttccaaggcaaggacaccaaggcatccgacaacgagagaaaggttatggatgaagcaaacttagagttcctcaataatggagagcattttgtaccaagcgccggaacagactcaaaaacatgcaatttggacatgcaagataacgctgccgctaactag

SEQ ID NO: 241881 - DNA, 2109 bp, Artificial Sequence
  Description of Artificial Sequence: Synthetic coding sequence
atggaccagcaccagcacctgaataaaaccgcagaaagcgcctccagcgagaagaaaaaaacaagacgttgtaacggatttaagatgtttcttgccgctctgagcttctcctacattgcgaaggctctggggggaattattatgaaaatctctatcacccaaattgagagacggttcgacatttcgtccagcctggccggtctcatagatgggtcatttgagattggaaacctcttggtgatcgtattcgtgtcctatttcgggagtaagcttcaccgcccaaaactgattggcattggttgtctcctcatgggcactggcagcattcttacaagcctgccccacttttttatgggatactaccggtattcgaaagagacacatattaatccctcagagaattccacttctagcctttccacatgtctgattaatcagacactttctttcaacggcacctcacccgagatcgttgaaaaagactgtgtgaaggagagcgggtctcacatgtggatctatgtattcatgggaaacatgctccgaggtatcggcgagacacctatcgtgccactcggaattagttacatagacgacttcgcaaaggagggacattcaagtctttacctgggcagtcttaacgccattggcatgatcggacctgtcattggatttgccttgggcagtctgttcgcaaaaatgtacgtcgacatcgggtatgtcgatctaagcacgatccggatcacacccaaagattctaggtgggtgggggcatggtggctgggtttcctggtgagcggccttttctcaatcattagctcaatcccgttcttcttccttccaaagaacccaaacaaacctcagaaagagaggaagatctcgctgtctcttcatgtactgaagaccaatgatgatagaaaccagactgctaacttgaccaatcagggcaaaaacgtaactaaaaatgtgaccggcttttttcaaagcctcaaaagcattctgacaaatcctctgtatgtgatttttctccttctcacactgctgcaagtgtcctctttcatcggctcctttacctatgtgtttaagtacatggaacagcagtacggacagtccgcctctcatgctaacttcctgctcggcatcataaccatccctaccgtagctaccggcatgtttctgggaggattcataatcaaaaaatttaagttatccttggtgggtatcgctaaatttagcttccttacctccatgattagtttcctctttcagctcctctattttcccctgatttgtgaatcaaagtctgtcgctgggctgactttaacctatgacggcaacaacagtgttgctagtcacgttgacgtccctctgagctactgcaatagcgagtgtaactgcgatgagtcacagtgggaacctgtttgcggaaacaacggcatcacctacttgagcccctgtttagcagggtgcaaatccagctcagggattaagaagcatacagtattctacaactgttcttgtgtggaggttaccggcttacagaacagaaattatagcgcccacctaggagaatgtcccagagacaacacctgtacccggaaatttttcatctatgtagccatccaagtaattaactcgcttttttccgccacaggaggaactaccttcattctcctgacggttaagatagtacagccagagctgaaggcactcgcaatgggtttccaatcaatggtcataagaacactcgggggaatcttggcaccgatctactttggagctctcatagataaaacctgcatgaagtggagcacaaatagttgcggggctcagggagcttgccggatatacaatagcgtgtttttcggacgagtgtacctgggactgtcaattgccttgcgctttcctgccctcgtgttgtatattgtgtttatctttgctatgaagaaaaagtttcagggaaaggacaccaaggctagtgataatgagaggaaggtgatggacgaggcaaatctcgagttcttgaacaatggagaacacttcgtaccatctgctgggaccgactctaagacatgtaatctagatatgcaggataacgcagcagcaaactag

SEQ ID NO: 241882 - DNA, 2247 bp, Artificial Sequence
  Description of Artificial Sequence: Synthetic coding sequence
atggaccagcaccaacacttgaacaagactgcagaatcagcaagtagtgaaaagaagaagacccggaggtgtaacgggtttaagatgttcttggcagccctgtctttttcatatattgcaaaggccttggggggaattattatgaagatatccattactcagattgagcggaggtttgacatctcctctagcttagcagggctgattgatggctccttcgagatcggtaatttgctggtgatagttttcgtgtcctactttggaagtaagcttcaccgccctaaactgatcggcatcgggtgccttctgatgggcaccggctcgatacttaccagtctgccacatttctttatgggatattatagatactcgaaggagacccacattaatcccagtgaaaactccactagtagcctcagcacctgcctgattaaccagacattgagtttcaatggcacaagtcctgagatcgttgagaaggactgtgtgaaagaaagtggcagtcacatgtggatctatgtgtttatgggcaatatgttgcggggtatcggagagactccaatcgtaccccttgggattagctatatcgatgattttgcaaaagagggccattcttcgctctacctcggctcactcaatgctatcggaatgatagggccagtgatcggcttcgcacttgggtctctgtttgccaaaatgtatgtcgatattggttacgttgacctgagtaccattaggattacacccaaagatagtcgctgggttggcgcttggtggcttggtttcttagtgtccgggcttttctctattatcagctcaatccccttcttctttctgcccaaaaatccaaacaagccacagaaggagcggaagatctcattatctctacacgttttgaagaccaacgatgatcgcaaccaaaccgccaatctgacaaatcaagggaagaatgttaccaaaaacgtaaccggcttctttcaaagcctgaagtccatcctgacaaatccactgtacgttatttttttactgcttacgctgctgcaggtatcaagcttcatcggttcttttacctatgtctttaagtacatggagcagcaatatggacagagtgccagtcatgcgaattttttactcggcatcatcacaattcccacggtggccaccggaatgttccttggcggattcattattaagaaattcaagctcagcctggtgggaatcgctaaattctccttcctgaccagcatgatatcattcctttttcagctcctgtattttcctctgatttgtgagtccaagtctgtcgccggactgaccctcacatacgacgggaataatagcgtcgcttcacacgtagatgttcccttatcatattgtaatagcgagtgcaactgcgacgagtctcaatgggagcctgtgtgcggaaataatgggataacatatttgagtccttgtctggctggctgtaaaagctcctcaggtattaaaaagcacacagtcttttataactgctcatgcgtggaagtcacaggattacagaatcgcaactactccgctcaccttggagaatgtcctcgggacaacacatgcacgcgcaaatttttcatttatgtcgccatccaggtgatcaactcactgttttccgcaaccggcggtacaacttttattctcttgactgtcaaaattgtccagccagagttgaaggccttggcaatggggtttcagagtatggtgattcggaccctgggtggaatcctggcccctatatatttcggcgctctgattgacaaaacctgcatgaagtggagcactaatagctgtggtgcacagggggcttgtagaatctacaatagcgtgttttttggaattgtgcagcctgagttaaaggccctggccatcggcttccacagcatgatcatgcgctcactgggtgggatccttgtcccgatctattttggtgccttgatcgatacaacatgcatgaagtggagcacaaacagttgtggcgcacgcggagcttgccggatatataatagtacctatctcggcagagccttttttggactgaaggtggctttaatttttccggttctggttctgcttactgtgtttattttcgtagttcggaagaagtctcacgggaaggacaccaaagttttggagaatgaaagacaggtgatggacgaggccaatctcgagttcctgaacgacagcgagcacttcgtgccctccgccgaggaacagtag

SEQ ID NO: 241883 - DNA, 2139 bp, Artificial Sequence
  Description of Artificial Sequence: Synthetic coding sequence
atggacacaagcagcaaggagaacattcaattgttctgtaagacttctgtgcaacctgtgggccgtcccagctttaaaacggaataccccagcagtgaggaaaagcagccgtgctgtggcgagcttaaagtgttcctttgcgccctgtctttcgtgtactttgctaaggccctcgcagaggggtacctgaaatctacgatcacccagattgaacggaggttcgacatcccgtcttccttagtgggggtgattgacggctctttcgagatcggtaacctcttggtcataacattcgtttcttattttggagccaaactgcatcggccaaagatcataggcgcaggctgtgtcattatgggagtgggaaccctgttgatcgccatgccacagtttttcatggaacagtataagtatgaacgctactccccatcctcaaactctacgctgagcattagcccctgcttgcttgaatctagctcacaacttccagtatccgtgatggagaaatccaagtcaaaaatttctaatgagtgtgaggtcgacacatcatccagcatgtggatctacgttttcctcggaaatttactccggggtatcggcgagacccctatccagcccctcggaattgcttatctggacgattttgcgagtgaggataatgctgctttttatatcggatgtgtgcagactgtggctatcataggcccaatctttggcttcttgctaggctccctgtgtgccaagctctatgtggatatcggttttgtaaaccttgaccacattaccattacccccaaggacccgcaatgggtgggcgcatggtggcttggctacctcatcgctggtattattagcctcttagcagccgtccctttttggtacctccccaaatctctgccaagaagtcagtcaagggaagactcaaactcctcctctgaaaagtctaagttcattatagatgaccatactgattatcagacaccccaaggggagaacgccaaaataatggagatggctagggatttcctgcctagtttaaaaaacctgttcggtaacccagtgtatttcctctacctctgcacgagtacggttcagtttaacagcttgttcggaatggtaacctacaagcctaaatacatagagcagcagtatggccaatcatctagtcgggctaacttcgtgatcggtctgattaacatacccgctgtggctttaggcattttctctgggggtatcgttatgaagaaatttaggattagcgtgtgcggcgctgccaagctctacctcggttcctcggtgttcggttaccttttatttttaagtcttttcgccctgggttgtgaaaattccgacgtggccggactcactgtttcatatcaaggcaccaagccagtgtcctaccacgagcgagctctgttcagcgattgtaacagccgctgtaaatgctccgagaccaagtgggaaccaatgtgtggagaaaatggcatcacatacgtatctgcctgcctcgccggatgtcaaacttctaaccgctcagggaagaatattattttctataattgtacttgtgtgggcatcgcagcgtccaagtccgggaactcttctggaattgtgggccgttgccagaaggataacggctgcccacaaatgttcctgtacttcttagtgatcagtgtaattacatcttatacgctctcactcggaggtattcccggatacattttattactgaggtgtataaaaccgcagctgaagtcatttgctctcggaatctatactctcgcaattcgggtcctggccggaattccggctcccgtatacttcggagttttaatcgacacttcttgcctaaaatggggcttcaaaaggtgtggatcccggggttcatgcaggctttatgactccaacgtcttcagacacatttaccttggactgaccgttatccttgggactgtttccatcctgttgtctatagccgtgttgtttatccttaagaaaaactacgtctctaaacacagaagctttataactaaaagagagagaacaatggtgagcactcgattccaaaaagaaaattacaccacttccgaccatttgttgcagcctaactattggccaggcaaggagacccagctgtag

SEQ ID NO: 241884 - DNA, 2193 bp, Artificial Sequence
  Description of Artificial Sequence: Synthetic coding sequence
atggacacttcatcaaaagaaaacattcagctgttttgtaagacctccgtccagcctgtgggacggcctagcttcaagaccgaatacccttcatctgaggagaaacagccttgctgtggggaattgaaggtgttcctgtgtgcactctcattcgtctacttcgccaaggccctggccgaggggtaccttaagagtaccataactcagatcgagagacgcttcgacattccgagttccttggtgggcgtcattgatggttcatttgagataggaaatctactagttattaccttcgtatcctacttcggagctaagctccacaggccgaaaatcattggagccggatgcgtgattatgggggtgggaacactgttgattgccatgccccagtttttcatggagcagtacaagtatgagcgatacagccctagtagcaactccaccctttcaatctcaccatgcctgctggagagttctagtcaactgccagtttctgtgatggaaaagtcgaagtccaagataagtaacgagtgcgaggttgacacttctagtagtatgtggatttatgtcttccttggaaatctcctccggggaataggggaaacccccattcaacccctagggatagcgtacctcgatgacttcgcatccgaggataacgccgcattctatatcggctgtgtgcagaccgtggccattattggcccaatattcggctttctgctaggctcactctgtgccaaactgtacgtcgatatcggctttgtcaaccttgaccacatcaccattacgccaaaagatccccaatgggtgggggcttggtggctaggttacctcattgctggcatcatctctctcttggccgcagtgcccttttggtacctacccaagtctctgcctcggtcccagtcccgggaggactcaaacagcagcagcgaaaaaagcaagtttataattgatgaccacactgattatcagactcctcagggagaaaacgcaaagatcatggaaatggcaagagacttcctgcctagtttaaagaaccttttcggaaatcctgtctactttctgtacctgtgtaccagcacagttcagttcaattccctcttcggcatggtgacttataagcccaaatacatcgaacagcaatacggacagtcctcttcacgggcaaactttgttatcggtttgataaacattcctgccgtggccttaggtatcttttccggcggaattgtcatgaaaaagtttagaatatccgtctgtggagctgctaagctctacttagggtctagcgttttcggctatttgttgttcctgagtttgttcgcgttagggtgcgagaacagcgacgtggcaggcctcactgtgtcctaccagggaactaaaccagtctcgtatcacgagagggccttatttagcgactgtaactctagatgtaaatgttccgagacaaaatgggagccaatgtgcggagagaacggtatcacctacgtatctgcttgtctggccggatgtcagacctccaacaggagtgggaaaaacataatcttctacaactgcacttgcgtaggaatcgccgcttcgaaatctgggaactcctcaggcatcgtcggccgttgccagaaagacaacgggtgcccgcagatgttcctgtactttctggtgattagcgtaattacatcatacacgctctctctaggagggatacccggatacatcctgttactgcgttgcattaagccccaattgaagtcattcgccctcggcatatacacactggctatccgcgttctggctggtatccctgcaccagtatattttggggtactgatcgatacctcctgtctgaaatgggggtttaagcgctgtggctctaggggctcttgccggctttatgattccaacgtttttaggtaccagattaagtctatccccgcttcccactgctattccatccctgatctgcataatgccaccgacacaaacaaatttagctgtcacttcaccgcctgcaagacctacatctctgggacgaattgtgacacagggcactcggtgaactcgcccaaacactgctcaacctttcacttcaaagagaaactgtgctttaagactcagaagttctacaaccaggaacgcaagaacaatggcgtctacaagattccgaaaggcaaattgcactataagtag

SEQ ID NO: 241885 - DNA, 1992 bp, Artificial Sequence
  Description of Artificial Sequence: Synthetic coding sequence
atggacaccagtagcaaggaaaacattcagttgttctgcaagacatctgtccagccagtgggcagaccgtcttttaagacagagtaccctagttccgaagaaaagcagccatgctgtggcgagcttaaggtttttttatgtgcactctcatttgtctacttcgctaaggctctggccgagggatatttaaagagtaccatcactcaaattgagcgcagatttgatattcccagttcactcgtaggtgtcattgatggaagcttcgagatcgggaacctgttggtaattacgtttgtgagctactttggggcaaagctacacaggcccaaaatcattggggcaggctgtgttattatgggtgtcgggactttactgatagcaatgcctcagttctttatggaacagtataagtatgagagatactctcccagttccaacagcaccctttctatatcgccctgcctactggaatcatcctcacagctgcccgtcagcgtaatggaaaagtcgaaaagtaaaatcagcaatggctgtgtccagacggtggccatcatcggcccaatatttgggttcctgcttggatccctttgtgctaaactgtacgtggacattggtttcgtgaatctcgaccatataactatcacccctaaggacccacaatgggtaggcgcttggtggctgggatacctgatagccggaatcatcagtctcctagccgctgtgcctttttggtacttgccaaaaagcctgccacgatctcagtcacgcgaggacagcaatagttcaagcgaaaaatccaagtttatcatcgatgaccacacggactatcaaaccccacagggagagaatgctaagattatggaaatggcccgtgacttcctgccatcactcaagaatctgttcggaaatccagtctatttcctgtatttgtgtacttccaccgtgcaattcaactctctattcgggatggtcacctacaaacctaaatacattgagcagcagtacggtcagagttctagcagggcgaacttcgttatagggctcatcaacataccagccgtggctctagggatcttcagcggaggcatcgtgatgaagaagttcagaatatcagtatgcggcgctgctaaactatacctggggtcttcagtcttcggctacctgctgtttctgtccctctttgccttaggatgcgaaaattctgacgtggctggattgacagtctcctatcaggggactaaacctgtttcatatcacgagagggctctctttagcgactgcaacagcaggtgtaagtgctcagaaacaaagtgggagccaatgtgcggagagaacggaattacgtatgtgtctgcttgcctagcgggatgtcagacctcgaacaggtcaggtaagaacatcattttctacaactgtacatgcgtgggcattgcggcttcaaagagcggtaactctagtggtatcgtgggccgatgccagaaagacaatggatgtccccagatgttcctgtattttctggtcatatcggtaatcacctcctatacactgagcctgggcggaattcctggctacatcctcctgctgagatgcataaaaccccaattgaaaagcttcgctctgggcatttacaccctggcaattcgggtcctagcgggtattcctgccccagtctactttggggttcttattgatacctcttgtctgaagtggggattcaaacgatgcgggtctcgcggaagctgtcgactatatgacagcaacgtctttagacacatctacctggggctgacggtcatcctgggcacagtgagcatcctgctctccatcgccgtgctgtttattctcaaaaaaaattacgtgagcaaacaccggtccttcattaccaagagggagaggaccatggtgagtacacggttccagaaagaaaactacactacatccgaccacttgctgcagcccaattactggccaggaaaagagacacaactctag

SEQ ID NO: 241886 - DNA, 1839 bp, Artificial Sequence
  Description of Artificial Sequence: Synthetic coding sequence
atgggggtgggcaccctgctgatcgctatgccgcagtttttcatggaacagtataaatacgagcgctactccccctcatccaattctactttaagcatcagcccctgtttgcttgaatcctcctctcaactgccagtatcagtcatggaaaagtctaaaagtaagatttcaaacgaatgtgaggtcgacacatcgtcttccatgtggatctatgttttcctcgggaacctcctaagaggcatcggggagacacccatccagcctctgggaatcgcgtatctcgatgatttcgcatctgaggataatgccgcattctatatcgggtgtgttcagacagttgcgatcattgggcctatcttcgggtttctgcttggttccctatgtgcaaagctgtatgtggacattgggtttgttaacctggatcacatcactataactcccaaggatccgcagtgggtgggggcatggtggttggggtatctcatcgcaggaatcatctccctccttgcagcggtcccgttttggtacctgcccaaatctctcccacggtctcagtccagggaggattcgaacagttccagtgagaagtctaagtttattattgacgaccacacagattaccagacccctcagggagagaacgccaaaatcatggagatggctcgggactttctgccctcgctgaagaacttgtttgggaatccggtgtatttcctctacctctgcacaagtactgtccagtttaattccctattcggtatggtcacgtataaaccaaaatacattgagcaacagtacggacagagctctagcagggccaacttcgtgatcggcctgatcaacatccctgccgttgccctcggtatattctctgggggaattgtgatgaagaagtttcgcatcagtgtctgcggcgcagctaaactgtatttgggctcctctgtcttcggatacttactcttccttagcctgttcgccttgggctgcgagaattctgatgttgcaggccttaccgtgtcttaccagggtaccaaacctgtgagctatcacgagcgagcactattctctgactgtaactctcggtgcaaatgcagcgagaccaagtgggagcctatgtgcggggagaatggcattacatacgtctctgcctgcctcgctggatgtcagacctcaaatcgcagcggaaaaaacatcatcttctacaattgtacatgtgtgggcatagcagcgagcaagtccggcaactctagcgggatcgtaggacgctgtcagaaagacaacggttgcccccagatgtttctgtacttcttggtgattagcgttattacgtcctatactctctctctgggcggtatcccagggtatatccttctcctgcgctgtataaagcctcaactgaagtcgtttgccctgggcatttacaccttagctatccgcgtgctggctggcatccctgccccagtttatttcggtgtacttatcgatacctcctgtttgaaatggggcttcaaacgttgcggatcgcgtgggagttgtcggttatacgatagtaatgtcttcagataccagatcaagtcaatcccagccagtcactgctacagcattcctgaccttcacaatgccactgatacaaataagttttcctgtcacttcactgcctgtaagacttacataagcggaacgaattgcgacaccgggcactcagtgaacagccccaaacattgcagcacgtttcattttaaggagaaactttgttttaagacacagaagttctataatcaggagcggaaaaataacggggtatacaagatcccgaagggcaagcttcactacaagtag

SEQ ID NO: 241887 - DNA, 2193 bp, Artificial Sequence
  Description of Artificial Sequence: Synthetic coding sequence
atggacacgtccagtaaggagaatattcaattattttgcaagactagcgttcagccagtgggcaggccatcgtttaagactgaatacccctcgtctgaggagaagcagccctgctgtggggagctcaaagtattcctgtgcgctttgtccttcgtctattttgctaaagccctggctgagggctatctgaagtccaccattactcagattgagagaagatttgacattcctagttcactggttggagtaatcgacggtagctttgagatcggaaacctactggtgatcacatttgtcagctattttggagccaagctgcacaggcccaagataatcggtgccggatgtgtcattatgggcgtaggtactctgctgatcgccatgccccagtttttcatggagcagtataagtacgaacgttattcgccttcatctaattccactctgagcataagcccttgtcttcttgaatctagcagccagttgccagtaagcgttatggagaaaagcaagtccaaaatatctaatgagtgcgaagtggataccagtagtagtatgtggatctacgtgttcctcgggaacctcttgcgtggcatcggcgaaactcctatccagcctctcgggatcgcctacctggacgactttgccagtgaggacaatgccgctttttacatcggctgcgtccagaccgttgccataatcggtcccatctttggattcttactggggagcttgtgtgccaagttatacgtcgatattggattcgtgaacctcgaccatattaccattacgccaaaggacccccagtgggtcggggcatggtggctgggttatctgatcgccggaatcatctctctcctcgcggcagtgcccttctggtacctcccaaagtcattaccgagaagccagtcacgggaagattcgaattcttcgtctgaaaagagcaagttcatcatcgatgatcacaccgattatcagacccctcagggcgaaaatgccaagatcatggagatggcccgagacttccttccctcactgaaaaacctcttcggaaacccagtttatttcctgtatctttgcacttccactgtccaatttaatagtctgtttggaatggtgacttataaacctaaatacattgagcaacaatacggacagtcgagtagcagagcgaattttgtaatcggccttattaatatccctgctgtcgctctgggaatcttttcgggaggaattgtgatgaagaaattccgtatctctgtttgtggagccgctaagctttacttgggatcttcagtctttggatatctcctcttcctctctctcttcgctctggggtgtgagaacagcgacgttgcaggattaacagtctcctatcaaggaacgaaaccagtctcctatcacgagagagctctcttttctgattgcaactcaaggtgcaaatgttcagagacaaaatgggaacctatgtgtggtgaaaacggaattacatacgtgtccgcatgccttgcaggttgtcagactagcaacaggtccggcaaaaacattatcttctataattgcacatgcgtcggcattgctgcgtctaagagtggcaatagctccggcatcgtgggcaggtgccagaaggacaacggatgtcctcagatgtttctctacttcctcgtgatttctgtgattacttcatatacgctgagtttgggcggaattcccggatacatccttctattgagatgcatcaagccccaactgaaaagtttcgctctgggtatttacaccctggctattcgggttcttgccggaatacctgccccagtttatttcggcgttcttattgacacttcttgcctgaaatgggggtttaagcgatgtggaagccgcggtagctgccgtctgtatgacagtaatgtctttcggtaccagataaagtccattccagctagtcactgttacagcattccggatctgcacaacgcaaccgacacgaataaatttagctgtcatttcactgcctgcaagacatatatttctggcacaaattgcgacactggccactctgtgaattcaccaaagcactgctcaaccttccatttcaaggaaaaattatgttttaaaacacagaagttttacaaccaggaaagaaaaaataacggcgtttacaagattcctaaagggaaactgcattataaatag

SEQ ID NO: 241888 - DNA, 1932 bp, Artificial Sequence
  Description of Artificial Sequence: Synthetic coding sequence
atgggtctcctgccaaagctgggcgctagccagggatctgacacatcaaccagcagggctggtagatgcgccagaagcgttttcggaaatataaaggtatttgtgttgtgccagggcttgctgcagctctgccagctgctgtatagtgcctacttcaaaagcagtctgacaaccattgagaagagattcggcctcagtagttcctccagcggcctgatatcctcgctgaatgagatttcaaacgccatcttgatcatctttgtctcctattttggatctcgagtacatcgaccacgcctaattggcatcggcggtctattcttggccgctggcgctttcatcctgacacttcctcattttctgtctgagccctatcagtacaccctcgcttccaccgggaataacagcagactgcaagccgagctatgccagaaacattggcaggatctgcctccaagcaagtgtcatagcacaacccagaatcctcaaaaggagacctcttcgatgtggggcttaatggtggtcgctcagctgttagcaggcattggcacagtaccgattcagccgttcggaatcagctacgtagatgatttttctgaaccatccaactctccgctgtacatctccattctttttgcgatatcagtattcggtcccgctttcggatacctgcttggctcagttatgcttcagatattcgtggattatggcagggtcaacactgccgctgtgaatctcgtgcctggagatccaaggtggattggcgcttggtggcttggcctgttgatctcaagcgctttactggtgttaacatccttccctttcttttttttcccaagggccatgccaatcggggcaaagcgtgcaccggcaacagcagatgaagctagaaaactggaagaggcgaagtctagaggttctctggtggattttatcaaacgattcccatgtatcttcttgagactgcttatgaactcgcttttcgtgcttgtcgtgctggcccagtgcaccttctcatctgtgattgcgggactctcaacatttctgaataaattcctagagaagcagtatgggacttcagcagcctacgcaaactttcttattggagccgtcaacctcccagcggctgcactgggtatgctttttggagggatcctcatgaagcgctttgtattcagcctacaggctatcccccgaatagcgactaccatcataactatctctatgatcctgtgcgtgcctttgttcttcatggggtgctccacacccacagttgcggaggtgtatcctccatctaccagctcatctattcacccgcagagtcctgcatgtaggcgtgactgcagttgtcccgatagcattttccaccccgtgtgtggagataacggcattgaatatctttctccctgccatgccggttgctctaacatcaatatgtcttctgctacctccaaacagcttatctatctcaattgttcctgcgtgacaggaggctcggccagcgctaagacaggttcctgccccgttccttgtgcgcactttttgctccccgctatcttcctgatctcattcgtgagtttaatagcttgcatcagccacaaccctctgtatatgatggtcttgcgggtggtaaaccaagaggaaaaatccttcgccatcggagtgcaatttctgctcatgcgccttctggcctggttgccctctcccgctctgtacggccttacaatcgaccattcttgtattaggtggaattctctgtgcttgggcagaagaggcgcatgcgcctattacgataacgatgccctcagagaccgctatctcggcctgcagatggggtataaagcattaggtatgcttctgctgtgttttatctcatggagagttaagaaaaacaaagagtataatgttcaaaaagcagcagggctgatctag

SEQ ID NO: 241889 - DNA, 1248 bp, Artificial Sequence
  Description of Artificial Sequence: Synthetic coding sequence
atgggactgctgccgaagcttggcgcttcccaaggtagtgacacttcaaccagtcgcgcaggccgatgcgccagatccgtgtttggaaacattaaggtgttcgtgctttgtcagggcttgcttcagctttgccagcttctctatagcgcctattttaaatcatcacttactactattgaaaagaggttcggcctgagcagttctagcagcgggctgatcagcagcctgaacgagatcagcaacgcgatactgattatctttgtcagctacttcggcagccgggtccaccggccaaggctgatcggcatcggaggtctctttcttgctgccggagctttcattctcacacttccacattttctctccgagccgtatcagtatactctggcgtcaactggtaataatagccggctgcaagccgaactttgtcaaaagcactggcaggacctgcctccatcaaagtgccacagcactactcagaacccccaaaaagagacatcttccatgtggggtctgatggtggtggcccagctgctagccggtattggcacagttcccattcagccctttggcatatcttatgtggatgactttagcgagccgtccaatagtccgttatacataagcatattatttgctatctccgtgtttggccctgccttcggatacttattggggtctgtcatgctccagatctttgtggattatggaagagttaataccgctgcagtgaatctcgtgccgggagacccccgttggataggagcctggtggctgggtcttctcatatcgtccgctctgctggtgctcaccagcttccctttcttcttcttcccgagagcaatgcccatcggggcaaaaagggcaccggctaccgccgacgaagctaggaaactggaggaagctaagtcccgcggaagcctcgtggattttattaagagatttccctgcatatttctgcgactcctgatgaattcactcttcgtgttagtggttctggcacagtgtacattttcatctgtgatcgcagggctctccaccttcctgaacaagtttcttgaaaagcagtatgggacctctgccgcatacgccaattttttaatagcgcaccaggtgctgtacatacgctccctactaccagctgccggtacggctcgagcgcagatactttccagtacacgcagtgtggaaacaatggaaagtagcacctcgcctcttgcgatgcccgctgctgctacgtccacatag

SEQ ID NO: 241890 - DNA, 2133 bp, Artificial Sequence
  Description of Artificial Sequence: Synthetic coding sequence
atgcaggggaagaagccgggaggaagcagcggtgggggacggagtggcgagctgcagggagatgaagcacaacggaacaaaaaaaagaagaaaaaggtgtcatgttttagtaatatcaaaatttttttggtgagcgagtgtgcgctcatgctggctcagggtacagtgggagcctatctagtgtctgtcctgacaacacttgagagacgcttcaatctccagagtgccgatgtgggggttatcgccagtagcttcgagattggaaatctcgctctgatcctgttcgtttcttacttcggagcccgaggccacagaccacgtctcattgggtgtggcggtatcgttatggcgctgggtgccttgctgagcgcactgccggagtttctgactcaccaatataagtatgaggctggggaaatcagatggggtgcagagggaagagacgtttgcgccgctaacggatccggtggggatgaggggcctgatcccgatctgatctgtagaaaccgtaccgccacaaatatgatgtatctgttgctcattggagcacaggtgctcctgggcatcggtgctactcccgtccagcctctaggtgtcagctacatcgatgatcacgtgaggaggaaggatagctctctctatatcggtattctgtttaccatgctggtgtttggtcccgcatgtgggtttatactggggtcattctgtaccaagatctacgtagacgctgtgttcatagacacctctaacttggacatcaccccagatgatcccaggtggattggcgcttggtggggaggattcttattgtgtggtgctctcctatttttcagttccttactgatgttcggattccctcaaagcctgcctccccattcagagcccgcaatggagtctgagcaggcgatgctatcagaaagagagtacgagcggcctaaaccctctaacggcgtgttgagacaccctctcgagcctgattctagcgcaagttgtttccagcaactccgcgtgatccctaaagtgactaaacatctgctctcaaatcccgttttcacatgtattatcctagctgcttgcatggagatcgcggtcgtggccggatttgcggcttttctgggcaaataccttgagcaacaattcaacctgacaacctcaagtgccaatcaattgctgggaatgacagccatcccctgcgcttgtttgggcattttcttgggtggtttgcttgtgaagaagctgtcactctctgccctgggcgctatcagaatggcaatgctggtgaatctcgttagcaccgcttgctacgttagttttctgtttctcgggtgcgataccgggcctgtcgcaggcgtcactgtcccatatgggaactctactgctccaggatccgcactggatccatattccccatgtaacaataactgcgagtgtcagaccgatagcttcacgccagtgtgcggggctgacggcataacatacttgtctgcttgttttgcaggttgtaacagcaccaacctcacggggtgtgcttgtctcaccaccgtccccgctgaaaacgcaactgtggtcccaggtaagtgcccgtctcccggttgccaggaggcttttctgacttttctttgtgtcatgtgcatctgctcgctcatcggtgcaatggctcagacaccatcagtaattatcctgattcggactgtgagtcctgagctgaaatcctatgctttgggggtgctgtttctgctcctacgactcttagggttcattcctccgccactgatttttggagctggcattgacagcacctgtctcttttggagcactttttgtggcgagcagggcgcttgcgtgctttatgacaacgtcgtctaccgatatctgtatgtgtctatcgctatcgccctgaagagctttgcattcatactttatacaactacctggcaatgtctcagaaagaattacaaacgctacataaagaatcacgaagggggtttgagcacatccgagttctttgcttcaacattaaccctagacaatcttgggagggacccagtccccgctaaccaaacccaccggacaaaattcatatataatctcgaggatcatgaatggtgtgagaacatggagagcgtactatag

SEQ ID NO: 241891 - DNA, 1356 bp, Artificial Sequence
  Description of Artificial Sequence: Synthetic coding sequence
atgagggagatcgttcatatacagataggccagtgtggcaatcagatcggggctaaattttgggagatgattggagaagaacacggtatcgacctggccggaagcgacaggggagctagcgctctccaactggaacgtataagcgtgtactacaacgaagcgtacggacgtaagtatgtgccacgagctgttctcgtcgatcttgaacccggtaccatggatagtattcgctcgtccaagctgggcgcactgtttcaacctgactcctttgtgcacggaaattctggcgcaggaaataattgggcaaagggccattacactgagggagctgaactgatagagaatgttttggaagtcgtccgacacgaatctgaatcttgcgactgtctccaagggtttcagattgtacattctctgggcggaggaactggatccgggatgggtacactgctgatgaataagattagagaggagtaccccgaccggatcatgaacagttttagcgtcatgcctagccccaaagtttctgacaccgtggtcgaaccctataacgccgttctgagtatccaccaattgatcgaaaacgcggacgcctgcttctgcatcgataacgaggccctgtacgatatttgtttccgtactttgaagcttactacccctacgtatggggaccttaatcacctggtgtctttaactatgtccggcattacaacatctcttagattcccaggacagctgaatgccgaccttaggaaattggctgttaacatggtgcctttcccgagactgcactttttcatgcccggattcgcgccacttactgcacagggaagccagcagtacagggccttgtctgttgcggagctgactcagcagatgtttgatgcccgaaataccatggccgcttgcgacctccgtcggggaagatacctgactgtggcgtgcatcttccggggtaaaatgtccacaaaagaagtcgaccagcagctgctaagcgtacaaactagaaacagctcatgtttcgttgaatggattcctaacaacgtcaaggtagccgtctgcgatattcctccaaggggcttaagcatggctgcgacgttcatcggtaataacactgctatccaagagatattcaatcgcgtgagcgagcatttctcggcaatgtttaagaggaaggcatttgtccattggtacacgtccgagggtatggacattaatgagtttggcgaggctgaaaataacattcatgatttggtcagtgagtaccagcagttccaggatgcgaaggccgtgctggaggaggacgaggaagtaacagaggaggccgaaatggagcctgaggacaagggccactag

SEQ ID NO: 241892 - DNA, 1749 bp, Artificial Sequence
  Description of Artificial Sequence: Synthetic coding sequence
atgcccctccaccagttgggcgataaaccgctcacatttccttccccaaacagcgcgatggagaacggtctagatcacaccccgccttctcggagggcctccccaggcacccccctttcgccaggtagcctccgcagcgccgctcattccccattggatacctccaagcaacctctttgccagttgtgggctgagaagcacggcgctcggggtacccacgaggttcgttatgtgtcggcgggtcaatctgtggcatgtggttggtgggctttcgccccaccttgcctccaagtactaaataccccaaaggggattctgttttttctgtgcgccgctgctttcttacagggaatgaccgtcaacgggttcataaacacggttattactagcctggagcggaggtacgacctgcattcctaccagtccggactgattgcaagcagttacgacatcgctgcctgcctctgtctgacatttgtcagctatttcggcggatccggtcataaacctcgctggttagggtggggcgtgctcctgatgggtactggtagtttggtgttcgctctgccacatttcacggcagggaggtacgaggtcgagctggatgcaggtgtgcgaacctgcccagcgaaccccggagctgtgtgtgccgacagcacatccggactgtctaggtatcagctggtttttatgctggggcagtttcttcatggcgtgggtgcaacccccctttacacccttggggtcacctatcttggaatgtctacgttctctccgaagttcctggagtcacagtttagcctgtcagcaagcgaagcggctacactattcggttatctagttgtgccagcaggcggtggaggcacgttcctcgggggtttttttgtgaataagctcaggctcagaggaagcgccgtgattaagttttgccttttctgcacagtcgtaagcctgctgggcatcttggtcttctctttgcactgccctagtgtgcctatggctggcgttacagccagttatggcggaagcctgctgcccgaggggcacctgaatctgacggctccttgtaatgctgcctgctcttgtcagccagagcactatagtcctgtatgcggcagtgacggactaatgtatttcagcctgtgccacgccggatgcccagctgccaccgagactaatgtcgacggccaaaaagtgtatagagactgtagctgcataccccagaacctcagttcaggttttgggcatgcgactgcaggaaaatgcacatctacatgccagaggaagcccctgcttctagtgtttatttttgtcgttatctttttcacattcttatcaagcatccctgcactcactgctacactgcgctgcgtgagggacccccagcggtcttttgcgctggggattcagtggatcgtggtgagaatattaggtggtatcccaggccctattgcgttcgggtgggttatcgataaggcatgtttattgtggcaggatcaatgcggccaacaaggaagttgcctggtttaccagaacagcgccatgtcacggtacatcctaatcatgggcctgctatacaaagttcttggagtcctgtttttcgctatcgccagctcccgggcagcctctgatcaccgcccacgacccccagggcatgggggacacagcgctttccccgacgaccgaacggtcccactgggggacgccatcactagggagctcctctttgatttgcagccatcaacctag

SEQ ID NO: 241893 - DNA, 2169 bp, Artificial Sequence
  Description of Artificial Sequence: Synthetic coding sequence
atgccacttcaccagctgggagacaaacctttgacgttcccctcgcccaattcagccatggagaatggactggatcacacccctccaagcagacgcgctagccctggcacacctttgtcccccggaagtctgaggagcgccgcacattctccactggacacctcaaaacaacctttgtgccagctgtgggctgaaaagcacggagccagaggcacccatgaagtccgttatgtctcagctggacagtccgttgcctgtggctggtgggcattcgcccctccctgtctccaggtcctgaacactccgaaaggaattttattttttttgtgtgccgctgccttcctccagggtatgaccgtcaacggttttatcaacaccgtaataaccagtctggaaaggaggtacgacttacatagctaccaaagcgggctgattgcgagtagttatgatattgccgcatgcctgtgcctgacctttgtcagctacttcgggggatcaggacataagcccaggtggcttggctggggggtcctgctcatgggaacaggcagcctggtcttcgcactgccgcatttcacggctggtagatatgaggtagagctcgacgcaggggtaagaacatgccccgctaaccctggagccgtatgtgctgattcaacgagcggcctgtcgaggtaccagctcgtgttcatgttaggacagtttttacacggagttggggcaactcccctgtacaccctcggcgtgacatatcttgatgagaacgtcaagtctagttgttcccctgtgtatatcgccatcttctacacggccgcaattctgggcccagccgcaggatacttgataggtggtgctctgctgaacatatacaccgagatgggtcgacggactgaattaacgaccgagtcccccctttgggtaggggcatggtgggtcggctttcttggttcgggtgctgctgccttcttcacagccgttccgatcttgggatatccaagacaattacctggcagccagaggtacgccgttatgcgcgctgccgagatgcaccagctcaaagactcatccagaggtgaagcttccaaccccgatttcggaaaaacaattcgggatctgcccctgtctatctggttgctgctgaagaatccaacttttatcctgctgtgtctggccggtgccactgaagccaccctaatcactggaatgagcacattctcgcccaaattcctagaaagccagttctcattaagtgcgagcgaagccgcaacgctgttcgggtatttagtggttccggctggcggaggcggtaccttcttaggcggattttttgtgaataaattgcggttgcgcggttctgccgtgatcaaattttgtctattctgcaccgtggtgtccctgctcggcatcctagtgttttctctgcattgccccagcgtcccgatggctggcgtgaccgcaagttatgggggtagtctcctacctgaaggacacctcaatctcacagccccatgcaacgccgcttgttcttgccagcccgagcattactctcccgtgtgcggatccgatggccttatgtacttttcactgtgtcacgctggctgtcccgcagccacagagaccaacgtggatggacagaaggtctaccgtgattgcagctgtattcctcaaaacttatcctcgggctttgggcacgccactgcaggaaagtgcacctctacatgccagaggaagccgctgctgttggtgttcatcttcgttgtgattttctttacattcctgtccagcatccccgcacttaccgctacacttagatgcgtacgcgatccccaaaggtcctttgcactcggcattcaatggatagtggtccgcatccttgggggaattccaggacccattgcgtttggctgggtgatagataaggcatgtcttttatggcaggaccagtgcggtcaacaagggtcctgcttggtgtatcagaacagtgccatgagccggtacattcttatcatgggacttctgtacaaagttctgggggtgctgttctttgccatcgcatgtttcctttacaagcccctgagcgaaagctcagatgggctggagacttgtctgccatcccaaagtagcgcacctgactctgccactgactctcaacttcagagttccgtctag

SEQ ID NO: 241894 - DNA, 2169 bp, Artificial Sequence
  Description of Artificial Sequence: Synthetic coding sequence
atgcctctccaccaactgggggataaaccactgaccttccccagtcctaacagcgccatggaaaatggcctggaccatacaccccctagcagaagggccagccccggtaccccactgtccccaggctctctacgaagcgctgcacactcccccctggacacttccaaacagcctctgtgccagttgtgggccgaaaagcacggggcacggggaacccacgaagtaagatatgtgtcagccggtcagagtgtcgcatgcggatggtgggcgtttgctccaccctgtctccaggtgctgaatacgccaaaaggaatcttgttttttctgtgcgcagcagcattcctgcaggggatgactgttaacggtttcatcaacacagttattacatccttggagcgtaggtacgacctgcattcctatcagtccggactgattgcatccagctacgacatcgccgcatgtctgtgcttgactttcgtgtcatatttcggaggtagtggtcataagccgaggtggttgggctggggtgttctccttatggggaccgggagcctggttttcgctctgcctcatttcacagcgggtcgctatgaagtggagttggatgccggtgtgcggacatgtccagccaacccgggagcggtatgtgccgattctacgagtggactgtcaagatatcaactggtgttcatgttgggccaattcttacacggggtgggcgcaacccccttgtataccctgggggttacatatttggacgagaacgtaaagtcaagttgctctccagtttacatcgcgatcttctatacagccgcaatcctcgggcctgccgctgggtacctcatcggtggtgcccttctgaatatttataccgagatgggcagaagaaccgagttgaccacagagtcacctctctgggtcggagcttggtgggtgggtttcctcgggagtggcgctgctgcatttttcactgccgtgccaattcttggatatccacgccagctgccaggcagccagagatatgctgttatgcgggctgctgaaatgcaccagctgaaggattcctccagaggggaagcatcaaatcccgatttcgggaagacaattagggacctccccctcagcatctggctattgctgaaaaacccaactttcattctgctttgtcttgccggagcgacggaagccacccttattaccggcatgtccaccttctcccctaagttcttggagagtcagttttctctgtcagcctccgaagccgctacactcttcgggtatctggtggtccccgctgggggtggagggactttcctaggaggtttcttcgtcaataagctgaggctccgaggaagtgcggttattaagttttgtctgttttgcaccgtggtctccttgcttgggatcctggtgttttcgctgcactgcccttcagtgcccatggccggagttaccgcatcctacgggggtagtctgttgccagagggccacctgaaccttaccgcaccttgcaatgccgcatgttcctgtcagcccgaacactacagccccgtgtgcggatcagacgggctcatgtatttctcgttgtgtcacgccggttgccccgctgccactgagaccaatgttgacggacaaaaagtctaccgagactgtagttgcattccacagaatctcagctcaggctttgggcacgccacggccggtaaatgtacatctacatttttatatatccctcagcaacactcctgtaccaatggaaacagtaccactggagccctacaagaaactccacggagcaaaagggcttgccggtgcgtccgcgatcctcagcggtcattcgctctgggcatccagtggatcgtagtgagaatccttggagggatcccaggccctattgcttttggctgggtgatcgacaaggcatgtctgctgtggcaggaccaatgtggtcagcagggctcctgcttggtctaccaaaactcggctatgtctaggtacattttgataatgggcctcctctacaaggtcttaggcgtgctgttcttcgcgatcgcatgcttcttgtataaaccactgtccgaaagcagcgacgggcttgagacttgccttccaagtcagagctcagcacccgattccgcgaccgacagccagcttcaaagctcagtgtag

SEQ ID NO: 241895 - DNA, 456 bp, Artificial Sequence
  Description of Artificial Sequence: Synthetic coding sequence
actaccgccttatgcgccgctcggacagcgagctgcacgagccattgcgccacgcagggagccctccagcctaggcgaaggatgtggaccgccagacggtgtgtaagggacccccaaaggtcattcgctctggggattcagtggatagtggtgcgcattctgggaggcatccctggcccaattgcgttcggttgggtcattgacaaagcttgcttattgtggcaagatcagtgtgggcagcagggctcctgcttggtatatcagaactccgccatgtctaggtatattctgataatgggtctgctgtacaaggttctgggggtgttattttttgccatagcctgcttcctttataaaccactgtccgagtctagtgacggactggagacctgcctgccgtctcagagctctgcgccagattctgccacagactcccagcttcagtcttcggtctag

SEQ ID NO: 241896 - DNA, 1863 bp, Artificial Sequence
  Description of Artificial Sequence: Synthetic coding sequence
atgccccttcaccaactgggggacaaacccctgaccttcccatcacctaactccgccatggagaacggtctcgatcacaccccaccctctcggcgagcttcacctggcactcccttgtcaccaggatccttaaggagtgcagcacacagtcccttggacaccagcaaacagcctttgtgccagctgtgggctgagaagcacggggctagaggtactcacgaagttcgctacgtgtcagcaggacagagtgtggcctgtggttggtgggcatttgcccctccatgtttgcaggtgctgaatacaccgaagggcatcctcttctttctgtgcgctgccgcattcctccaaggtatgacggtgaacggattcattaacaccgtcatcacctcgttggaacggaggtacgacctacactcatatcagagcggactgatcgcatcgtcatatgacattgcggcttgtctctgcctcaccttcgtctcttacttcgggggtagcgggcacaaacctaggtggctgggctggggcgtgcttctgatgggcacaggaagcctggtttttgcacttccacactttacagctggacgatatgaagtagaactcgacgccggagttcgaacttgcccagccaaccctggggctgtctgtgccgactccacgtccggcctatctcgatatcagttagtcttcatgctgggccagttcctgcacggcgtaggtgctactcctctgtacacacttggagtcacatacctggatgagaatgtcaaaagttcctgctcaccagtctacatcgcaattttctacactgcagcaatcttgggcccagccgcaggttacctgatcggcggagcactcctcaacatatacaccgagatgggcagaagaaccgagctcacgaccgaatcaccactttgggtgggcgcttggtgggtcggctttctcggatcaggggcagcagcctttttcacagctgtgcctattctggggtaccctagacagttgccaggaagccagagatatgccgtgatgagggcagcggaaatgcatcaactgaaggactcatcacggggtgaggccagcaacccagatttcgggaagactatcagggacctgcccctcagtatttggctgctcctgaaaaacccgaccttcatacttttatgcttggctggtgccactgaggctacacttatcacagggatgtccacattctccccgaaatttcttgaaagccagttctctttgagcgcatccgaagcagccacactgtttggctacctggtcgtgcccgcaggcggtggcggtactttcttaggcggtttttttgtgaacaaactccgactcaggggatcggccgttattaagttttgtctgttttgcacagttgtgtctcttctcgggatactggtcttctctctccactgcccaagcgtgccgatggcaggagtcaccgcctcctacggcggaagcttgttgccagagggtcacttgaacctgacggcaccttgcaatgcagcatgcagttgtcagcctgagcactactcaccagtatgcggcagcgatgggctgatgtatttctccctgtgccacgccggatgccccgctgccaccgagactaacgtggacgggcaaaaggtatccggggcagccgcttaccgtccttgtcctccgcttgaccctggtaaaggccctccatgcctgcctttggtgattggtgccattgtcgggctgcccaggtgcactgaaaccgtggccgtgtcattacgcatttttcccctcgttttggccatgcctttgcaggggaacgcactccagctcgtgagggaatctccaagcttctggttcagttactccttatag

SEQ ID NO: 241897 - DNA, 2160 bp, Artificial Sequence
  Description of Artificial Sequence: Synthetic coding sequence
atgttcgtcggtgtggcccgacatagcgggagccaagacgaagtttcgcggggagttgagcctctcgaagctgctagagctcagcctgccaaggacagacgggcaaagggaacaccaaagtcatcaaagccgggaaagaagcaccgctacctgagactccttccagaggctctgatacgttttggtggatttaggaaacgaaaaaaggccaagagtagcgtgagtaaaaagcccggtgaggtcgacgactctctggagcagccttgcggtctgggttgcctagtatcaacctgctgcgaatgctgcaacaatattcggtgtttcatgatcttttattgtattttgttgatctgccaaggagtcgtgtttggcttgattgacgtctccattggagactttcaaaaggagtaccaactgaaaacgatcgaaaagctcgccctggaaaaatcatatgatatatctagcgggctggtggccatcttcatagccttctacggcgatcgcaagaaagtgatttggtttgtggctagttcattcctcatcggactgggttccctcttatgtgcattcccatccatcaacgaggagaataaacagtccaaggtgggcatagaagatatttgcgaagagataaaggtggtgagcgggtgtcagagtagcgggatttcattccagagcaaatacctttctttcttcattctgggtcagacagttcaaggtattgccggtatgcccctttatatccttggtattacttttattgatgaaaatgtggctacacacagtgcaggaatctacctggggatcgccgaatgtaccagcatgataggttatgccctcggatacgtcctaggcgcaccattggtaaaggtcccagagaatacgacgtcagcaactaacactacagtcaacaacgggagtcctgagtggctgtggacctggtggatcaatttcctgtttgccgcagtggtcgcctggtgcacgctgattcctttgagctgcttcccaaataatatgcctggatccacaagaataaaggcccgaaagcgtaagcagcttcatttcttcgactcacgtctaaaagacctcaaacttggcaccaacattaaggatctgtgtgccgctctgtggatactgatgaagaaccctgttcttatctgcttagccctgtcaaaggctactgaatatctcgtcatcattggagcatccgagttccttccaatatacttagagaatcaatttattctgacacccaccgtcgccacgacactggcaggtttggtgcttataccgggtggtgcgcttggccaattgttaggaggtgtcattgtgtctaccctggagatgagctgtaaggccctcatgaggtttattatggtgacatcagtcatcagccttatcttgctggtgtttatcatctttgtccgctgtaacccggtgcagtttgccggtatcaatgaagactacgacggcaccggcaagctcggcaaccttaccgcaccttgcaacgagaagtgccggtgtagcagcagtatctactcatctatttgtgggagggatgacattgagtattttagcccctgcttcgccggttgtacatactcaaaggcccagaatcaaaagaaaatgtactacaactgtagttgtattaaggaaggactgatcacagccgatgccgaaggtgactttatagatgccagaccgggaaaatgcgacgctaaatgctataagctacccctttttattgcatttattttctctacactgatcttttccggcttctcaggtgtcccaattgtcctggccatgacccgggtggtgccagacaagctgaggagcttagcgctgggggtgtcatacgttatcctgcggatcttcggaactatccctggaccctcaatcttcaagatgagcggcgaaacgagttgtatccttagggatgttaataagtgtggccatactggccgttgttggatctacaacaaaacaaaaatggcctttctgttggttggaatttgttttctctgcaaattgtgtacgatcatctttaccacgattgcattcttcatttataaacgtaggctcaacgaaaatacagattttcccgacgtaacagtgaagaaccccaaagtgaagaagaaggaagagaccgacctctag

SEQ ID NO: 241898 - DNA, 1401 bp, Artificial Sequence
  Description of Artificial Sequence: Synthetic coding sequence
atgtttgtgggagtcgcaaggcactccggatctcaggacgaggtttctagaggagttgagccactggaggccgctcgcgcacagcccgcaaaggatcggagagcaaaaggaacgccaaaatccagcaaacctggaaagaaacaccgctatttaaggttattgcctgaagctttgataagatttggaggctttagaaaacgcaagaaggccaagagttcggtcagcaagaagccgggtgaggtggatgatagcttggagcagccatgcggactgggctgtctggtctctacatgctgcgagtgttgcaacaatattaggtgcttcatgattttctactgcatcctgcttatttgtcagggggtggtctttggactcattgatgtaagtatcggagacttccagaaggagtatcagctaaagacgatcgagaaactggctcttgaaaagtcttacgatatcagttctggcctggtggcgatttttattgctttctacggcgatagaaagaaagtgatttggtttgtggctagttctttcctcattggtctaggctctctgctgtgtgctttccctagtatcaatgaagaaaacaaacaaagtaaggtaggaattgagggcattgctgagtgcacgagcatgattggctatgccctcggctacgttctaggagctcccctggttaaggtgcccgagaataccacctctgcaaccaagaccggcaaactgggcaatctgaccgcgccatgtaatgaaaagtgccgttgttcctcctcaatttattctagcatctgcggccgagacgatattgagtacttctctccatgcttcgccggatgtacctattcaaaggcccagaatcagaagaagatgtactataattgcagctgtatcaaggaaggcctgatcaccgcggatgcagagggggacttcatcgacgctcgtcctggaaagtgtgacgcaaagtgctacaagctgccactctttatcgccttcatattctcaaccctaatcttctcagggttcagtggagtgcctattgtccttgccatgacacgagtggtgcccgacaaattgagatccctagcactgggcgtcagctacgtaatcctccggatattcggtaccatccccggacccagcatcttcaagatgagcggggaaaccagctgcatcctgcgtgatgtgaataaatgtgggcatactgggaggtgctggatctacaataagaccaaaatggcgttcttattagtgggcatttgctttttgtgcaaattgtgcactatcatcttcaccacgatcgcattctttatttacaagcggaggctgaacgagaacaccgatttccccgacgtcactgtcaagaatcctaaagttaagaaaaaagaggagacagacctgtag

SEQ ID NO: 241899 - DNA, 1974 bp, Artificial Sequence
  Description of Artificial Sequence: Synthetic coding sequence
atgtttgtgggcgtcgccaggcactcgggatcacaggatgaggtttctaggggagtagaaccactggaggctgccagggcgcagccagctaaagatcgcagagccaagggcacacccaagtcaagtaaacccggaaagaaacatcgttatctgcggctgctccccgaagcactgattcgattcgggggatttcggaaacggaagaaggccaaaagctccgtctctaagaaacccggtgaggtcgatgattccttagaacagccctgtggcttaggatgcctagtttcgacatgctgcgagtgttgcaataatatccggtgctttatgattttttactgtatccttctgatttgccagggtgtggtctttggactgattgacgtgagcatcggggactttcagaaagagtaccaactgaagactattgagaagctggccctggagaaatcttatgacatctccagcggtctggtggccatcttcattgctttctacggcgacaggaagaaagttatttggttcgtggcctcctcatttttgatcggactgggatcacttctgtgtgcatttccaagcatcaatgaagaaaataaacagtcgaaagttggtattgaggggatcgccgagtgtacatcgatgattggctacgctctgggttatgtgctcggggcacccctggtcaaagttccagagaataccacaagcgcaaccaacaccacagtgaataatggaagtcctgagtggctttggacatggtggattaactttctgttcgctgctgtggtggcgtggtgtacactgattccgttgagttgttttcctaataatatgcctggtagtacccgcatcaaagctagaaagcgaaagcagctgcatttctttgattccagactgaaagatctaaagctggggacgaatattaaagatctttgcgctgccctgtggatcctgatgaaaaatcccgtactgatttgtctcgccctttcgaaagcaacggagtatctagtgattatcggagcttctgagttcttgcctatctacttagagaaccaatttatcctgacccctaccgtcgcgactacgttggctggcttggtgttgatccccggaggggctctcggtcagctgcttgggggagtaattgtgtcaacactggagatgagttgcaaggctctgatgaggttcatcatggtgactagcgttatctccctaatcctgctcgtgttcattatctttgttcgttgcaatccagttcagttcgctggaatcaacgaggactacgatgggacggggaagcttggaaatctgacggctccatgcaatgagaagtgccgttgctcctcgtctatatattcttccatctgcggcagggatgatattgagtattttagcccctgcttcgcgggttgcacctatagcaaggcacaaaaccagaaaaagatgtattataattgtagttgcataaaagaagggctgataacagccgacgctgagggggacttcatagatgcgaggcccggaaaatgcgatgctaagtgttacaaactgcccctgtttattgcctttatattcagtacgctgatcttctcgggcttttctggcgttcccatagttttagccatgacccgagtggtcccggataagctacgctctctggccctcggcgtcagttatgtcatcttgcggatcttcgggactataccaggcccttcaatcttcaaaatgtcgggagaaacctcctgcattttgcgggatgtaaataaatgtgggcatacaggcagatgctggatctataacaagaccaagatggctttcctactcgttgggatctgctttctttgcaaactatgcactattattttcactacgatagccttcttcatctacaagcgcaggctcaatgagaataccgattttccagatgtaacggtgaaaaaccccaaggtgaaaaagaaggaggagacagacctgtag

SEQ ID NO: 241900 - DNA, 2160 bp, Artificial Sequence
  Description of Artificial Sequence: Synthetic coding sequence
atgttcgttggggtggctcggcacagcggtagccaggacgaggtttcaaggggggtcgagccgctggaggccgcacgcgcacagcccgcaaaagaccggcgagccaagggaacacccaaatcttctaagcccggaaaaaaacacaggtatctgagattgctgccggaagctctgattcgatttgggggatttagaaaaaggaaaaaggcgaaatcctctgtatcaaaaaagcctggagaagtagacgactcgctcgaacaaccttgcggactgggctgtctggtaagcacgtgctgtgaatgctgtaataacatccggtgttttatgattttctattgcatcttgttgatatgtcagggagtggtgttcggccttatagacgtctctattggggatttccagaaggagtatcagcttaaaactatcgaaaaactcgccctcgaaaagtcttacgatatctcctccggcttagtcgccatttttatagccttttacggcgataggaaaaaggtgatttggttcgttgcttctagcttcctaatcggactcggatcccttctctgtgcttttccatctataaatgaggagaacaaacagagtaaggtgggaattgaagacatatgtgaggagataaaagtggtttcaggctgccagtcctcaggcatcagtttccagtccaagtatctctcattctttatactgggtcagactgtccaaggcatcgctggtatgcctctctacattttaggcattacatttatcgacgagaacgttgccacacattcagcgggtatttacctagggatcgcagaatgtactagtatgatagggtatgcattggggtatgtgttgggtgctccattagttaaggtccccgagaataccaccagtgcgaccaatacgactgtaaataatggatctcccgaatggctttggacttggtggattaattttctgtttgcagccgtggtagcctggtgtactttaattcccttgtcttgcttcccgaataacatgccaggtagcacaaggattaaggcccgaaagcgcaagcagttacacttcttcgactcccggctgaaagatcttaagttgggaacaaacatcaaggacctgtgcgccgctctctggatcctcatgaagaatcccgtgctgatctgcctggccctgagcaaggccaccgagtatctggtgattatcggggcatctgagttcctcccaatttacctggagaaccagttcattttaactcctacggtcgcaactacactggcgggtttagtacttattcccggtggcgctctgggacagctcttgggaggagtgattgttagcaccctcgaaatgtcatgtaaagctctgatgcggttcatcatggtcacttctgtgatttcgctaattctcctcgtgttcattattttcgtgagatgcaaccctgtgcagttcgctgggataaacgaggactatgacggcaccggtaaactcggtaacctcacagcaccatgtaacgagaagtgcaggtgttcttcctcaatctatagctctatatgcggtagagacgacatcgaatacttcagtccttgtttcgctgggtgcacgtactctaaagcacagaatcagaagaagatgtattacaactgcagctgtatcaaagaaggcctaataacggctgatgcagagggtgattttatcgatgccaggccaggcaaatgtgacgcaaaatgctataaactgccgctattcatcgccttcatctttagcacattgatttttagcggctttagcggcgtacccatcgtgttagcaatgaccagggtcgtcccagacaagctcagatctttggctttgggagtctcttacgtcatcctcagaatttttggcaccattccaggcccatccatcttcaaaatgtctggagagacttcatgtattctgagagacgtgaataaatgcggtcacactgggaggtgctggatttacaacaagacgaagatggcctttctgctggtaggcatttgttttctctgtaagctgtgcacaattatcttcaccactatcgcttttttcatctacaagcgtagactgaacgagaataccgacttccctgacgtgaccgtgaaaaatccgaaggttaagaaaaaggaggaaaccgatctgtag

SEQ ID NO: 241901 - DNA, 78 bp, Artificial Sequence
  Description of Artificial Sequence: Synthetic coding sequence
ctcaatgaaaataccgactttccagacgtaaccgtcaagaatcctaaagtcaagaaaaaggaagagacggatctatag

SEQ ID NO: 241902 - DNA, 1401 bp, Artificial Sequence
  Description of Artificial Sequence: Synthetic coding sequence
atgtttgttggcgtcgcgaggcacagcggcagccaagatgaggtgtctcgcggagtggagcccctagaggcagcacgtgctcagccagccaaagataggagggccaaaggtacacctaaatcgtctaagccaggcaagaaacataggtacctgcgcttgcttcctgaggcactgatacgttttgggggttttcgcaagcgcaagaaagccaagtcatccgtttccaagaagccgggtgaggtggatgacagcctcgagcagccgtgtggattaggctgtctagtgagcacttgctgcgaatgctgcaataatatcagatgctttatgatcttctattgcatccttctgatttgtcagggagtggtcttcgggctgatagatgtgtcaataggggattttcagaaggaataccagttgaagacaatcgaaaagctcgcccttgagaagtcatatgatatctccagtgggcttgtagccatcttcattgccttctacggagacaggaagaaagttatctggttcgttgcctcctctttcctgatcggactcggatctctgctttgcgctttcccatctatcaatgaagaaaataaacagagtaaggtgggcatagagggaattgcggaatgcacatccatgatcggatatgcgctgggatacgttctcggggcaccattggtgaaagtacctgagaataccacttccgccacaaaaaccggaaaactgggcaacctgacagctccatgcaatgaaaagtgtcgatgctcttcttcaatctacagttccatttgcggcagggacgacatcgagtacttcagcccatgtttcgccggatgcacatattctaaggctcaaaaccagaaaaagatgtactataactgctcttgtattaaggagggcctaatcaccgctgatgcggagggggatttcatagacgcccgaccaggaaaatgcgatgccaaatgttacaaactgcctctttttatcgcctttatattcagcacactcattttttcgggtttttccggcgttcccatcgtcttagccatgacacgggtagtgccggacaagctcaggtcacttgccctcggagtatcctacgtcattttgcgcattttcggcacgatcccaggcccttctatcttcaagatgtccggcgagacctcctgcattctccgggacgtgaacaagtgtggccacaccggacgctgctggatttataataagacaaagatggccttcctgctagttggcatttgcttcttgtgcaaactgtgtacaatcatctttacgaccattgccttctttatatacaagaggcggctgaatgaaaacacggatttccctgacgtcacagtcaagaaccctaaagtcaagaagaaggaagaaactgatttgtag

SEQ ID NO: 241903 - DNA, 351 bp, Artificial Sequence
  Description of Artificial Sequence: Synthetic coding sequence
atgctgagctgtcgcctgcagtgcgccctggcggctctgagtatcgtccttgctctcggctgcgtgacaggggcaccttccgacccacggctgcggcagtttctgcagaagtccctagcggcagctgctggtaagcaagaactggctaagtattttctcgcggaactgctgagtgagccaaaccagactgagaacgacgccctcgaaccagaagacctgtcacaggccgctgaacaggacgagatgagactcgaacttcaaagatcagccaattccaatcctgccatggccccacgcgagcgtaaggccggatgtaaaaactttttctggaaaacattcacctcatgctag

SEQ ID NO: 241904 - DNA, 1176 bp, Artificial Sequence
  Description of Artificial Sequence: Synthetic coding sequence
atgtttccgaatgggaccgcgtcctctcccagctcgtctccctcaccctccccgggatcttgcggggaggggggtgggagccgtggaccaggggcaggcgctgctgacggaatggaagaacccggtcgcaatgcgagccagaacgggactttgtctgaaggccagggcagcgcgatcttaatctcctttatatactcagtggtttgtctggtgggattatgtggcaattcaatggttatttacgtcattctgcggtatgcaaaaatgaagaccgccaccaatatatatattctgaatttagcgattgcggacgaattactgatgctgtcggtacctttccttgtcacaagtactcttctgagacactggcccttcggtgccctgctgtgccggctggttttatcggtggatgctgtgaatatgttcactagcatttactgcctcacagtgctgagtgtcgaccgatatgtggccgtcgtccaccccatcaaggcagctcgatatagaagacccaccgtggccaaggtggtgaatctgggagtatgggtcctctcgttactggttatccttcccatcgttgtgttttctcggactgcagctaatagcgacggcacagtggcctgtaatatgttgatgcctgaacccgcacagcgttggctggtcggttttgtgctttacacattcctaatgggctttctgttacccgtcggggcaatctgcttgtgctacgtgttgataatcgcaaagatgcgcatggtcgccctgaaggccggatggcagcagagaaagcgtagcgagagaaagattactcttatggtgatgatggtggttatggtgttcgtgatttgctggatgccattttacgtggttcagttggtcaacgtttttgcagaacaagacgacgctacagtgtcacagctgtccgtgattttggggtacgctaacagctgtgccaaccccatactgtatggctttctgagcgataatttcaagcgaagcttccagcggattctgtgtctgagctggatggataatgccgctgaggagcccgtggactattacgcaactgcactcaaaagtcgggcatacagcgttgaagattttcagcccgagaatctggagtcgggaggtgtcttccgaaacggcacttgtacctcaagaattaccaccttgtag

SEQ ID NO: 241905 - DNA, 1257 bp, Artificial Sequence
  Description of Artificial Sequence: Synthetic coding sequence
atggatatgctccaccccagcagcgtctcaacaacatccgagccagaaaatgcttcttctgcatggccaccagatgcgacgctcggaaacgtgtcggctggcccatctcctgcaggactggcggtgagcggagttctcattccactcgtctatctcgtggtgtgcgtcgtggggttgctggggaactcgttggtcatttacgtcgtgctgaggcacaccgcaagtccctctgttactaacgtttacattttaaacctggccctggccgatgaactattcatgctgggactgccctttctggccgctcagaacgctttgagttactggccatttggcagcttgatgtgtaggttggtgatggccgtggacggcatcaaccagttcacttccattttctgtttaactgtgatgtccgtggatcggtatttagccgtcgttcatccaactaggagcgcccgatggcgtacagctccggtcgcccgtacggtgtcagcagccgtgtgggtagcctcagcggttgtggtcctgcccgtggtcgttttttccggggtccccaggggtatgagcacgtgtcacatgcagtggccggagccggcagccgcttggcgtgcagggttcatcatctatactgccgctctgggtttttttgggcctttactggtcatttgcctgtgctacctgctgatcgtcgtcaaggtgcggagcgcaggacggcgagtctgggcacccagttgtcagcgcagaaggagatccgagcgcagagtgaccagaatggtcgtcgccgtggtagcgctgtttgtcctctgctggatgcctttctacgtcttaaacatcgtcaacgtggtctgtccactgccagaagagcccgcattcttcggtctctattttctggtggtagctctaccctacgcaaattcatgtgccaacccgattttatatggtttcctgagctatcgttttaagcagggctttaggagggtgctgttacgccctagcagacgcgtgcggtcccaagaaccaaccgtcggcccacctgagaagacggaggaagaagatgaggaggaggaggatggtgaggagtctcgcgaagggggtaaaggcaaggaaatgaacggacgtgtaagccaaattacacaacccggtacgtcaggtcaggagcgccctccctccagagtcgcctctaaggagcaacagctcctcccgcaggaggcctcaactggtgagaaatctagcacaatgaggatctcatacttgtag

SEQ ID NO: 241906 - DNA, 1257 bp, Artificial Sequence
  Description of Artificial Sequence: Synthetic coding sequence
atggacatgctacatccatcctccgtatcgaccacctccgagcctgagaacgccagcagtgcctggccgccagacgcgacgttggggaacgtctcagctggaccttccccagccggtttggccgtaagcggagtgttgatccctctggtgtatctggttgtgtgcgttgtcggcttgctgggaaacagcctggtgatctatgtggtcttgaggcacactgctagcccgtccgttaccaacgtctacatccttaatttggcactcgctgacgaattgttcatgttgggccttcctttcctggccgcacagaatgcactttcatactggccatttgggtccctaatgtgtaggttggtgatggctgtagacggtatcaatcagttcactagtatattttgcttgaccgtaatgtcagtcgaccgctatcttgctgttgtccaccctacgcggtccgcaagatggcgcaccgcaccagtggctagaacggtatctgccgctgtgtgggtggcctccgccgttgtggtactccctgtcgtggtgttctctggggttccacgcggaatgtccacttgccatatgcaatggccagaacctgccgctgcatggcgggctggattcatcatatataccgccgctttggggttctttggtccccttcttgtcatttgcctgtgttacctgctcattgtggtaaaggtcaggtccgctggtcgcagagtctgggctccaagctgccagcggagacgccgttctgaacgcagagtaacccgaatggtggtggcggtcgtggccctattcgtcttgtgttggatgccattctatgtcctgaacatcgtgaatgttgtgtgcccgttgccagaagaaccagccttctttggactgtacttccttgtcgtggccctcccgtatgccaatagctgcgccaatcccattttgtacggattcctttcatacagatttaaacagggttttaggagagttttgctgaggccctccaggagggtccgcagtcaagaaccaacagtgggccctcccgagaaaactgaggaggaggacgaggaggaagaggacggggaggagagcagggaggggggaaagggaaaggagatgaacgggagagtctcacagatcactcagcctggcaccagcggacaagagaggcctccctccagagtggcttcaaaagaacaacaattgctgccacaggaggcatctaccggcgagaaatcaagcacaatgagaatttcctatctgtag

SEQ ID NO: 241907 - DNA, 1167 bp, Artificial Sequence
  Description of Artificial Sequence: Synthetic coding sequence
atgagtgctccctccaccctccctcccggtggtgaggaagggctgggcaccgcctggccctctgccgcaaacgcgagctctgcacctgctgaggctgaggaagctgtggccggacctggggatgctagagccgcaggcatggtggctatccaatgtatatatgccctggtttgtttagtcggattggtgggcaacgctcttgtgattttcgtgattctccgttatgctaaaatgaaaacagctacaaatatatacctgcttaacctggctgtggcagacgagctttttatgctttcggttccatttgtcgcctcctcggccgcactccggcactggccattcggaagtgttctctgccgagcagtcttgagcgtggacgggctgaatatgtttaccagcgttttttgcctgactgtcctatctgtggatcgatacgtggccgtcgtgcacccccttcgcgctgcaacctatagaaggccaagcgttgccaagctgatcaatctgggcgtgtggctcgcctccctcttggtcactctcccaattgctatcttcgccgacaccaggcccgcaagaggagggcaagccgtggcctgcaatctgcaatggcctcaccctgcctggtctgccgtgtttgtcgtctatacattcctgctcggatttcttctcccagtgttagccattgggctttgctacctactgatcgttggcaagatgagggcagtggctttacgtgccggatggcaacagcgcagacgctccgagaagaagattacacgcctggtgctcatggttgttgtggtgtttgtgctttgctggatgcctttctacgtagttcagttgctcaaccttttcgtgactagcctcgatgctaccgtgaaccatgtgagtctgatattgtcttatgcaaactcatgtgctaatccaatcttgtatggattcttgtctgataatttccgacggtttttccaaagagtcctgtgcctacggtgctgcctgttagaaggagccggaggtgcagaggaagagccgcttgactattacgccacggcactgaaatcaaaaggtggcgctgggtgtatgtgccccccactgccatgtcagcaagaggctctccagcccgagcctggaaggaaaaggattccactgactcgcaccactacattttag

SEQ ID NO: 241908 - DNA, 1095 bp, Artificial Sequence
  Description of Artificial Sequence: Synthetic coding sequence
atggagcctctgttcccagcgtctaccccctcttggaatgccagctcccccggtgccgcatctggcggaggtgataaccggacgctagtggggccagcaccttctgccggtgccagggccgttctggtcccagtgctgtacctgctggtgtgtgcagccggactcggcggaaataccttggtaatatatgtagtcctgaggttcgccaaaatgaaaactgttacgaacatctatatcctaaacctggctgtggccgatgtactgtacatgcttggacttccttttcttgctacccagaacgcagcgtctttctggccattcgggcctgtgctatgtagactcgtgatgacgcttgatggggtcaaccaatttaccagcgtgttctgcttgacagtgatgagtgtggacagatatcttgccgtggtgcatcctttatccagcgcgaggtggaggaggcctcgtgtggccaaattggcctctgctgctgcgtgggtattgtcactatgcatgagccttccactgctagttttcgctgacgtccaggagggcggaacctgtaatgcttcctggccagagcctgtagggctgtggggcgcagtcttcattatctatactgccgtcctggggttctttgcccctctgcttgtaatctgtctgtgttacctattaatcgtggtgaaagtgcgggcagccggagtgcgagtgggatgtgtgcgcagacgcagcgagaggaaggtgacccgcatggtgctggtcgtggtccttgtgtttgcgggttgttggcttccattcttcaccgttaatatcgtcaaccttgctgtcgctctgccccaggaacctgcctcagcaggtctgtattttttcgtcgttattctttcctatgccaatagttgtgcgaacccagttttgtatggatttttgagcgacaatttcaggcagtcgtttcaaaaggttttgtgtctcagaaaagggtcgggtgctaaagacgccgacgccaccgagccaagacccgaccggatcagacagcagcaggaagcaactcctccagctcatagggctgcggctaacggtctcatgcagacgtctaaactgtag

SEQ ID NO: 241909 - DNA, 1095 bp, Artificial Sequence
  Description of Artificial Sequence: Synthetic coding sequence
atggagccattattccccgctagcacgccctcgtggaatgcaagctctcccggagctgcgtctggaggaggagacaatcggacgttggtgggtcctgcaccgtccgctggggcaagggctgtgctcgtgccggttctatacctcctggtgtgtgcagctggcttgggtggcaacactctcgtgatttacgtcgtgctccgatttgctaagatgaaaacggtgacgaatatctatatactgaatcttgccgtcgccgacgtcctgtacatgctggggttacctttcctggctacccaaaatgcggcatctttctggccttttggacccgtactgtgcaggctcgtgatgacactcgacggggtgaatcagtttacttcggtgttctgtctgaccgttatgtccgtagaccgttacttggcagtggttcacccactgagctcagctaggtggcggagaccgagggtggcaaagcttgcctctgcagcggcttgggtcctgtctctctgtatgtccttgccacttctggttttcgctgatgtgcaggaaggtggcacttgcaatgctagctggcccgaaccagtgggcctgtggggcgctgtgttcatcatttataccgccgttctgggcttcttcgcaccgctgttagtgatttgtctctgctacctattgatcgtggttaaagtgcgggctgcaggcgtccgcgtaggatgtgtgcggagaagaagtgagcgcaaggtcaccagaatggtgttagtggtcgtactggtgttcgctgggtgttggctgccattcttcaccgttaacatcgtaaatttggctgtggcattgccacaggaaccagcatcagctggcctttatttcttcgtggtgatactcagttatgccaacagctgtgctaatccagtcctatatggtttcctgagcgacaacttccggcagtcgttccaaaaggtcctctgtctcaggaagggatcgggtgccaaggacgccgacgcgaccgaaccgagacccgacagaatccgacagcaacaggaggcaacacccccagcacatagagctgccgcaaacggtctgatgcagacttccaaactatag

SEQ ID NO: 241910 - DNA, 822 bp, Artificial Sequence
  Description of Artificial Sequence: Synthetic coding sequence
atggagccactgtttcctgcctcaacaccgtcgtggaacgcttcctcacccggtgcggcaagcggcggaggtgataacaggacactcgtaggaccagcgccttccgctggtgcaagagcggtgctggttccagtgctctacttacttgtatgtgccgctggactcggtggtaatacacttgtcatttacgtggtcctccgcttcgccaagatgaagaccgtgaccaacatctatatcctgaacctagccgtcgccgacgtgctgtacatgcttggacttcccttccttgcaacccaaaatgctgccagtttctggcctttcggtccagtgctctgcaggttggtaatgactcttgatggggtgaaccagttcaccagtgtgttttgcttaaccgtgatgtccgtggaccgatatctcgccgtcgttcatccgttaagctctgccagatggcgacgaccacgggtggccaaactggcctctgcagctgcgtgggtgctgagcctgtgtatgagtctccctctactggtctttgcagacgtgcaggaagggggtacgtgcaatgcttcctggccggagccagtagggctctggggcgcagtctttataatctacacagccgttctgggcttcttcgctccattacttaggggatctgggagggccggtgacgccaacggtaggccttgggaatcgcggagattaccgccacgaatcgtgctccctccccctcctcaaacccccgctttccccggagcgccaggaccagagagaggtccgagggagccatgttggggcctatggggcacgttggcactcctatag

SEQ ID NO: 241911 - DNA, 6978 bp, Artificial Sequence
  Description of Artificial Sequence: Synthetic coding sequence
atggctacaaacatcgagcaaattttcagatccttcgttgtgtccaagttccgtgagatccagcaggagctttctagtgggaggaatgagggacaacttaatggcgagacaaacacacccattgagggaaaccaggctggcgatgctgcagcatcagctaggtccctgccaaatgaagaaatcgtgcagaagatagaagaagtgctgagcggcgttctggacactgagcttaggtacaagcccgacctcaaagagggcagcagaaagtcgagatgcgtctcggtgcagactgatcccaccgacgagatccccactaagaagagtaaaaagcacaagaagcacaaaaataagaagaagaagaagaaaaaggaaaaggaaaagaagtataagcgccaaccggaggaatctgagagcaagacaaagagccacgacgatgggaacatcgacctcgagtctgattcgttcctgaagtttgactcagaaccatctgctgtcgctctcgaacttccaacccgtgcgtttgggcctagcgaaactaacgagtcacctgctgtcgtgttggagcctcctgtagtttcaatggaagtgagcgaacctcatattctcgaaacattgaaacccgcaaccaaaacagccgaactgtccgtggtgagcacttcagtgataagtgaacaatcggagcaaagtgtggccgtcatgcctgagccctcaatgaccaaaatcctagacagttttgcggcagctcctgtgcctacaaccaccctcgtgctcaagtccagcgagccggttgtcaccatgagtgttgagtaccaaatgaagtcagtgctgaaatccgtggaatctacgagcccggagccctcaaagatcatgctggtggaaccgccagttgctaaagttctcgagccctctgagacactggttgtgtctagcgagaccccgacggaagtgtacccggagccatcgacttccactaccatggatttcccggagtccagcgctatcgaagcccttcgcctacctgagcagccagtggacgtgcctagcgagattgctgattcttcaatgacaagaccacaggagctgcccgaactgcctaaaaccacagcacttgagctgcaggaatcctccgttgcatctgctatggaacttccaggcccaccggctacatctatgcctgagctgcagggaccccctgtaacgccagttcttgagctccctggaccttctgccacaccggttcccgaactgccaggacccctcagcactccagtccccgaattgccaggccctcccgcaaccgccgtgcctgagttgcctggcccttcagtcaccccggtcccacagctgtcccaagaactccccggacttcctgctccttctatgggtttggagccccctcaggaggtccctgagcccccagtaatggcacaggagttaccaggactcccgctggtcacagccgctgtggagttacccgagcagcctgccgtgactgtagcaatggagctgaccgagcagcctgtgacaaccaccgaactggagcagcctgtaggaatgactaccgtggagcaccccggacacccggaggtgaccaccgcaacggggctgctgggacagcccgaggccaccatggtcctggagctgcccggtcagcctgtggcaacgactgccctggagctccctgggcagccctctgtaacaggcgtgcctgaattaccaggtctcccttcagcaacgagagcactggagctcagcgggcagccagtggcaactggggctctagaactccccggaccactgatggccgctggggctcttgaattcagcggtcagtcaggcgctgccggtgcacttgagctgctgggccagcccctggcgaccggcgtattggaattaccaggacagcctggagcccctgagttgccagggcagccggtagccaccgtggcactagagatttctgtccagtctgttgttactacgtccgaattatccaccatgacagtgagtcagtctttggaagtgccttcaacaactgccctggaatcttacaacaccgtggcacaggagttgccaactacactggttggagaaacgtccgtaactgttggggtcgaccctttgatggcaccagaaagccatatcctcgcttctaacaccatggagactcacattctggcttctaatactatggattcccagatgctggctagcaacacaatggatagccagatgctggcttctaatactatggacagtcagatgttggcatcttccacaatggatagtcagatgttggctacctcatcgatggacagtcagatgctggcaacaagctctatggattcccagatgctggccacctctacaatggattcgcagatgctggctacttcttcgatggattctcagatgttggctaccagctctatggatagtcagatgctagccacctcctctatggacagccagatgcttgccacatcgtccatggatagccaaatgcttgctacaagcacgatggactcacaaatgttggcgacctccaccatggactctcagatgctcgccacatctagcatggattctcaaatgctggccagtggcaccatggacagccagatgctggcctcagggactatggacgcgcagatgctggcatctggaactatggatgcccagatgctggcttcctccacccaggactcagccatgctgggctcaaagtcccctgacccctaccgcctagcccaggacccttacaggctggcgcaggatccatatcgtctgggccacgatccctatcggctgggtcatgatgcatatagactcggtcaagacccataccgactgggtcatgatccatacaggctgacacctgatccatacaggatgtcgcctaggccctatagaatcgcccctcgcagctacagaatcgcccctcgaccctatagactcgccccaagacctttaatgctggccagtcgacggtcaatgatgatgagttacgccgctgaacggtcaatgatgtcctcctacgaaaggtctatgatgagttacgaacgtagtatgatgtcccctatggctgaacgatcaatgatgtcggcttatgaacggagtatgatgtcagcatatgaacgatctatgatgtcacccatggccgagagatcaatgatgtccgcatacgaacgatccatgatgtctgcatatgagcggtcaatgatgtctcctatggcagataggtcgatgatgagcatgggtgcagacaggagcatgatgagttcctactcagccgcagatcgaagtatgatgtccagttattccgccgctgatcggtcgatgatgtcatcatatacagctgataggtctatgatgtctatggctgctgattcctacactgatagctataccgacacatatactgaggcatacatggtgcctcccctgcccccagaagagcctcctactatgcctccactgccccctgaagaacccccaatgacacctcctctgcctcccgaagagccacccgagggccctgcattgccgacagaacagagcgcactgactgcagagaacacctggccgacagaggtaccatctagtccttcagaagaatcggtcagtcagcctgagccccctgtaagtcagtctgaaatcagtgagccctccgcggtcccaaccgactactcggtttccgcgtcggacccctctgtcttggtgtcagaggcagccgtcaccgtccccgaaccgccaccggagccagaatcgtccatcacactcaccccagtggagtccgcggtcgtcgcggaggagcacgaagttgttcccgagaggcccgtgacctgcatggtgagcgagactcccgctatgtctgccgaacctaccgtgttggcaagcgagccccctgttatgagcgagaccgctgagaccttcgactctatgcgtgcttccggtcatgtggccagcgaggtatcaacatccctgctagttccagccgtaaccaccccagtgctggctgagtcaatcctggagccacccgctatggccgcacctgagtcaagtgccatggctgtcctggaatcttcagccgtgaccgttcttgagagttcaaccgtgacggttctggaaagctccacagtgacggtactagaaccttccgtggttacagtgcctgagccacctgtagtggccgagcccgactatgtaaccatccccgtgccggtggtttctgcactcgagccaagtgtgccggtcctggagccagctgtgtcagtcctgcaaccgtcaatgattgtatcagaaccctcggtgagcgtccaggaatctacagtgaccgtctccgaaccggctgtgaccgttagcgagcaaacacaagtcattccaaccgaagtagccattgaaagtacaccgatgattcttgaatccagtatcatgagttctcacgtaatgaagggaatcaaccttagcagtggggatcaaaacctggctcccgaaattggcatgcaggaaatcgcattgcattctggggaggagccccacgccgaagagcacctgaaaggtgacttctatgagagtgagcacggcatcaatattgaccttaatattaacaaccacctgatcgccaaagagatggagcacaacactgtgtgcgctgcagggactagcccagtcggggagataggagaggagaagatcctgccgactagcgaaaccaagcagagaaccgtcctggacacataccctggcgtgagcgaggccgatgctggggagaccctatcaagcaccggaccttttgcactggagccagatgccactggaacctcaaaggggatagagtttacaacagcttcaacgttatcccttgtgaacaagtatgacgtcgatttatcactaacaacccaggataccgagcatgacatggtcatatcaacaagtccctccggtggttccgaggcagatattgaaggtccgctccctgctaaggacatccacttggatctgccctccaacaataatctagtgtcgaaggacaccgaagaaccgttgcccgtgaaggaatcagaccaaaccttggctgctcttctcagccccaaagaaagcagtggtggggagaaagaggtccccccaccacctaaggagacactgccagattcaggattctctgccaacatagaggacatcaacgaggccgatctggtgagacccctgctgcctaaagatatggagcggctgacatcattaagggccggaatagaaggtccactcctggcatccgatgtgggtagggacagaagtgcggcatcccccgtcgtgtcctctatgcctgaacgcgcttcagaaagcagcagcgaggagaaggacgattatgagatctttgtgaaagtcaaggacacacacgagaaatcaaagaaaaataagaatcgcgacaaaggagagaaggaaaagaagagggacagctctctgaggagccgctccaagcggtctaaaagcagtgaacacaaatcaaggaagaggacgtcagaatctcgctcgcgcgctcgcaaaaggagtagtaagtctaagagtcataggagccagacccgcagccgatcaaggtctcggcgacgccgtcgtagctctagaagcaggtctaagtcaagggggaggaggagcgtgtctaaagaaaaacgtaagagatcacccaagcaccgatcgaagtcccgagagcggaagcgtaaacggtcctcatcaagagacaatcgcaagacggtgagggcgagatcacggacaccgagcagacggtcccgaagccataccccatctagacgccgtaggagcagaagcgtcggtagaagaagatctttctctatcagcccctcaagacgaagcagaaccccttctagaagaagccgtaccccatctcgccgttcacgtacaccatcgaggcggtcccgtactccgtccagacgttcccgcaccccttcaagacgttcccgcaccccatcaaggaggcggcgttcgagatcagtggtgaggcggagatcattcagcatatcaccggtccggctgcggagatcccggacgccattacgaagaagattctcacgctcaccaattcggaggaagcgatcccgaagcagcgagcggggacgcagtcccaagcgcctcaccgatcttgataaggctcagctacttgagatagccaaggcgaacgccgcagctatgtgtgccaaggcaggcgtgcccctccccccaaacctgaagccagcaccgccacccacaatcgaggagaaggtggccaagaagtctggcggagccacaatcgaagagctcactgagaagtgcaagcagatcgcacagtctaaagaggacgacgacgtcatcgtcaataagccccatgttagcgacgaggaggaggaggaacctcctttctaccaccatccttttaagctttccgaacccaaacccatctttttcaacctcaacatcgccgcagctaaacccactcctccaaagtcgcaggtcactttgactaaagaattccctgtttcctccgggtcccaacacagaaaaaaggaagccgacagcgtttacggcgaatgggtaccagtcgaaaagaacggggaggaaaacaaagacgatgacaatgtctttagctctaatttgccctccgagcctgttgatatttctaccgccatgagcgaacgcgcacttgcgcaaaagcggctgtctgaaaatgccttcgacctcgaagccatgtcaatgctgaacagagctcaggagcggatagatgcatgggcccagctcaactcgatccctgggcaattcactggtagtactggcgttcaggtcctgacacaggagcagctggctaatacgggtgcccaggcctggataaagaagggtcagatcctggtggcggtgtttttgcctcggagcgtccccgctgtactgtttacgaccctccttctccctaggccccgaatatccagttac

SEQ ID NO: 241912 - DNA, 6911 bp, Artificial Sequence
  Description of Artificial Sequence: Synthetic coding sequence
atggctactaacatcgagcagatatttaggtctttcgtagtgtccaaatttcgggagattcaacaggagctgtcgagcggtagaaatgagggccagctgaacggagagaccaacacgcctatcgaggggaaccaggccggagatgcagccgcatccgctagatcactcccaaatgaagaaatagtgcagaagattgaggaggtcctctcaggcgtgctggacacagaacttcggtataaaccagatttgaaggagggtagccggaagtcccggtgtgtctcagtgcagactgacccaactgacgagatccccactaaaaagtccaaaaagcataaaaagcacaaaaacaagaaaaagaagaagaaaaaggaaaaagaaaagaagtacaagagacagcccgaggagtccgaatccaaaaccaaatcccacgatgacggaaacattgatctggaaagtgattcgttcctgaagtttgatagcgaaccttcggcggtcgccctcgagttaccgacaagagcctttggtccatccgaaaccaacgagagtcccgcagtggttctggaaccccctgttgtatctatggaggttagtgagcctcatattctagagacattgaaaccagctacaaagacagcagagctgtccgtagtgtcgactagtgtgatcagcgagcaaagcgagcagtccgttgccgtgatgccggaaccttctatgacaaaaattctggatagcttcgcagcggcacctgtgccgaccaccacgctcgtcttaaaatcttctgaacccgtcgttaccatgtcagtcgaataccagatgaagtctgtgctgaaaagtgtggaatcgacatccccagagccatcaaaaatcatgctcgtagaaccccctgtggccaaggtgctggagccgagcgaaactcttgtggtctccagtgagacccctacagaagtttatccagagcccagcacctctaccaccatggacttccctgagtcctctgcgattgaagctcttcgactgcctgaacagcctgttgacgttcccagtgagatagctgattcatcgatgactcgaccccaagaacttcctgagctgcctaagacgactgcactggaacttcaggagtcatctgtggcctcagccatggaactgccagggcctcccgctacttcgatgcccgaattgcaagggcctcccgttacccccgtgttggaacttcctggcccttctgccaccccggtaccggagttgcctggtccactgagcacgcctgttcctgaattacctggacccccagccacagcagtgccggagcttcctggcccttctgtgactcccgtccctcaactctctcaggagctccccggacttcccgctcccagcatgggtctagagcctcctcaggaggtacccgaaccgccagtgatggcacaggagcttcccggactgcccttggtaaccgcggctgtagaactgcccgaacagcccgcagtgaccgtggccatggagctgacggagcagccagtgaccactaccgaactggagcagccggtcggtatgactacagtagagcacccagggcacccggaggtgaccacagctacaggactgctgggacagcctgaagcaaccatggtcttggagcttccagggcagcccgtagctaccacagcattggaattaccagggcagccttccgtgacgggagttcccgaactgcccggactgccgtctgccactagggcattggagctgtctggacaaccggtcgcgactggggctctcgagctaccgggtcccctgatggccgcaggagccctggagttttccggccagagcggcgctgccggtgcattggagctgctaggacaacccctcgccactggcgtcctggagcttccaggccagccaggcgctcctgagctgcctggccaacccgttgcaaccgtagctctggaaatctcagttcagagtgtggtcaccacctccgaattgtctactatgaccgttagtcagagcttggaggtccccagcacgaccgctttggagtcatataacaccgtcgcacaagaactgcccacaacgctcgtgggggagactagcgtgacagtgggggtcgatcctctgatggcccctgagagccatatcctcgcttcaaataccatggagactcatatccttgcttctaatactatggattctcagatgttggcttcaaacacaatggacagtcaaatgctcgcaagcaacacaatggacagccagatgctggctagctctaccatggactcccaaatgctggccacatcatccatggactcacagatgttagccacgtccagcatggactcccagatgctggctacgagcactatggactctcaaatgttagcaacctcctctatggatagtcagatgctggctacatctagcatggacagtcaaatgctggctacatccagcatggattctcagatgctggccaccagcagtatggactcacagatgctcgcaacctctacaatggatagccagatgttggcaacgtccactatggacagtcagatgcttgcgacaagtagcatggacagtcagatgttggcgagcggaacaatggatagccaaatgcttgcctccggcaccatggacgcccagatgttggcctcaggcacaatggatgcccagatgctggcttcatcaacccaggatagtgccatgcttggaagcaagtcgcccgacccctaccgcctggctcaagacccatacaggcttgcccaggacccatatcggctcggtcatgacccctatagactgggacacgacgcctacaggctaggccaggacccgtaccggttgggacatgacccttacaggctcacccctgatccctataggatgagcccacgcccataccggatcgctcccagaagctatagaatcgctccgagaccttacagattggctccacgcccactcatgctcgcatccagacggtccatgatgatgtcttacgccgcagagcggagcatgatgagctcatatgagcgcagcatgatgagctacgaaagaagcatgatgagccccatggccgagagatcgatgatgagcgcctatgagcgctcaatgatgtctgcgtacgagagatctatgatgtccccaatggctgagcgatctatgatgagcgcttatgagcgttctatgatgagtgcttatgagaggagcatgatgagccccatggccgacagaagtatgatgtctatgggggctgacaggtccatgatgtccagctactctgcagccgatcggagcatgatgagctcttactcagctgcagaccggagcatgatgtcgtcctacacagctgaccggagcatgatgagcatggctgccgatagttacaccgacagttataccgatacctatacagaagcctacatggtgcctccactgcccccagaagaaccgcctacaatgccgccactgcccccagaagagcctcccatgactcctccacttccccctgaggagccacctgaggggcctgcactgcctacagagcagtccgcattaactgccgaaaacacctggccaacggaagtgccatcatcgccctccgaagaatctgtctcacaacccgaaccacccgtttcacagtctgagatcagtgaaccatctgctgtgcccaccgactactccgtctcagcttccgacccctccgttcttgtgagcgaggccgctgtgactgttcctgagccaccacccgaacccgagagtagcatcactctcactcccgtcgaaagtgccgtagtggccgaggagcatgaggtcgtgcccgaaaggcccgtcacctgtatggtctctgaaacacctgcgatgtccgctgagccaaccgtgctggcttccgagcccccagtcatgtcagagaccgccgaaacctttgactcaatgcgagcctccggccatgtggcttccgaggtcagcacatctttactagtacccgcagtaacgaccccagttctagcggaaagcatacttgaaccgcctgccatggctgcacctgaatcatccgcgatggccgtgctcgagtcctctgcagtcactgtgctggaatctagtacagttacagtgctggaatcaagcacggtgacagttcttgaaccctcagtagtaactgtgccggagccaccagtggtggcggagcccgactacgtgacaattcccgttcccgtggtgagtgcccttgagccaagcgtccctgtactggagcccgcagtgtcagtcctccagccctccatgattgtgtcagaaccatccgtgtccgtgcaggagtctacagtcactgtgtccgaacccgcagtgacagtgtctgagcagacccaggtaatacccaccgaggtggcaattgaatccacacccatgattctggaaagcagcatcatgtcttctcacgtcatgaaagggattaacctttccagtggcgaccagaatctggccccagagatcggaatgcaggagattgccctgcacagcggcgaggaaccacacgcggaggagcacctcaagggggatttctacgaaagtgagcacggaataaacatagacctcaacatcaacaaccatttgatcgccaaggaaatggaacacaataccgtgtgtgccgctggtacatcaccagtaggggagattggcgaagagaagattctgccaaccagtgagacgaagcagaggacagtgttggatacatatcccggagtgtctgaggcagatgcaggtgagacactttcgtcaactggaccctttgccctggagcctgatgccaccgggacttcaaaaggcattgaatttaccaccgctagcacccttagtctggtaaataagtacgacgtcgatctgtctctcaccactcaagataccgagcacgatatggttattagcaccagtcctagcggtggaagtgaagcagacattgaaggccctttacccgctaaggacatccatttggacttgccatccaacaacaacctggtcagcaaggacacagaggaaccacttcccgtgaaagaatcagaccaaactctggctgcgctgctcagccctaaagagtcttccggtggggaaaaggaagttcccccacccccaaaggagacactccccgactcggggttctccgcaaacattgaagacattaacgaagctgatcttgtacgacctctgctccccaaggacatggagcgcctgaccagcttaagggctggaattgaggggcctctgctcgcatctgacgtaggccgagataggtccgcagcgtcccccgtcgtgagttctatgcccgaacgcgcaagtgagtccagctctgaggagaaggatgactatgaaatcttcgtgaaagttaaggatacacatgagaagtccaaaaagaacaaaaatagagacaagggggaaaaagaaaagaagcgggacagcagcttacggagccgcagcaagcggtccaaatctagcgagcataagtcacggaaacggacttcagaatctcgcagtagagcacgcaaaagaagctcaaaaagcaaatcccaccgctcacaaaccaggagcagatcccgaagcagaagaaggcgccgttccagtaggagtaggagcaagagccgtggtcgcaggtctgtgtccaaggaaaagaggaaacggtcaccaaagcatagaagcaaatcacgggagaggaaaaggaaacgctccagctctagggataatagaaagacagtgcgggctcgctcacgcacgccgtcaagaagaagtcgatcccacacaccgtcacgtaggcgccgttccagatctgtaggacgccgaagatccttcagcattagtcccagtcgaagatctaggaccccctctcggcgttcaagaactccaagccgccgaagccgcacaccctcacgcagatctagaactccttcccgtcggagcaggactccgagcaggaggtcgaggacgccaagtcgcaggcgacgcagtcgcagcgtggtcagacgaaggtcattcagcatcagtcccgtcaggcttaggagaagcaggacacctctccgaaggaggtttagcaggagccccattagaagaaaaagatcccggagtagcgagagagggagatctcctaagcggttgacagacctggataaggcacaattgctggaaatagccaaggctaatgcagccgctatgtgcgccaaggctggggtgcctttaccccctaatctaaaacccgctcctcccccaacaattgaagagaaagtagcgaaaaagagtggaggcgcaaccattgaagaattgacagagaaatgtaagcagattgcacagtcaaaggaagatgacgacgtaatcgtcaacaagcctcatgtgtctgacgaagaagaggaagaaccccctttttatcatcatccttttaagctgtctgagcccaagccaatctttttcaatttgaacatcgcagccgctaaaccgacacccccaaagtctcaggtgacgctcaccaaagagttccccgttagctccgggagccagcatcggaagaaggaggccgacagtgtgtacggagaatgggtgccggtggagaagaacggtgaagaaaataaagatgacgacaacgtttttagttctaacctaccaagcgaagggagagtgaaacgccaggggcgtgtgcggaggcagatgaagcagccagctgcctcccatttaactgtgacgcgctgtaattctctgtgtgggactaagcctcagagcgaaaagcaccggattgctgagaactccgtgatcacaagcttgcccaatatcggacccagtctgcacttatgggaagggtcaccaagatacaattaccttgcatctaggtttgcctcccgactgtattccagcagattctggtggta

SEQ ID NO: 241913 - DNA, 7280 bp, Artificial Sequence
  Description of Artificial Sequence: Synthetic coding sequence
atggcaacaaacattgagcagatttttcgttctttcgttgtgtccaagttccgggagatccagcaggaactgagcagcggacgaaatgaagggcagctgaatggggagacaaacacacccatcgagggaaaccaggcaggcgatgccgcagcatctgcacggtccttgcccaatgaagagatcgtgcaaaaaatcgaggaagtgctcagtggcgtcttggatacagaactcaggtacaagcccgacctgaaggaggggtccaggaagtcacgctgtgtatcggtacagaccgaccccaccgacgaaataccaaccaagaagagtaaaaagcataaaaaacacaaaaacaaaaaaaagaagaaaaaaaaggagaaggagaagaaatacaagcgacagcctgaggagagcgaaagcaaaaccaagagtcacgacgatggaaacattgatctcgagtccgactcattcctgaagtttgacagcgagccatccgccgtggccttggagctcccgacaagggcctttggaccatcggaaactaatgaatcccccgctgtagttctcgaaccgccagtggtctcaatggaggtgtcagagccccacattctggaaaccctgaagcccgcaaccaagacagccgagctgtccgttgtgtcgaccagtgtaatctccgaacaatcagagcagtccgtggcagttatgccggaacccagtatgacgaaaatcctggatagtttcgccgctgctccggtcccaaccaccactctagtattgaagtctagtgaacctgtggtcacaatgtcagtcgagtatcagatgaaatccgtcctgaaatccgtggaatcgacctctcccgagccctccaagatcatgctcgtcgagccccctgtggcaaaagtgctagagccttctgagacccttgtggtgagttccgagacccctactgaggtttatccagaacccagcacgtctacaaccatggattttcccgaatccagcgcaatcgaagcattaaggctccccgagcagcccgtagacgtaccaagcgagattgcagattctagtatgactagacctcaggaactgccagaactgcccaaaaccacagctctggagctccaagaaagttccgttgcgagcgccatggaattgccaggaccaccagcaacctccatgccagaactgcagggacctccagttactcccgtgctcgaactgcccggtccatccgctacccctgtgccagagttacccggaccgctgtctacccccgtccctgagctgcctggcccaccagctactgccgtcccagaactgcccggtcccagtgtcactcctgtcccgcagctgagccaggaattaccgggactcccagctccttccatgggacttgagccaccacaagaggtacccgaaccgcctgtgatggcccaggagctaccgggactcccgttggtcacagctgccgtagaattgcctgaacagccagctgtgacagtggccatggagttgacggagcagcccgtgacaacaacagaactggagcagcctgtagggatgaccacagtggaacatcctggacaccctgaggtgaccaccgcaaccggcctgctcggtcaaccagaggctaccatggtcctagaactccccggacaacccgttgcgactaccgccctcgaacttcctggccaaccctccgtcaccggcgtgccagagctacctggtctgcctagcgctacacgtgcgctcgagcttagtggccaaccagtcgcgaccggggctctagaactgccgggtcccctgatggctgcaggcgcactcgagttttctggccaaagtggggctgccggtgccttggaactgctgggtcagccattggccacgggtgtgctggagctaccgggacaaccaggcgctcctgagctgccaggccagccagtagcaaccgtggctctggaaattagcgtacaaagcgtggtgactactagcgagctaagcactatgacagtatcccagtctctggaagtgccgtcgaccactgccctggagtcctacaacacagtcgctcaggaactgcccaccaccctggttggagagacctccgtcacagtgggagtggaccccttaatggcacccgaatcccatatcctggcctccaacacaatggagactcatattctagcttcgaacacaatggattcacagatgctagcctcaaatactatggacagtcagatgctggcgagcaacactatggactcgcagatgctggctagctcgacgatggactcccagatgctcgcgacatcgagcatggatagtcaaatgttggcgacgagtagcatggacagccagatgcttgccacctctaccatggactcccagatgctggccaccagttccatggactctcagatgctggcaacttctagtatggactcccaaatgcttgccacctcttccatggattctcaaatgctggccacctcaagcatggatagtcagatgttagccaccagtacaatggattcccaaatgctcgctacttccacaatggactcccagatgttggctactagctccatggatagccaaatgctagcttccgggacaatggactctcaaatgttggcctcgggaacgatggacgctcagatgctggcgtctggaaccatggatgctcaaatgctggcaagctcaacacaagatagcgctatgctggggagcaaatcacctgatccttatagactcgcacaagatccttatcgtcttgctcaggacccgtaccgcctggggcacgacccttatcgcctggggcacgacgcgtatagactaggacaggacccttatagattaggtcacgatccctacagactgactcctgatccatatagaatgtcaccaaggccctaccgaattgcccctcgatcctaccgcattgccccaaggccctacagactcgcgccacgacctctgatgcttgcctcgagacgcagtatgatgatgtcctatgccgcagaacgcagtatgatgtcatcgtacgagcgatctatgatgtcatatgagcggagtatgatgagtcctatggcagagcggtccatgatgagcgcctatgagcgttctatgatgagcgcctacgagaggtcaatgatgtcaccaatggcagaacgaagcatgatgagcgcatatgagagatcgatgatgtctgcgtatgagagatcaatgatgagtccgatggcagaccgctccatgatgagcatgggcgctgaccgctctatgatgtcttcatacagcgctgcggatcgatccatgatgtcctcctattcagccgcagacagatccatgatgtcaagttatactgccgatcggtctatgatgagcatggccgcagattcgtatacagattcctatactgatacctatactgaggcctacatggtccctccactgcctcccgaagaaccccctaccatgcccccattgccccctgaagaacctcctatgaccccacccctccctcctgaggagccacctgagggaccagctctgcccacggagcagtctgcactcaccgctgagaacacctggcccactgaagttcccagctctcccagcgaggagtccgtttcacaaccagagcctccagtctcccagtcagaaatcagtgagccatcagctgtacccacagactacagcgtgtccgcgagcgatccaagtgtgctggtgagcgaggcggcagtgacagtgccagaacccccaccagagcctgagagctcaatcactctgacccctgtcgagtctgctgtggtggccgaggagcacgaggtggttcccgagcgaccagtaacctgtatggtcagcgagacacctgctatgtccgctgagcccactgtactggccagtgagcctcctgtcatgagtgaaacagccgagacattcgactcaatgcgggcatcggggcacgtcgcttccgaggtgagcacctctttgttggtgccagccgtcacaacaccagtgcttgcagagagtatccttgagccccctgcaatggccgctccagaatcgtccgcgatggcagtgctggaaagctccgcagtaactgttctggagtcttcgacggtgactgtgctcgaatcctcaacagtaactgtgctggaaccgtccgtggtgaccgtgcctgaacccccagtggtagctgaacccgattatgtgacaatcccagtgccagtcgtgtccgcgctggaaccctccgttcctgtgctcgaacccgctgtgagcgttctccaaccttctatgattgtgtccgagccaagcgttagtgtgcaggaatcaacggtcacggtcagcgagcctgcggtaactgtaagcgaacaaacccaggttattcctactgaagtcgcaatagagagcacacctatgatacttgagtcttctatcatgtcctcccacgttatgaaggggatcaatttgtcaagcggggaccagaatctggcaccagagattgggatgcaggagattgcactccactcaggcgaagaaccccacgcagaggagcacttgaagggcgacttctacgagagcgaacatggcataaatatcgatttgaatattaacaatcacttgatagccaaagaaatggaacacaacactgtgtgtgctgccggaacctctcccgtgggcgagatcggggaggagaagatcctgcctacctctgaaactaagcaacgcaccgtgctggacacttaccccggagtcagtgaggcggacgctggtgaaacactctcttccaccggtccgtttgcgctggaaccggatgcaactggtaccagtaaggggatagagttcacaaccgcaagcacactttctctggtgaacaaatatgacgtcgaccttagcttaacgacacaggacactgaacacgatatggttatatccacttcacccagcgggggatctgaggccgacattgagggacccctgcctgccaaggacatccacttagacttgccatctaataataacttagtaagtaaagacactgaggagcctctccccgtaaaagagtcagaccagacactggctgccctgctttcccccaaggagtccagtggtggtgagaaagaggtgcctccaccaccaaaggaaactttaccggactctggattcagtgccaacatcgaggatatcaatgaggcagacctggttcggcctctgctccccaaggatatggaacgactgacttcattgcgtgccggaatcgaaggacccctcttggcgtcggacgtgggtcgggatcgcagcgctgcgtcacccgtggtatcgtccatgcccgagagagcttcagagagctcttctgaagagaaggacgactacgagatattcgtaaaagtgaaggatactcacgagaagtccaagaaaaacaagaacagggacaaaggtgaaaaggagaaaaaaagggattcatctcttcggagccgaagtaagcgttccaagagctctgaacacaaatcccgtaagagaacctccgaatccagaagccgggctcggaagcgcagttctaaatcgaaatctcaccgatcccagacgaggtcaagaagccggagtagacgcagacgacggtcatctagatcacgcagcaagagccggggtcggcgttctgtctctaaagaaaagcgcaagcggtccccaaaacaccgcagcaaatcgagagagaggaagagaaagcgttcatccagcagagacaaccggaagacggtcagggccagatctaggaccccaagtaggcggagcagatcccacaccccttctcggagacggagatccagaagtgtgggacggaggcgatcattttctataagccccagcaggcggtctagaaccccctcgcggagatcacgaacgccatcaagaagaagccgcacccccagccggcgttccagaactccctccagaagatcccgcacgccctctcggagatcccgcaccccttccagacggaggcgatcgagaagcgtggtgaggcggaggtctttcagcatttcccccgtgagacttcgtcggagtagaacaccgttgagacgcagattcagccgttcccccattcgcagaaagagatcacgtagcagcgagcgcggacgcagccctaagaggctgactgacctagacaaagcccagcttctcgaaatcgcaaaggcaaatgccgctgctatgtgcgcgaaggcaggggtcccactgcctccaaacttgaaacccgcacctccgccaactatcgaggagaaggtcgctaaaaaatccgggggtgccaccattgaagaactcacagagaagtgcaagcagattgcacaatctaaggaagacgacgacgtcattgtgaacaagccccatgtctctgatgaggaagaggaggaaccacccttttaccaccacccgttcaaactgtctgaacctaaacctatcttcttcaacctcaatatcgccgctgccaagccaacccctcctaagtcacaggtcacactgactaaagagtttccagtgtcatctgggagtcagcaccgaaagaaggaggcagatagtgtgtacggcgagtgggtcccagtggagaaaaacggcgaggaaaataaagacgacgacaacgtgttctccagcaatcttccgtccgagcccgtagacatcagcacggcaatgtctgagcgagctctggcccagaaacggctatctgaaaatgctttcgatttagaagctatgagtatgctcaaccgcgctcaagaaaggattgacgcctgggcccagctgaattccataccaggccagtttactggatccaccggggtgcaggtcctgacccaagaacagctcgcaaatacaggagcacaggcttggatcaaaaaggatcagtttctgagagcggctcccgtgactggaggaatgggagccgtgctgatgcgcaagatgggctggcgagagggggagggccttggcaagaataaggaagggaataaagagcccatacttgtcgacttcaagactgatcgtaaaggcttagtcgctgtgggtgaaagggctcagaaacgcagcggtaacttcagcgctgcaatgaaagatctctcaggaaaacaccctgtaagcgccctcatggaaatttgcaataaaaggaggtggcaacccccagagtttcttcttgtgcacgacagcggcccagaccatcgcaagcatttcctgtttcgcgtccttaggaacggtgccctaacaaggcccaattgcatgttttttttgaaccgctacta

SEQ ID NO: 241914 - DNA, 1584 bp, Artificial Sequence
  Description of Artificial Sequence: Synthetic coding sequence
atggcgccagagcggttgcgtagtcgcgcactgagtgcgttcaagctccgcggtctgctcttaaggggagaagcgatcaagtatttgacagaggccctgcagagcatcagtgaactggagctggaagacaagctggaaaagattatcaacgccgtagagaagcagccgctctcttccaacatgatagaacgaagcgtcgtcgaagctgcagtgcaggagtgttctcaatccgtagacgaaacaatcgaacacgtctttaacatcataggcgcttttgatatccccagattcgtgtataactccgaacggaagaagttccttccactgctgatgaccaatcacccggcaccgaatctgttcggaacaccgagggacaaggccgagatgtttcgtgaacggtacacaatcctccatcagaggactcaccggcacgaactcttcactccaccggtaatcggctctcacccagatgagagcggcagcaagtttcaactaaagacaatcgagactctcctgggttccacaactaaaatcggcgatgcaatcgtactgggcatgatcacccagcttaaagaaggaaaattcttcctcgaggatcccacaggcacggtgcagctcgacctcagcaaggcacagtttcactcgggtctctacacggaggcatgctttgtgctcgccgaaggctggtttgaggatcaagtgttccacgtaaatgctttcggctttccccctactgaaccatctagtacaacgagagcgtattacggtaatattaattttttcggcggtccctctaatacgagcgtgaaaactagtgccaagctgaagcagctggaggaggaaaacaaggacgctatgttcgtgttcctgagcgatgtctggttggaccaggtcgaagtgctcgagaaattacggattatgtttgcaggctattctccagctccccctacttgctttattctgtgcggcaactttagcagcgcaccctacggcaaaaatcaggtgcaagccctgaaggatagcctaaagacactggccgatattatctgtgagtaccctgacattcatcagtcctctagattcgtgtttgtccccggtcccgaagaccctggtttcggaagtatcctcccccgacccccactagctgaatccatcactaacgagtttcggcagcgcgtgccattttcagtatttacaacaaatccatgtcggattcagtattgcacacaggagataactgtgttccgggaagatctcgtaaacaagatgtgcagaaattgcgttcgctttcctagctcaaatcttgcgatcccgaaccattttgtgaaaacaatccttagccagggacatctgacacccttaccgttgtatgtatgtcctgtgtattgggcctatgattatgctctgcgcgtgtatcctgttcctgatctcctggtgatcgctgacaagtacgatcccttcactaccaccaataccgagtgcctttgcattaatcctggctcatttccacggagcgggttttccttcaaggttttctatccttcaaataaaaccgtggaggattctaagttacaaggtttctag

SEQ ID NO: 241915 - DNA, 3900 bp, Artificial Sequence
  Description of Artificial Sequence: Synthetic coding sequence
atgcagcaggcccctcagccttatgagttctttagcgaagaaaactccccaaagtggcgcggactgcttgtcagcgcactgcgcaaagtgcaagagcaagtacaccctacactgagcgctaacgaggaaagcctttactatatcgaagaactgatctttcagctgttgaacaaattatgcatggcccagccacggactgttcaggacgtggaagaaagagttcaaaagacattcccacacccaatagataagtgggccatcgccgatgcccaaagtgctattgaaaaacgcaagcgaaggaaccccttgctcctgcccgtggataaaattcatccatccctaaaggaagtgttgggatataaagtggattatcacgtgtcgttatacattgtggcagtcctagagtatatctcagcagacatcctaaagttggctgggaattacgtgttcaacatacggcactacgagatcagccagcaagacatcaaagtttcaatgtgtgccgacaaagttctaatggacatgttcgatcaggacgacatcggtctggtgagcctgtgcgaagacgagccttcgagcagtggggagctcaactactacgatctggtgcggacagaaattgccgaggagagacagtaccttagagagctaaacatgatcatcaaagtattcagggaagcattcctgtcagaccgtaagctctttaaaccatccgacattgagaagatcttctctaacataagtgacattcatgaactgacagtgaaattgctggggcttatcgaagacaccgttgagatgaccgatgaaagctctccacacccactagcgggatcctgtttcgaggatcttgccgaggaacaggcgtttgacccatacgagactttatcgcaagatattttaagtcctgagtttcatgaacacttcaacaagttgatggcgaggccagccgtggcactccactttcagcaattgaaagcttgtagcgaagagcaggaagatcgcgagtgcctcaaccaggcaattactgctttgatgaatctgcagggatctatggatcggatttataagcagtactcccctcgaaggcggccaggagatcccgtgtgcccgttctactcccatcagctcagaagcaagcatttggccatcaagaaaatgaatgagattcagaaaaatattgacggttgggaaggcaaggacattggccaatgctgcaacgagttcattatggagggaccattaacacggattggggcaaagcacgaacgccacatcttcctcttcgatggtctgatgatttcctgcaagcccaaccatggccagaccaggctccctggatattcatccgcagagtacaggctgaaggaaaagttcgtcatgaggaaaattcaaatctgcgataaagaggacacttgcgaacataaacacgcattcgagctagtgagtaaagacgagaatagcattattttcgccgcaaagtcagccgaagagaagaataattggatggcggcactgatttccctgcactaccggagtacattggatcgaatgctggacagtgttcttctcaaggaggagaacgaacagcccctgaggttgccgagcccggaagtgtaccggtttgtggtaaaggactccgaggagaatatcgtattcgaagacaatcttcaatcaaggagcggcatccctattatcaaaggcggaactgtcgtgaagttgattgaacgtctgacctatcacatgtacgctgatcctaattttgttaggaccttcctgactacttatagatctttctgtaagcctcaggagctattatcccttctgatcgaaaggtttgagatacctgagcctgagcccactgatgcagacaagctggctattgagaaaggggaacagccgatctccgcggacctgaaacgctttagaaaggagtatgtgcagccagtacagctgcggattctgaacgtgtttagacattgggtggaacatcacttctacgacttcgagcgggacctggaacttttggaaagactggaaagcttcatttcctccgtgcggggaaaggctatgaagaaatgggtagagagtatagctaaaatcatcaggaggaaaaaacaggcgcaggcgaatggggtctctcacaacattaccttcgagtctcctccccctcccatcgagtggcatatatccaagcctgggcagtttgagacattcgatttaatgaccctccatccaatcgaaatcgcgcgacagctcacactgctggagtcagacttatacaggaaggtgcagccatcggaactcgttgggtctgtgtggaccaaggaagataaagagattaacagccctaatttactcaaaatgattcggcacactacaaatcttaccctctggtttgagaagtgcatagtggaagctgagaactttgaggagagggtggcagtactgagccgcatcattgaaattctgcaggtgtttcaggatctgaataactttaacggggtgttggagattgttagtgctgtgaattccgtgtccgtgtatagactggaccatactttcgaagcacttcaggagagaaagcggaaaatcctggacgaagcggtcgaactgtcacaagaccatttcaagaagtacctggtgaagctgaaatctatcaacccaccttgtgtgcccttcttcggtatttacctaacaaatattctgaagacagaggaaggaaataacgattttttgaaaaagaaaggcaaggacttgatcaatttcagtaaacggagaaaagtggcggaaatcactggagagattcagcagtatcagaatcagccctactgtctgcgcatcgagcccgatatgcggcgttttttcgagaatctgaaccctatgggctctgcctctgagaaagagtttaccgactatctgtttaacaagtctctagagattgagcctagaaactgtaagcagccacccagattccccagaaagtctacatttagcctcaaaagcccaggaataagacccaataccggcagacacggctctacgagcggcaccctgcggggacacccaactcccctggagcgagagccatgtaagatctcatttagtcgaatagcagaaacggaacttgaatccacagtgtctgctcctacttcaccaaacacacctagtacacctcctgtctcggccagctctgaccttagcgtcttcttagacgttgatttgaacagctcgtgtggatctaattcaatatttgcccctgtgctgctgccacattctaaatctttttttagttcgtgtggctccctacacaagttatccgaagaacccctcattccccctccacttcctccaaggaaaaaattcgaccacgacgccagcaattctaaagggaatatgaaaagcgatgatgatccgccagctattcccccacgtcagccgccaccacccaaagttaaaccgagggtaccggttcctactggagctttcgatggcccactgcattctcctccccctccaccccctcgggatccgctgccagatacgccccctcctgtgccactgagaccacccgagcatttcatcaactgccctttcaatctccaacctcctcccctagggcatctccatagagactcagattggcttcgggacattagtacatgtccaaattccccgagtacgccaccctctaccccctcccccagagtgccaaggcggtgctatgtgctttctagttcccagaacaatctggcacaccctcctgcaccgccagttcctcccaggcagaactccagccctcacctgcctaaattaccccctaagacttacaaaagagaactctcgcacccaccattgtataggctgccactgctcgaaaatgccgaaacaccgcagtag

SEQ ID NO: 241916 - DNA, 1389 bp, Artificial Sequence
  Description of Artificial Sequence: Synthetic coding sequence
atgctacttctggccagatgtctcctcctggtgttagtgtcgtcgctgttggtatgctccggcctggcctgcggccctggcagggggttcggtaaaagaagacatcccaagaaactcactcctctggcatacaagcagtttattccaaatgtcgctgagaaaaccttgggagcttccggcagatacgaaggcaagatctcaagaaattctgagcggttcaaggagctgacacctaactacaaccctgatataatcttcaaagatgaggagaatacaggcgctgacagattgatgacacagcggtgtaaagacaaacttaatgcgttggcaataagtgtgatgaaccagtggcctggagtaaaattgagggtaaccgaggggtgggatgaagatggtcatcacagcgaggagtcacttcactacgaaggacgcgcagtggatatcacaactagcgaccgagatcgaagtaagtacggcatgctggcgaggcttgccgtcgaggccggtttcgactgggtctattatgaatcaaaagcccatattcactgcagcgttaaggcagagaacagcgtagcagcaaagagtgggggttgctttcctggttccgctacagtgcatctcgaacaggggggtactaaactggttaaagatctaagccccggagatagggtattggcagcagatgaccagggacgacttctttattctgacttcctcacattcctcgacagagatgatggggctaaaaaagtgttctatgtgattgagacccgagagccacgtgaacggcttctactgacggcggctcatcttcttttcgtagcccctcataatgatagcgccacaggcgaaccagaggccagctccgggagcggccctcctagtggcggagccctgggtcccagggcactcttcgcatctcgcgtgaggcctggccagcgggtatatgtcgtggccgaaagggacggggataggcgcctgctgcctgcggctgttcactcggttactctgtccgaggaggcagcaggggcatatgctcctttgaccgcacaaggtactatcctcattaacagagttctcgcgagttgctacgctgtgatcgaagagcatagttgggctcaccgtgccttcgccccattcaggctggcccatgcactccttgccgctctcgcccctgctcgaaccgaccgcggaggggacagcggaggcggagacagaggcggagggggaggtcgcgtcgcactgaccgctccaggcgctgccgatgcacccggtgcgggagcaactgctggtattcattggtactcccagctcctctaccaaatcggcacgtggctgctggatagcgaagcactgcaccccttaggcatggcagtcaagtcgtcttag

SEQ ID NO: 241917 - DNA, 3456 bp, Artificial Sequence
  Description of Artificial Sequence: Synthetic coding sequence
atgagctctgagtgtgacggtgggtctaaggccgtgatgaacggtctggctccaggctctaacgggcaagacaaggctaccgctgacccacttagagcgagatccattagcgctgtgaaaatcatcccagttaagacggttaagaacgcatccgggttagtgctgcccaccgacatggatctgacaaaaatctgcaccggcaagggcgcagtaaccttgagagcctctagcagctatcgggaaaccccctcctctagtcctgcaagccctcaggagacaagacagcacgaatcgaaacccggattagagccagagccctcaagtgccgatgagtggagactctcaagttctgcggatgccaatggaaatgcccagcccagctctctggccgctaaagggtatcgctctgtgcaccctaatctgccgtctgacaagtctcaggacgctaccagctcttccgcggctcaaccagaagtgattgtggtgcccctgtacctagtcaatacggaccggggtcaggaaggcacagccaggccgccaactccactgggccctcttgggtgcgtgcccacgattccggcaaccgcatctgctgccagtccgctgacgttccctactctggatgacttcatccctccccacttgcaaagatggccacatcattctcagcccgcacgtgcctcagggagcttcgctcccatcagccagacaccccctagtttttccccccctcctcccctcgtccctcctgcacccgaagacctgaggcgggtctccgaacccgacttgaccggcgcagtgtcctccactgatagctctcccctactaaacgaggtctcatcctccctgatcggtaccgatagtcaggcctttccctcagttagtaagccatcctccgcttacccatctactacaattgtcaaccccactatcgtgctgctgcagcataacagagaacagcagaagagactgagcagtctgagtgacccagtctcagaaagacgggtgggtgagcaggactccgcacccacacaagagaaaccgactagccccggaaaggccattgaaaaaagagcaaaggacgactcccgaagggttgtgaaatcaactcaagacctttccgatgtgtccatggatgaagtgggcattcctttgcgcaacaccgagaggtctaaggactggtacaagaccatgtttaaacagatccataaactcaacagagatacgccagaagagaacccctactttcctacttataagttccctgagcttccggagatccagcagacaagtgaagagacaaaatcctgcagcgttatgtccccccgactggagtgctcaggtacagtcattgcccattgcagcctaaaactgctggactcctccaacccacccacgtctgcatcacaggtcgctggcactgccgacgacgactctgacctgtattccccaagatacagttttagcgaagataccaagtcccctctgtcagtgcccaggtcaaagtccgagatgtcctacatcgatggtgagaaggtcgttaagcgctcagcgaccttgccgctacccgctaggagttctagtctgaaatcctcaagcgaacggaacgactgggagccacccgacaagaaagtggatacgagaaagtacagggcagagcccaaatctatttacgaatatcaaccaggcaaatcatccgtgctgacaaacgagaagatgagccgcgatatctcccccgaagagattgacctgaagaatgagccttggtataaattctttagcgagctggagtttggcaagcccccaccaaaaaagatctgggactacacacccggagactgtagcatcctgccgagagaggataggaagaccaacctagataaggatctgagtctttgtcagaccgaactcgaagccgacctggaaaagatggagaccctcaacaaggccccaagcgccaatgtgccacagtctagcgctatctcccctactcctgaaatctcgagtgagacccctgggtacatctacagctctaacttccacgcagtgaaacgagagtcggacggcgctccaggtgatctgacatcactcgaaaacgagaggcagatttataagagcgtcctcgaggggggtgatattcccctgcagggtttgtccggcctgaagcggccttcaagctctgcctccactaaagattccgaatccccccgacattttatacctgccgattacctggaaagtactgaagaatttatcagacgtcgacacgatgataaggagaagcttctggctgatcagcgacgcctcaaacgcgagcaggaagaggccgacatcgccgcaaggcgtcataccggcgtgattcccacacatcaccagttcattaccaacgaacggttcggagatctactgaacatcgatgatactgcgaaacggaagagtggttccgaaatgaggcctgctcgcgctaagtttgattttaaggcccagaccctgaaggaactccctctacagaagggggacattgtgtacatatataagcaaattgaccagaattggtatgaaggtgagcatcatggacgggtcgggatcttccccaggacctatattgaactgttgccccctgccgagaaggcccagcccaagaaactgaccccagtgcaagtccttgaatacggagaggcgatagctaaattcaactttaatggggacacccaggtagaaatgtcatttcgaaagggagagagaattactctgcttaggcaggttgacgagaattggtatgagggcaggatccctggaacgagtcgacaggggatcttccctattacctatgtggatgttatcaagcgccctttagtgaaaaatcctgtggactatatggatctccctttttcatcgtcaccctctagatctgcgacagcttccccacaaccctggcgcgaagagtcagggcaatatgagcggaaagcggagagaggagcaggtgaaaggggtcctggtggaccaaaaatctccaagaagtcttgccttaaacctagcgacgtcgttagatgcttatccaccgagcagagactgtcagatctcaatacaccggaagagtctaggcccggtaagcccttaggaagcgctttccctggcagcgaagccgagcagactgagcgccaccgtgggggagagcaggcaggccgaaaggccgctcggagaggtgggtcccagcaaccgcaggcccaacagagacgtgtaaccccggataggagccagacgagccaggacttgttctcatatcaggctttgtattcatacatcccacagaatgatgacgagttggagctgcgggacggtgatatcgtcgatgtgatggaaaagtgtgacgacggctggtttgtgggcacctcaagacggaccaagcagtttgggaccttccccggtaattacgttaagcctctgtacttgtag

SEQ ID NO: 241918 - DNA, 2346 bp, Artificial Sequence
  Description of Artificial Sequence: Synthetic coding sequence
atgtctagtgaatgtgacggcggtagcaaggcggtgatgaacggcctggcaccagggtctaacgggcaggacaaagccaccgcagacccgctgcgcgctaggagtatcagtgccgtgaaaatcatacctgttaagacagtgaagaatgccagcgggctggtgctgccaactgacatggacttgaccaagatttgcactggcaagggcgcagtgactctcagggcgtcttcttcctaccgggagactccaagctcctctccagcatcaccccaggagactagacaacacgaaagtaaaccaggcctcgagcccgaaccctctagcgctgatgagtggagattatcaagttctgctgacgcgaacggtaacgctcagccatcctccttggcagcgaagggataccgctcagtccaccccaatcttcccagcgacaagagccaggatagcagccccctcctcaatgaagtgagcagctctctgataggcacggatagccaggccttcccgtctgtgagcaagccttcaagtgcttaccccagcacgacaatagtgaaccccacaattgtgctcctccagcacaatcgcgaacaacaaaagagactgagtagcctatcagatcccgtctctgagaggagggttggcgagcaagacagcgccccaactcaagagaaacccaccagtcctggaaaggccatagagaagcgcgcaaaggacgacagtagaagggtcgtcaaatcgacacaggatctctccgatgtgagcatggatgaggttgggatccctctgcgaaacaccgaacgcagcaaagactggtacaaaaccatgttcaaacaaatccacaagcttaaccgtgacgacgattctgatctctacagccctagatatagcttctcggaggatacaaagagtcccttgtcagtgccacgctctaagtctgaaatgtcttatattgatggcgagaaggtagtcaaaaggtcagcaaccctgccccttcctgcccgaagcagcagtctgaagagttccagtgagcgcaacgattgggagccccctgacaaaaaagttgacactcgaaagtaccgggctgagcccaaaagcatctacgagtaccagcccggtaaatcgagcgtgctgaccaacgaaaagatgtcttcggctataagtcctactcccgagatcagcagcgagactcctgggtatatctattctagcaacttccacgcggtcaagcgcgagagtgatggagccccaggagatttgactagcctcgagaacgaacggcaaatatataagtcggtgctggagggaggagacatacccctgcagggtctatccggtctgaagaggccatccagtagcgcctcaaccaaggacagcgaatctcccaggcacttcatccccgctgattatctcgagagtacggaggagttcattcgcaggagacacgacgataaggagaaactcctggctgaccagagaagactcaagagggaacaagaagaggccgacattgcagctagacggcatacgggggtgattccaacacatcatcagtttatcaccaacgagcggtttggcgacctccttaatatagacgatactgccaagcgcaagtccgggtcagaaatgaggccggcaagggcaaaattcgatttcaaggcccagactctaaaggaactgcccttacagaaaggggatattgtatacatttacaaacagatagaccaaaattggtatgagggggaacaccacgggcgagtgggaatcttcccaaggacatacatcgaattgttgccccctgccgaaaaggcccagccgaaaaaactgacccctgtccaggttctcgagtacggggaggcaatagctaagttcaatttcaacggggacacccaagtcgaaatgtcatttcggaagggggaaaggatcacccttttaagacaggtagacgagaattggtacgagggtcgcataccaggcacgagcaggcaagggattttccctatcacgtatgtagatgtgattaaacgccctcttgtgaagaaccctgttgactacatggatttgccttttagctcatctccctcccgaagtgccacagccagtccccagcagccgcaggcccaacaaaggcgcgtgactcctgaccggtctcagacatcacaggatctgttcagctaccaagccctctactcgtacataccgcagaacgatgacgagcttgagctgcgcgatggcgacattgtagatgtcatggaaaagtgtgatgacgggtggttcgtcggaacatccaggagaaccaaacagttcggcacattccccggaaactacgtcaagccactgtatttgtag

SEQ ID NO: 241919 - DNA, 2541 bp, Artificial Sequence
  Description of Artificial Sequence: Synthetic coding sequence
atgtcaagcgaatgcgatgggggaagtaaagccgttatgaacgggctggcgccaggtagtaacggtcaggacaaagccacagcagacccacttagagcccgtagcatatcagctgtgaaaatcattcctgtcaaaaccgtgaaaaacgcaagcggtttggttctgcctacagatatggatctcacgaagatctgcaccggcaaaggcgcagtgaccttgcgggctagctctagctatagggaaacacccagctctagtccagcctccccccaggagaccaggcagcacgagagcaagcctgatgaatggaggcttagttccagcgctgacgctaacggcaacgcccagccttcatcacttgctgcaaaaggctacaggtccgtccacccgaacctcccgtcagacaaatcccaggatagctcaccactgctcaatgaggtcagctcaagcttgatcgggaccgactcccaggcgtttccgagtgtatccaagccttcgagcgcctatccgtctacaaccatagtgaaccccaccatcgtgctgctgcaacataatagggagcaacagaaacggctcagttcactcagcgatccagtgagtgaacgacgggtgggggagcaggattctgccccaacccaagagaaacctacttctccaggcaaggcaattgaaaagagggccaaggatgacagccgaagggtggttaagtccacacaggatctgtcggacgtctccatggacgaagttggtatccctctgcgcaataccgaacggagcaaagattggtataagacaatgtttaagcagatccacaaactgaatcgggacactccagaggagaatccatactttccaacatataagttcccagagctcccggagatccagcagacttccgaggaagacaatccttatactcccacctaccagtttccagcatccaccccgtcccctaagtcagaggacgacgattcggatctgtacagccccagatacagtttcagcgaggacaccaagagtcctttgagtgtgcccagatcaaagtctgagatgagctacatcgacggagagaaggtcgttaagcgtagcgcaacactcccccttccagctcggtcttccagtctgaagtctagttccgaacggaacgactgggagccccctgacaagaaggtagataccaggaaatacagagccgagcccaaatccatttatgagtaccagcctggcaagtcgtcggttttaacaaatgaaaaaatgtcgagggacattagccccgaggagatcgacttgaaaaatgagccatggtacaaattcttcagcgagttggaatttggcaagcctagcagtgccatcagccccactcctgagatctcaagcgagacaccaggctatatttatagttctaacttccatgccgtcaaacgggaaagcgacggcgcacctggggatctgacctccttggagaacgaacggcagatctataagtccgtcctggagggcggagacatccccctccagggtttgtctgggcttaagcgaccgtcatcctcagctagcacaaaagatagcgaatcccctagacactttataccagccgattatttagaatccacagaggaatttatccgtcgacggcatgacgacaaagaaaaactcctggccgaccagcgtcgactgaagcgagaacaggaggaagccgacatcgctgccaggagacatactggcgtcatccctacccatcatcagttcatcaccaatgagaggttcggggacctgctgaatatcgacgatacagccaaacggaagtcaggatcagagatgcgcccagcacgcgcaaaatttgacttcaaggcccaaacgctcaaggagcttcccttacaaaaaggggatatagtctacatttacaagcagatcgaccagaactggtatgaaggggaacatcacggtagggtgggcatcttcccaaggacctatattgaattgttgcctccagcggagaaggcccagcccaaaaagttgacccccgtgcaggtactcgagtacggcgaagccatcgccaagttcaattttaatggcgacacccaggttgagatgtccttccggaagggcgagcgaatcaccctgctgagacaggtggatgagaattggtacgaggggcgtattcctgggacaagccgacagggtatttttcccatcacttacgtagacgttatcaagaggccactcgtaaaaaatccagtagattatatggacctgccattctctagttccccctccaggtccgctacagccagccctcagcagccccaggcccagcagcgacgcgtgacacctgatagatcacagaccagccaggacctctttagctatcaagcgctatatagctacattccacagaacgatgacgaattggaactccgcgatggagatatagtggacgttatggaaaagtgcgacgatggatggttcgtgggtacttcgagacgcaccaaacagttcggaacttttcccggaaactacgtgaaacctctctacctgtag

SEQ ID NO: 241920 - DNA, 2718 bp, Artificial Sequence
  Description of Artificial Sequence: Synthetic coding sequence
atgagctccgagtgcgacggaggctccaaggccgttatgaatggactggcaccgggatctaatggccaggacaaggcaaccgccgatccgctgagggccagatcaatcagcgccgtgaaaatcataccggtcaagaccgtgaagaatgcctctgggttggtgctccctaccgatatggatttgactaaaatctgcactgggaaaggcgcagtgaccctcagggcatcttccagttaccgggaaaccccctctagtagccccgctagtccccaggagacccgtcagcacgagagcaaacctggcctagaacccgaaccctctagtgctgacgaatggagactgtcctcctctgccgatgccaacggaaatgcgcagccttcatcattagcagccaagggatacaggtcggtacatcccaatctcccaagcgataagtcccaacgatggcctcaccacagtcagcctgcgagggcctctgggtctttcgcgcctatctcccagactcccccttctttcagcccaccgcctccactggtgccccctgcacctgaggacctcagacgcgtatccgagcccgatctgaccggagcagtgtcatccactgattcctctcccctattgaacgaagtgtctagctccctcattggaacagactcccaggcttttccaagcgtaagtaagccatcgtcggcttaccccagcactacaatcgtaaacccaactatagtgctgctgcaacataatagggagcaacagaaacgtctgagctccctgtcagaccccgtgagtgaacgacgtgtcggcgagcaggacagtgccccaacccaggaaaaaccgacgtcaccaggtaaggccatcgaaaagagagcaaaggacgactctcgaagagttgtgaagagcacccaagaccttagcgacgtgagtatggacgaagttggcataccgctgcgtaataccgagaggtccaaagattggtacaaaacaatgtttaagcaaatccacaaattgaatcgcgatgatgattcggacctctacagtcccagatacagctttagcgaagatactaagtccccactctccgttcctcggtccaaatctgaaatgtcttatattgatggcgagaaagttgtcaaaaggtcagcaaccctgccccttcccgcaagaagttcctccttgaaaagctcctctgagcggaatgactgggagcctcctgacaaaaaggtcgatacccgcaagtatcgggctgagccaaaatcgatctacgagtatcagcctggcaaaagcagcgtgctgacgaatgaaaagatgagtcgtgacatctcacctgaagaaatcgacttgaagaatgaaccatggtacaagtttttttccgaactcgagttcggcaaaccaccgccaaagaaaatttgggactacacgccaggcgactgttctatactgccgagggaggatcgtaaaagctcggcgatctcgcctacaccggaaatctctagtgaaacccccggatatatctacagctcaaatttccatgccgtcaaacgcgaaagtgatggcgcacccggtgaccttacatcattagaaaacgagagacagatttataagtctgtgctggagggtggcgacattccactgcaaggcctatcaggactgaagcgcccttctagcagcgcatcaacaaaggattctgaaagtccacgtcatttcattcccgcagactaccttgagagtaccgaagaattcattaggcggaggcacgacgataaggagaagctgctggccgatcagcgcaggctgaaaagagagcaggaggaggccgatatagccgctaggaggcacaccggcgtcatacccacacatcatcagtttataacgaatgaaaggttcggcgatctgctcaacattgacgacacggccaaacgcaagtccggatcggaaatgcgtccagcaagggcgaagttcgacttcaaagcgcagactctcaaagaacttcccctccagaaaggggatatagtttacatctacaagcaaattgatcagaattggtacgagggcgagcatcatggcagagtcggcatctttcctcgcacttatattgagctcttacctcctgcagagaaagctcaacccaaaaagctaaccccagtgcaagtattggagtatggggaggccatcgccaagttcaattttaacggcgacacccaggttgagatgtccttccgcaagggggagaggattacactgttacggcaggtggatgagaactggtatgaaggcagaatcccaggaacttctaggcagggcattttcccaataacatacgtcgatgtgatcaagagacccttggtaaaaaaccctgtcgattacatggacctgcctttttccagcagcccctctcgatcggcaacagccagtccccagctgagccaccacagcctccgcgctggaccggacctgacggagtcagagaaatcctacgttcaaccccaggctcagcaacggagagtgacccctgaccgtagtcagaccagtcaggatctattctcataccaggcgctgtacagctatatcccacagaatgacgatgaacttgagttacgggatggcgatattgtggacgtcatggaaaaatgtgacgacggttggtttgtggggacgagtagaaggacaaagcaatttggaacattccctgggaattatgtcaaacctctctacctgtag

SEQ ID NO: 241921 - DNA, 3015 bp, Artificial Sequence
  Description of Artificial Sequence: Synthetic coding sequence
atgagctcggagtgcgacggcggaagcaaggcggttatgaacggtctggcccctggcagcaatggtcaggacaaagcaacagccgatcccctccgtgcccgtagcatcagtgctgttaaaataataccagtcaaaaccgttaagaatgccagcggtctggtgttaccgaccgacatggacctcactaagatctgtacaggaaagggagccgtcacactgcgcgcttctagttcttaccgagagaccccctcctcaagccccgcttcccctcaggagacacggcaacacgaatccaaacctgacgaatggcggctgagctccagcgccgatgcaaatggaaacgcacagcccagttctctggccgctaaggggtacaggtctgtgcaccccaacctgccaagcgacaaatctcaagacgccactagctctagcgccgcacagccagaagttattgtggttcctctctatttagttaacactgatcggggtcaagagggtacagcacgtcctccaaccccacttggccctcttggttgcgtccctactatccctgctacggctagtgcagctagtcccctcacttttcccactcttgacgatttcatccctccacatttacagaggtggccccaccactctcagccagcaagggcgtcaggatcctttgcccctatttctcagacccctccttccttttcaccaccccctcctctcgtccccccagcccctgaagatctgagacgcgtctctgaacccgatcttaccggagccgtctccagtacagactcgtcccctttacttaatgaggtgtctagtagcctgattggtactgattcccaggccttcccctcggtgtctaaaccttcttctgcatatccatctacaacaatcgtcaatcccaccattgtactactgcagcacaatcgagagcaacagaaaaggctgagcagcctctcggacccagtgagtgaacgcagggtcggcgagcaggacagcgccccaacacaggaaaaacctaccagcccaggtaaagcaatagaaaaacgcgctaaggacgactcccgcagagtggttaaatccacccaagatctcagcgacgtgtctatggatgaggtggggattccgctgcgcaatacagaacgttcgaaggactggtacaaaacaatgttcaagcagatacacaagttgaatcgggataccccagaggagaatccttacttcccaacttataagtttcccgagctgcccgagatccagcagacctccgaggatgatgatagcgacttgtattcacctaggtatagcttttccgaagacacaaagagccctctatctgtgcccagatctaagtctgagatgtcttacattgacggcgagaaagtcgtcaaaaggagcgccacattacccctccccgctcggtctagctcactcaaatcaagctccgagcggaacgactgggagcccccagacaagaaggttgatacccggaagtaccgggctgaacccaaatcaatctacgagtaccagcccggtaaatcaagcgtcctgaccaatgagaagatgtcacgagacatctctcccgaagagattgatctcaaaaatgaaccatggtacaagtttttcagcgagctggagtttggcaagccccctcccaagaaaatatgggattacaccccaggggattgctcaattcttcctagggaggaccggaaaaccaatctggataaggaccttagcctctgccagactgagctggaagccgacttggaaaagatggagaccttgaataaagccccaagtgccaacgttccgcagagcagcgccataagccctacacccgagattagttcagaaactcctggatatatctacagtagcaactttcacgccgtcaaaagggagtccgatggggcacccggagacctaacatccctggaaaatgagcggcagatatacaagtctgtcctggaggggggagatatcccattgcagggacttagcggactgaaaaggccatcctcttcagccagtacaaaagactctgaatcacctcgacactttatccctgcagattatttggaatctacagaagagttcattcggagaaggcacgatgacaaggaaaagcttttggcggaccaaaggcgtctgaaacgcgagcaggaagaagcggacatcgccgctcggaggcataccggagtgatacccactcaccatcagtttatcacaaatgagcgctttggggatctgttgaacatcgacgatactgccaaaaggaagtccggcagcgaaatgaggcccgctagagccaagtttgacttcaaagcacagacccttaaggagctgccccttcagaaaggcgacatagtgtacatttataagcagattgatcaaaattggtacgaaggcgagcaccacggtagggtaggtatcttccccaggacctacatcgagctcctgccacctgctgaaaaggctcagcccaagaaattgacccccgtgcaggtactggagtacggcgaggccatagccaagtttaacttcaacggggatacacaggtagaaatgagctttagaaagggtgaaaggatcactctcttgagacaagtggacgaaaactggtacgagggaaggatacccggaacttctcggcagggtatttttcctatcacctacgtggacgtaataaagagaccgcttgtgaagaaccccgtggattacatggacctgccttttagcagttccccgagtagaagtgctaccgcgagtccacaacagccccaggcccagcaacggagggttacacccgatcgcagccagacttcccaagatttgttctcctatcaggctctatactcctacatcccacagaatgatgatgagctggaactccgtgacggcgatatcgtggacgtcatggagaaatgcgatgacggatggttcgtcgggacgagtcgccgaaccaaacaattcggaactttcccaggcaactatgtgaaacccctgtacctgtag

SEQ ID NO: 241922 - DNA, 3879 bp, Artificial Sequence
  Description of Artificial Sequence: Synthetic coding sequence
atgtcctccgagtgcgacgggggatcaaaggccgttatgaatggcctggccccaggttcaaatgggcaggataaggccactgccgaccccctgagggccagatcgataagtgctgtgaaaattattcccgtgaagacggttaaaaacgcgtcaggtcttgtactccctacagatatggatcttacaaagatctgtacggggaaaggggctgtgacactgcgtgcatccagcagttatagggagaccccatcttcctcccctgctagtccacaggagacgcggcagcatgagagcaagcccggtttagaaccagaaccctcctcagctgatgagtggcggctgagcagctcagcagatgcgaatggtaacgcccagccctctagcttagctgcgaagggatatcgatccgttcatccaaaccttcctagtgacaaatcacaggacgccactagttccagcgctgcacagcctgaggtgattgtggtgcccctctacttggtgaatacagataggggacaggaaggcactgccagaccacctacgccacttggacctctgggatgtgtgccaaccatccccgctacagcttctgcagcctcccctctgaccttccctaccctggatgactttatccctccacacctacagcgatggccacatcactctcagcctgctcgcgcaagcgggagcttcgcccctataagccagacccccccatctttctcccccccaccgcctctcgtccctccagctcctgaggatttgaggcgcgtgtctgaacccgacctcactggggcagttagttccacagactcatctcctcttctcaatgaagtgtcgtccagcctgatcggcacagatagccaggccttcccatcagtaagcaagccttcttctgcctatcctagtactaccatagttaaccctacaatcgtattgctgcaacataatagggagcagcagaaaaggctgtcctctctgtccgaccccgtctccgaaagaagagttggagaacaggactccgcaccaacccaagaaaaaccaacttcaccaggcaaggctatcgaaaagagagctaaagatgatagtcgtagagtcgtgaagtccactcaggacctttcagacgtgagcatggatgaggtggggattcccctacgaaacaccgagcggtcaaaggattggtataaaactatgttcaagcagatccataaactgaatagggacactcccgaggaaaacccctacttccccacttacaagtttcctgaattgccggaaattcagcagacatctgaagaagataacccatacacaccgacatatcagttccctgcctccaccccctcccccaagtctgaggacgatgattcggatttgtattcgcctcgatactctttctcggaagatacaaagtcacccctttccgtgccacgcagtaagagcgagatgtcttacatcgatggagaaaaagttgtgaagagaagcgccaccctacctctgccagcgagatcctcttctctgaagtcaagttctgagcgcaatgattgggaacctccagacaagaaggtggacactcggaaataccgcgctgaacccaagtccatttatgagtatcaaccgggtaagtcatctgtgttgaccaatgagaagatgagtcgcgatatttctcctgaagagatcgacctgaagaatgaaccttggtacaagtttttcagcgaactcgagttcgggaaaccgccacctaagaaaatatgggattatacccctggagattgctccatcctgccacgcgaggatcggaagactaaccttgataaagacctttccctgtgccagactgagctggaagccgacctggagaaaatggagacactcaataaggcaccaagtgctaacgttcctcagtcctccgctatctcacccacccctgagatttcgtccgagacgcctggctacatctactcaagcaacttccatgccgtgaagcgagagtcagacggcgctcctggcgatctcacctcccttgaaaatgaacgacagatttacaagtcagtgttagaaggaggagacatccctcttcagggactgtccgggctcaagcgcccatccagctcagccagcacaaaggactccgaatcaccacggcatttcatcccagcggactacctggagtctaccgaagagtttatccggcgacgacacgacgataaggaaaaactgctcgctgaccaaaggcggctgaagcgagagcaagaagaggctgatatcgccgcacggagacacacaggcgtgattccaacacaccaccagttcattacaaatgaaagatttggcgatctgctgaacattgatgataccgccaagaggaagtctgggagcgaaatgaggccggctcgcgctaagttcgactttaaagcccagacgttgaaggagctgcctctacaaaagggggacatcgtgtacatctataagcagattgaccaaaactggtacgagggggaacaccacggcagggtgggaatttttccgcgtacctatatcgaacttcttccccctgcagagaaagcacaaccaaagaaactaaccccagttcaggtgttggaatacggggaagcaattgccaagtttaatttcaatggagatacacaagtagaaatgagtttcaggaaaggggagagaatcaccctgcttcgccaagtcgacgaaaattggtacgaaggtcgtatcccagggacttccaggcaaggtatctttcccatcacatacgtggacgttatcaagcggcctttggttaagaacccagtggactacatggatttgccattttcatcgtctccgagcagatccgctactgcttctccacagttttcaagccacagcaaattaatcacccccgctccgtctagcctgcctcacagccgcagagctcttagccctgagatgcacgctgtaacatccgagtggatcagcctcaccgtgggcgtccctgggcgtcgatccctagccctaacccccccactccccccactgcctgaggcctctatttataacaccgatcacttagcgcttagtccacgagcatcccccagcctgagcttgtccctgcctcacctgagctggtcggaccgaccaacgcccagaagcgtcgcctctcccctggcacttccttctccacacaagacatatagcctggctccgacctcacaggcctctttacacatgaacggagatggaggggtccacacaccttcctctggtatccaccaggatagcttcctgcagttgcctctcggctctagcgattctgtgattagccagttgtccgacgcctttagttctcagtccaagcgtcagccatggcgcgaagaatccggccagtacgagcgaaaggccgaacgcggtgctggcgagagaggacccggtggcccaaaaataagcaagaagtcttgtctgaagcctagcgatgtggtaaggtgtctgtccactgagcagaggctcagcgatctgaacactccagaggagagccggccaggaaagcccctgggttctgccttccctggttcagaagccgaacagactgagaggcatagggggggtgagcaggcaggccgaaaagcagcccgacgagggggttctcagcagccccaggcccagcagcgcagggtcacccctgatcgatcccagacttcacaagatctattttcctatcaggctctgtacagctacataccccaaaacgacgatgaactcgagttacgcgatggagacattgtcgacgtcatggagaagtgtgacgatggctggttcgttggaacctctcgaaggacaaagcaatttggcacatttccaggaaactatgtgaagcccctttatctttag

SEQ ID NO: 241923 - DNA, 3801 bp, Artificial Sequence
  Description of Artificial Sequence: Synthetic coding sequence
atgtcatccgagtgcgatggaggatccaaggctgtgatgaacgggctggctcccggtagcaatgggcaggataaagctaccgcagatcccttgagggccaggagcatttccgccgtgaaaatcataccagtgaagaccgtgaaaaacgcgtcaggcctggttctgcccaccgacatggatcttactaaaatctgcactggcaagggagcagttacccttcgggcttcgagcagctaccgtgaaaccccaagcagcagtcctgcctcccctcaggaaacgagacagcacgagtccaagcctggtctggagcctgaaccaagttcggctgacgagtggcgcttatccagctctgccgatgctaacgggaacgcacagccatccagcctggcagcaaagggctacagatcggtccatcctaacctgccctccgataaatctcaggacgctacctcttcgtccgccgcacagccagaggtgatcgtggtgcccctctatcttgtgaacaccgatcggggtcaggaggggacggccagaccacctacacccttaggccctttaggctgtgtgcccaccatcccagcaactgcttccgcagcctcaccattgacttttcccacgttagacgacttcataccccctcacttgcagaggtggccacaccactcccaacctgcccgagcatccggtagttttgcaccgatatctcagacgccgccaagcttcagccctcctcctccactagtcccaccagctcctgaggatttgcgaagagtgtcagagccggacttaacaggggctgtaagctctacagactcttccccactgctgaatgaagtgtccagttcactcatcggaacagactctcaggccttccctagcgtatctaaaccctcgtctgcctacccttccaccactatcgtcaaccctaccatcgttctcctgcagcacaatcgtgagcagcagaaaaggctgagtagtctttcagatccagtgagcgagaggcgggttggtgaacaggatagcgcacccacgcaggaaaaacccacctcgccagggaaagcaatcgaaaaacgcgctaaagatgacagcagaagagtggttaagtctacacaggacctgagcgacgtctctatggatgaagtgggcatccctcttaggaacacagagagaagcaaggactggtataagacaatgttcaaacaaattcataagctgaatagggatgacgactctgatctctactctccaaggtattctttcagtgaggacactaaatctccgctttcagttcctcgttctaaaagcgagatgtcctacattgacggcgagaaggtggtgaaacgatccgctactctgccattgcctgcgaggtcgtcttctctgaaatcaagctctgagagaaacgactgggagccccctgacaagaaagtggacacccggaaataccgggctgaacccaagagtatatatgagtaccagccaggaaagagttctgtactcactaacgaaaaaatgagccgcgacatcagccccgaagaaattgacctaaagaacgagccttggtacaagttcttttcagagctggagtttgggaaacccccacccaaaaagatttgggattacaccccaggagactgttcgattctgccgagggaagaccgcaagaccaacctggacaaagacctcagcctttgccaaacagagctggaagcggatctggagaagatggagactttgaataaagctccctctgccaacgtgccacagagcagcgcaataagcccgactccggagatcagctctgaaacacctgggtatatttactcctctaattttcatgccgtcaagcgggagtccgatggtgccccaggtgatctcacgtctctggagaatgagcgccagatctacaaatcggtacttgaagggggtgatatccccctacaaggattgagcggcctgaaacggccttccagttcagccagcacaaaggacagcgagtctccacgacacttcatcccagcagattacctcgagtctaccgaggagttcattaggcggagacacgatgataaagaaaaattgctcgccgaccaaagaaggctgaagagggagcaggaggaggctgacatcgctgccagaagacacactggggtgattcctactcaccaccagttcatcacaaacgaacgcttcggagatttgctgaacatcgacgataccgccaaacggaagtcaggatctgaaatgagacccgcacgcgctaagttcgacttcaaagcccagaccctgaaggagttgcctctgcagaagggggacatagtctacatctataaacagatcgaccagaattggtacgagggggaacaccatgggagggtcgggatcttcccgaggacctacattgagctgctgcccccagcagaaaaagcccagcccaaaaaactgacgcccgttcaggtcttagagtacggagaggccatagccaaatttaatttcaacggcgatacgcaagtagaaatgtcttttcgcaaaggggaacggatcacccttctcagacaggtagacgaaaattggtacgaggggaggatcccaggaacttcccgccaagggatctttccaatcacttatgtggacgtcataaaacgccctctcgtgaagaatcctgtggactatatggatttacccttttcatcctccccctcccgctccgccactgctagcccccaatttagtagtcatagtaaactaatcacaccggctcctagctcacttccccatagccgcagggctctctcccccgaaatgcacgccgtgacttctgaatggatttccctgacagtaggcgtacccggtcggcgaagtctggcacttacgccaccattgccaccactacctgaggcgagcatttacaacaccgaccacctcgcattgtcgccgagagcttccccctctctgagcctgagcttgccccacctgagctggtccgatcgccctactccaaggtctgttgcaagcccgttagcgcttccctcccctcataagacgtacagcctggctcctacatcacaggcaagtcttcacatgaacggtgatggtggcgttcacactccctcaagcggaatacatcaagacagttttctgcagttacccctagggagcagcgatagcgtcataagccagctgagtgacgcgtttagctctcagtcaaagcggcagccttggcgggaggagagtggccagtacgaaagaaaggccgaaaggggcgcaggcgagcggggtccaggagggccaaaaattagtaagaaaagctgcctcaaacccagtgatgttgtacgctgtctgtctactgagcagcgcctgtctgacctgaatactccagaggaatcacgacccggaaaacctcttggaagcgctttccccggatctgaagcagagcaaactgaacggcatcgaggcggagaacaggccggacgcaaggctgctaggcgagggggaagccagttgtcccaccactcactgcgagctggaccagacttgacagaaagcgagaaatcttatgtgcagccacaagcacagcaaaggcgtgtgactcctgaccggagccagaccagccaggaccttttctcctatcaggctctctacagctacattcctcagaacgatgatgaattggagctgcgagacggggacatcgtcgatgtgatggagaagtgcgatgacggctggttcgtcggaaccagccgacggactaagcagtttggcaccttcccgggaaactatgttaaaccactctatctctag

SEQ ID NO: 241924 - DNA, 2436 bp, Artificial Sequence
  Description of Artificial Sequence: Synthetic coding sequence
atgtcttctgaatgcgatgggggaagcaaagcagtgatgaatgggctggcacccggatcaaatggccaggataaggatatggatctgactaagatttgcaccggtaagggagcagtaaccctgagggcttcaagtagctatcgagaaaccccttcctcgtcgcctgcaagtccgcaagaaaccaggcagcacgagtcaaagcccggacttgagcccgagcctagttccgcagatgaatggcgcctcagctccagtgcagacgcaaatgggaatgcccagcctagttcattggctgctaaaggataccgcagtgtgcacccaaatctcccttcagataagagccaggattcatcccccctccttaacgaggtgagctcgtcccttatcggaaccgattcgcaggcgttcccaagcgtgtctaagccctccagtgcgtatccatccactacaattgtaaatcccactatagtgcttctgcaacataatcgcgagcagcagaaacgccttagctccctctccgacccagtgtcagagcgaagggtgggagagcaagactctgcgcctacccaggaaaagccaactagcccagggaaggccattgagaagagggccaaggatgactcccgcagggttgttaagagcacgcaggatttatcagacgtgtcaatggacgaggtggggatccccctccggaatacggagagatctaaagactggtataaaacaatgttcaaacaaatacacaaactcaatcgcgatgatgactccgatctttacagcccgcgttattccttcagtgaagacactaaatcacctttgtccgtgcctcggagcaaatctgaaatgtcatatattgatggagagaaggttgtaaaacggtccgccaccctgcccctcccagccaggtcgtcatctcttaaatcgtcctcggaacgcaacgactgggagccacccgacaagaaggtggacacacgcaaatatcgcgcagaaccaaagagcatatacgaatatcagcctgggaagagtagcgttctgaccaacgaaaaaatgagccgagacattagcccagaagaaatcgacctcaagaatgaaccttggtacaaattcttttccgaactagaattcggaaagccaacaaatttggacaaggacttgtctctgtgtcagacggaactggaggcagacttggaaaaaatggagacccttaataaagcccctagtgccaatgtgcctcagtcaagcgccattagtccaacacctgagatctcttctgagaccccgggttatatctactcaagcaactttcatgctgtcaaaagggagtcagacggcgctcctggcgacctgacatccctggagaatgaacgccagatctacaaaagcgtcctcgaggggggtgacatcccacttcagggcctgagcggccttaagagaccatcttcatcggccagtaccaaagattccgaatcgcctcgccactttattcctgcagattacctggaatcaacagaggagttcatcagacgaaggcatgatgacaaggaaaagcttttggctgatcaacgccgactgaagcgcgagcaggaagaggccgatatagccgctaggagacatactggagtgattccgacccaccatcaattcatcaccaacgagcggtttggagacttgttgaacatcgacgatactgctaaaaggaaaagcggaagcgagatgcggcctgcgcgagccaagtttgactttaaggctcagacgctgaaagagctacccctgcagaagggcgatatcgtgtacatctataagcagattgatcagaattggtacgagggcgaacatcatgggagggtggggatctttccgaggacgtacattgagctcctcccgcctgcagagaaagctcaacccaagaagttaacaccggtgcaggtgttggaatacggagaggccatcgccaaattcaactttaacggagacacgcaggtggagatgtcttttcgaaagggcgagcggatcacactgttaaggcaggtcgacgagaattggtacgaaggtcggattcccggaacatctagacaggggattttccccatcacctacgtcgatgttatcaagagaccgctcgtgaagaaccctgtagattacatggatcttcccttctccagtagcccctctcgctcagccaccgctagtccccagcaacctcaagctcagcagcgccgagtaactccggatcgtagtcaaaccagccaagacctgttcagctaccaggcactatattcttacatccctcagaatgatgacgaactggaacttcgcgatggcgacatagtagacgtgatggagaagtgcgatgatgggtggttcgtggggacgagtcggaggacgaaacagtttggcacatttcctggcaattatgtgaaacccctctacctgtag

SEQ ID NO: 241925 - DNA, 2055 bp, Artificial Sequence
  Description of Artificial Sequence: Synthetic coding sequence
atgagttccgaatgtgacggtgggtcaaaggcagtgatgaatggcctggccccaggctctaacggccaagataaagacatggacctgactaaaatctgcacaggcaaaggggctgtgactctaagagcatcttccagttatcgagagaccccgtcatctagtcccgcttctcctcaggagacgaggcagcatgaatccaagcccgacgaatggcggctgagcagctccgctgatgctaacggaaacgcccagccatccagcctggctgccaagggctataggagcgtacatcctaacctaccctctgacaaatcacaggactcctcaccactcctgaatgaagtgtcttcaagtctgatagggaccgactctcaggcgttcccaagtgtctctaagcccagtagtgcatatcccagcaccactatcgtgaaccccaccatagtgttgctgcagcataacagggagcaacagaaaaggttgtcaagcctaagcgatccagtaagcgagaggcgggtgggagagcaggattctgctcccacacaggaaaaacccacaagccctggaaaggccatagagaagagggctaaggatgacagcaggcgagtggtcaagagcacccaggatttgtcagatgtttcaatggacgaagtgggaatacctctgagaaatacagagcgctcaaaggactggtataagacaatgtttaagcaaattcacaagcttaacagagacgacgactctgacctatacagtccgagatactccttttccgaagacaccaaaagccctctctccgttccaaggagcaaaagcgagatgtcctacatcgacggggagaaggttgtaaagagatctgccactctgccattgcctgctagatctagctccttaaagtcttccagtgaaaggaacgactgggaaccacccgacaaaaaagtggacacacgcaaataccgggctgagcccaaatctatctacgagtatcaaccagggaagagttcagtgttgacgaatgagaaaatgtcctccgctatcagccctacccctgaaatttccagcgagactccagggtacatttactcgtccaatttccatgccgtcaaaagggaatcagacggggcaccaggagacctgacgtcactagaaaatgagcgtcagatttataagtcagtgttggaggggggagacattccattgcagggactgagcggtcttaaacggccaagctctagcgcctcaacaaaagatagcgagtctccaagacacttcattcctgccgattatctggagtcaaccgaagaattcattaggcgcagacacgacgacaaggagatgaggccggctagggcaaagtttgattttaaagctcaaaccttaaaagagctaccattacagaaaggggacattgtatacatctacaagcagattgatcagaactggtacgagggggagcaccacggcagggtgggcatttttcctagaacctatattgaattgctccctcccgcagagaaagcccagcctaaaaaactgacaccagtgcaagttctggagtacggtgaggctattgctaagttcaacttcaacggagatacacaggtagaaatgtcattccgaaaaggcgagcgaatcactttgttgcgtcaagtggacgagaactggtacgaggggagaatcccaggtacaagccggcagggaattttccccattacctacgtggatgtgataaagagacctttggttaagaacccagtggactacatggacctgcctttctcctcctcccccagcaggtctgcgacagccagtccccagcaacctcaggcgcagcagagacgggtgactcccgaccggtcccaaacgagtcaagacttgttctcatatcaggctctatacagttacattccccagaatgacgacgaactggagttaagggatggcgacattgtggatgttatggaaaaatgtgacgacggttggttcgtaggaacaagcaggagaaccaaacagtttgggacttttcccggtaactacgtgaagcctctgtatctgtag

SEQ ID NO: 241926 - DNA, 2718 bp, Artificial Sequence
  Description of Artificial Sequence: Synthetic coding sequence
atgagttccgagtgcgacgggggaagcaaagccgtgatgaatggcttggcacctgggtcgaacgggcaagacaaagctacagcagatcctctcagagccagatctatttcagccgttaagattatccctgttaaaaccgttaaaaacgcctcgggccttgtcctccctactgatatggatctcactaaaatctgtacggggaaaggtgcggtgacactccgggcatcctcttcctaccgcgagacacctagctccagcccagcttccccccaggaaaccaggcagcacgaatcgaaaccgggtttggaacccgagccaagctcagccgatgaatggaggctgtcttctagcgccgacgctaacgggaacgcacagccctctagcctggccgctaagggctacagatcagtgcaccccaacctgcccagcgacaagtcccagcgatggccccaccactctcagccagccagggcctctgggagctttgctcccattagtcagacacccccaagtttttctccaccccctcccctggtgcctcccgcacctgaggatctgaggcgcgtgagtgaaccggatctcacgggggctgtgtcctctactgatagcagcccgctactgaatgaggtctccagctccttgatcggtaccgactcccaggctttcccctccgtatcgaagccatcctctgcttacccctctacaacaattgtcaaccccactatcgtgctgctccaacataatcgggagcaacagaaacgcctctcatccttgagtgaccccgtttctgaacgaagagttggcgaacaagactcagcccctactcaggagaaacctacctcaccaggcaaggctatcgaaaaacgtgccaaagacgactccaggagagtggttaagagcacacaggatctgtccgatgtctctatggacgaggtggggattcctctgcggaacactgaacgttctaaggattggtataagacaatgtttaagcagatccacaagctgaaccgtgacgatgattccgatctatactccccacggtactccttttcagaagacacaaagtcccctttatctgtacccaggagcaaatctgagatgtcctacatcgatggagaaaaggtagtcaagcgttctgcaaccttgccgttgcctgccagatcctccagcttgaagtcaagttccgagagaaacgactgggagccacctgataagaaggttgataccagaaagtacagggccgaacccaaaagcatctacgagtaccagcctggcaaaagctccgtcctcaccaatgaaaaaatgtccagagatatttcaccagaggagatcgacctgaaaaacgaaccttggtacaagttcttcagtgaactggagtttggcaaacccccacctaagaaaatctgggactatacacccggagactgctctatacttcctcgggaagaccgcaagtcaagcgccatatcaccgactcctgagatatcctctgagacccctggctacatatactcttccaatttccatgcggtcaagcgcgaatcagacggcgctccaggtgacctaactagcttagagaatgaacgacagatatacaagtcagtactggagggaggcgatatacctctccagggcctgtccggacttaagcggccttcaagtagtgcctctacaaaggattcagagagccctcgacactttattccggctgactatttggagtcgaccgaagaattcattagaagacgccatgatgacaaggaaaagttgctggctgatcagcgcagacttaagcgcgagcaggaagaggcagatattgctgctaggcggcataccggcgtaatacctactcaccatcaatttattacaaacgagaggttcggcgacctgctgaacatcgacgacacagcaaagagaaaaagcggaagcgaaatgaggccagccagagccaagtttgatttcaaagcccaaaccctgaaagaactacctctccaaaaaggcgatatcgtgtacatatacaaacagatcgatcagaattggtacgagggtgagcatcatggcagggtgggcatctttcctcggacctatatcgagctgctgcctcccgctgaaaaagctcagcctaaaaagcttacacccgtacaggtgctcgagtacggagaagcgattgcgaagtttaattttaatggggacacccaagtggaaatgtccttcagaaagggagagagaatcacattgctgaggcaggttgacgaaaactggtatgaggggaggattcccggaacttcaaggcaaggcattttccctatcacgtacgtggatgttattaagcggcctctcgtcaagaacccggtggactatatggatctgccttttagctcatcaccctcccgaagcgccacagccagcccacagctttctcatcacagcttaagggccggaccagatctgaccgagtctgagaaatcctacgtccagccccaggctcagcagcggcgagtcacccctgaccgctcccagacgagccaagacttattcagctaccaggcattatatagttatatcccacagaatgatgatgagcttgagctacgtgatggcgatattgtggatgtgatggagaaatgcgatgacgggtggttcgtgggaacttcgcggagaaccaaacaattcggtaccttcccaggcaactatgtgaaacccctgtatctgtag

SEQ ID NO: 241927 - DNA, 3456 bp, Artificial Sequence
  Description of Artificial Sequence: Synthetic coding sequence
atgtcatctgagtgtgacggcggaagcaaagccgtgatgaatggcctggcgcctggctctaacggacaagacaaagctacagcagaccccctgcgggcaaggtcaatctctgccgtgaaaatcattcccgtgaagaccgtaaaaaacgcctcaggccttgtcctgcccacagatatggacttgactaagatctgcacgggaaagggcgctgttactctccgggcttcttcgtcctatcgggagaccccaagtagctctcctgcctcaccccaggagactcggcagcatgagtccaagcccggattggaacctgagccctcctccgcagatgaatggagactgagcagttccgcagatgcgaatgggaatgcacagccctcttctcttgccgctaaaggctacagatctgtgcatccaaacctgccctcagacaaatctcaggatgcaacaagctcttctgccgcacaaccggaggtaatagtggtaccattgtacctggtcaacacagatcggggacaagagggaaccgccagacctccaactccactgggcccactaggttgcgttcccacaattcccgctactgccagtgcggcttcccctctgacgtttcctacactcgatgattttattcccccacacctgcagcgctggccccaccatagtcagcccgctcgggcttccgggtcctttgcgccaatttcgcaaactcctccttctttttccccaccaccaccacttgtgcctcctgccccagaggacctgagaagagtatctgaaccggacctgaccggagccgtcagcagcacagactcctcacccctgttaaacgaggtgtcatctagcctaatcggcacagattcacaggccttcccctctgtgagcaagccatccagtgcatatccatccacaacgatcgtgaatcctaccatcgtgctcttgcaacacaatagggaacagcagaaaagattaagcagtctgtctgaccccgtgagtgagcggagagtgggagaacaggattctgcaccaacacaggaaaaacccacctcacctggaaaagccattgaaaaacgagcaaaagacgattcacggagagtggtgaagtccacccaggacctgtcagacgtgtcaatggacgaagttggaattccgctgcgcaacacggaacggtccaaggactggtataaaacaatgttcaagcagattcacaaactgaaccgtgatactccagaggaaaatccttattttcccacctataagtttcccgaattgcccgagattcagcaaactagcgaggagacaaagtcatgctcggtgatgagtcccagactcgagtgctccgggactgtgatcgcacattgttcacttaagctgctggactctagcaatcctcctacatctgcgtctcaggtggctggtaccgcagacgacgacagcgacttatactccccaaggtactctttcagcgaagacacaaaaagccctctatccgtcccacgctctaagtccgagatgtcctacatcgatggtgaaaaggtggtgaagagatctgccaccttgcctctacctgccaggtcttcgtcgcttaaatcaagttcggaaaggaatgactgggagcctcccgacaaaaaagtggatacacgaaaataccgggcagaacctaagtcaatctacgagtatcagccaggaaaaagcagcgtgctgacaaacgaaaagatgtctagggatatcagccccgaggaaatagaccttaaaaacgaaccttggtacaaattcttcagcgagctggagttcggtaagccacctccgaaaaagatatgggattatacacctggcgactgcagtatactgccacgcgaggatcgtaagacgaaccttgacaaagatctgagcttgtgtcaaactgaactggaagcagatctggagaaaatggagaccctcaataaggcaccaagcgcaaatgttccccagtcgagtgctatctcccctacaccggagatttctagcgaaactccaggttatatctattcttcaaacttccacgccgtgaagcgagagtctgacggggctcctggcgacctaacttccctcgagaacgagcggcagatctacaaaagcgtcctagaaggcggagatatcccactgcagggcttgagtggtttaaagaggcccagcagcagtgcctctaccaaggatagcgagtctcccaggcattttattcctgcggactatctggagagcacagaggagtttattagacggaggcacgacgataaggaaaagttgctggctgatcagcgcaggctcaagcgcgagcaggaagaggctgacatcgccgctaggcgacacactggcgttattcccacacaccatcagttcatcacgaatgagcgcttcggcgaccttttaaatattgacgacaccgcaaaacgcaagagcgggtcagaaatgaggcctgctcgtgcaaagttcgacttcaaagcccagacactgaaagagctgcccttgcagaagggtgacatcgtgtacatttataaacagattgaccaaaactggtacgagggagaacaccatggtcgcgttggaatctttcctcgcacatatatagaactactgcccccagcagaaaaagcacagcctaagaaactaacacctgtccaggttctcgagtacggtgaagcaatcgcgaagttcaatttcaacggggacactcaggttgagatgagtttcaggaagggagaaaggatcacactgcttaggcaagtggatgagaattggtacgaggggagaatcccaggaacttctcggcagggaatcttccccataacttacgtggatgtgataaaaaggccactcgtgaagaatcctgtcgattacatggatctcccgttctcatcctcccccagtcggtccgcgaccgcatcaccccagccctggagggaagaatctgggcaatacgagcggaaggccgaaaggggcgctggcgagaggggacctgggggtccaaaaatctctaagaagtcttgtctgaaaccatcagacgtcgtgagatgtctgagcaccgagcagaggctgtcagacttgaatactcctgaggagtctcggcctggtaagcccctcggctctgcattccccggttcagaggctgaacagacagagcgccaccgcggtggagagcaagccggaaggaaggcagctcgcaggggtggaagccagcagccacaggcccaacagagaagagtgaccccagaccggagccagacatcccaagatttattctcttatcaagctctgtatagctacattccacagaacgatgatgagctggagctccgggacggggatattgtggacgttatggagaaatgcgatgacggctggtttgtaggaacctcccgaaggactaaacaattcggcacctttccaggaaactacgtcaaaccactctatctgtag

SEQ ID NO: 241928 - DNA, 3879 bp, Artificial Sequence
  Description of Artificial Sequence: Synthetic coding sequence
atgtccagtgagtgcgatggcggatctaaggctgtgatgaacggtttggctcccggatcgaatggccaggataaagctaccgccgaccccctcagggctcgctctatctctgccgtaaagatcattcctgttaaaaccgtgaaaaacgcctccggactggtccttccaaccgacatggatctaacgaaaatttgcaccgggaaaggcgctgtgacactcagagccagctcctcctatcgggagactcctagtagctctcctgcctctcctcaggagacacgccagcatgagtccaagccaggactcgagcctgagccttcttccgcggatgagtggcggctttcttccagtgctgatgccaatggtaacgcccagccttcttcactagcagccaaaggttatcgatcggtgcacccaaacctgcctagcgacaagagccaagacgcgacatcaagttcggctgcacagccagaggtgatcgttgtacccctgtatctggtgaacaccgatagagggcaagagggcaccgcgaggccccctacccctctgggccctttgggatgtgttcccacaatccctgctacggcttcagctgcatcacccctgacattccctacgctggatgacttcattccccctcacctgcagcgctggccccaccactcacagcccgctcgcgcaagcgggtcattcgccccaatatctcaaacacccccttcattcagccccccacccccattagtgccaccagcccctgaggatctgcgcagagtgtccgaacctgacctgaccggcgctgtgagctccacagattcatccccactcctgaacgaagtctcgtctagtttgatcggcaccgatagtcaggcctttccttctgtatccaaacctagtagtgcctacccctccacaacgattgtgaacccaactatagttttactgcagcataatcgagagcagcagaagcgactctcatctctgtccgatcctgtcagtgagagacgggtgggagagcaggattcagctcccactcaggagaagcctacaagtcctggcaaggccattgagaagcgggcaaaagatgactcgcgtagggttgttaagagcacacaggacttgagcgatgtgagcatggatgaggtaggaattccactgcgaaacactgaacgctctaaggattggtacaagacgatgtttaaacagatccacaagttaaaccgcgatacaccagaagaaaacccatattttccaacatacaagtttcctgaactacctgagatccagcagacctccgaagaggataacccgtatacaccaacctaccagtttccggcatctacccctagcccaaagagcgaggatgacgacagcgatctctattctcccagatattcttttagcgaagacacaaaatccccactctcggtgcctaggagcaagagtgaaatgtcatatatcgatggagaaaaggtggtgaagcgctcagcgacactgcccctcccagcacgcagttcttcacttaagagttcatctgagagaaacgactgggagcctccagacaagaaggttgatacgcgcaagtatagggcagaaccgaaatcaatttatgagtatcagccgggaaagtctagcgtgctgaccaacgagaagatgagtcgggacatctcaccagaggagatcgatctcaagaacgagccctggtacaaatttttctctgagctggaattcgggaaacctcccccaaaaaaaatctgggactacacacctggagactgctcaattctccccagggaggaccgtaagacgaacctggacaaagacttatcgctttgccaaacagagctggaagcagacctcgagaaaatggagacgctgaacaaggctccgtccgccaatgtgccccagtcttctgcaatcagtcctacacccgagatcagctccgagacccccggatacatctactcatccaatttccacgctgtgaaaagggagtccgatggggcacccggtgatcttacctccttagaaaatgaaaggcagatctacaagtccgtgcttgaggggggagacatcccattgcaggggttgagtggtctcaaacgaccttcttcatccgcatccacgaaggactctgagagcccgaggcactttatccccgcagactatctggagtctactgaagagtttattcgtcggaggcatgacgacaaagagaaactcctggccgaccagcggaggctcaaaagggagcaggaggaggcagatatagccgctaggaggcacacgggggtcattcccacccatcatcagttcattaccaatgaaaggttcggggatctcctcaacattgatgataccgctaagcgcaaatctgggtccgagatgagacccgcacgggcaaagttcgatttcaaggcacaaaccctgaaggagctcccattgcagaaaggcgatatcgtgtatatatacaagcagattgaccaaaactggtacgagggggagcatcacggacgggtgggaatttttcctagaacttacattgagttgctgccgcctgctgagaaagcacagcctaagaaactgacccccgtgcaggttctcgaatacggcgaagccattgccaagtttaattttaacggagacacccaggtcgagatgtcgttcaggaaaggagaaagaattacacttcttagacaggtcgacgagaactggtacgaaggcaggattcctggaacatctcgacaaggcatatttccaatcacctatgttgacgtgataaagcgtcccttggtgaagaaccctgtcgattacatggacctcccctttagctcgtccccctcaagatcagccacagcttcaccccaatttagctcacatagcaaacttatcacccctgctccgtcttccctgccccactccaggcgtgcactgagcccagagatgcacgccgtcacatccgagtggatcagtctgacggttggggtgccaggcaggcggagcctggcccttaccccccctctgccccctctgcctgaagcctcaatctataatacggaccacctggccctgtcaccacgcgcatctccgtctctttccctatctctgcctcacttgagctggtccgatcggcctacccctaggagtgtggcaagcccactggcccttccatctccccataagacctacagtctggcgccaacaagccaggcatccctgcatatgaatggggacggaggggtccataccccatcttctggtattcaccaggacagcttcctccaactgccactcggcagctccgacagcgttatttcacagcttagcgacgctttctcaagccagtccaagcgccaaccatggcgcgaggaatccggtcagtatgagcggaaagctgagcgaggcgctggcgagcggggacctggcggaccaaaaatcagtaagaaatcatgccttaaaccttccgacgtggtgagatgcctgtctaccgagcagagactatctgacttgaacacccctgaggagtctcgcccaggtaagccccttggctcagcctttccaggttctgaggctgagcagacagagagacacaggggtggggagcaggcaggtagaaaggctgcccgtcgcggaggttcacagcagccccaggcccagcagcgccgagtcacgccagaccgaagccagacaagccaggatctgttctcgtatcaggctctctacagctacattccccaaaatgatgacgagcttgagctcagagacggagatatcgtggatgtaatggaaaagtgcgatgacggctggttcgtggggacgagcaggcgcactaaacagtttggtacatttcccggaaactatgtcaagcccctgtacctctag

SEQ ID NO: 241929 - DNA, 2451 bp, Artificial Sequence
  Description of Artificial Sequence: Synthetic coding sequence
atgtcatcggagtgcgacgggggaagcaaagcagtgatgaatggtctggctccaggatccaatggccaggacaaagacatggacttgaccaaaatctgtactggcaagggggctgtgaccctgcgggcatcgtcatcctacagggagaccccctcatcaagccccgcaagtccacaagagacccgtcaacacgaaagtaaaccaggcctggaaccagagccatccagtgcagacgagtggcgtttatcaagctcagccgatgccaatggcaacgcacagccctcgtccctggcagcaaaaggctataggtcggtccacccaaacctgccttcggacaaatcacaggacgcaacaagcagcagtgccgctcaacctgaggtcatcgttgtccctctgtatctggtgaacacagaccgcggacaggaggggactgctaggccccctaccccactcggacctctgggatgcgtccctactataccagcaaccgcctccgcagcaagtccgctcacctttccgaccctggacgatttcatacctccgcacctgcaaaggtggcctcaccacagccagccagctagagccagtggaagctttgcacccatcagtcagacccccccatccttctcaccaccccctccacttgttcctccagcccctgaggatttacgaagggtgtccgagcctgatctgacaggagccgtatcttcgactgactcatctcccctgctcaacgaggttagcagtagcctgatcggcacagactcccaggcattccccagcgtttcaaagccttcctccgcatatccctcgactaccattgtgaacccaacgattgtgctactccagcataatagggagcagcagaaacgtctgtcttccttgtccgaccctgtcagcgagagacgggtgggcgaacaggacagcgctcccacgcaggagaagcccaccagccctggcaaagctatagagaagcgtgccaaggacgactcgcgacgagtggtgaagtctacacaagacctctccgatgtgtccatggacgaggttggaatcccactgcggaatacagagaggagtaaggattggtataaaactatgtttaaacaaattcataaactcaatcgagacgacgattctgacctttactccccgaggtacagctttagcgaagatacaaagagcccactgtcagttcctcgctccaagtctgaaatgagttacattgacggggaaaaggtagtgaagagatctgctactctgccgctgccagcccgaagctcatctttaaagagtagctccgagcgcaacgattgggagcccccagataagaaggtggacacgcgcaagtatagagcggagccaaaaagtatttatgaataccagccgggaaagtcaagtgtgctaacaaatgagaaaatgtcatcagccatctctcctacccccgagataagttcagagacaccaggctatatctactcctcaaattttcacgccgtcaagagggaaagcgacggcgcacctggcgatttgacttctcttgagaatgagcgccagatttacaagtcagtgctggaagggggtgacattcccctgcagggcttgagcggcttgaaaaggccctcctccagcgccagtacgaaggattctgagagtcccagacacttcatccccgctgattaccttgagtccactgaagagttcatacggcgacgacatgatgataaggaaatgagacccgctagagctaaatttgactttaaggcgcagaccttaaaggaactgcctctgcaaaaaggagatatcgtctatatttacaaacagatagatcaaaattggtacgagggagaacaccatggtagggtggggattttcccacgtacatacatcgagcttctaccacccgctgagaaggcacagcccaagaagctgacccccgtgcaggtcctggaatacggcgaagctatcgcaaagttcaactttaatggagacacacaggttgagatgtcattcaggaaaggagagcggatcacacttttgcgccaggtcgatgaaaattggtacgagggacggattccaggcactagcagacagggcatctttcctataacttacgtggacgtgattaaaaggcccctggttaaaaaccccgtcgattacatggatctcccattttcatcatcacctagtcggtctgctacggcttcccctcagcagccacaggcccaacagcgccgtgtgaccccggatagatctcagacttcccaggatctgttttcctatcaggccctttactcttatattccacagaacgacgacgagcttgaattgagggatggcgacattgtggatgttatggaaaaatgtgacgatggctggttcgttggaacctctcggcgtactaaacaattcggcacatttcccggtaattacgtaaaaccactgtacttatag

SEQ ID NO: 241930 - DNA, 3015 bp, Artificial Sequence
  Description of Artificial Sequence: Synthetic coding sequence
atgagttctgaatgtgatgggggatctaaggctgtgatgaatggtttagcacccggtagtaacggccaagataaagcgacagcagaccctctacgcgcacgttcaatttccgcagtgaagataattccagtgaaaacagtaaagaacgcatctggtctggtcctacctacagacatggacttaactaagatttgcacaggtaagggggctgtgacactgagggcttccagttcttacagggagactccctctagttccccagcctcaccccaggagacgagacaacacgaaagtaagccggacgaatggaggcttagttcttccgccgatgccaatggcaatgcccaacctagtagcttggccgcaaaggggtaccgtagtgtccatccgaatctgccatccgacaaatctcaggacgccacatcttcttcagctgcccaacctgaagtgattgtcgtgcctctctacttggtgaacacggaccggggacaggagggcaccgcccgtccaccaacgccacttggtcccctgggatgtgtaccgacaattcccgcaaccgcgtccgctgctagcccactcacttttccgaccctggatgatttcatcccaccccacttgcagcgctggccgcaccacagccagccagctagagcttcagggagctttgcacccatcagtcaaaccccaccttctttctctccccctcctccactcgtccccccagcccctgaagacttacggcgagtgtcagagccagacctcacaggagccgtgagttcaactgacagctccccactgctgaatgaggtgagttcttcgttaataggcaccgattctcaagcattccccagtgtgtccaaaccatcctcagcctatccatctacgactattgtgaaccccactattgtattgctccagcataatcgtgagcaacaaaagagactatccagcctgtctgatcctgtcagtgagcggagagtgggggaacaggacagtgcacctactcaagaaaagccgaccagccctggtaaggcaatcgagaaacgcgctaaggacgactccagacgtgttgtcaaaagtacgcaggatctatctgatgtgagtatggatgaggttggaatacccctccggaacacggaacgcagcaaggactggtataagaccatgtttaagcagatccataagttgaatcgggacacaccagaagagaacccatactttccaacgtacaagttcccagaattgcccgaaatccagcagacatccgaggacgacgattcagatctctactcacccaggtactcattttcagaggataccaaaagtcctctgagtgtcccccgttcaaaatcagaaatgtcctacatagatggcgagaaggtcgtaaagcggtcagcgactcttcccttgccagcccgttccagtagcttgaaatctagttctgaacggaatgactgggaacctcctgataagaaagtggatactagaaaataccgggctgagcccaaaagcatctatgaatatcagccagggaaatctagcgtcctgacgaacgaaaaaatgtcaagggacattagtcccgaggagattgatctgaaaaatgagccatggtacaagttcttctccgaattggagttcggaaagcctcctcctaaaaagatctgggactatacccccggtgactgcagtatcttaccacgcgaggataggaagactaacctcgacaaagatctttcgctctgccagacagagcttgaggcagatctggagaagatggagaccctcaacaaggcgccttccgcgaacgttcctcagagcagcgcgatcagcccaacaccagaaataagctcggaaacgcctgggtatatctactcctcaaactttcatgcagtgaagcgcgaatctgatggcgcacccggagatttaactagtcttgaaaacgagaggcagatttacaaatccgtattggagggtggtgacatcccgcttcaaggcctctccggacttaaacgaccctcatcttcagccagcacgaaagacagcgaatccccacgacactttatccctgctgattatttagaatctacggaggaatttatacgtcgcagacacgacgataaagaaaaactcttggcggaccagcgacgactgaagcgagagcaagaggaggccgatattgccgctagaagacacaccggggtgatccctacacatcaccagtttatcactaatgagcgcttcggggatctcctcaatattgatgacaccgctaagagaaagagtgggtcagaaatgagacctgcacgcgcaaagtttgactttaaagctcagaccctgaaggagctccctctgcaaaagggcgatatcgtgtacatttacaaacagatcgaccagaactggtacgaaggcgagcaccacgggagggttggaatttttcctcgaacatatatagagttgctccctcccgctgagaaggcacagcccaagaaacttacgcctgtgcaagtgcttgagtatggcgaggcaatcgccaaatttaacttcaacggagatacacaggtggagatgtccttcaggaagggagagagaatcacactccttcggcaagtggacgaaaattggtatgagggtaggatcccgggtacatcccggcagggaatcttccctatcacttacgtagacgtgatcaaacggcctctggtaaaaaaccccgtggattacatggatctgccattctcgagctctccaagcagatccgccaccgctagtcctcaacagcctcaggcacagcaacggcgagtgacaccggaccgttcacagaccagtcaagacctgttcagttaccaggccctatacagttacattccccaaaatgacgatgaactggaattgcgcgacggtgacatcgtggatgtcatggaaaaatgtgatgatggttggtttgtcggtactagtagacggaccaaacaatttgggactttcccaggaaattatgtcaagcctctttatctgtag

SEQ ID NO: 241931 - DNA, 2016 bp, Artificial Sequence
  Description of Artificial Sequence: Synthetic coding sequence
atgcagggaccacctcgaagccttcgggcagggttatccctcgacgatttcattcccggacacttacagtcccacattggatcttcctcccggggtacccgggtgcctgtgatccgaaacggcggaagtaataccctgaatttccaatttcatgatccagcgccacgcaccgtttgtaacggaggctacactcctcgccgagatgctagccaacacccagacccggcttggtatcaaacctggccagggccaggaagtaagccaagtgcgagcactaagattcctgcatcacagcacacccaaaactggtctgccacctggaccaaggactcgaaaaggcgggataagaggtgggtgaaatacgagggaatcggtccggttgatgagagcgggatgccaattgctcctcgttccagcgtagaccggccaagagattggtatcggcgtatgttccagcaaattcacaggaaaatgcctgatctgcagctcgactggacatttgaggagccaccacgcgatccccgacatctcggcgcacagcagcgccctgcccatcgtcctggccctgccacatcgtcctctggtaggtcctgggatcatagcgaggagttgcctcgatctaccttcaattatcgccctggcgctttttccacagtgctgcagccatcaaaccaggtgctgaggcgccgagagaaggtggacaatgtctggaccgaggaatcttggaatcaatttttgcaggagctagaaacggggcagagacccaagaaacccctggtcgacgatcccggagaaaagccaagccagcctattgaagtcttgctggaacgcgaactggcagagctgtctgccgaactggacaaggacctgcgggcaatcgaaacaagattgccatctccgaaatcttcacctgctccccgaagggcaccggagcagcggcctccggctgggccagcaagtgcatggtcttctagctatccccacgccccttatctcggatctgctcggagtctgtctccacataaaatggctgatggaggaagccccttcttgggccgtcgggattttgtttacccgagcagtacacgagacccctccgcttccaatggcggaggaagcccagcaagacgcgaggagaagaaacgcaaggccgctaggctaaagttcgactttcaggctcagtccccaaaggagttgaccctgcaaaagggcgatatcgtctatatccataaagaggtggacaaaaactggctggaaggcgagcatcacggacggctgggcatcttcccagcaaactatgttgaggtgctgcctgccgacgagattcccaaacccatcaagccgccaacctatcaagtcctggagtacggagaagcagtggcacagtacacgttcaagggggacctagaagtcgagttgtccttccgcaaaggtgagcatatctgcttgattcggaaggtgaacgaaaactggtacgagggcagaattacgggcactgggcgacaaggaatcttcccagcatcatatgtgcaggtgtcgagggaaccgagattacggctgtgcgacgatggtccccagttgcctacatcccccagactgacagcagccgcacgcagcgcgaggcatccttctagcccgtcggccttgaggtcaccagccgacccgatcgacctcgggggacagacgtccccacggagaaccggatttagcttcccgacccaagaaccaaggccacaaacccaaaacctcgggaccccagggcctgcattatcccattcccgcggtccaagtcaccccctggacctgggaaccagcagtccaaacacatcccagatacattggactccgtacagggctatgtatcagtatcgtccccagaacgaggacgaactggagctccgagaaggtgaccgcgttgacgttatgcagcagtgcgacgatggctggttcgtgggtgtgagccgtagaacccagaagtttggaacctttccgggtaactatgttgcacccgtatag

SEQ ID NO: 241932 - DNA, 990 bp, Artificial Sequence
  Description of Artificial Sequence: Synthetic coding sequence
atggccgatggcggatccccattcctgggacgtcgggactttgtgtaccccagcagtacacgagacccaagtgcatctaacgggggaggctcgccagctcgcagagaggagaaaaagaggaaggccgctaggttaaagttcgacttccaggcacagagcccaaaggagcttactctgcaaaagggtgatattgtctacatacataaggaagtcgacaagaattggctcgaaggggagcaccacggacggctgggcatctttcccgctaactacgtcgaagtgcttcctgctgacgaaattccaaaacctatcaagccaccaacttatcaggttctggagtatggagaggcagtggctcagtacacattcaaaggggacttagaggttgagctgagtttcagaaagggagaacatatatgtctgatccgtaaagtcaatgagaactggtacgagggacgtataaccggcacgggtcggcagggcatttttccggcatcatacgtacaggtcagcagagagccaagattgcgtctctgcgatgacggtcctcagcttcctacatctccacggcttaccgccgctgcgcgatcagctcggcatccctcctcaccttcggcccttcgcagccccgcagatccgatcgaccttgggggacagacatctccacgccgtacgggttttagctttccaacacaagaaccgaggccacagactcagaatctcggaactcccggtccggcactttcccactccagaggcccttcccaccctctggatctggggacttcgtcccccaatacctcccagattcattggacaccatacagagctatgtaccaatatcggcctcagaacgaagacgaactcgagctacgggaaggtgatagggtcgatgtaatgcagcagtgtgacgacggatggttcgtgggcgtgagcagacgcacgcagaaattcgggacctttcctggaaattacgtggcacccgtttag

SEQ ID NO: 241933 - DNA, 1074 bp, Artificial Sequence
  Description of Artificial Sequence: Synthetic coding sequence
atggctgcagccgctaaacccaacaatctgtcgctcgtggtgcacgggccaggtgatctgcgattggagaactacccaataccagagccgggacctaacgaggtcctgctccgcatgcactctgttggaatctgcggctccgatgtccactactgggaatacgggcgtatcggcaacttcattgtaaaaaaacccatggttctggggcacgaagcatctggcaccgtggagaaagtgggtagtagcgtaaagcatctgaagcctggcgacagagtggcgattgagcctggtgctccaagggagaacgacgaattctgcaagatggggaggtacaatctgtccccaagcatcttcttttgcgcaacacctccagatgatggcaacctgtgccgattttataaacataatgccgctttctgttacaagctgcctgacaatgtcaccttcgaggagggggcactgatagagcctttgtcagtaggaatacacgcatgcagacgcggaggtgtgaccctcggccacaaggtgttagtctgtggagctggtcctattggtatggtcacactcttggtggccaaggcgatgggcgcagctcaggttgtggtgaccgacctgtctgcgacaaggctgagcaaggccaaggagatcggggcagacctggtcctgcaaattagcaaagaatccccgcaggaaattgccagaaaggtggaaggacagctcggctgcaagccagaagtcactatcgaatgtactggagccgaagctagcatccaggccggaatttacgctacccgaagtggcggaaatctcgttctggtgggcctgggcagcgaaatgacaaccgttcccctgcttcatgccgctattagagaagttgacatcaaaggagtgttccgatactgtaacacctggcccgttgccatcagcatgttagctagcaaatcagtcaacgtaaagccgcttgtgacacaccgcttcccactggagaaagccttggaggcctttgagaccttcaagaaggggttaggcttgaagattatgctaaaatgtgatccgtccgatcaaaatccctag

SEQ ID NO: 241934 - DNA, 597 bp, Artificial Sequence
  Description of Artificial Sequence: Synthetic coding sequence
atggcttatcctggccatcccggtgctggagggggttactatccaggaggatacgggggtgcccctgggggaccagcctttcccggacagacccaggacccactctacggctatttcgcagcagtggctggccaggatgggcagatagatgccgacgaactgcagagatgcctgactcagtcgggtattgccggagggtacaagccttttaatcttgagacatgtagattgatggtgtccatgctggaccgagatatgagtggaaccatggggtttaacgagttcaaggaactctgggccgtgctgaacggctggcggcagcacttcattagtttcgatactgaccggagtggcaccgtggacccgcaggagctacagaaagctctgactacaatgggttttaggctgtctccccaggcggtaaattcgattgcaaagcgatacagcaccaacggaaaaatcacgttcgacgattatatcgcctgttgtgttaaactgcgcgctctaacagatagctttcggcgacgcgatactgcacagcagggtgtcgtgaacttcccatacgacgatttcattcaatgcgttatgagcgtgtag

SEQ ID NO: 241935 - DNA, 552 bp, Artificial Sequence
  Description of Artificial Sequence: Synthetic coding sequence
atgcagtatggcggtgcccctggtggtcctgccttccctggtcagacacaggatcctctgtacggatatttcgcagctgtggccggacaggatggccagatagacgccgacgagctgcagaggtgcttgactcagagcggcatcgcgggaggctataaacctttcaatttagagacttgtcgtttgatggtgtctatgctggatcgcgatatgagcggcaccatgggcttcaatgagtttaaggaactgtgggcagttctaaatgggtggcggcagcacttcataagctttgataccgataggtcaggcaccgttgatcctcaggagctgcagaaagccctgaccacgatggggttccgtctctctccccaagcagtgaactccatcgccaaaaggtattccacgaatggcaaaattaccttcgatgactacatcgcatgttgcgtcaagctacgagccctgaccgatagtttcaggcgacgcgatactgctcaacagggtgtagtgaatttcccatacgatgactttatacaatgtgtgatgtccgtgtag

SEQ ID NO: 241936 - DNA, 543 bp, Artificial Sequence
  Description of Artificial Sequence: Synthetic coding sequence
atgcagtatggaggtgcacccggtggcccagcattcccgggacagacgcaggacccgctttacggatatttcgccgcagtggcgggtcaagatggtcagatcgatgctgacgagctgcagaggtgtctgacccagtctggcatcgcagggggatacaagccattcaaccttgaaacttgcagactgatggtgagtatgctggatcgcgatatgtctgggaccatgggattcaatgagttcaaggaactgtgggccgtccttaacggatggcgacaacattttatttccttcgatacagatcgctccggcactgtggacccacaggaactccagaaagcattaaccaccatgggctttagattatctcctcaggcagtcaactctatagccaagcgatactcaacaaacgggaaaattacattcgacgattatatagcgtgttgtgtaaaactccgcgcactgaccgactcatttcgcaggcgagacacagcccagcagggtgtggtaaatttcccctatgacgacgtgtcactccgcaactag

SEQ ID NO: 241937 - DNA, 6644 bp, Artificial Sequence
  Description of Artificial Sequence: Synthetic coding sequence
atggcaacccgaagctcccgaagggagtcccggctcccttttttgtttaccttggtagccttgctgcctcccggagccttgtgtgaggtttggacacagagactgcacgggggttcggctccactgccgcaggacaggggattcttggtggtccaaggtgaccctagggaactacgcctgtgggcaaggggggatgcccgtggagcctcgcgggcagacgaaaagccactgcgtcggaaacggtctgctgcccttcaaccagagcctatcaaggtgtatgggcaggtgagtttaaacgatagccacaatcagatggtcgtgcactgggcaggcgagaagtctaatgttattgtggctcttgcccgtgacagcttggctctagcgaggccaaagtcgtctgatgtgtacgtgagctatgactacggtaaaagttttaaaaagattagtgataaactcaactttggattgggcaaccgctctgaggcagtgattgctcagttttatcattcccccgcagacaacaagagatacatatttgcagatgcatacgcccagtacttatggatcacatttgatttttgtaatacactgcagggtttcagtatacccttcagagccgcagacctgctgctgcacagcaaggcttccaacctgctgcttgggtttgacagaagccaccccaacaaacagctctggaagtctgacgactttggacaaacctggattatgatccaggagcacgtcaaaagttttagctgggggatcgatccctacgacaaacctaatactatatacattgagcggcatgagcccagtggttatagcacagttttccgaagcacagatttttttcagagtagagagaatcaagaagtgatcctggaagaagtcagggacttccagctgcgcgataagtatatgttcgccacaaaagtcgttcacctgctaggctctgaacagcagagttcagttcagttatgggtgtcctttgggaggaaacccatgcgagccgctcaattcgtcacacggcacccaataaatgaatattacatcgctgatgcctcagaagaccaggtttttgtgtgtgtgagtcactccaataacaggactaatttatacatctcggaagcagaagggttgaaattctctctatcactcgaaaacgtcctgtattatagtccaggtggggcaggttccgacacccttgtgaggtatttcgcaaatgaaccattcgctgatttccacagagtcgaaggcttgcaaggagtctatatagccaccctgatcaacggcagcatgaatgaagagaacatgcggagcgtaattacattcgacaagggtggaacttgggagttcttgcaggcacccgcattcaccggatacggggagaagatcaactgtgaactaagccaggggtgctctctacacctggcgcagagactgagccagctgctgaacctacagttgagaaggatgcccattctcagcaaagagtccgcccctgggctgatcatcgccactgggagtgtggggaagaacctcgccagcaaaacaaacgtctacatttcgtcttcagccggtgctaggtggcgtgaggctctccctgggcctcactattatacctggggagatcacgggggaataattaccgccatcgcccagggcatggagaccaatgaactcaagtactccacaaatgaaggtgaaacgtggaagacattcatcttctctgagaagccggtgtttgtctacgggctcctgacagaaccaggcgaaaagagcacagtgttcaccatattcggctctaacaaggagaatgtccacagctggcttatcctgcaggttaacgcaaccgatgcactaggtgtgccttgcaccgaaaacgactacaagttgtggtcacccagcgacgagaggggtaatgagtgtcttctcgggcacaagacggtgtttaaacgtcgcacacctcacgcgacatgctttaacggcgaggacttcgatcgcccagtggtggtcagtaactgctcctgcacacgggaagattatgaatgtgactttggtttcaagatgagcgaggatctcagtctggaagtttgtgttcctgatccagaattcagcggcaagtcttatagtccccctgttccatgtcctgtcggttccacctacagacgaacacgagggtaccgaaagattagcggcgatacttgcagcggcggtgacgtcgaggccagactggaaggggaattggtgccctgtccattagctgaggagaatgagtttatattgtacgcagtgcggaaatccatataccggtacgacctggcgtcaggggctacagaacaattgccactcaccggactccgggctgctgttgcccttgactttgactatgagcacaactgtctgtattggtctgacctcgcactcgatgtgatccagcggctgtgtttaaacggcagcacggggcaagaggtgatcataaatagcgggttggaaaccgttgaggcactggcatttgagcccctctcccagttgctgtactgggtggacgccggattcaagaagattgaagtggccaatccggacggagatttccgcctgacaatagttaattctagcgtcctggacaggcccagagccctagtacttgtgccccaggagggagtcatgttttggacagattggggggacctgaaacccggaatctacagaagcaatatggatggttctgctgcctaccacctggttagcgaagacgttaagtggcccaatggaatctccgttgacgatcagtggatctattggaccgatgcttacctggaatgtatcgagaggataacattcagcggccagcagagaagtgtcatcttggataacttgcctcacccctacgccattgcagtctttaagaacgaaatttactgggacgactggagtcagttgtccatcttccgcgcatcaaagtactctggatcccagatggaaatcctcgccaaccaattaaccggcctcatggacatgaagattttttataaggggaagaatactggcagcaacgcttgcgtgccgagaccttgtagtctactgtgtcttcctaaggccaacaacagcaggagctgtaggtgccccgaggatgtgtcctcatcggttctgccgagcggcgatctgatgtgcgactgtcctcaggggtaccagctcaaaaacaacacatgcgttaaacaagaaaatacctgcctacggaaccaatacaggtgttccaacggtaattgcatcaacagcatttggtggtgcgacttcgacaacgactgtggagatatgtctgatgaacgtaactgccccacaactatatgtgatttagacacccagtttcgctgtcaagagagcggaacctgtattcccttgagctataaatgtgacctcgaggacgactgcggagataatagcgatgagtcccattgcgagatgcatcaatgtagatccgacgaatacaattgcagttccggcatgtgcatccgctcttcctgggtgtgcgatggcgacaacgattgccgggattggagcgatgaggcaaactgcaccgcgatctaccatacctgcgaagcttccaacttccagtgccggaacgggcactgtattccccagcgctgggcctgtgatggcgacactgattgtcaggatggcagtgacgaggacccagtaaattgtgaaaaaaagtgtaacggattccgctgcccaaacgggacgtgcattccatcgtccaaacactgcgacggcctccgcgactgcagcgatgggtcagacgaacagcattgtgagccgttgtgtacacatttcatggattttgtgtgcaagaataggcagcaatgtctgtttcactctatggtgtgtgatggtatcatacagtgtcgagacggaagtgacgaagacgccgctttcgcaggttgctcacaggatcctgaattccataaagtctgcgacgaatttggctttcagtgccagaacggcgtctgcatttcgttgatctggaaatgcgacggaatggacgactgcggtgattatagcgatgaagccaactgtgagaacccgaccgaggcccctaactgtagtagatatttccagttcagatgtgaaaatggccactgtattccaaaccgctggaagtgcgatcgcgagaacgattgcggagattggagtgatgagaaggactgcggggatagccacattctcccgttttcaacccccggaccttcaacctgcctccctaattactatagatgtagttccggcacatgtgtcatggatacttgggtctgcgatggatatagggactgtgctgatggttcagacgaagaagcgtgccccctgctggcaaatgtcacagctgcctctactcctacacagcttggtcgatgtgatcgctttgaattcgagtgccaccagcctaaaacttgcataccaaactggaaaaggtgcgatgggcatcaggattgtcaggatggtagagacgaagctaactgcccaactcattcgacgctaacctgcatgtccagagagttccaatgcgaggacggcgaagcctgcattgtactctccgagcgctgtgacgggttcctggattgttcagatgaatctgacgagaaagcttgtagtgatgaactgactgtctataaggtacagaatctgcagtggaccgccgacttttctggcgacgtaacactcacatggatgaggcctaaaaagatgcccagcgctagctgcgtgtataatgtgtattatcgagtagtgggcgagtctatctggaagacactggagacccattccaataaaactaacaccgtcctgaaagtactgaagccagacactacctaccaggttaaggtccaagtgcagtgcctcagcaaggcccacaataccaacgactttgttaccctccggacccctgaaggcctgcccgatgcccctcgaaacttacagctcagcctgcccagggaggccgaaggggtcatagtaggacattgggcaccccctatacatacgcacggtctcatcagagagtacattgtcgaatattctcggagcggttctaagatgtgggccagccagagagccgcttctaattttacagagataaagaacctgttggtcaataccctgtacacagttcgggtggctgcggttacaagtagaggcatcgggaactggagcgacagcaagtccatcacaactattaagggaaaggtgattccgcctcccgacatccatatcgactcgtacggggagaactacctaagtttcacgttgaccatggaatccgatatcaaggtgaatggatacgtggttaatctcttttgggctttcgacacacacaagcaggaacgcagaaccctgaacttcagaggctccattctgagccataaggtgggaaacttaaccgcccacaccagctatgagatatctgcctgggccaaaaccgacctgggggactcccccctcgcatttgagcacgtgatgactcgcggagtgagacctcctgccccttcccttaaggccaaggccatcaaccagactgctgtggagtgcacttggacaggcccacggaatgtcgtctacggcatcttctacgcgaccagttttctggacctgtataggaaccctaagtccctgactacatctttgcacaataaaaccgtgatcgtgtctaaggatgaacaatacctgttccttgtccgcgtcgtggtcccttaccagggacccagttccgattacgttgtggtcaaaatgatcccggacagcaggctaccaccccgtcacctccatgtggtacataccggtaagacaagtgtggtaattaaatgggagtccccatatgactccccagaccaggatctgctttacgctgtggcagtgaaggacctgatccggaaaacagatcgcagctataaggtgaaaagcagaaactcaacagtagagtacacactgaacaagctggagccgggtggcaagtatcatatcatagtgcaacttggaaatatgtcaaaggactcttctatcaagatcactacagtatctctgagtgccccagatgcacttaagattatcacagaaaatgaccatgtcttactgttttggaagtccctggccctgaaagaaaagcattttaatgagagtagaggctatgaaatccacatgttcgatagcgcgatgaacatcacagcctacctaggaaatacaaccgataattttttcaagataagcaatttgaaaatggggcacaattatacattcacggtacaggctcggtgcttgtttggcaaccagatctgcggggagccggcaattctgttatatgatgaactgggaagtggagctgacgcctctgctacgcaggcggctcggagtaccgatgtggccgcagttgtggtccctattctgtttctgatcctgttgagtctcggcgttggattcgccatcctctatactaaacaccgccgattgcagtccagttttaccgcatttgctaattctcattacagctctcggctaggatccgctatttttagctccggcgatgatctgggggaggacgacgaagatgcgcctatgataaccggtttttccgatgacgtcccaatggtgattgcgta

SEQ ID NO: 241938 - DNA, 3507 bp, Artificial Sequence
  Description of Artificial Sequence: Synthetic coding sequence
atgggtaaagtcggcgctggcggtggatcgcaagcccgtctatcagcactcctggctggtgcaggcctcctcattctgtgcgcgcctggcgtttgtggaggagggagttgctgtcctagccctcatccttcttccgcccctaggtctgcttcaactccaaggggcttctcacatcagggacggccagggcgtgccccagcaacaccactgcccctggtggtgcggcctctttttagcgtcgcacctggggatcgggctctgtcgttggaacgagccaggggcactggtgcatctatggcagtggcggcacgatcaggacgtaggcggaggtcaggtgccgaccaggagaaggccgaacgaggggaaggtgcctctcgcagccccaggggcgtgctccgagatggagggcagcaggagcctggcacacgggaacgtgaccctgacaaagcgacacggtttagaatggaggagctgaggctaactagtactaccttcgccttgacgggagattcagcacacaaccaagcaatggtgcactggtccgggcacaatagctctgtcattctcattctgaccaagctctacgactataatctaggtagcattacagagtcaagcttatggcggagtaccgattatggaaccacgtacgagaagctgaacgacaaagtgggtcttaagactattctgagctatctctatgtgtgtccaaccaataaaagaaaaattatgctgctcacagatccagagatcgagtcgagcctcctcatttcatccgatgaaggagctacctatcagaaatacaggttaaacttttacattcagtccttgctgttccaccctaaacaggaggactggatcctggcatattcccaggatcagaaactgtactccagcgctgagttcggcaggcggtggcagctgattcaagaaggagtggtgccaaaccgcttctactggtctgttatgggctctaacaaagaaccggatctcgtgcatctcgaagctcgcaccgtagatggccattctcactacctgacatgtcgcatgcagaattgcactgaagcgaatcgtaaccagcctttccccggatatatagaccccgattcacttatcgttcaggatcattatgtattcgtccagttgactagcgggggaaggcctcactactatgtatcatacaggcgcaatgcctttgctcagatgaaactaccaaaatatgcccttccgaaagatatgcacgtgatcagcaccgatgaaaatcaggtattcgcagccgttcaggagtggaatcaaaatgatacctacaacctgtacatctctgacacccggggagtgtatttcaccttggcattagaaaacgtgcagtcaagtagaggaccagagggcaatatcatgattgacctttacgaggtggctggaattaagggaatgttcctggccaataagaaaatcgacaatcaagtcaagacctttataacatataataagggcagagactggagactgctgcaggcacctgataccgatctccgcggagacccagtgcactgcctccttccctattgtagcctgcacctccatttgaaggtgtctgagaatccctacacatctggaattatcgcttccaaggacacggctcctagtattatcgtggcctctgggaatatcggctccgaactgtctgacactgatatttcaatgtttgttagctccgacgccggtaacacctggaggcaaatctttgaggaggaacactccgtgctatacctagaccagggcggagtcctcgttgctatgaagcacacttcgcttcccatccgtcatctgtggcttagtttcgatgagggtaggagctggtcgaagtatagtttcacatccattccgttatttgtggacggagttctgggggagcccggtgaagagaccctcataatgaccgtcttcggccacttcagccatcgctcagaatggcaactggtgaaggtggattacaagagcattttcgaccgccgatgtgcggaggaagactatcggccttggcagttacactcacagggtgaggcgtgcatcatgggagccaaacgtatttacaagaagagaaaaagcgagcgcaaatgcatgcagggcaagtatgctggggcaatggagagtgagccttgtgtgtgcaccgaggccgactttgactgcgattatgggtacgagaggcactccaatggccagtgcctccccgcattctggtttaaccccagctctctctctaaagattgcagccttgggcagagctatttaaacagcacaggatacagaaaggtagtgtctaataactgcaccgacggcgtccgtgagcaatatacagccaaaccccaaaagtgcccaggcaaggcacccaggggtttgaggatagttactgccgatggtaagctcacagccgaacagggacacaatgtgacacttatggttcagctagaagaaggagatgtgcagaggaccctgattcaggtggactttggggatggtatcgcagtgagctatgtgaatctgtcttctatggaagacggcattaagcatgtctaccagaatgtcggaatttttagggtcaccgtccaggtcgataactccctgggatccgactccgccgtcctttatctgcacgtgacctgccccctagagcacgtgcacctctcattgccattcgtgaccactaaaaataaagaagtcaatgcaacagcagttctgtggccaagtcaagtcggtaccctcacatacgtgtggtggtatggtaataacactgagcctctgatcacactggagggaagtatctcttttaggtttacctcggaaggcatgaacaccatcactgtccaggtgagcgcgggtaatgccatcctccaggacacaaagacgatagcagtgtatgaagaattccggtccttgaggctgtccttctcccccaatctcgatgattacaacccggatatcccagaatggagacgtgatatcggaagggtgattaagaaatctctggtggaggcaactggggtgcctggccagcacatcctggtcgctgtcctgcctggcctgcccacaacggcagaattgttcgtgctcccttaccaggatcccgcaggggagaataaacggagcacagatgatctggagcaaataagtgaactgttaatccacactctgaaccagaacagcgtccacttcgagctcaagccaggggtacgggtactcgttcatgccgctcatctcacggccgctcctctggtagaccttacaccaacccatagtggaagcgctatgctgatgttgctgtctgtggtgttcgtcggcctggcagttttcgtgatttataagttcaaaagaagagttgcactgccatccccaccttctccttctacccagccaggtgacagctctttgaggctccaacgtgccagacatgctactcccccttccacccctaaaagaggttccgctggggctcagtatgctatctag

SEQ ID NO: 241939 - DNA, 3597 bp, Artificial Sequence
  Description of Artificial Sequence: Synthetic coding sequence
atgggcaaggttggtgccggtggcggttctcaggctcgcctcagtgccctgttggctggcgcaggcctgttgatcctgtgtgcccctggagtttgcggcggtggttcctgctgtcccagtcctcacccatcttccgcacccagaagcgcaagcacaccaagaggattcagtcatcaaggacgcccagggagagctcccgcaaccccgttaccactggtagtcagaccgctgttctctgtcgccccaggtgacagagcactgagcctagaacgcgcaaggggaaccggtgcaagcatggcagttgccgcaaggagcggcagacgaaggagatctggagcagaccaggagaaggcagagcgtggcgaaggggctagcaggtctcccagaggtgttctccgggacggagggcagcaggaaccgggaacacgggagcgagacccagacaaagctacccgttttaggatggaggagttacgccttacatccaccacatttgctctcacgggggacagtgcccataatcaagccatggtgcactggagcgggcacaacagttctgtgattctgattctaaccaaattgtatgactacaacctaggttcaatcactgaatcgtcactgtggcgtagtactgattacgggaccacgtacgaaaagcttaacgataaagtcggtctaaaaaccattctgtcatatttatacgtctgtcctactaacaaaaggaaaattatgctcctgactgatcctgaaatcgagtcgtcactacttatcagttccgacgagggggcaacctatcagaaatatcggttgaatttctacatccagtccttgctgttccaccccaaacaggaggactggatccttgcctactctcaggatcagaagctgtatagctcggccgagttcggcagacgctggcagctgatccaggagggcgtggtcccaaaccgcttctattggtccgttatgggctcaaacaaagaaccagacctcgtgcacctcgaggcgcgaacagtcgatgggcactcacattatcttacatgccgcatgcagaattgtacagaagcaaacagaaatcagcccttccctgggtacattgatcccgactctctcatcgtgcaggaccactatgtgttcgtgcaattaacctccggaggtaggccacactactacgtgtcctatcgcaggaatgctttcgcgcagatgaaactcccaaaatacgctttgcccaaggatatgcacgtcatttcaaccgatgaaaaccaggtgtttgcggcagttcaggaatggaaccagaatgatacttacaacctctacatctccgatacgcgaggtgtctattttacacttgcgctcgagaacgtacaatctagccgcggacctgaaggtaacattatgatcgacctgtatgaggtcgcaggtatcaagggcatgttcttggctaataaaaaaatagacaatcaggtgaaaacctttatcacctacaacaaaggtcgcgattggcgcctccttcaggcaccagacacagatctccggggagacccagttcactgcctgcttccttactgctctttgcacttgcatctcaaggtgtcggaaaatccatacacgtctggcatcatcgcgtccaaagatacggccccatctattatcgtggcaagcggaaatatcgggtccgagctgagtgataccgatatcagcatgtttgtctcttctgacgccggaaacacctggagacagattttcgaggaggaacactctgtactatacctcgatcagggcggagtgctggtcgctatgaaacatacctctctgcccatccgccatctgtggctgagcttcgatgaagggagatcatggtccaagtactcatttactagcatccccctattcgtggatggcgtactaggagagcctggggaagaaaccctgattatgactgtgttcggccacttttcccatcgcagtgagtggcagctcgtcaaagttgattataaaagcatcttcgaccggaggtgcgccgaggaggactacagaccatggcagctgcacagccagggagaagcctgcataatgggtgccaagaggatctacaagaagaggaaatcggagcgaaagtgtatgcagggtaagtatgctggtgctatggagagcgaaccatgtgtgtgcaccgaggcggactttgactgtgattacgggtatgaacgccattccaatggtcagtgcctgccagcgttttggtttaacccttcgtcactgagtaaagactgctcccttggacaaagctatctaaactctactggataccgcaaagtggtttccaataactgcacggacggcgttagggagcagtacacagcaaagcctcaaaaatgtccaggtaaggcccctaggggacttcgcattgtcactgctgatggtaaactgactgcagaacaggggcataatgtcacccttatggtccagctcgaagagggggacgttcagagaacactgatacaagtggattttggggacggtatcgccgtctcttatgtcaatttatctagcatggaggatggcattaagcacgtgtaccagaatgtgggaatcttcagagtgaccgtgcaagttgataactctttgggctctgatagcgccgtgctgtacctacatgtgacatgcccactggagcacgtccaccttagtctgcctttcgttactaccaaaaataaggaggttaacgccaccgccgtcctgtggccgtctcaggttggcacactaacgtatgtgtggtggtacggaaataatacagaaccgctaatcacgttggagggttccatcagcttcagattcaccagcgagggaatgaataccataaccgttcaggtctctgcaggaaacgccatccttcaggataccaagaccatcgcggtgtatgaagaattcaggtcgcttaggctttccttttcaccaaatctcgacgactataacccagacatccccgagtggaggagagacatcgggagagtgattaagaagagccttgttgaggccactggcgtgcctggccagcatatcctagtggcagtgttaccaggcctgccgacaacagctgagttatttgtgctgccctaccaggatcccgctggagagaataaaagaagtactgacgaccttgagcagatctcggaactcctgatccataccctgaaccaaaactccgtccactttgaactgaagccaggggtgagagttctcgtccatgctgcacacctgactgccgctccattggtggacttgacccccacccattcaggttctgcaatgcttatgcttttgagcgtggtctttgttggtttggccgtgttcgtgatatacaaatttaagcggaagattccaggaatcaacgtatatgcccagatgcagaatgagaaggagcaggaaatgatttctcctgtcagtcattcagagtcaaggcctaacgtgccccagaccgaactgagacgtcctggccagctcatcgacgaaaaggtggaatctcagctgatcggcagtatcagtatcgtagctgaaaaccagtcaacaaaagaaatcccaacctatgtgaatgtttag

SEQ ID NO: 241940 - DNA, 2145 bp, Artificial Sequence
  Description of Artificial Sequence: Synthetic coding sequence
atgatcgacctttatgaggtcgctggaattaagggtatgttccttgcgaataaaaagatcgataaccaggttaagacgtttattacttacaataaaggaagggactggaggcttctgcaggctccagacacagatttacgaggggaccccgtgcattgtctgctaccctactgctccctgcacctccacctgaaagtgtctgagaatccttatacctcaggtatcatcgcctctaaggatactgctcctagcatcattgtggcctccggaaacattggatcggagctgtcagatacagacatcagcatgtttgtgagctccgatgccggtaatacatggcgccagatctttgaagaggaacacagcgtcttatatctggaccaaggtggagtgcttgtggcgatgaagcataccagtttgcccatcagacatctctggttatctttcgatgaaggcaggtcttggtctaagtacagttttacttcgatccccctttttgtagatggggtgctaggggaacccggagaggagactctgatcatgacagtattcgggcacttcagccatagatcggagtggcagctggtcaaggttgactacaagtctattttcgatcggaggtgtgcagaggaggactacaggccatggcaacttcactcacagggcgaagcgtgcattatgggggcaaaaaggatttataagaaacgcaaaagcgagagaaaatgcatgcagggaaagtatgcaggagccatggagagtgagccttgcgtgtgtacagaggccgactttgattgcgactacggctacgagcggcattcaaatggtcagtgtctgccagctttctggtttaaccccagcagtctttcaaaagactgcagtctcgggcagtcatatctgaacagcacaggttatcggaaagtggtgtccaacaattgtaccgatggggttcgtgagcaatacaccgcaaagcctcagaaatgtccaggaaaggcccctcggggtctccgcattgtgaccgccgacggcaagctgacagctgagcagggccacaatgttactttgatggtccagcttgaggagggagatgtacagcggacactcatccaggtggattttggcgatggaattgctgtgtcatatgttaacttgtcatctatggaggacggaatcaagcacgtgtaccagaacgttgggatcttccgcgtcaccgtgcaggtggacaactctctgggtagcgattcagcagtgttatacctgcacgtcacttgtcctctagaacatgttcacctgtctttgcccttcgtgactactaaaaataaggaggtcaacgccacagccgtcctctggccatctcaggtcggcactctgacttacgtatggtggtacgggaataacactgagcctttaataacccttgagggctccatttcattccggtttacatccgagggtatgaacacgattacggtccaagtgtcggcagggaacgctattttgcaggacactaagactattgctgtgtacgaagaattcagatcgctcaggctgtcatttagccccaacctggatgattataacccagatatcccagagtggcgcagggacatcgggagggttatcaagaaaagcctggtcgaggccacaggcgtacctggacaacatatccttgtcgccgttctgcccggtctgccaactacggccgagttgttcgtgcttccttaccaggaccccgctggggagaataagcgcagtacagacgacttagagcagatttccgaacttctgattcataccctcaaccagaacagcgtccacttcgaactgaaacctggagttcgcgttttggtccatgcagcccatctcacagccgctccgctagtggatctcacacccactcactcagggtccgctatgctgatgctcctgtccgttgtctttgtgggtttggccgtattcgtgatttacaagttcaaaaggaaaatccctggcatcaatgtgtacgcacagatgcaaaacgagaaggagcaggagatgatctcacccgttagccattctgaatctaggccaaacgtcccgcagactgaactgcggagacctgggcagctcatcgatgagaaagtcgagtctcagcttattggcgagtag

SEQ ID NO: 241941 - DNA, 642 bp, Artificial Sequence
  Description of Artificial Sequence: Synthetic coding sequence
taactcgacgattacaaccctgatattcctgaatggagaagagacattggcagagtcatcaagaaaagcctcgtggaggcaaccggagtgccaggtcagcacatccttgtggcagtgctgcctggacttccaaccacggcggagcttttcgtgttgccatatcaggaccccgctggggagaacaagagaagcaccgatgatctagagcagatttctgaattattgatacatacactaaaccagaacagtgtgcactttgagctcaaaccaggagtgcgggttctggtccatgctgcgcacctgaccgctgctccgttagttgacctgacccccacacattccggatccgccatgctgatgctgctctccgtcgtgttcgtcggccttgcagttttcgtcatctataaattcaaacgcaagattcccggaattaacgtctacgcccagatgcagaacgaaaaggagcaagagatgatttcccctgtgtcccattcagagagcaggcccaacgtgccgcagacagaactgaggagacccggacagctgatcgacgagaaagtggaaagtcagcttatcgggtctatttcaatcgtcgcagaaaaccagtctaccaaggagattcccacttatgtgaatgtgtag

SEQ ID NO: 241942 - DNA, 3009 bp, Artificial Sequence
  Description of Artificial Sequence: Synthetic coding sequence
atgggaaaggtgctggaaagttctctttggaggtctagtgacttcgggactagctatacaaagctgactctgcagcctggtgttaccaccgtgatcgataacttctacatctgccctacaaacaagaggaaggtgattctggtatcttcttctctcagcgatcgtgatcagagcctttttctgagtgcagacgagggcgctacgttccaaaagcaaccgatcccattttttgtagagacattaattttccacccgaaggaagaggacaaagtgttagcgtatacaaaggagagcaagttatacgtctcaagtgatttgggtaaaaaatggaccctgttgcaagagagggtcaccaaagatcatgtgttctggtctgtgtcaggcgtggacgcagacccagaccttgtgcacgtagaggctcaggatcttgggggagattttcgctacgttacatgcgcaatccacaactgctccgagaagatgctgaccgcccctttcgctggccctattgatcacggttcactgacggttcaggatgattacatcttttttaaggcaacctctgcaaatcagacaaaatattatgtatcttatcgtcgaaacgagttcgtcctaatgaagctcccgaaatacgcactgccaaaggatctgcagatcatatcaaccgacgaatcccaggtcttcgtggccgtgcaagaatggtatcagatggatacctacaacttgtatcagtccgatcctcggggtgttagatatgcccttgtcctgcaagatgtcagatccagcagacaagctgaggagtccgtgctcattgatattctggaagtcagaggggtgaagggagtttttctggccaaccaaaagattgatggcaaagtcatgacccttatcacctacaataaaggccgtgattgggattatctgagacccccatcaatggacatgaatggcaagcccacaaattgtaagccccctgactgtcatcttcaccttcaccttcgatgggccgacaacccttatgtttccggcacagtacatacaaaggacaccgcgcctggcttgattatgggagctggcaacctcggttctcaactggttgagtataaagaggagatgtacatcacaagtgactgcgggcatacttggcgccaggtgttcgaagaggaacaccatatcctgtatctggaccatgggggagtgattgttgccattaaggacacatccatccccctgaaaattcttaaattctcagtcgacgagggactcacatggtcaacacacaatttcaccagcacgagcgtgttcgtggacggtttgttatcggaaccaggcgatgagacgttggtgatgacagtgttcgggcatatatcatttaggtctgactgggaactcgttaaagttgatttccggccatccttttcacggcagtgtggtgaagaagactacagctcctgggagctgagcaatctccaaggcgacagatgcataatgggccagcagcgaagtttccggaagcggaagtctaccagctggtgcataaaaggccgatcttttacatccgctctcacgagcagagtctgcgagtgccgagacagcgattttctgtgtgactatggctttgaacggtcaagttcatcagagagtagcactaataagtgtagcgctaacttctggttcaaccccttgagcccaccagatgactgcgctctggggcagacttatacttcctcactgggctaccggaaggttgtcagtaacgtatgcgaaggtggggttgatatgcaacagagccaggtgcagctgcagtgcccgttgactcctcccagggggcttcaagtaagcatccagggtgaggccgtcgcggtcagaccaggggaggacgtgctattcgtcgtgagacaggaacagggggatgtcctgacgaccaaataccaggtagacctgggtgatggattcaaagccatgtatgttaatctgaccttgaccggcgagccaattcgccaccgctacgagtccccaggcatctatagagtatctgtgagagctgagaataccgctggccacgacgaagctgttctgtttgtgcaggtcaatagcccactgcaagccctatacctcgaagtggtgccagtgattggccttaaccaagaggtgaatcttactgccgtgctgctccccctcaatccaaatctcactgtgttttactggtggattgggcactcccttcagcctctgctatcgcttgataatagtgtcaccacacgatttagtgacacaggagacgtgcgtgtgaccgtccaagccgcttgtggaaattcagtgttacaggatagtcgcgtactgcgggtactagatcagttccaggtcatgcctctccaattcagcaaagagttggacgcctacaacccaaatactcccgagtggagagaggacgtcggcctagtggtgacacgcttactgagcaaggagaccagcgtcccacaggaacttctggttacggtggtaaaacccggactgccgactctggccgacttgtacgttcttctccctccccctcgtccaaccaggaagagaagtctctcatccgataaacgcctggccgctattcagcaggtcctaaacgcccaaaagatttctttcctgttgaggggcggtgtgagagtgctagtcgccctgcgggatacaggcaccggtgcggaacagctggggggagggggaggttattgggccgtagtcgtcctgtttgttattggacttttcgctgcaggcgcattcattctgtataaattcaaatcccgcaagcggcctggcagaaccgtgtacgcccagatgcacaacgagaaagaacaggaaatgacaagccctgtctctcattctgaagatgtgcaaggtgcagtacagggcgaagagttcattgatgacgatctagattcgcagacattgggaaaccatagtggagttgtgctctcgattaattcgcgagaaatgcattcgtatctggtttcctag

SEQ ID NO: 241943 - DNA, 3480 bp, Artificial Sequence
  Description of Artificial Sequence: Synthetic coding sequence
atggcccaccgcggaccgtccagagccagtaaaggccctggccctactgctagggcgcctagcccaggagccccacctccaccacgatccccaagaagccgaccactccttttgctgcttctgctgttgggcgcatgtggggctgctgggaggtccccagaaccgggtcgcctcgggccacacgcccagctaacgcgggttcccaggagccctccagctggcagagctgaacctggtgggggagaggatcgccaggccaggggaaccgagcctggggcacctggcccatcgccaggcccagcccctggcccaggggaagatggggcacccgcagccggttacagaagatgggagagagctgcacccctcgctggcgttgctagccgagcacaggtatctctgatctctacctctttcgtactcaagggggacgccacccacaatcaggccatggtgcactggaccggcgagaattcttctgtgattctcatcctgactaaatactaccatgcagacatgggcaaagttctggagtcctcactctggagatccagtgattttggcacatcctatacaaagctaacgctacaaccaggagtgacaaccgtcattgacaacttctacatctgcccaaccaacaagaggaaggttattcttgtaagcagctctctatcagaccgggaccagtctctatttttgtcggctgacgaaggcgcaacattccagaagcaacctattcctttctttgtagagaccttaatcttccaccccaaggaggaagacaaagttttagcctacacaaaggaatccaaactctatgtatcctcagacctgggaaaaaaatggacactcctacaggaaagggttactaaagatcatgtgttctggtcagtgtctggcgtcgacgccgatccggatttagtgcacgtggaagcccaggatctgggcggtgactttcggtatgtaacatgcgctattcataattgtagtgagaagatgttaacagcccctttcgctggacctatcgaccatggtagcctcaccgtccaggacgactacatcttttttaaagctacatcagccaaccaaacaaaatactatgtctcctatcggaggaacgagtttgttctcatgaaactccctaagtatgcgctgcccaaagacctgcaaattatttccactgacgaatcccaggtctttgtggcggtccaagagtggtaccagatggacacgtataacttgtatcagagcgatccacgaggagttagatacgctctggtcctgcaggatgtgaggtcgagccgacaggcagaggagagtgtgttgatagatatcctggaggtgcggggagtgaaaggcgtgttcctggcaaaccaaaagatcgacggaaaggttatgaccttgatcacatataacaagggccgagattgggattacctcaggcctccctccatggacatgaatgggaaacccacaaactgcaagccgcctgactgtcacctgcacctgcatctgcggtgggccgacaatccatacgtatcgggcaccgtgcacacaaaagacacggcaccgggtttgattatgggcgcaggaaacctggggtctcaattggtcgagtacaaggaggaaatgtatataacatctgactgcggacacacatggagacaagtttttgaggaggagcaccacatcctttacctggaccacggcggtgttattgtcgctattaaggatacttctatccctctgaaaattctgaaattctcggtggacgaagggctgacctggtcaacacacaacttcacgagtactagtgtttttgttgatggcttattgtccgagccaggcgacgagaccctggtcatgacggtgttcggccatatcagctttagatccgactgggaacttgtcaaagtggattttaggccatccttctcacggcagtgtggggaggaagactactcctcatgggagttatctaacctgcagggcgatcgctgcataatgggccagcaaagaagcttcagaaagagaaagtctacatcctggtgtattaagggaaggagcttcacctccgccctgaccagtcgcgtatgcgagtgtagagactcggattttctttgcgactacgggttcgaacggtcgagcagttccgagtcttcgaccaataaatgcagtgccaacttctggttcaacccccttagccccccagatgactgtgctctgggtcagacttacacatcctcactcggttaccgcaaagtggtttctaacgtgtgcgaaggcggagtggatatgcaacagtctcaggtgcagctgcagtgtcccttgacacctcctcgagggcttcaggtgagtatacagggcgaagccgtggcagtaagaccgggtgaggatgtactgttcgtagtccggcaggagcagggggatgttttgacaaccaagtaccaggttgaccttggtgatggcttcaaggctatgtacgtaaatctcactctaaccggcgagcccatccgtcaccgctacgaatcccccggaatctaccgggtgtcagtgcgcgctgaaaacaccgcaggtcatgacgaggcggtcttgttcgtccaggtcaactctccgctgcaagccttgtacctggaagtggtgcctgtaatcgggctgaaccaggaagtcaatttgacagccgtgcttctccctctgaaccccaacctgaccgttttttactggtggatcggtcattcactgcaacccctgctcagcctggataattccgtgacgacaagatttagcgacaccggcgatgttagagtgacagtgcaagcggcatgtgggaattcagtccttcaagatagtagggtgctccgggttctggatcagtttcaggttatgcccctgcagttttccaaggagcttgacgcgtataatccaaatacacctgaatggagggaggacgtcggcctagttgttacccggctgcttagtaaggaaacttccgtcccacaggaactgttggtcactgtggtcaagccaggactgcctactttagcagatctctacgtcctgctcccaccaccccgacctacccgaaagcgcagcctatctagcgataaacgcctagcagctatccagcaggtactgaatgcccagaagatttctttcctgctgagaggcggtgtacgggtgctggtagccttacgagacacaggtacaggagccgaacagctgggaggcggtgggggttattgggcagtggttgttctcttcgtgatcggtctgtttgccgctggcgctttcattctctataagtttaaacgaaaacgccctgggaggactgtgtatgctcaaatgcacaatgaaaaagaacaggaaatgacctccccagtctcccatagcgaagacgtgcagggtgccgtacagggcaaccattctggcgtggtactgtccatcaacagtcgggagatgcacagctacttggtgtcatag

SEQ ID NO: 241944 - DNA, 594 bp, Artificial Sequence
  Description of Artificial Sequence: Synthetic coding sequence
atgggagaaagaaagattttcaaaaagagaaaacccggagctcaatgcgccttgggcagggaccactccggctcagtggtgagcgagccctgcgtctgcgctaattgggatttcgaatgcgattacgggtatgaaagacacggagagagtcaatgcgtgcctgctttctggtacaaccctgcttcaccaagtaaggactgtagcctgggacagtcgtatctgaatagcaccgggtacaggcggattgtgtccaacaattgcaccgacggactgcgtgagaagtacaccgcaaaggcacagatgtgtcccggaaaagcgcctagaggcctgcatgtcgtgaccactgatgggcgtcttgtcgccgagcagggccacaacgcaaccttcatcattctgatggaggagggagacctgcagaggacaaatattcagcttgacttcggggacgggattgctgtgtcttatgctaacttctcacccatcgaggacggcattaaacatgtgtacaagagcgcagggattttccaggtcaccgcctacgctgaaaataatcttggaagcgacacggcggtcctgttcctccacgttgtgtag

SEQ ID NO: 241945 - DNA, 3669 bp, Artificial Sequence
  Description of Artificial Sequence: Synthetic coding sequence
atggaggctgctagaactgagcgccctgccggtagaccaggagccccactggtgcgaacgggactgcttctcctgtctacatgggtcctggccggtgctgagataacttgggatgccaccggtggacccggacggccagccgcacccgctagtcgtcctccagctttgtcacctctttcaccaagagccgtggcttcacaatggcctgaggagctggctagcgccaggagagctgccgtcctgggcagaagagcagggccagagcttctacctcagcagggcggaggaaggggcggagagatgcaggtagaggctgggggaaccagccctgcgggagagcggagaggcagaggcattccggctccagctaagctagggggtgcgagaaggagtcggagagcccaaccgccaatcacccaggagagaggagatgcgtgggccaccgcgccagccgacggaagcagagggtctagacctctcgccaagggctccagagaggaggttaaggcgcctagggctggtgggagcgctgcagaggatctgcggctgccgagcacctcatttgccttaacaggcgactcggcacacaatcaagcgatggttcactggagcgggcacaacagtagtgtgatcctcatattgacaaagttatatgatttcaacctgggttcagtgacagaaagtagcctgtggaggtccacagattacgggaccacttacgagaagcttaatgataaggtggggttgaaaacagtactctcatacctgtacgtaaatcccaccaataaaagaaagattatgctgctgagcgatccagagatggagagttcaattctgatctcgagcgacgagggcgctacatatcaaaagtataggcttacgttttacattcaatctctgctatttcatccaaaacaggaagactgggtgctggcatactcactggaccagaaattatacagcagcatggacttcggcagacgctggcagctcatgcatgagagaattactcctaataggttttactggagcgtagctggcctggacaaggaagctgatctggttcatatggaggtcaggactactgatggctacgctcactacctaacctgtaggatccaagagtgcgcggaaactacgcggtccggaccttttgccagatcgatcgacatctcgtcgctggttgttcaggacgagtatatttttatccaagtgaccaccagcggcagggcttcctactatgtgtcttatcgcagagaggcatttgcacaaatcaagctgccaaaatattccctgccgaaagatatgcatatcatttcaacagacgaaaatcaggtgttcgcggcagttcaggagtggaatcaaaacgacacctataatctctacatctctgacacacggggtatttattttacactggccatggaaaatattaaatctagccggggattgatggggaatatcataatcgagttatatgaggtggccggtatcaaaggaatctttctggcaaacaaaaaagtagacgaccaggtgaagacttacataacctacaataaggggagggactggcggcttctgcaagctcccgacgtagatctgaggggttccccggtgcattgccttctgcctttctgttccctgcatctgcatctgcagttgagcgagaacccatacagtagtgggcgaatcagcagcaaggaaaccgcccctggcttggtggttgctacaggcaacatcgggcctgagctgtcctacacagacatcggtgtgttcatcagcagcgacgggggaaatacctggcgacaaattttcgatgaagaatacaatgtttggtttctcgattggggtggcgctctggtggcaatgaagcacacccccctacccgtcagacacttgtgggtgtccttcgacgagggccactcatgggacaaatacgggtttacttccgtccccttatttgtagatggcgctcttgtggaggcaggcatggagactcacattatgactgtcttcgggcatttcagcctgagatccgaatggcagctggttaaggtcgactacaaaagcatcttctccaggcactgtactaaagaggactatcaaacctggcacctgctcaatcagggcgagccttgcgtgatgggcgagagaaagattttcaaaaaacggaaaccaggggctcaatgcgctctgggcagagatcattctggatccgttgtgtctgaaccatgcgtgtgtgccaattgggatttcgagtgcgattatggttatgagcggcatggtgagagtcaatgtgtgccagctttctggtacaaccctgcatccccgagtaaggattgttctctgggacaatcgtatcttaatagcactggttaccgacgcatagtttcaaataattgcactgacggactgcgcgagaagtacacagccaaagcccagatgtgcccagggaaagcgcctcgcggtctccatgtcgtcactacagacggtagattggtcgccgaacaggggcataacgcgacatttattattcttatggaggagggggacctccagcgcacaaatatacaactggattttggcgacggaatcgctgtaagctacgcaaacttctcgcctatagaggacgggattaagcacgtgtataagtctgcaggtatcttccaagtcacagcgtatgccgaaaataatctggggagcgatacggctgtactgtttctacatgtggtgtgtccagtggagcacgtgcacctgcgggtacccttcgtggcaattcgcaacaaggaagtgaacattagtgctgttgtttggccatcacagctgggcacactgacctacttttggtggttcggaaacagcacgaagcccctaattaccttggactcatcaattagttttacgtttctcgcagaagggaccgacaccatcacggttcaggtagccgctggcaacgcactgatacaagacaccaaggagatcgcagtgcacgaatactttcaaagccagctgcttagcttctcaccgaacctcgactaccacaatcctgatatccccgaatggcgaaaggatattggaaacgtgattaagcgagccctggtgaaggtgacgagtgtaccagaggaccagattctgatcgcagtatttcccggactgcccacctcagctgagttgtttatcctgccacccaaaaatttgacagaacggaggaagggtaatgagggagacctggaacagatcgtggagaccctgttcaatgccctcaatcagaacctcgtgcagttcgagctcaaacctggggtccaagtgatagtatacgtcacacagttaacattggctccccttgtggactcttccgcaggtcactcttcatcagccatgctgatgctgctgtctgttgtgttcgtaggacttgccgtgttcctaatctataagttcaagcgcaaaatcccttggatcaacatttacgcccaagttcagcacgataaagagcaagaaatgatagggtcggtttcccaatctgagaacgctccgaagatcacactgtcagacttcactgaaccagaggaactgctcgacaaggagctcgatacaagggtaatcggtggtatcgccactatagctaacagcgaatctaccaaggagatacctaattgcacctcagtgtag

SEQ ID NO: 241946 - DNA, 462 bp, Artificial Sequence
  Description of Artificial Sequence: Synthetic coding sequence
gaaaacccttattcctcgggccgaatttcatctaaggagaccgcccctgggctggtagtggcaactgggaacattggcccagagttgtcctatacagatattggagtctttatctcttctgacggagggaatacatggcgccaaatattcgatgaagaatataacgtgtggttcctcgactgggggggtgcactggtggctatgaaacatacccccctacccgtgcgacatctgtgggtcagcttcgacgagggacacagttgggacaagtacggttttacatccgtccccctattcgtagacggagcactggtggaggcgggtatggagacacacataatgactgattacggttatgagcggcacggtgagtctcagtgtgttcccgctttttggtataacccggcttcacctagtaaagattgcagcctgggccagtcatacttaaattccactggatag

SEQ ID NO: 241947 - DNA, 1410 bp, Artificial Sequence
  Description of Artificial Sequence: Synthetic coding sequence
atgggaactgttcacgccagatcactcgaaccattaccatcttctggccctgacttcggcggactgggagaagaagcagaattcgtcgaggtggagcccgaggcaaaacaggaaattctggaaaacaaggacgtagtcgtccagcatgttcacttcgacggcctcggaaggacaaaggacgatatcattatctgtgagatcggcgatgtctttaaagcgaaaaatttgattgaagttatgcgtaagagccatgaagctagggaaaagttgttgaggttaggaatatttcgacaggttgatgtactcatcgatacatgccagggggatgacgcacttcctaacggtcttgatgtgacatttgaggtcaccgagctacggcgtttgacgggctcttataacacgatggttggcaacaacgagggctcaatggttctgggactgaagttgcctaacctgttaggacgagcagagaaagtgaccttccagttctcttatggcaccaaggagactagctacgggttgagtttctttaaacctaggcctggcaatttcgaacgaaatttttcggttaacttatataaagtgaccggccaattcccatggtccagccttagggagacagacaggggcatgtccgccgagtactcctttcccatctggaaaacttcccacaccgtaaaatgggagggcgtgtggcgcgagctgggttgcctctctcggaccgcttcctttgctgtccgaaaagagtcaggtcacagcctaaaaagcagcctgagccatgccatggtgattgattcacgaaacagctcgattttgcccagaagaggcgcattactaaaggtgaatcaagaactagctgggtacactggcggagacgtgtccttcattaaggaagatttcgagctgcagttgaacaagcagctgatattcgatagcgtgttctccgctagcttctggggtgggatgctggtacccataggtgataagccatcaagcattgccgataggttctatctcggcggacctactagtattcggggtttcagtatgcattccatagggccacagagcgaaggcgattatcttggtggcgaagcatactgggctgggggtctccacctctatacccctctgccattccggcctggtcagggcggattcggggagttattcagaacccacttcttcttaaacgctggcaatctctgcaatctgaattatggggagggacctaaagcccatattaggaagttggcagaatgtatcagatggtcgtacggtgctggcatcgtcctgcggctggggaatattgctagactcgagctgaactattgtgtcccaatgggagttcagactggtgacagaatctgtgacggagtgcagttcggcgctggtatccgtttcctgtag

SEQ ID NO: 241948 - DNA, 780 bp, Artificial Sequence
  Description of Artificial Sequence: Synthetic coding sequence
atgtctgctgagtactcttttccaatttggaagactagtcacacagtgaaatgggaaggggtgtggcgggagttagggtgtctctcaagaactgcctcctttgctgtcaggaaggaatctggccactccttaaaatctagtcttagccatgcgatggtgatcgatagcaggaacagctcgatcctgcccaggcgtggcgcactattgaaggtgaatcaagaactagctggttatactgggggtgatgtctctttcataaaagaagattttgagctccagttgaacaagcaactaattttcgactctgtgtttagcgcaagtttttgggggggaatgctagtacccattggagataagcccagcagtattgccgatcgattttaccttggagggcctacatcgattcgcggtttttccatgcactctatcggaccgcaatctgagggggactatctgggcggtgaagcctactgggctggcggactccatctgtatacccccctgccttttaggccaggacagggtggcttcggagagctcttcaggacccacttttttctcaacgccggaaacctgtgtaacttgaactatggcgagggcccaaaggcccatattcggaaactggccgagtgtattaggtggagctacggcgcaggcattgtgctcagactggggaatatagcgcgactggagctaaactactgcgtccctatgggggtgcagactggggataggatttgcgacggagtgcaattcggagccggaattaggtttctgtag

SEQ ID NO: 241949 - DNA, 1425 bp, Artificial Sequence
  Description of Artificial Sequence: Synthetic coding sequence
atggccagcggaggaggtggctgctctgcttcagagagactgcctcccccttttccaggccttgagcctgagagcgaaggtgctgcaggcggttcagagcccgaggctggggactcagacactgaaggcgaagacatcttcaccggcgctgccgtggtctccaaacaccagtctcccaagataactacttcactgctgccaattaacaacggatccaaggagaacggaatccacgaagagcaggaccaggaaccgcaggatttgtttgcagacgctacagtggagctgagtttggattctacccagaacaaccagaaaaaagtgctggccaaaaccttgatcagcttgcctcctcaagaggcgactaactcatccaagccgcaacccacatacgaggagctggaggaagaagagcaggaagaccaatttgatctcacagttggcatcacggatccagagaaaatcggagatggtatgaacgcatacgttgcctacaaggtgaccacacagaccagcctcccactgttcagatccaagcagtttgctgtgaagcgaagattcagcgatttcctgggactctacgaaaagctgtcggagaaacatagccagaacggcttcatagttccccctccccctgagaagagcttgattggcatgactaaagtgaaggttggtaaagaggatagttcatctgcagagttcttagagaagagaagagccgctcttgagcggtatctccagcggattgttaatcatcctacaatgttacaggacccagatgtacgggagttcctggagaaggaagaactcccgagggctgtcggtacccagacactgagcggggctggactgttgaaaatgtttaataaggccactgatgcggtctccaaaatgacaattaagatgaacgagtcagacatctggttcgaggaaaagcttcaagaagtcgagtgcgaagaacaaagactgagaaagcttcatgctgtagtggagacgttggtaaaccacaggaaagagctggccttgaatacagcacagttcgccaagagtctggctatgctaggctctagcgaggataatacagcgctgagtcgggctcttagtcagcttgccgaagtggaagaaaagatagagcagttacatcaggagcaggccaataatgatttctttctgctggccgagcttttgtccgattatatacggttactggccattgtgcgttgggagtcccgggtcacccaatacgaaagagacttcgagagaatttccacagtcgttagaaaggaggtgatccggttcgagaaagaaaagtctaaggacttcaagaaccacgtgattaaatatctcgagaccctgctgtattcgcagcagcagcttgccaagtattgggaggcttttcttccagaggctaaggccatttcctag

SEQ ID NO: 241950 - DNA, 1569 bp, Artificial Sequence
  Description of Artificial Sequence: Synthetic coding sequence
atggcttccgggggaggaggctgctctgcatccgagcgccttcccccaccattccctggcctggagcctgagtctgaaggagccgctggcggaagtgagcccgaggctggagattccgacacggaaggggaggatatctttacgggtgccgcagtggtgagcaaacaccaatccccaaagattactaccagcctgctgcctattaataatgggtccaaggaaaatggtatacacgaagaacaggatcaggaaccacaggatctgtttgcggatgctaccgtggagctgtcactcgactccacacagaacaaccagaagaaagtgcttgccaaaacacttatttctctgccacctcaggaagccacgaacagcagcaagcctcaacccacctacgaagaattagaagaggaggagcaggaggaccagttcgatttgacagtcgggattaccgacccagagaaaatcggagacggaatgaatgcctatgtggcttacaaggtgacaacgcagacctccctgcctctctttaggtcaaagcagttcgcagtcaagagacgcttttccgactttctggggctgtacgaaaagctctctgagaagcactcccaaaacggattcatcgtgcccccacccccagagaaatccctcatcgggatgacaaaagtaaaggtaggaaaggaggattcttcttcggctgagttcctcgaaaagcggcgagctgccttggaacgatatttgcaacgcatcgtcaatcaccccactatgctacaggaccctgatgtgcgtgaattcctcgaaaaggaggagctgcctcgggctgtggggacccaaacgctgtccggggctggtctgttgaaaatgtttaacaaagcaacagatgccgtaagcaagatgacaattaaaatgaacgagagcgacatatggtttgaggaaaagctccaagaggtggagtgcgaggagcagcgcctgcgtaaactgcacgcagtggtggagactttagtgaatcacaggaaggagttagcactgaataccgcacagttcgctaagtcgctggccatgttgggtagctccgaagataatacagccctgagcagggcactgagccaacttgctgaggtggaggagaagattgaacaactacatcaggaacaggcgaacaatgacttctttctcttagccgagctcttaagcgattacatcaggctgcttgccatcgtgagagccgcatttgaccagcgcatgaaaacctggcagaggtggcaggatgcccaggctactcttcagaagaagcgcgaggccgaagccagactgttatgggcaaacaagccagataagttgcaacaagcgaaggacgagatattggaatgggagtcccgtgtcacgcagtacgagcgcgatttcgagcgcatctcaacggttgtccggaaagaagtcatacgctttgagaaagagaagtctaaggatttcaaaaatcatgtcattaagtacctagaaacactactgtatagtcaacaacagctggccaaatactgggaggccttcttgcctgaagcaaaggccatatcttag

SEQ ID NO: 241951 - DNA, 1374 bp, Artificial Sequence
  Description of Artificial Sequence: Synthetic coding sequence
atggctagtggcggtggaggttgctccgcctcagagcggctgccccctccatttccaggtttagaaccagaaagcgaaggagctgcaggcggaagtgaaccggaagccggagattcggatacagagggggaggatatttttacaggagccgcagtggtgagtaagcatcagtcacccaaaataaccacgtccctactgcccattaacaatgggagtaaagagaatggcattcacgaggaacaggaccaggagccacaggacctgtttgctggggacgggatgaacgcgtacgtagcctacaaagtaacgacccagacttccctgccactgttccggtcaaaacaatttgccgttaaacggcgattcagtgatttcctgggcctgtacgagaaacttagtgagaagcatagccagaacggatttatagttcctcctccacctgaaaaaagtttgattgggatgaccaaggtcaaggttggaaaggaggattcttccagcgccgagtttctcgagaagcgtcgagccgctctggaaagatacttacaacgaattgtcaatcaccccacgatgctgcaggatccggatgtgagagagttcctagagaaggaggagctgcccagagccgtgggcacccagaccctgagtggcgcaggcttgctgaagatgtttaataaagccacggacgccgtgtccaagatgacaattaagatgaatgagagcgacatttggttcgaagaaaagctccaggaagtggagtgcgaggagcaaagactccgcaagcttcacgctgtagtggagactctggtgaaccatcgcaaagaactggccttgaatactgcgcagtttgccaaatcattggccatgttgggtagcagcgaagacaatactgccctgagcagagcactgagtcagcttgctgaggtggaggaaaagattgaacagctgcaccaggagcaggcaaacaacgacttctttctcctagctgagctcctctcagactatattagacttttggccattgtgagggctgccttcgaccagcggatgaagacctggcagcgatggcaggacgctcaagccacactgcagaagaagagagaagcggaagcccgacttctctgggctaacaagcctgacaagctgcagcaggcaaaggacgagattctcgaatgggagtcaagagtgactcagtacgagcgggattttgaaagaatctctacggtggttagaaaggaagtgatccggttcgaaaaagagaagtctaaggattttaagaaccacgtcatcaaatacctcgagaccctcctctacagccagcagcaactggctaagtattgggaagcctttctgcctgaggcaaaggccatctcctag

SEQ ID NO: 241952 - DNA, 1374 bp, Artificial Sequence
  Description of Artificial Sequence: Synthetic coding sequence
atggcctccgggggagggggatgtagcgccagcgagcgtctacccccaccctttccaggacttgaacctgaatctgagggcgctgccggagggtccgagccagaggccggtgatagcgatacagaaggcgaggacatcttcacaggtgccgctgtggtgagtaagcatcagagccccaagatcactacgagccttctgcctatcaacaatggcagcaaggagaacgggatccacgaagagcaagatcaagagcctcaagatctctttgcgggagatggcatgaatgcctatgtggcttacaaggtaactacacagacttccttgccgttatttaggtccaaacagttcgctgtcaagcggaggttcagcgatttcttgggactgtatgagaagctgtctgaaaaacactcccaaaacggctttatcgtgccacccccaccagaaaagagcctgatcggcatgactaaggtaaaagtgggcaaggaggactcatcctctgcagagttcctcgaaaagcgacgcgcagccctggagcggtatctgcagcgcattgtaaatcaccctacaatgctgcaggaccctgatgtccgcgagtttcttgaaaaagaggagttaccaagggcggttggtacccagactctgtctggcgctgggctcctcaaaatgttcaacaaagcaactgatgccgtgtccaagatgaccattaagatgaatgagtctgacatctggttcgaggaaaagttgcaggaagtagagtgtgaggagcaacgccttcgaaagctgcacgcagtggttgagaccttagtgaaccatcgcaaagaactggctctgaatacagctcagttcgcaaagtctttagccatgcttggttccagtgaagataataccgcactctccagggccctgtcacagctcgccgaggtggaggaaaagattgagcagctgcaccaggagcaagccaataacgattttttccttttagcagagttgctttccgactacatcaggttgctggctatcgtgcgcgcagccttcgaccagcgcatgaaaacgtggcagaggtggcaggacgcccaggctacccttcaaaaaaaaagagaggcagaagctaggctgttgtgggctaataaaccagacaaactgcagcaagccaaagacgagatcctggagtgggagtccagggtaacccagtacgaacgcgattttgaaaggatttcaactgtcgtgcgtaaggaagtgatcagatttgagaaggagaagagtaaggattttaaaaaccacgtcattaagtatcttgaaacgttgctatatagccaacagcagttggcaaaatactgggaggcgttcctgccagaagccaaagcaatatcatag

SEQ ID NO: 241953 - DNA, 3018 bp, Artificial Sequence
  Description of Artificial Sequence: Synthetic coding sequence
atggccgctcggccatcccgggctaccggccctagaggaggacagaggagccgagttaaaccacctcccggacgcagattaaaagagcagcttccacccctcgcagctgcccgagccgtgtttgcagcagccaccgccgtgatcatgctcaccgaagcatctctgtccatctgggggtgggggtctttgggcatcgtgttattcctcatcacctttggcccatttgttattttctatctgactttctacatcctttgttttgtgggaggcggactggtcgtgacactgttgttcggtaaaacgaacagcgagaaatacttggaacagtgcgagcattctttcctgcctcctacatccccgggtgtgcccaagtgtctagaagagatgaagagggaggccaggacaatcaagatcgacagaaggctaacaggagcaaacattattgatgagccactccaacaggtaatccagtttagcttaagggattatgtgcaatattggtattatacactatcagacgatgaaagctttctcctcgagatcaggcaaacacttcagaatgccctcatccagtttgcaacccgtagtaaagagatagattggcagccctactttacaactcggatagtggacgacttcgggactcacttgagagtttttcggaaggctcagcagaaaataacagaaaaagatgatcaggttaaagggaccgccgaggacttggtcgatacgttcttcgaggtggaggtggagatggagaaggaggtctgtagagacctggtttgcacatcacccaaagacgaggagggctttctgcgagatctgtgcgaggtcctcctctacctgttgctgcctcccggtgattttcaaaataaaatcatgcgatactttgtgcgcgagatcttagcacgtggcatcctgctgcccctgatcaatcaactaagtgacccggattacattaatcaatacgtgatttggatgatccgagattctaactgcaactatgaggcattcatgaacattatcaagttgagtgataatataggggaactggaagccgtccgggataaagccgctgaggaactacaatatctccgctctctggacactgccggagacgatataaacacaataaagaaccaaattaacagtctgctgttcgtgaagaaggtgtgcgattcccgcatccagcgcctgcaatcaggtaaggagattaacacggtcaagctcgcggcaaatttcggaaagctgtgcacagtacctctcgactccatcctagtcgataacgttgctctgcaatttttcatggattatatgcagcagacaggagggcaagcgcacctcttcttctggatgaccgtggaggggtacagagtaactgcacagcagcagcttgaagttcttcttagcaggcagagggatggtaaacaccagactaatcagaccaagggactgctcagagcagccgctgttgggatctacgagcagtacctgtctgagaaggcctccccccgagtgacagtggacgattaccttgtggcaaaactcgccgacacccttaaccacgaagatcccacgccagaaatcttcgatgatatacaacggaaagtgtacgaactgatgctgcgagacgaaagattctatccttccttccggcagaacgccctgtacgtaaggatgttagctgagttagatatgctcaaggatccatcgttccggggtagcgacgacggggacggcgaatcattcaacggatcccctacaggctctatcaacctctctctggatgatctgtccaatgtatctagtgatgactctgtgcagctccacgcatacatttctgacacaggcgtatgcaacgatcacgggaagacttatgccctttacgccatcaccgtgcacagaagaaatctcaattccgaagagatgtggaaaacttacaggagatacagtgacttccacgatttccacatgcgcatcacggagcaattcgagtctctgtccagcattctcaagctgccaggcaaaaagacattcaataacatggatcgagattttctggagaagaggaagaaggatcttaacgcctatctgcaactccttctggctccggagatgatgaaggcctctcctgctctagcccattacgtgtacgactttctggagaataaagcctattcaaaaggaaaaggcgatttcgccaggaagatggacaccttcgtcaatccccttaggaactcaatgaggaatgtgagcaacgcagttaagtccctaccggactcactcgccgaaggaatgacaaagatgtctgataatatgggtaaaatgtcagagcgactgggacaggatatcaaacagtcattctttaaagtgccaccactcataccgaagactgactccgaccccgagcatcggagagtgagcgctcagctagacgacaacgtcgatgataatattcctcttagagttatgctgttactgatggatgaggtgtttgacctcaaagaaagaaatcagtggctcagaagaaatatcaaaaatctgctgcagcagctgatccgtgcgacctacggggacacaatcaatcgcaagatcgtggatcacgtagactggatgaccagtccagagcaggtagctgactccgtgaagcgattccgcgacgctttctggcctaatgggatccttgcggaggccgtcccgtgtagggataaaagtatacgcatgaggaccagagtcgccggtaaaaccaaactccttgcaattatgcctgatgaattgaaacacatcataggcgctgaaaccactagaaaagggatcttgcgcgtgttcgaaatgtttcagcataatcaactgaacagacggatggtctacgtgttcctggaaggcttcttagagactctgttcccgcaatacaagttccgcgagctcttcaacaaactgcacagccggtctaaacagatgcagaaatacaaacaaaagctgcagaccacgcaggccccttccctgcagaaaagatag

SEQ ID NO: 241954 - DNA, 2874 bp, Artificial Sequence
  Description of Artificial Sequence: Synthetic coding sequence
atgctaactgaggcatcgctgtctatttggggctggggcagcctgggcattgtgcttttcctgattacgtttggaccgtttgtcattttttatctcaccttttatatactttgcttcgtgggcggaggcctcgtcgtgacacttctgtttggcaagactaatagcgaaaagtacctggagcaatgtgaacactcattcctgcctcccactagtccaggagtgccaaaatgtctagaggagatgaagagagaggccaggaccataaaaatcgacaggcgcttgaccggggcaaatatcatcgatgaacccctccagcaggtgatccaattctcactgagagactatgtccagtattggtattacacgctttctgatgacgaatcttttcttctggaaatcagacaaacacttcagaacgcactgatccaattcgcaaccagaagcaaggagatcgattggcaaccgtactttactacgcgtatcgtggacgatttcggaacacacttgcgtgtgtttcgaaaggcacaacaaaaaattaccgagaaagacgaccaggtcaaggggacagctgaggacctggttgacacgtttttcgaggtggaagtagagatggaaaaagaagtgtgtcgcgatctagtgtgtaccagtcccaaggatgaagaaggcttcctgcgagatttatgcgaagtgctgctctaccttttactccccccaggtgatttccaaaacaaaataatgagatactttgtgagagagatcctcgccaggggaattctgctgccactgattaaccaactcagcgatccagattatatcaatcagtacgtcatatggatgatccgagatagcaactgcaattatgaggcttttatgaacatcatcaagctcagtgacaacatcggtgagcttgaagccgtccgagacaaggccgctgaggagctgcagtatctgaggtcactggacaccgccggagacgacatcaatactataaaaaatcagattaacagtcttctttttgtgaagaaggtgtgtgacagccggattcaaaggctccagtccggcaaggagataaatactgtgaagctggccgcaaacttcggcaaactgtgtaccgtgccgcttgattccatcctcgtggacaacgtggccctccagttttttatggattacatgcagcagaccggtgggcaggcccaccttttcttctggatgactgtagaagggtatagggtaactgcccaacagcaactggaagtcctcctttcgagacaaagagatggcaagcatcagactaaccaaactaaggggctcctcagagctgctgcagtcggaatttatgaacagtacttgagcgagaaagcctcccctcgggtcacagtggacgattatttggtggcaaagcttgccgatactcttaaccatgaagatcccacacctgagatcttcgacgacattcagagaaaggtttacgaattgatgttgagggatgaaaggttttaccctagtttccggcagaatgctctttatgtgcgcatgctcgcggaattagacatgttgaaagacccttcattcagaggctccgatgatggggacggggagtcattcaacggctcaccgactggatctatcaatctgtcgctggacgatctctccaatgtctcaagcgacgactccgttcaattgcacgcatatatatctgacacaggggtgtgcaatgatcacggtaagacttatgctctctatgctatcaccgtacatcgccgtaatctaaacagcgaagagatgtggaaaacatatcgaaggtatagcgactttcacgactttcatatgagaataaccgagcaattcgagtcgctgagtagtattctaaaacttccgggtaagaaaacattcaataatatggaccgagattttctggaaaagcggaaaaaggacctgaacgcatacctgcagctgctactggcccctgagatgatgaaagcctcacccgctcttgcacattacgtctacgactttttggaaaacaaggcctactctaagggtaagggcgattttgcccgaaaaatggatacgttcgtgaaccctcttaggaattccatgcgcaatgttagtaatgctgtaaaatcccttcctgattctctcgcggaagggatgactaaaatgagtgataatatggggaagatgtccgaacgcctggggcaggatatcaagcagtcgttcttcaaggttcccccacttattcccaaaaccgacagcgaccccgagcacaggagggtttccgcacagctcgatgataatgtggatgacaatattcccttacgcgtgatgctcttgctgatggatgaagtgttcgatctcaaggaaaggaaccaatggcttagacgcaacatcaaaaacttgctccagcaattaattcgagctacctacggggatactattaaccgtaagatcgttgaccatgtagactggatgaccagccccgagcaggtggcggatagcgttaaaagatttcgggacgcgttctggcccaatggaatattggcagaggcagtcccctgtagggataagtccatacgaatgcgaacccgcgtcgccggaaagactaagctgctcgccattatgcccgacgagttgaaacacattatcggagctgagaccacaagaaaaggtatccttagagtgttcgagatgtttcagcataaccagttgaataggcgaatggtgtacgtgttcctggaggggttcctagagaccctgtttccacagtataagttccgagagttgtttaataagctgcactcaaggagcaagcagatgcagaaatacaagcagaaattacagacaacgcaagcacctagcttgcagaaacggtag

SEQ ID NO: 241955 - DNA, 771 bp, Artificial Sequence
  Description of Artificial Sequence: Synthetic coding sequence
atgtcccgccaggcaaaagacgacttcctacggcattacaccgtttccgaccctcgaacccacccgaaaggctacaccgaatacaaggtgactgctcagttcatcagtaagaaagatccagaagatgtcaaagaggtggtagtgtggaagcgttacagcgactttaggaaactgcacggtgatctcgcctatactcatcgcaatctgtttcgtaggttagaagaattccctgcatttcccagagctcaggtcttcggaagatttgaagcctcagtcatagaggaacgcagaaaaggagcggaagatttgttacgcttcaccgtccatatccctgccttaaataattcccctcagctcaaggagttctttagaggtggcgaagtgaccaggccactagaagtgtctcgagacctgcacatcttaccgccacccctgatccctaccccgcctcccgatgatcccaggctgtctcagctgctccccgcagaacggaggggattggaggaacttgaagttcctgtcgatcccccaccctcaagcccggcacaggaggctctcgacttgctcttcaactgcgagtccacggaggaggccagtggcagcccagcgcgaggtccactgacagaggcagagctggcactatttgatccgttctctaaggaaggagatccacttccagcgcgtcaagaaggagtcaagaaaaaggctgcggagtatctgaaaagagccgaggagatcctgcggcttcacctgtcccaactgccaccatag

SEQ ID NO: 241956 - DNA, 1029 bp, Artificial Sequence
  Description of Artificial Sequence: Synthetic coding sequence
atgagtcgtcaggccaaggatgatttcttacgccattataccgtgtccgacccgaggacacaccccaaaggttataccgaatacaaggtcacagcccaattcatttctaaaaaagatcctgaggacgtcaaagaggtggttgtctggaaacgatactctgacttccgaaagttgcatggcgatttagcttacactcatcggaatcttttccgcaggctggaggagttcccagcattccctcgtgcccaagtcttcggaaggttcgaggcttctgtgattgaggaacggagaaagggcgctgaggaccttctgaggttcaccgttcacattcccgctctgaataacagcccacagctcaaagagttcttcagggggggagaggtgacacgtccactggaggtctctcgggacttgcacattttaccccctcctctaatccctactcccccacccgacgaccctcggctctcccagctattgcctgccgagaggagggggctcgaagagctggaagtaccagtggaccctccgccaagctccccggcacaggaggcactcgacttactgtttaattgcgagtccaccgaggaagcctccgggtcgccagccagaggacctctcactgaagccgagctggcccttttcgatcctttctcaaaagaagagggggctgcgccatctccaacacatgtggccgagctggccactatggaagttgaatcagccagattggatcaggagccctgggagccaggaggacaggaggaagaggaagatggtgaggggggtccgactccggcttacctgagtcaagccaccgagcttatcactcaggccctccgcgacgagaaggccggagcctacgcggcagcgctccaagggtaccgagacggggttcacgtcctgttacagggcgtgcccagtgaccctttacccgcacggcaggagggagtgaaaaaaaaagcagcggaataccttaagcgggctgaggaaatcttgagacttcatctgagccaactgccaccctag

SEQ ID NO: 241957 - DNA, 1608 bp, Artificial Sequence
  Description of Artificial Sequence: Synthetic coding sequence
atgtctgagggagagtctcagaccgtattgagtagtggatccgaccccaaggttgaatcatctagctctgctcccggactcaccagtgtctcccctccagtgactagcactacgtccgccgctagccccgaggaggaggaggagtccgaggatgagtccgaaattctcgaggagagtccttgcgggcgttggcagaagcgacgggaggaggtcaatcagcgaaacgtccctggtattgactccgcatatctggctatggatactgaggagggtgtagaggtggtgtggaatgaagtgcaattctccgaaagaaaaaactataaactccaagaagagaaggtaagggcagtctttgataatctcatacaactggagcacttgaacattgtcaagttccacaagtattgggccgatatcaaggagaataaggcaagggtgatcttcatcaccgagtacatgtctagcgggtccctgaaacaatttctcaaaaagaccaagaaaaatcacaagacaatgaacgagaaagcttggaaacgctggtgtactcagattttgtctgccctgtcctacctgcacagttgcgaccctccaataatacacgggaatctcacctgcgacaccatattcatccagcataatgggctgattaagattggcagtgtagccccagacaccattaacaatcacgttaagacttgtagggaggagcaaaaaaatcttcacttttttgcaccagagtacggagaagttacaaatgtaaccactgcagtagatatttactccttcggcatgtgtgccctcgagatggccgtgttagagatccagggaaatggcgaaagctcttacgtcccacaggaagccatcagtagcgctattcagctcctcgaagatcccctccaacgcgaattcattcagaagtgtctgcagtcagaacccgctagaaggccaacggctcgagagctgctcttccaccctgcactttttgaagttccaagtctcaagctgctcgccgcacattgtattgtcggtcaccagcatatgattcccgagaacgccctggaagagatcaccaagaatatggacacctctgcggttctcgcagagattcccgcaggaccagggagggaaccagtacaaacattgtactcacaaagcccagccctcgaattggacaaatttctggaggatgtgagaaacgggatctaccccctgactgcctttggactcccaagacctcagcagccgcagcaggaagaggttactagtcccgtggtgccgccttccgtgaagacccccacgccagagcccgcagaagtggagacaagaaaggtggtattaatgcagtgtaacatagagagcgtggaggaaggcgtgaaacatcatctgacactgctcctcaaactggaggacaaattaaatcgacatctctcttgcgatcttatgcctaatgaaaacattcctgagttggctgcggagctcgtacagctcgggttcatatcggaggctgatcagtcgagactcacatccctgcttgaagagacacttaacaaatttaatttcgctcgtaactctaccctcaatagcgccgctgtgacagtgtctagttag

SEQ ID NO: 241958 - DNA, 1338 bp, Artificial Sequence
  Description of Artificial Sequence: Synthetic coding sequence
atgcatttctcaatcccagaaacagagtccagatccggagattccggaggatcagcctacgttctaaggaaagaatatggagcaaatgttcttccggcattcccaccgaagaagctgttttctttaacaccagcagaggtggaacagcgtagggagcaactagagaagtacatgcaggcagtacgtcaagaccccctgttggggtcaagcgaaacattcaatagctttctgagacgggctcagcaagagacccagcaagtgcctaccgaggaagtatccttggaggtcctgctctcgaacggtcaaaaagtcctggtgaatgtgctcactagcgaccaaacagaagatgtgctcgaggctgttgccgctaagctggatcttcccgacgacctcatcggatatttttcactgttcctggtgagagaaaaggaagacggggcttttagctttgtgcgcaaactccaggagttcgagctgccatacgtcagcgtgaccagcctgcgcagccaggaatacaagatcgtgctcagaaagtcgtactgggattcagcttacgacgatgacgttatggagaaccgcgtgggcctgaatctactgtacgcacaaacagtcagcgacatcgagaggggatggattctggtaactaaagagcagcatagacagctgaaaagcctgcaggaaaaagtaagtaagaaggagttccttcgccttgcccagactcttcggcactacggctatctgaggttcgacgcctgtgtggctgactttcctgaaaaggattgtccagtggtggtgtctgctggcaatagtgagctttccctacagctgcgcctgcccggacagcagcttagggagggctcctttcgcgtaaccagaatgcgctgttggagggtgacatcaagtgtcccactccctagtggctcaaccagctcacccggaagaggccgtggcgaggtgcggctggaactcgcgttcgaatatctgatgtcaaaggaccgcttacagtgggttacaatcacgagtccgcaggctataatgatgagcatttgcttgcagagcatggtagatgaactgatggtcaaaaagtccggcggatcaatcaggaagatgctcagacggagagttggaggaactctgcgcagaagcgatagccagcaggccgtgaaaagcccccctctgctggagtccccagacgcaaccagggagtcgatggttaagctgagcagcaagctgagcgccgtctctctgagaggcattggtagcccttcgacagatgcctccgcttcagacgtccacggcaactttgcattcgagggaattggagacgaggacttatag

SEQ ID NO: 241959 - DNA, 771 bp, Artificial Sequence
  Description of Artificial Sequence: Synthetic coding sequence
atggagaatagagtcggcctcaatctgctttacgcccaaacggtgtccgatatcgagaggggctggatcctcgtcaccaaagaacaacacagacagcttaagagtctccaggagaaagtttctaagaaggaattccttcggctcgcccaaactctgcgacattacggctacttaagattcgacgcgtgtgtggccgacttccctgaaaaagactgccccgtcgtcgtttcagcgggaaactccgaactctctcttcagttgcggcttcctggacagcagcttagagagggcagttttcgtgtgacgcggatgcggtgctggagggtgactagtagcgtgccccttccctctggctccacttcatctccaggacgcggaagaggggaggtgcgattagagctcgcatttgagtatctgatgtctaaggatcgccttcagtgggtgaccatcacttccccgcaggctataatgatgtccatttgccttcagtctatggtggatgagctgatggtgaagaaatcggggggatcaatacggaaaatgctgaggcgccgagtgggtggtaccctgagaaggagtgattcgcaacaggccgtgaaaagcccccctcttctggaaagtccagatgcaacacgggagtcaatggtgaagcttagctcgaagctttctgccgtcagtctcaggggcattgggtccccaagtactgacgcctctgctagtgacgtccatgggaattttgcgttcgagggcatcggcgatgaagacctgtag

SEQ ID NO: 241960 - DNA, 771 bp, Artificial Sequence
  Description of Artificial Sequence: Synthetic coding sequence
atggagaatcgcgttggcctcaacctgctgtatgcacagacagtgtccgacatagaacgcggatggattctggtgaccaaagagcagcatcgccagctcaagtccctgcaggaaaaagtgtccaagaaggagttcttgcgactcgcgcagacccttaggcattacggatatttgcgcttcgacgcctgcgtggcagacttccctgaaaaggattgtccagtcgtggtttctgccggtaattccgaactgtctctgcagctgagactccctggtcagcagctgcgcgaagggagcttccgagtgacaagaatgcggtgttggagggtgacctcctccgtccctcttcccagcgggtctaccagcagtcccggacgcggaaggggcgaggtgcgcctggaactggccttcgagtacttgatgtcaaaggatcgcctgcagtgggtcactatcacctcacctcaagccatcatgatgagtatttgtttgcaaagcatggtcgacgagcttatggtgaagaagtctgggggatcaattagaaagatgttaagaaggagggtcggtgggactctccggaggagcgatagtcaacaggccgtcaagagcccaccattgctagagtcacctgatgcaactagagagtcaatggtaaagctcagcagtaaactcagcgctgtgagtttgcggggtataggatctcctagcactgatgctagcgccagcgacgtccacggaaactttgcatttgagggcatcggggacgaggacctgtag

SEQ ID NO: 241961 - DNA, 1560 bp, Artificial Sequence
  Description of Artificial Sequence: Synthetic coding sequence
atggcagcggagagagaacccccaccactgggggatggcaagcccactgacttcgaggatcttgaagacggagaggatctctttacaagcacggtgtctaccttggaaagctccccctcatcccctgaacccgctagcctccctgcagaggacatctcagcaaacagtaacggcccaaagccaaccgaggtggttctcgacgatgaccgggaggatctttttgcagaagccactgaagaggtgtcgctcgacagccccgaacgtgaaccgatcttgtcctccgagccatcacccgctgtgacaccagtgacccccaccaccctaatcgcgccacggatagagagcaagagtatgtccgcaccagtgatttttgaccgctcgcgcgaagagatcgaggaggaagctaatggcgacatttttgatatcgaaatcggtgtttcagacccagaaaaagtgggcgacggaatgaatgcttatatggcctatagagtaaccacgaagacgtctctgtctatgttttctaagtcagagttctcagtcaagcgcaggttcagtgactttttagggctacactccaaacttgcttctaaatatctgcacgttggctacatcgtgcctccagcacctgagaaaagtatcgtcggtatgactaaggtgaaggtggggaaggaagactccagttcaacggagttcgtggagaagcgaagagccgcactggaacgttaccttcaacgtaccgtaaagcaccccacgctgttgcaggaccccgatcttagacaattccttgaaagctctgagctcccaagggccgtgaacacacaagcgctttcaggtgcaggaatattgcgcatggtgaataaggctgctgacgctgtgaacaaaatgactattaaaatgaatgaatctgatgcatggttcgaagagaaacaacagcagtttgagaacctcgatcagcaactgagaaagctacatgtgtctgtggaggcgcttgtgtgccatcgaaaggagctctcggccaacactgctgcttttgccaagtcggcagctatgctgggaaattccgaggatcacaccgctcttagccgggctttgtcacagttggcggaggtcgaagaaaagattgatcaactgcatcaagagcaggccttcgcggatttttatatgttttcggaactgttaagcgactacattcggctgatcgcggctgttaaaggggttttcgaccacagaatgaagtgctggcaaaaatgggaagacgcacaaattaccttgttgaagaagagagaggccgaggcaaaaatgatggtggccaataagcccgacaagatccagcaagcaaaaaacgagatcagggagtgggaggcaaaagttcagcagggcgagagagatttcgagcagatttccaaaaccattcgtaaagaggtgggtcgtttcgagaaagagcgtgtgaaggatttcaagactgtgatcatcaagtatcttgaatccctggtacagactcagcaacagcttatcaagtactgggaggctttcttacccgaagccaaagccatagcctag

SEQ ID NO: 241962 - DNA, 390 bp, Artificial Sequence
  Description of Artificial Sequence: Synthetic coding sequence
atggccagcccagagcaccctggctcaccaggatgtatggggccaatcacccaatgtacggccagaactcagcaagaagcacctgccaccggtcctgatctgcctcaccccggaccggacggccacttggacacgcattcgggactgagttctaactctagtatgactacccgtgagttgcagcagtactggcagaatcagaaatgtaggtggaagcatgtgaagctccttttcgaaattgcatcggctcggattgaagagagaaaggttagtaagttcgtcatgggcaagtcccgccctggcgagatgacctatcccggatccaggggagaaacagggacggccccagaaccagatcccaggtgccctcgtcagtccgacatgctgtag

SEQ ID NO: 241963 - DNA, 951 bp, Artificial Sequence
  Description of Artificial Sequence: Synthetic coding sequence
atggcttcacccgagcaccctgggtcacccggatgcatggggccaatcactcagtgtaccgcacgaacccagcaggaggcgcctgccaccggcccagatctcccgcatcccggaccagatggccacctcgatacgcattcaggactatctagtaattcatcaatgactaccagagaacttcagcaatactggcagaatcagaaatgcaggtggaaacatgtgaaattactctttgaaatcgcctccgctaggatcgaggaacggaaggtgtccaagttcgtagtctaccagatcatcgttatccaaacaggatcattcgacaacaataaggcagtgctagagcgaagatactctgattttgcaaagctgcagaaagcacttttgaagactttccgcgaggagatcgaagacgtcgagttccccaggaagcacctgactggaaattttgccgaagagatgatctgcgaacgaagacgcgctctccaggagtatctcggcctcttgtacgctatccgatgcgtgcgcaggtctcgggagtttctggacttccttacccgcccagagctcagagaagcattcggttgtctgagggccggacagtaccccagggcattggaactgttgctccgcgtactccccctacaggaaaagctaacagctcactgccccgctgctgccgttcccgcactgtgcgccgtgctgctgtgccaccgcgacctggatcgccctgctgaggcttttgccgctggcgaaagggcactgcagagactgcaagctcgcgaaggccacaggtattacgctcctctgctcgatgcaatggtgaggctggcctacgcactcggtaaggactttgtgacgttgcaggagaggctcgaagaaagccagctgcgacgtccaacacccagggggattactttgaaggaactcactgttagggaatacctgcactag

SEQ ID NO: 241964 - DNA, 459 bp, Artificial Sequence
  Description of Artificial Sequence: Synthetic coding sequence
atggcttcgccagaacacccaggctcaccaggctgcatgggcccaattacacagtgtacagcacgcactcagcaggaggctcccgctactggtcctgatctccctcatcctgggcctgacggtcatctggacacccacagtggcctctcttctaactccagcatgaccaccagagagttacagcaatattggcagaaccaaaagtgtagatggaagcacgtgaaactcttgttcgagattgcttcagcacgaattgaggagcggaaggtcagtaagtttgtggtgtatcaaataatcgtgatccagacgggatccttcgataacaataaagctgtgttggagcggagatatagtgacttcgttaccctgcaggagagacttgaagagtcacagcttagacggcctacacccagagggatcactctgaaagaactgaccgtccgggagtatctgcattag

SEQ ID NO: 241965 - DNA, 309 bp, Artificial Sequence
  Description of Artificial Sequence: Synthetic coding sequence
atggcatcaccagagcatcccggaagccccggttgcatggggccaatcacccagtgcaccgcaaggacacagcaggaggcccctgcaacagggccagacttgcctcaccccggaccagacggccaccttgacacacactccggattgtctagcaattcttctatgactaccagagagctccagcaatattggcagaatcagaaatgccgatggaaacacgtcaagctgctcttcgaaatagcttccgcgaggattgaggaacgcaaggtgtctaagttcgttgcccctgcccctgatgccaccccttag

SEQ ID NO: 241966 - DNA, 807 bp, Artificial Sequence
  Description of Artificial Sequence: Synthetic coding sequence
atgcagcagattcgccctcctttcattcggggtccccctcaccatgcatcgaatcctaactccccactgtccaatccaatgttacctggtattggcccacccccaggtggtccgaggaatctggggccaacgtccagtccaatgcatagacccatgctttctcctcacatccatcctccttcaacgccaactatgcctgggaatcctccaggactgcttccacccccacccccaggcgctcccctgcccagtctcccttttcctccggtaagtatgatgccgaacggcccaatgccggtcccacagatgatgaacttcgggctcccatcccttgccccactggtcccaccaccaactctccttgtgccctaccccgttattgtgcctctgcctgttcccattcccatcccaattccaattcctcatgtgagtgattcaaagccacccaagaagctgttgtcccccgaggagcctgcagtgtctgagttggaatccgtcaaggagaataattgcgcatccaattgccatctcgatggggaggccgcaaagaagctcatgggcgaggaggccctggccggtggagacaaaagtgatccaaatcttaacaacccggcagacgaggatcacgcctatgccttaagaatgctcccgaagacgggttgcgtcatacagccggtccctaaacctgccgaaaaggcagcaatggcgccttgtatcatcagctcccccatgctgagcgctgggcctgaagacttagagccccctctgaaacggaggtgcttacggattaggaaccagaataagtag

SEQ ID NO: 241967 - DNA, 423 bp, Artificial Sequence
  Description of Artificial Sequence: Synthetic coding sequence
atggccgagactgtggccgacacccggagactgattaccaagccacagaatctgaacgacgcctacggccctccaagtaattttttggaaatagacactaatctaccaatttttaagctcaaagaaagcactgtgcgcagaagatactcagactttgagtggctgcgttccgaactagagagggagtctaaggttgtcgtgcctcctctgcccggtaaggcgttcttgagacagctcccttttcgcggagatgacggtatctttgatgacaactttatcgaggagcgcaagcagggtctcgagcagtttattaataaggtcgccggacatcctctggcccagaacgaacgatgtctccatatgtttctgcaagacgagatcatagataaatcttataccccgagcaaaattaggcatgcttag

SEQ ID NO: 241968 - DNA, 342 bp, Artificial Sequence
  Description of Artificial Sequence: Synthetic coding sequence
atggctgaaacggtcgctgacactcggaggttaataactaaaccgcagaatctgaacgacgcatacggcccaccgtcaaatttcctagaaatagatgtgagcaatccccaaaccgtcggtgttgggaggggacgatttaccacctacgagattagggtgaaaacaaaccttccgatattcaaactaaaagaatccactgtaagacggagatattcagactttgaatggttgcggagtgagcttgagcgtgagtctaaaccctgtctgcgcatgacctcagaagcaagatcacacgggagaacatggtgtgctcagaatgatgaaaagctgttctgcgattag

SEQ ID NO: 241969 - DNA, 393 bp, Artificial Sequence
  Description of Artificial Sequence: Synthetic coding sequence
atggccgagactgttgcggacacccgaaggctaataaccaagccccagaacttaaatgacgcgtatggaccaccctcaaacttccttgagattgatgtgtctaacccacagactgtaggagtcggccgaggaagatttacgacctacgaaataagggtgaaagttgtcgtgcctccactgcccggaaaggctttcttgcggcagctgccctttagaggggatgatggaatcttcgatgacaattttatagaagaaagaaaacagggcctggaacagtttatcaataaagtggccggtcacccactggcccagaatgagagatgcctgcacatgtttctccaggacgaaattatcgacaaatcctacactccctctaagatccgacacgcttag

SEQ ID NO: 241970 - DNA, 1353 bp, Artificial Sequence
  Description of Artificial Sequence: Synthetic coding sequence
atggaacaggcgcctcctgacccggagagacagctgcaacccgcacctcttgagcccttgggcagccctgacgccggactcggagccgcagtggggaaggaggctgagggagctggggaagaatctagtggtgtcgacaccatgacccataacaatttttggctgaaaaagattgagatctcggtaagcgaggcggagaaacgcacgggacggaacgcaatgaacatgcaagaaacatacaccgcctacctgattgaaacgcggtccgtggaacacacagacggacagtctgtgctgactgattctctctggcggaggtatagtgaatttgagttactgcgctcatatctgttggtatattacccacatatcgtcgtgccaccactgcccgagaagcgtgctgagtttgtatggcataagttaagcgccgacaatatggaccctgactttgtcgagcgaagacggatcggactcgaaaatttcctccttcgcattgcctcccaccctatcctgtgccgagacaaaatcttctacctgttcctgacacaggagggcaactggaaggaaaccgtgaatgagacgggcttccagctcaaagctgatagccgcttaaaagctttaaacgcaactttccgggtaaagaatcccgacaagagattcacagacctgaaacactattctgacgaattacagtctgttatctcccatctcctgcgtgtgagggcacgggtcgccgaccgactgtacggagtgtacaaggtgcacggtaattatgggagagtgttctccgagtggagcgctatcgagaaggagatgggtgatgggctgcagtccgctggccaccatatggacgtctacgccagcagcatagacgacatccttgaggatgaagaacactacgccgaccagctgaaggaatatttattctatgctgaggcactgagggccgtctgccgcaaacacgagcttatgcagtacgacctcgagatggctgctcaggatctggcgtcaaagaaacagcaatgtgaggagcttgttacaggtacagtcagaacattctcactcaagggaatgactaccaagttgtttggccaggagactcctgaacagagggaagccaggataaaagtgctcgaggaacagatcaacgagggcgagcagcagctcaaatctaaaaacctggaaggaagggagttcgtgaagaacgcctgggccgacatagagagattcaaagaacaaaagaaccgagacttaaaagaggctttaatcagctacgccgtaatgcaaatcagcatgtgcaaaaagggtatacaggtctggactaacgccaaagagtgcttctccaaaatgtag

SEQ ID NO: 241971 - DNA, 918 bp, Artificial Sequence
  Description of Artificial Sequence: Synthetic coding sequence
atggaccccgactttgtggaacggcgtagaataggcttggagaatttccttctgagaattgcttcccaccctattctctgccgggacaagattttctacctcttcctgactcaggagggcaactggaaggaaaccgtcaacgaaacagggttccagctgaaggcagacagcagactgaaggcacttaacgctaccttccgtgtgaagaacccagataagaggtttacagacctaaagcattactcagatgagttacagtccgtgatctctcatttgctaagggtgcgggctcgggtggcagatcggctgtacggggtgtacaaggttcacggcaattacggcagagtctttagcgagtggagtgcgatcgagaaagagatgggggatggcttgcagagcgctggacatcacatggacgtctatgcctccagtattgacgatatcctggaagacgaggagcattatgccgatcagctgaaagagtatctattctatgcggaggcacttcgcgcagtgtgtaggaaacacgagcttatgcaatacgacctggagatggccgcacaggacctggcaagcaagaaacagcagtgtgaggagctggtaactggcaccgtgcgaaccttcagcctgaaaggaatgacaacaaagttgtttggccaagagactcccgagcagagagaagccagaataaaggtgctggaagaacagattaacgaaggggaacagcagctcaaaagcaagaatcttgagggcagagaatttgttaagaatgcatgggcagacatagagaggtttaaagaacagaagaaccgcgatctgaaggaagccctcatctcttacgccgtgatgcagatttccatgtgcaagaaaggcatccaggtttggacaaacgcaaaggaatgcttttcaaaaatgtag

SEQ ID NO: 241972 - DNA, 1215 bp, Artificial Sequence
  Description of Artificial Sequence: Synthetic coding sequence
atggcagccgtcccagagctgttgcagcagcaagaggaggacaggtcgaagttgcgatcggtgtcagtcgatttaaatgttgacccatctctccagatcgacataccggacgccctgtccgagcgcgacaaggttaagttcacagttcacactaaaaccactctgcctacatttcagagtcccgagtttagtgttacgcggcagcatgaagacttcgtgtggctacacgataccctgatcgaaaccacagactatgccggactgattataccaccagccccaacaaaacccgacttcgacggcccacgagaaaaaatgcagaaactaggagagggggaaggatctatgacaaaagaggagtttgccaagatgaaacaggagcttgaggctgagtatctggccgtgtttaaaaaaaccgtcagctcccacgaagtgttcctgcagaggctgtccagccacccggtgctatccaaagacaggaacttccacgtgtttttggagtacgatcaggatctttctgtccggaggaagaatactaaggagatgttcggaggcttctttaaaagtgtggtgaagtcagctgacgaagtgctgttcacgggggtgaaagaggtggacgattttttcgaacaagaaaagaactttctgattaactactacaatcgcattaaagattcatgcgtcaaggccgataagatgacccgctcccacaaaaatgtggctgatgactacattcacaccgcggcttgcctacacagcctggccctagaggaacctaccgtgataaagaagtacctcctgaaagttgcggagctgttcgaaaagctgagaaaagtcgaaggacgggtctcttctgacgaagatctcaagctgactgagctcctgcgttactatatgctgaatattgaggctgcaaaggatctgctttaccgcaggactaaagcgctcatcgattacgaaaacagcaacaaggccttggacaaagccaggctgaaatccaaagacgtgaaactcgccgaggcgcaccagcaagagtgttgtcagaaattcgagcagctgagtgaatccgccaaggaggaactcataaattttaagaggaagagagtcgccgctttccggaagaacctcattgagatgtcagaactggagataaagcacgctcggaacaacgtgagtctgctgcagtcctgcattgatctgtttaaaaataattag

SEQ ID NO: 241973 - DNA, 1215 bp, Artificial Sequence
  Description of Artificial Sequence: Synthetic coding sequence
atggccgctgttcccgaattgctccaacaacaggaggaagaccgttctaaactgcggagcgtgtcagtcgatctgaacgtggatccttcactgcaaatcgatattccggacgccctgagcgaaagggataaagtcaagtttaccgtgcacacaaaaaccaccttaccaacattccagtcccccgagttttcagtgacccgacagcacgaggacttcgtttggctccatgataccctgattgaaaccaccgattacgctggtctgattataccacctgcgccaacgaaacccgattttgacggtcccagagaaaagatgcagaagctaggagaaggggaaggctctatgacgaaggaggaattcgccaagatgaagcaggagcttgaagctgagtatctggccgtttttaaaaaaacagtcagcagccacgaggtctttctgcagcggttgtcctcacacccagtgctgtctaaggatagaaattttcacgtcttcttggaatatgatcaggacctctccgtgcggaggaaaaacacgaaggaaatgttcggtggatttttcaagtctgtggtgaagagcgctgacgaggtcctgttcaccggcgttaaagaagtagacgatttcttcgaacaggaaaagaatttcctgatcaattattacaatcgaataaaggacagttgcgttaaggcagacaaaatgaccagaagtcacaagaatgtggcagatgattatattcacacagctgcctgtctgcacagtctggccctcgaagaaccaacagtgatcaagaagtaccttctcaaggtggccgagttgtttgaaaaactcagaaaggtggaaggacgcgtctcctctgatgaggacttaaagctgacggagctcctgagatattatatgttaaatatcgaagccgctaaggatctgctgtaccgacggacaaaggcccttattgactacgaaaatagcaataaggccttggataaggcgaggttgaagagcaaggacgtcaagcttgcggaggcccaccaacaggagtgttgtcagaagtttgaacagctatccgagagtgctaaggaggagctcataaacttcaagcggaaaagagttgccgctttcaggaagaacctcatcgagatgtctgagctggagattaagcacgcacggaacaacgtgagtcttttgcaatcgtgtattgatttatttaagaataattag

SEQ ID NO: 241974 - DNA, 687 bp, Artificial Sequence
  Description of Artificial Sequence: Synthetic coding sequence
atggcagccgtccctgagttgctccagcagcaggaggaggatagatcaaaaactactctgcctacatttcagtctcctgaattttccgtcacgaggcaacacgaagatttcgtctggctgcatgacaccttaattgagactacggattacgcaggactaatcataccgccagccccaactaaacccgacttcgatggcccacgcgagaagatgcagaagctgggcgagggtgaaggaagtatgactaaggaagaatttgccaaaatgaagcaagaactggaggccgaatacttggcagtgtttaagaaaactgtgtcttcccatgaagtttttctccaacgcctctccagccacccggtgctatcaaaggatcgaaacttccatgtgtttctcgaatacgaccaggacctttctgtgcggaggaaaaatacaaaggaaatgttcggtggcttcttcaaaagcgtggtgaagagtgccgacgaagtgttatttacaggggttaaggaagtcgatgattttttcgagcaagagaagaacttcctcattaactactacaaccggatcaaggacagctgcgtcaaagccgacaaaatgacacgctctcataaaaatgtcgccgacgactatattcatactgctgcgtgtctgcacagcttggccctggaggagcccactgttataaaatag

SEQ ID NO: 241975 - DNA, 810 bp, Artificial Sequence
  Description of Artificial Sequence: Synthetic coding sequence
atggccgcagtgcctgaactgctccagcagcaggaggaagaccgttccaagttgcgcagcgtctcagtcgacctgaacgtagaccccagccttcagattgatattcctgatgctctttcggaaagggataaggtgaaatttaccgtccatacaaagatcccacctgcgccaaccaagccagacttcgacggccctcgcgagaaaatgcagaagctgggcgaaggcgaagggagcatgactaaagaggagttcgcgaagatgaaacaggagctggaggctgaatacctcgccgtctttaaaaagacagtgagctcacacgaggtcttcctccagcgactgtcaagtcatcctgtgctgagtaaggacaggaatttccacgtatttctagaatacgatcaagacctctccgtgaggagaaaaaatactaaggagatgtttgggggtttcttcaagtctgtcgtcaagagcgccgacgaagtcctgttcacaggagtcaaagaggtggatgacttcttcgagcaggagaagaattttctgattaactattataacaggattaaagattcctgcgtgaaggcagacaagatgaccaggagtcacaaaaatgtcgcagacgactacatccataccgccgcttgtttgcattcactagcattagaagagccaaccgttattaaaaaatacctgttgaaagtggctgagctgtttgaaaaactgagaaaggtggaggggcgtgtgagctctgacgaagatctgaagctgacagaattgctgcggtattatatgttaaatatcgaggcagcaaagtag

SEQ ID NO: 241976 - DNA, 885 bp, Artificial Sequence
  Description of Artificial Sequence: Synthetic coding sequence
atgacaaccctgacagagattaagctactcccgtctctggtcctcctggtttgttgcgagtacctggcaatctttaaaaagacagtggccatgcacgaagtgttcctctgtcgggttgcggctcatcccattctgaggagagatttgaacttccacgtgttcctggaatataaccaggaccttagtgtgagaggtaagaacaaaaaggagaagttggaggactttttcaaaaacatggtcaaaagcgccgatggcgtgatcgtaagcggggtgaaagatgtagatgacttttttgaacacgagcgtactttccttcttgagtaccataaccgggtcaaggacgcctccgctaagtccgaccgtatgacccgctcccacaaatcagctgcagatgattacaaccggatcggcagctctctgtatgcactcggaacccaggacagtacagatatctgtaagttttttttaaaggtttccgagctattcgacaaaacgcgcaaaattgaggctagggtgtcggctgacgaggatctgaagctctccgacctcctgaagtactatttgcgggaaagtcaagccgcaaaggacctgctttatagacgctctaggagcctggtggactatgagaatgctaacaaagccctggataaagcgagagcgaaaaacaaggatgtgctccaggccgaaaccagccagcagctgtgctgccagaaattcgagaagatttctgagagtgccaaacaggagttgatagattttaagacgagacgcgtcgccgcatttaggaagaatctggtggagctcgctgaacttgagcttaagcatgcaaaggggaatctgcagctgctccaaaactgcttagccgtgctgaatggtgatacatag

SEQ ID NO: 241977 - DNA, 1257 bp, Artificial Sequence
  Description of Artificial Sequence: Synthetic coding sequence
atgagagcctgtgccggaccacgcctgggggctgccatgatggaaggcctggacgacgggccagacttcctctcagaggaagaccgtggcttgaaagcaatcaacgtggatctgcagtctgacgccgctctacaggtggacatttcagatgccttaagcgaacgagacaaagttaagttcactgtgcacaccaagtcctccctgcccaatttcaagcagaatgagttttcagtagtgcgccagcatgaagaattcatctggctgcatgacagcttcgtggaaaacgaggattacgccggatacattatccccccagcccctccccgacccgactttgacgccagtagggagaagctccagaagctgggtgagggagagggcagcatgaccaaggaggaattcaccaaaatgaagcaggagctggaagcagaatatttggctatcttcaaaaaaaccgttgcgatgcacgaggtattcctgtgcagggtggctgcccatccaatcctgagacgggaccttaacttccatgtcttcctcgaatacaatcaggacctcagtgtcaggggtaaaaataagaaagaaaagttggaagatttctttaagaatatggttaagagcgccgacggcgtgatcgttagcggggtaaaagacgtggacgacttctttgaacacgagaggacgttcctcctggagtaccataatcgggtgaaggatgcttctgcaaagtccgatagaatgacccgtagccataaatccgccgctgatgactacaatagaataggaagcagtctatatgctttggggacccaggattctacggacatctgtaagttctttctcaaagtgtcggaactattcgataagacccgtaagatcgaagccagagtatcagctgacgaggacctaaagctatctgacttgttgaagtattatttgcgggaaagccaggcagccaaggatctcctctaccggcgttcccgttctctggtagattacgagaacgctaacaaagcactcgataaggccagagcaaaaaataaggacgtgctgcaggcagagacatcccagcagctctgctgccagaaatttgaaaagatatctgagagcgcaaaacaggagctgatagactttaaaacccggagagtcgctgcctttaggaaaaatctagtggagttggccgagctcgagctgaaacacgctaagggaaatctccagctccttcagaactgtctggcggtgttgaatggagatacctag

SEQ ID NO: 241978 - DNA, 873 bp, Artificial Sequence
  Description of Artificial Sequence: Synthetic coding sequence
atgaccaaggaggaatttaccaagatgaagcaggagctggaggctgagtacctagcaatctttaagaaaacagtcgctatgcatgaggtgttcctctgtagagtggccgcacatcccattctgagaagagacctgaattttcacgtgttcttggagtacaaccaggatctttctgtgagaggtaaaaataagaaggaaaagctggaggacttcttcaagaacatggtgaaatccgcggacggggtgatcgtgtccggggtcaaggacgtcgatgactttttcgagcacgagcgcaccttcctgcttgagtaccacaatagagtcaaagatgctagtgccaagtctgaccggatgactagaagtcacaagagtgccgcagacgactacaacaggatcggctcaagtctgtatgccctgggcacacaggacagtaccgacatctgcaaatttttcttgaaagtgtcagaattgttcgataagacaaggaagatcgaggccagggtgtcagcggacgaggatttgaaactctctgatctgctcaaatactacctgcgcgaatctcaggccgctaaggacctcctgtatcggcgaagccgatcgctggttgactacgaaaatgcaaacaaggccttagataaagctagagctaagaacaaggacgtgcttcaggccgaaaccagccagcagctctgctgtcagaagttcgagaagataagtgagtctgctaagcaagagttgatcgacttcaagacaagacgcgtggcagcctttcgaaagaacttagttgagctggccgaactcgaattgaaacatgcgaaggggaacctgcagcttttgcaaaactgtctggcggtactgaatggggacacgtag

SEQ ID NO: 241979 - DNA, 873 bp, Artificial Sequence
  Description of Artificial Sequence: Synthetic coding sequence
atgactaaagaggagttcaccaagatgaaacaggagctcgaggccgagtatctggccatctttaaaaagactgtcgcgatgcacgaagtgttcctatgtcgggtggccgctcatccaattctgcgcagggatttgaattttcacgtttttctggagtataaccaggatctttctgtgagaggcaaaaacaaaaaagaaaagctggaagacttttttaagaacatggttaagtccgcagatggggtcatcgtgtcgggtgtaaaggatgtagacgatttctttgagcatgagcgaacctttcttctcgagtaccacaacagggtgaaagatgctagcgctaaaagcgatcggatgacacggtcgcacaagtcagcggcagatgactataataggatcggtagcagtctgtatgccctggggacacaggattctacagatatttgtaaatttttcctgaaagtttcggagctgttcgacaaaacaagaaagattgaggctcgggtgtcggcggatgaagacctgaaactgagcgacctgctgaagtactacttgcgagaatcccaggccgctaaagacctcttatatagaaggagtcgcagcctggtagactatgagaatgccaataaagccctcgataaggcccgagccaagaacaaagacgtgctgcaggcagagacctcccagcaactgtgttgccagaagttcgaaaagatctcggagtcagcaaaacaggaactgattgacttcaagacacgccgtgttgccgcatttcgcaagaatctggtcgaattggccgagcttgagctgaaacatgccaaaggcaatttacagctgctccagaattgtctggctgttcttaacggggacacttag

SEQ ID NO: 241980 - DNA, 1188 bp, Artificial Sequence
  Description of Artificial Sequence: Synthetic coding sequence
atgaaaatcccacttaataagttccccggattcgcaaaacccggtacagagcagtacctgctggctaagcaactggcgaagcccaaggagaaaatacctattatcgtcggtgattacggaccaatgtgggtgtaccctactagtaccttcgactgcgttgtggcggatcctcggaagggaagcaagatgtacgggttgaaatcttacatcgaataccagctgacgcctacaaataccaatagatcggtgaatcataggtacaagcacttcgactggctctatgagcggctcctggtgaagttcggtagtgcgatcccgatcccctctctaccagacaaacaggtaaccggacgatttgaggaggaatttataaaaatgcgcatggagaggctgcaggcctggatgacccgcatgtgcaggcacccagttattagtgagagtgaggtgtttcagcagtttctgaactttagggatgagaaagagtggaaaaccggtaaacgtaaagcagagagagacgaattggccggagtgatgatattttcaacgatggagcctgaagcccctgacctggatttagtagaaattgagcagaagtgcgaagctgtggggaaattcactaaagcaatggatgacggtgtaaaagaactgctgacggtgggccaagaacattggaagaggtgcactgggcctcttccaaaggaatatcagaagatcgggaaagcgttacaaagcctggcaaccgtgttcagcagttctggctaccagggagaaacagacttaaatgatgccatcactgaggctgggaagacgtacgaggagatcgcaagccttgttgcagagcaaccgaaaaaagatctgcatttccttatggagtgcaatcacgaatacaaagggtttctggggtgtttcccggatattatcggtacgcataaaggggctatcgagaaggtaaaagagagcgataaactggttgccaccagtaaaattaccctccaggacaaacaaaacatggttaagagggtttccattatgtcttacgccttgcaggctgaaatgaatcatttccattcaaaccggatctacgactataacagtgtcatcaggctctatctggaacagcaagtgcaattttatgagactatcgccgagaaactgcgacaggctttaagccggttcccagtcatgtag

SEQ ID NO: 241981 - DNA, 1788 bp, Artificial Sequence
  Description of Artificial Sequence: Synthetic coding sequence
atggccaccaaggctcgtgtcatgtatgattttgctgcggaaccaggtaacaatgaactaactgttaatgaaggagagataattaccattacaaaccctgatgtgggcggaggatggctggaaggaagaaatataaaaggcgaacgtggattagtgcccacagactacgtcgagatcttaccgtcagatggaaaagaccagttctcttgcgggaatagcgtagcggaccaggcctttcttgattccctcagcgcatccactgcccaggctagttcctctgccgcaagcaataatcaccaggtgggtagtggcaacgatccctggtccgcctggtctgccagcaaaagtggcaactgggagagctctgagggatggggcgcacagccagaaggcgctggtgcacagaggaataccaacactccaaataattgggacacagcctttgggcatccacaagcataccagggcccagctaccggtgatgacgacgactgggatgaagactgggatggcccaaaaagctcttcctattttaaggattcggagagtgcagatgcaggcggtgctcagagaggaaatagcagagcctcctccagctctatgaaaattccactgaataaattccccggttttgctaaacccggaacagagcaatatctgttggccaagcagttggccaagcccaaggaaaaaatccccatcatagtaggcgactatgggccaatgtgggtctatccaacatcaacctttgactgtgtggtagcagacccacgcaagggatcaaagatgtatgggctgaagtcttacatcgaatatcagctaacccctaccaataccaaccggagcgtcaatcaccgctataagcattttgattggctgtacgaacggctcttggtcaaattcggctctgctatcccaattccctccctcccagataaacaggtgactgggcgatttgaagaggaattcatcaagatgaggatggagcggctgcaggcttggatgacccgcatgtgccggcatcccgtaatcagcgagagtgaggtctttcagcagtttctcaactttcgggacgagaaagaatggaaaacagggaaaagaaaggctgagcgcgatgagctggctggcgttatgatcttcagcacaatggagcctgaagctccggatctcgacttggtggagatagagcaaaagtgtgaagccgtggggaagtttacaaaagccatggacgatggtgtgaaagaactcctgacagtaggccaggagcattggaagcgttgcaccggccctctgcctaaggagtaccagaagattgggaaggcactccaaagcctagccaccgttttctccagcagcggctatcaaggggaaactgacctcaatgatgccataaccgaggctggcaagacatacgaggagattgcgagtttggtggccgaacagccaaagaaagatcttcatttcctcatggaatgtaaccacgaatacaaagggtttctgggctgtttcccagacatcatcggcactcacaagggtgcaatagaaaaggtcaaggagtctgataaactagtggctacatcaaagattactctacaagataaacagaatatggtcaaacgcgtgtcaatcatgtcttatgccctgcaggccgaaatgaaccattttcactctaaccggatctacgattacaacagcgtgattagattgtacttggaacagcaggtgcaattttacgagaccattgcggaaaagcttcgtcaggcactttcacgctttcccgtcatgtag

SEQ ID NO: 241982 - DNA, 1788 bp, Artificial Sequence
  Description of Artificial Sequence: Synthetic coding sequence
atggctacaaaggctcgagtgatgtatgattttgcggcagaacctggcaataacgagctgactgtcaacgagggtgagatcataaccatcacaaatcctgacgtcggcggaggttggctggaagggagaaacatcaaaggggaacgaggactggttccaacagactacgtggagattctcccctctgacggcaaggatcagttttcgtgcggtaattcggtggcagatcaggctttcctcgattctctttcagcctctacggctcaggcctcatcctcagcagccagtaacaatcaccaggtggggtccgggaacgacccatggtcggcatggtctgccagcaaaagtggtaactgggagtcttccgaaggctggggggctcaaccggagggggctggcgcacagcggaacacaaatacccctaacaattgggatactgcctttggtcaccctcaggcttatcaaggccctgcaacgggagacgatgatgattgggatgaagactgggatggcccaaagtctagttcatactttaaggactccgagtccgccgatgctggtggggctcagcggggaaactccagagcaagtagcagcagtatgaaaatcccactgaacaaattccctgggttcgctaagcctggcactgaacagtacctcctggcgaaacaactggccaaacccaaagaaaagatacccatcatcgtaggtgattatgggccaatgtgggtgtacccaacgagcaccttcgactgcgtcgtggctgaccctcgcaaaggtagcaaaatgtacggccttaagtcttatatcgagtatcaactgactccaacgaacactaaccgtagcgtcaatcatcgatataaacacttcgattggctgtatgaaaggctcctcgtcaagtttgggtccgcaatccccattccatcactgcctgataagcaagtgacaggcaggtttgaggaagaatttataaagatgcgaatggaacggctccaggcttggatgaccagaatgtgtcgacaccctgtcatctctgagtcagaggtctttcagcagttcctgaattttcgagatgagaaggaatggaaaactggcaaacggaaggccgagcgagatgaactggccggtgtgatgatctttagtacaatggaacctgaagctcccgatctggacctagtggagatcgaacagaagtgcgaggcagtggggaagtttactaaggccatggacgacggtgttaaggagctgctgaccgtgggtcaggaacactggaagagatgcaccggtcctcttcccaaagaataccagaaaattggtaaggcattgcagtccctggccacagtcttctcctcaagcggctaccaaggtgagactgatctgaatgatgccatcactgaggccggaaagacctacgaggaaattgcatccctggtggctgagcagcctaagaaagacttgcatttcctgatggagtgcaatcacgaatataagggatttctgggatgcttccccgatatcatcgggacccacaagggcgcaatagaaaaggtgaaggaaagtgacaagttagtagcaacttcaaagataacacttcaggataagcagaatatggtgaagcgcgtttcaataatgtcatatgccctccaggccgagatgaatcacttccatagtaatcgcatttatgattacaattcggttattcgcctgtatctggaacaacaagtgcaattttatgagaccatagctgaaaagctaagacaagccctctcacgattcccagtcatgtag

SEQ ID NO: 241983 - DNA, 1308 bp, Artificial Sequence
  Description of Artificial Sequence: Synthetic coding sequence
atggggctctccttctctctgtttcctctgcgcaaccatgtgaacgtagaaggcgctacacataaacaagttgtcgatctaatccgcgctggtgaaaaggagctgattttaacagttttgtccgtcccaccgcacgaggccgacaatctggacccatccgatgactccctggggcagtccttttatgattatactgagaaacaggctgtgcctataagtgtgcctaggtacaagcatgtggaacaaaatggggagaaatttgtcgtgtataacgtctacatggcgggtcggcagttgtgctccaaaaggtaccgcgaattcgcgatattgcatcagaacctcaaacgtgaattcgccaacttcacgtttcccaggttgccaggaaagtggccatttagcctgtctgagcagcaactggacgccagacgcaggggtttggaagagtaccttgaaaaggtgtgtagtatccgcgttattggcgaatctgatatcatgcaggaatttctgtcagaaagtgatgaaaattataatggcgttagtgatgtggagttgagggtggccttaccggacgggactacggtgacagtgcgagtgaagaaaaactccaccacagatcaagtctaccaggcaatcgccgctaaagtggggatggactccaccaccgtgaactactttgcactgtttgaagtgatcagtcacagctttgtgcgaaaactcgccccaaatgagtttccgcacaagctgtacattcagaactacactagtgccgtccctgggacttgcttgacaatacggaagtggctatttactacggaggaagagatcctactcaatgataacgacctggccgtgacctatttctttcaccaggccgtggacgatgtcaagaaggggtatattaaagctgaggagaagagctaccaactgcaaaagctttatgaacaacggaagatggtgatgtatctaaacatgttgcggacttgtgaaggctataacgaaattatctttcctcattgcgcgtgtgattctagacgcaaagggcacgtgatcacagcaataagcataacccatttcaagctgcatgcctgcacagaggaaggccagctggagaaccaggttatcgcatttgagtgggatgagatgcaaaggtgggacaccgacgaggagggaatggctttttgttttgagtacgccaggggagaaaagaaacccagatgggtcaaaatatttaccccctacttcaactacatgcacgagtgttttgaacgggtgttttgcgaactcaaatggcgtaaggaagaatactag

SEQ ID NO: 241984 - DNA, 1587 bp, Artificial Sequence
  Description of Artificial Sequence: Synthetic coding sequence
atggcggatgaagatggggaagggatccacccatctgctccccacaggaacggtgggggtggagggggagggggtagtggactccattgcgccggaaatgggggaggaggcggtggaggaccaagagttgtgaggattgtgaaatcagagtcaggctatgggttcaacgttcggggtcaagtgtctgagggaggccagttacggtcaatcaatggggagctttatgcccctcttcaacacgtcagcgccgtccttccagggggagccgcagatagagcaggcgtacggaaaggggataggatcctcgaggtgaatcacgttaatgtcgagggagcaacccacaagcaggtggtggaccttattcgtgccggtgagaaggaactgattctcacggtgctctctgttccgccacatgaggccgacaacctggatccgtcagacgactccctgggccagtcattttatgattacaccgaaaaacaggctgtacctataagtgttccaaggtacaagcatgtggagcagaatggggagaagttcgttgtctataatgtctatatggccggtcgccaattgtgtagcaagcgataccgcgagttcgctatcctgcaccaaaatttgaagcgcgagtttgctaactttactttccccagactgcccggaaaatggccgtttagcttgagtgaacagcagctggacgccagaaggcgcggactggaggaatatctcgaaaaagtctgcagtattcgggtgatcggggagtctgatataatgcaagagtttttatctgaatctgacgagaattataatggggtcagtgacgtggagctgcgtgtggcactcccagatggaaccactgttacagtgagagtgaagaaaaatagcaccacagaccaggtgtaccaagccatcgccgctaaggtgggcatggatagcacgacagtgaattacttcgccctattcgaagtgatttctcactcctttgttaggaagctggcccctaacgagttccctcacaagctttacattcagaattatacctccgctgtccctggtacatgtcttactattcggaagtggctatttaccaccgaagaagaaatcctgctgaatgacaacgacttagccgtgacgtacttcttccatcaagcagtggacgacgtgaagaagggatacatcaaggctgaggaaaagtcgtaccagctacagaagctatatgaacagaggaagatggtgatgtacctgaatatgctgcgaacttgtgaagggtacaatgaaatcatcttccctcactgcgcctgcgattccaggcgaaagggccacgtgatcacggcaatctccatcacccactttaagctccacgcctgcactgaggaaggacaacttgaaaaccaggtaatcgcatttgagtgggatgaaatgcagaggtgggacacagacgaggaaggcatggctttttgttttgagtatgcgagaggggaaaaaaagccccgatgggtcaagatcttcaccccttattttaattacatgcacgagtgttttgagcgcgtattctgtgagctaaaatggcggaaggaagaatactag

SEQ ID NO: 241985 - DNA, 1626 bp, Artificial Sequence
  Description of Artificial Sequence: Synthetic coding sequence
atggccgacgaagatggagaaggaatccatccttcggcccctcacaggaacggcggaggaggcggaggaggaggctctggcctccattgtgctgggaatgggggaggcggagggggaggtcctagggtagtccgaatcgtcaagagcgagagcggctatggctttaatgtgcggggtcaggtttctgaggggggtcagttaagaagcattaacggagaactttatgcgcctcttcaacacgtaagcgctgtgctgcccggaggcgctgcagaccgggctggggtgagaaagggtgaccggatcctcgaggtaaatcatgtgaatgtcgagggagctacacacaaacaggtagtggaccttattcgggctggtgagaaagagctcatcctgacagtgctgtcggtgccaccacatgaagctgacaatttggatcctagcgatgatagtttaggacagagtttctacgattatacggagaagcaggccgtgccaatcagcgtgcctcggtataagcacgttgaacagaacggcgaaaagttcgtggtgtataacgtatacatggccggacggcaattgtgcagcaagcgttacagggaatttgccatcttacatcagaatttgaagcgggaattcgccaattttacttttccacgccttcccggaaaatggccattctcgctctctgagcagcagcttgacgctagacgtaggggcctcgaggaatatctggagaaggtgtgctctattagagtgataggcgaaagcgatataatgcaagagttcttatccgaatccgatgaaaattacaacggtgtgagcgacgttgaattaagagtggctctccccgatgggaccacagtcacggtgagagttaaaaagaactctactaccgaccaggtttaccaggcgatcgccgcaaaagtagggatggacagcactactgttaactactttgctttgtttgaggtgatatcgcattcattcgtccgcaaactggcaccaaacgaattccctcacaaattgtatatccaaaattacacctccgcggtgccaggtacgtgcctgaccattagaaaatggcttttcaccacagaggaggagatactattgaatgataacgacctcgctgttacttactttttccaccaggccgtcgacgatgtcaagaagggatatattaaggccgaggaaaagtcctaccagctgcagaagttatatgaacagcggaaaatggtcatgtatctcaacatgctccggacttgcgaggggtacaacgaaatcattttccctcattgcgcatgtgacagccggaggaagggccatgtcatcacagctatatcgattactcacttcaaactgcatgcctgcactgaagaaggccagttagagaaccaggtgatcgcattcgagtgggacgaaatgcagcgatgggacactgacgaagaaggaatggccttttgctttgaatatgcccgtggggagaagaaacctaggtgggtgaaaatttttaccccatatttcaattatatgcacgagtgctttgagcgagtcttctgcgaacttaagtggagaaaggaaaatatattccagatggctaggtcacaacagcgcgatgttgccacatag

SEQ ID NO: 241986 - DNA, 2640 bp, Artificial Sequence
  Description of Artificial Sequence: Synthetic coding sequence
atggccggaggaggtggggatttgtccactaggagacttaatgaatgtatctctcctgtcgccaacgaaatgaatcaccttcccgctcacagccacgatcttcaaagaatgttcacagaggatcagggtgtagatgaccggctgctctacgatattgtgtttaaacatttcaagaggaataaagtggaaatctcaaacgcgataaaaaagaccttcccattcctcgaggggctgcgggatagggatctgataacaaataaaatgttcgaagactcgcaggattcctgccggaaccttgtgcctgtacagagagtagtatacaacgtgctgtccgagctagaaaaaacatttaatcttcctgtgctcgaagctttattctccgatgtgaacatgcaggaataccccgatctgattcatatttacaaaggatttgaaaatgttattcatgacaagctgccactccaggagtcggaagaggaagagcgggaggaaagaagcggtctgcagctgagcctcgaacaggggactggcgaaaatagctttagatccttgacatggcctccgtccggttctccttcccacgcagggactacccccccagagaacggtctgtccgagcacccctgcgagaccgaacaaattaacgccaagaggaaggataccacttccgataaggatgacagcctgggaagccaacaaactaacgagcagtgcgctcagaaggccgaacctacagaaagttgtgaacagatagctgtgcaagtcaacaatggagacgcaggtagagaaatgccttgccctctcccctgtgatgaagagagccctgaggcagagctccataatcacggcatccaaatcaactcatgttctgtccggctggttgatattaaaaaagaaaaacctttctcaaattcgaaggtggaatgccaggctcaggcacgcactcatcacaatcaggcctctgacattatcgtgatctctagcgaggatagtgagggtagcaccgatgtggatgagcccctggaggtttttataagcgctccaagatcggaacccgtgatcaacaacgataatcctctggagagcaacgatgagaaggagggccaggaggccacgtgcagtaggcctcaaatcgtacctgagccgatggattttcggaagctgtccacctttcgagagtcctttaaaaagagagttatagggcaagatcatgacttttccgagagctccgaagaagaggcaccagccgaggcgagcagtggcgcactgcgatcaaagcacggcgagaaggcacccatgacgtcaaggtcaacaagtacatggcgaataccatctcggaagagacggttttcaagttctgacttctccgacctgtctaatggcgaggaactgcaggagacttgctccagctcactgagacgaggcagcgggagccaaccacaggagcctgaaaataaaaagtgctcctgcgtaatgtgtttcccaaagggcgttccgcgttctcaagaggctcgcacagaatctagccaggcttcagatatgatggatacgatggacgttgaaaacaactcaaccttagagaaacacagtggaaagcggaggaaaaagcgcagacataggagtaaagtcaacggactgcagaggggcaggaaaaaggaccgacctagaaagcacctgacattaaataataaggtgcagaagaaaagatggcagcaacgcggaaggaaggctaatacgcgacctctgaagcggagacggaagcggggtccaagaattccaaaagacgaaaacataaactttaagcaaagcgaattacctgtgacctgtggagaggtaaaaggcaccctttataaagaacggttcaagcaaggaacgtcgaagaaatgcatacagtcagaagataagaaatggtttaccccaagggagtttgagatcgagggcgaccggggtgcaagtaaaaattggaaactgtctatccggtgcggaggttataccctgaaggtgctcatggagaacaagtttctgccggagccaccatctacaaggaagaagcggatactggagtcacacaacaataccctggtggacccatgcgaggaacataaaaagaaaaaccccgacgcctctgtgaaattttccgaattcttgaaaaaatgcagcgagacctggaaaaccatctttgctaaagagaaaggcaagttcgaagatatggctaaagcagacaaagcccactacgagagggagatgaaaacttatattccgccaaaaggcgagaaaaaaaaaaagttcaaggatcccaacgcgcctaaacgacctcccctggctttttttcttttttgctctgagtatagacccaaaatcaagggtgaacacccgggtctttcaatagatgacgtcgtcaagaaactggctgggatgtggaataatacggcagcagcggacaaacagttttacgaaaaaaaggccgcaaagctgaaagagaaatataaaaaagatattgcagcataccgagctaaggggaagccgaacagtgcaaagaaaagggtcgttaaggctgaaaaaagtaagaaaaaaaaagaggaggaggaggatgaagaggatgaacaggaggaggaaaacgaggaggacgatgataaatag

SEQ ID NO: 241987 - DNA, 2658 bp, Artificial Sequence
  Description of Artificial Sequence: Synthetic coding sequence
atggccggaggtggtggagacctgagcactcgcaggctaaatgaatgcatctcacccgtggctaatgaaatgaaccacctgcccgcacactcccacgacctccagaggatgttcaccgaggaccagggtgtcgatgaccgcttgttatatgatattgtcttcaaacatttcaagcgaaacaaggtggaaattagcaatgccattaagaagacattcccctttctcgaaggactgcgcgaccgcgatctcattactaacaagatgttcgaggattcccaggactcatgcaggaatttggtccctgttcagcgagtcgtgtacaacgttctatcagagctcgaaaaaacctttaatctgcccgtcctggaagcattatttagtgacgtaaatatgcaggaataccccgacttgatccatatctataaaggatttgaaaatgtgattcatgataaactgccactgcaagagtccgaggaagaggagcgcgaggaacggtccggtctccagttatcattggaacagggaaccggagagaactctttcaggtctctcacttggcctcccagtggatcaccttcacacgctggaaccactccgcctgagaatggtctgtctgaacacccctgcgagacagagcagattaacgccaagcgcaaggacactacttctgacaaggatgactccctcgggagtcaacagaccaatgaacaatgtgcccagaaagctgaacccaccgaatcctgtgagcagatagccgtacaggtcaacaatggtgacgcgggacgggaaatgccttgcccactaccatgtgacgaggaatcaccagaggcagaactgcataatcacgggattcagattaatagctgcagcgtgcgattggtggatattaagaaagagaaacctttctccaacagcaaagtggagtgccaggcacaggcgaggacccaccacaaccaggcctctgacataatcgttatcagcagtgaagattcggagggttctacagatgtggatgagcccctggaggtttttatatccgctcctcggtctgaacccgtgatcaacaatgataatccccttgaatctaacgacgagaaggaagggcaagaggctacctgttcccggccacagattgtccccgaacctatggacttcaggaagctgtccacattccgagagtcttttaaaaaaagagtgatcggacaggaccatgatttcagcgagtcttccgaagaagaagcaccagctgaagcatctagtggagccttgcgaagtaagcacggtgaaaaggctccgatgacatctaggtcaactagtacatggagaatccccagtcgtaaacggagattctcttcttctgatttcagtgacctgtcgaatggagaagaactgcaggagacatgtagcagttcgcttagaagaggtagcggaagccagccccaggaacccgagaataaaaagtgcagctgtgtgatgtgctttcccaagggcgtgcctagaagccaggaggcccgtacagaaagctctcaggcaagtgacatgatggacacaatggatgtggagaacaactccaccttagagaagcactctggaaagagacgtaaaaagcggaggcacagatcaaaggtcaatggcctgcagcggggacgtaagaaggacagaccaagaaaacatttaacactgaataataaggtgcagaagaagcgctggcaacagagaggcaggaaagctaataccaggcccctgaagcggaggcggaaaaggggccctagaatccccaaagatgaaaacatcaatttcaaacagtcggagctgcctgtgacatgcggagaggttaaaggcaccctttataaggaaagatttaaacagggaacctccaagaagtgcatccagagtgaagataaaaaatggttcacgccgagagagtttgagattgaaggggataggggagcctcaaagaactggaagctgtccatcagatgcggaggctacacgcttaaagtgctcatggagaataagttcctgcccgagcccccttccacgcggaagaagcggattcttgagagtcacaataacaccctggttgatccctgccccgagaatagtaatatttgcgaagtgtgtaacaagtggggcaggctcttctgttgtgacacatgtcctcgtagttttcacgagcactgtcacatccccagtgtggaggctaacaaaaacccttggtcttgcatattctgcagaataaagaccatacaggaaaggtgccccgagtctcagtccggtcatcaggaatctgaggtactaatgcggcaaatgctgccagaggaacaactcaaatgcgagtttctgctgctcaaggtgtattgcgattccaaaagctgcttttttgcttccgagccatactataatagggaggggagccagggcccacagaaacccatgtggctcaataaggtgaagacaagcctcaatgaacaaatgtatactagggtggagggtttcgttcaagatatgcgccttattttccacaaccacaaggagttctaccgcgaagataaattcacccggttgggtatccaggtgcaggatatctttgagaaaaatttccgcaacattttcgccatccaggagacatccaaaaacattattatgtttatttag

SEQ ID NO: 241988 - DNA, 1422 bp, Artificial Sequence
  Description of Artificial Sequence: Synthetic coding sequence
atggctggcggagggggagatctttccacccgaagacttaatgaatgtatctctcccgtggcgaatgagatgaaccaccttcccgcacatagccacgacctccagaggatgtttaccgaagaccagggcgtggacgaccgactgctctatgatatcgtcttcaaacacttcaagcgcaacaaagttgagatcagtaacgctattaaaaagactttcccgttcctagagggactgcgcgatcgagatctgattactaataaaatgtttgaggactcccaggactcgtgtcgaaacctggttccggtgcagcgcgtggtttacaacgttctctcggaactggaaaagacctttaatctccccgtgctggaggccctcttcagcgatgtaaacatgcaggagtaccccgaccttatccacatttacaaaggttttgagaatgtcattcacgataaattgcccttacaggaatccgaggaggaggaaagagaggagcgctcaggtcttcagttgagcttggagcagggtacaggagaaaacagcttcagatcactgacatggcccccttctggatctccatctcacgctggcacgaccccccctgagaatggcctaagtgagcacccatgtgagactgagcagataaacgctaaaagaaaagatactacatcagataaggacgactctctgggcagccagcagacaaatgaacagtgcgcacagaaggcagagcctacggagtcctgtgaacagatagcggtacaggtgaacaatggcgacgccggacgcgagatgccctgcccgttgccttgtgatgaggagtcacccgaagcagaactccataaccacggcatccagataaattcatgctccgtacgtttggtcgatattaagaaggaaaagccctttagcaacagcaaggtagagtgccaggcacaagcaagaacccatcacaatcaagctagtgacatcatcgtgatctcttctgaagatagtgagggctccaccgacgtggatgagcccctcgaagtttttatctccgcccctaggagcgagcccgttatcaacaatgataatcctctcgaaagtaatgacgaaaaagagggtcaggaggccacttgttccaggccacagatagtgcccgagcccatggacttccgaaagctaagtactttccgagagagttttaagaagcgggtaattgggcaggaccacgatttcagcgagagctctgaagaggaagcacctgccgaggcctcgtctggagccttgagatctaaacatggagaaaaggcccctatgactagcaggtcaacgagtacatggcgcattcctagcagaaaacggcagctgaagaagaaaaagaaaaagaagcagtgccacccacaacctcaaccacaaagaggactgcttgagcagagctag

SEQ ID NO: 241989 - DNA, 2067 bp, Artificial Sequence
  Description of Artificial Sequence: Synthetic coding sequence
atggcaggtggaggtggagacctgtcaacccggcgtctgaacgagtgtatttctccagttgccaatgaaatgaaccacctcccagctcattcccacgacttgcagcgcatgttcacagaggatcagggggtggatgatagactcctgtacgacatcgtgtttaagcattttaagagaaacaaggtggagatcagcaacgccatcaaaaaaacgttcccctttcttgaaggtctaagggaccgagatttgattaccaataagatgttcgaggattcccaggattcctgccggaacttggtgcccgtgcagcgtgtggtatacaatgtgctttctgagctggagaagacatttaacttgcccgtgcttgaagctctgttctcagatgtcaacatgcaggaataccccgatctgattcacatatacaaagggttcgagaatgtgattcatgacaaattgccacttcaagagtcagaagaggaggagcgagaggaaagatcaggtctgcagctgagtctggaacaggggaccggcgagaatagcttccggtcccttacctggccaccttctgggtccccaagccacgcgggaacaactccgcctgaaaatgggctgtctgaacacccttgcgaaacggaacagatcaacgccaagcggaaggacacaacaagcgacaaagacgacagtctcggctcccaacaaaccaacgagcaatgtgcccaaaaagcggaacctactgagagctgtgagcagatagccgtccaggttaataatggcgacgccggtagagaaatgccttgcccactgccatgtgatgaggaatcccctgaagctgaactgcacaaccacggaattcaaatcaactcttgcagcgtgaggctggttgatatcaagaaagagaagcccttcagcaattctaaggtggagtgccaagcccaggcgaggacccatcacaatcaggcctcggacattattgtcatcagcagcgaggattccgaggggtctaccgatgtagatgagccactcgaggtattcatctcagccccacgctcggaaccagttattaacaatgataaccctctcgagtcaaatgatgagaaggagggacaggaagctacatgctctcggcctcagattgtacccgagccaatggattttcggaaattgtcaacctttcgcgaatcatttaaaaaacgtgtcattggtcaggaccacgatttttccgagtcctctgaagaggaagccccagcagaagcctcttctggcgctctgcgtagtaagcatggagagaaggcccctatgacgtctaggtcgacatcaacgtggcgaatccctagtaggaaacggaggttttcaagttccgattttagcgatctttctaacggggaggaactgcaggagacctgttccagttccttaagacgaggatcaggatcacaaccccaggagcctgaaaataaaaagtgcagctgcgtcatgtgcttcccaaagggtgttccacgctcgcaagaggctagaacagagagctctcaggcctcagacatgatggatacaatggacgtggaaaacaactccaccttagaaaaacattcaggcaagcgaaggaaaaaaagacgacacaggagcaaggtgaacggactgcagagaggccgaaagaaagaccggcctcgcaagcacttaacgctcaataacaaagtacagaagaagcggtggcaacagagggggaggaaggccaacacgaggccactgaagagacgaagaaagcgtggtcccagaattcctaaggatgagaacattaattttaagcagagcgaactccccgtcacatgtggagaagtgaaggggaccctgtacaaagagcgatttaaacaggggacctccaagaagtgcatccagtcagaagataagaagtggttcacaccacgcgagtttgagatcgagggtgatcgcggagcctccaaaaactggaagcttagcataagatgcggcggttatactctgaaagtactaatggagaataaattcctaccagagccaccatctacacggaagaaggtgatgatcaaatag

SEQ ID NO: 241990 - DNA, 1443 bp, Artificial Sequence
  Description of Artificial Sequence: Synthetic coding sequence
atggctgggggagggggtgatctgagtacccgccgtttgaacgaatgcatatccccggttgcaaacgagatgaatcacctcccagctcacagtcacgacctgcaacgtatgttcactgaagatcagggcgtggatgatcggctgctgtacgacatcgtgttcaaacattttaagagaaataaggtggagatttcgaacgcaatcaagaagacctttccctttttagaaggccttcgggaccgagacctcattaccaacaaaatgttcgaagatagtcaggattcttgccggaacctggtgcccgtccagagagtggtttataacgtgctctcagagctggaaaaaactttcaacctgccagtcctggaagcactcttctctgacgtcaacatgcaagaataccctgatctgatccacatctacaaggggttcgaaaacgtgattcacgataagttacctttgcaggagagcgaggaggaagagcgggaggagcgtagcgggctacagctgagtctggagcagggcactggggagaatagctttagatctctcacatggcccccttccgggtctccatcccatgctggtactactccccctgagaacggtctctcagagcacccatgcgagaccgagcagattaatgcaaaacgcaaggacaccacatctgacaaggacgactccttaggctctcagcagacaaacgagcagtgcgcccagaaagctgaaccgacagagtcatgcgagcagatcgccgttcaggtcaataatggggacgcagggagggagatgccctgccctttaccttgtgacgaggagtcgccggaggcagaacttcataaccatggaatccagattaactcctgctccgtgaggctcgtggatatcaaaaaggaaaaacccttctcgaatagtaaagtggagtgtcaggcccaggctcgtacccatcacaaccaagcttctgacatcattgttatcagctccgaggatagcgaggggtctactgacgtcgatgaaccgctagaggtattcattagtgctccaaggtccgaaccggtcattaataatgacaatcccctggagtccaacgatgagaaggagggccaggaggccacatgctcccgtcctcagattgtccccgaacccatggactttcgaaaacttagcacctttagggaatcttttaagaagcgcgtcattgggcaggaccatgatttttctgagtcttctgaggaggaggcccctgccgaagccagtagtggcgctctgcggagtaagcacggcgagaaagccccaatgacatcacgtagtacttccacatggagaataccatctcgcaagaggcgctttagctcctccgatttcagcgacctctccaacggggaagagctgcaggaaacttgtagcagtagcctgcggaggggtagcggaaaagaggattag

SEQ ID NO: 241991 - DNA, 1068 bp, Artificial Sequence
  Description of Artificial Sequence: Synthetic coding sequence
atggatgtggaaaacaacagcaccctggaaaaacattctgggaagcggagaaagaaaagaagacacagatctaaagtgaatggactccagaggggtcggaagaaagatcgccctagaaaacacctgacactcaataacaaagttcaaaagaagcggtggcaacagcggggaagaaaggctaatacaaggcctcttaaacgaaggcgcaagcgcggaccacggattcccaaagacgagaatattaattttaagcagtcagaactgccagtgacctgcggagaggtcaaagggacactgtacaaagagaggtttaaacagggaaccagtaaaaaatgtatccagagtgaggacaaaaagtggtttacacccagagagttcgaaatcgagggcgacagaggagcctccaagaactggaaactcagcatccggtgcggcggatacacattgaaagtgctgatggagcgtattctggaaagccataataataccctggtggacccctgccctgagaacagtaacatctgcgaggtgtgcaataagtggggtcgactgttttgttgcgacacgtgccctagaagctttcacgaacattgtcacattccgagcgtcgaggccaataagaacccttggtcctgcatcttctgcaggattaagaccatacaagagcgatgtccagagtctcagagcggccaccaggaatctgaggtcctgatgagacaaatgctccccgaggaacagctcaagtgtgagtttctgcttttgaaagtctactgcgacagcaaaagctgcttcttcgcttctgaaccatactataaccgcgaggggtcccagggcccacaaaagccaatgtggttaaacaaagtgaagacatcacttaacgagcagatgtacactcgtgtagaaggtttcgttcaggacatgagactgatcttccataatcacaaggagttttaccgcgaagataagtttaccaggcttggcatccaggtgcaagatattttcgagaaaaacttccgaaacatattcgccatccaggaaacctctaagaacatcattatgtttatctag

SEQ ID NO: 241992 - DNA, 1359 bp, Artificial Sequence
  Description of Artificial Sequence: Synthetic coding sequence
atggctggcggaggaggagacctcagcacaaggatgttcactgaggaccagggcgtggacgatcggctcttgtacgatatagtcttcaaacattttaaacgcaataaggttgagatttccaacgcgatcaaaaaaacgttcccctttcttgaaggcctgcgagacagagatcttattactaataaaatgttcgaggactcacaggattcatgcaggaacctggtgcccgtccagcgtgtagtttataatgtgctcagtgagttggaaaagacattcaatctgccagtgctggaagctttgttttccgacgtgaatatgcaggagtatccggatctgatacatatttataagggcttcgagaatgttatacatgacaagctaccactgcaggagagcgaagaggaggaaagggaggagagatctggccttcaattgtcccttgagcagggtaccggcgaaaactcattcagaagtctgacgtggcccccttccggttccccctcccacgccggaaccaccccacccgagaacggcctgtccgagcatccttgtgagactgagcagatcaatgcaaagcggaaagataccacaagtgataaggatgacagcctggggagccagcagacgaacgaacagtgcgcacagaaagccgaaccaactgagagctgcgagcagattgcagtgcaggtgaataatggtgatgccggaagagagatgccatgtccattgccatgcgatgaggagtcccctgaggccgaactgcataatcatggtatccagattaatagctgctcagttcggttggttgacatcaagaaagagaagccattttcgaattccaaagtggaatgtcaggcccaggctcgcactcatcacaaccaagcctctgacattattgtcatatcatctgaagacagcgaaggaagtacagacgtggacgaaccgcttgaggtctttatttctgcccctagatccgaaccagtcataaacaatgacaatcccctggagtctaacgacgagaaggaaggccaagaagccacatgctccagaccacaaatcgtccccgagccaatggattttagaaaactttcgacttttcgcgaatccttcaaaaaacgggtgatcggtcaagaccacgatttcagcgagtccagcgaggaagaagccccagctgaggcatcaagcggcgctctgcggtcaaaacacgctcccatgactagtagatcgaccagcacctggagaattcccagcagaaagcgtcggttctcctctagcgacttctcggacctgtctaacggcgaggagctacaagagacatgctcctccagcctgcgcagagggagcggaaaggaggattag

SEQ ID NO: 241993 - DNA, 1338 bp, Artificial Sequence
  Description of Artificial Sequence: Synthetic coding sequence
atgatgttcactgaggaccaaggcgtagatgaccggctcttgtatgacatcgtctttaagcacttcaaacgaaacaaagtagaaatttccaacgccatcaagaagaccttccctttcctggagggcctgagggatcgcgatctgattaccaataagatgtttgaagattcccaggattcatgccggaatctggtgccggtgcagcgagtggtgtacaacgtgttaagcgagctcgagaagacctttaatctcccagtgctcgaagccctgttttcggatgtcaacatgcaggagtatcccgacctcatccatatttacaaaggattcgagaacgttatccacgataagctgcctttgcaggaaagcgaggaggaggagcgggaagaacgcagcggcctgcagctgtcactggagcaggggactggcgagaacagcttccggtcgctgacttggcctccttcgggaagcccatcccacgctgggacgaccccccctgagaatggtctgtccgagcatccctgtgagacagagcagataaacgccaagcgcaaggacactacttcagataaggatgattcactgggcagccaacagaccaacgaacagtgcgcccaaaaagccgaaccaactgagagctgtgagcaaattgcagtgcaggtgaacaacggggatgccggaagagaaatgccttgtcctcttccttgcgatgaagagagtcccgaggcggagctccacaaccacggaatacagatcaactcatgtagcgtccgcctggtggatataaaaaaggaaaaaccattcagcaactccaaggttgagtgtcaggcacaagcacggactcaccataaccaggccagcgatataatcgttattagtagtgaggactcggaaggatcaaccgacgtcgacgagccacttgaagtatttatcagtgctcccaggagcgaacccgtgattaataacgataaccctcttgagtccaatgatgagaaggaaggacaggaggccacctgttcccgacctcaaatcgtgcctgagccaatggattttaggaagctttcgaccttcagagaaagcttcaaaaagcgcgtgatcggccaggatcatgacttcagcgaatcaagcgaggaggaagccccagctgaggcttcctccggtgcactgcggtcaaagcatggagagaaagcacccatgacctctcgctctactagcacctggcgcataccaagtagaaagcgccgtttcagcagctctgatttcagtgatttgagcaacggcgaagagttacaggaaacctgtagcagcagtctgagacgcggaagcggcaaggaggactag

SEQ ID NO: 241994 - DNA, 2142 bp, Artificial Sequence
  Description of Artificial Sequence: Synthetic coding sequence
atgttcaccatgacccgtgccatggaagaggctctgttccagcattttatgcaccagaagctgggtattgcttacgccatccacaagccttttccatttttcgaggggctacttgataattcaatcatcaccaagcggatgtacatggaaagcttggaggcatgtcgcaatctgatcccagttagccgggtcgtgcataatatcctcacccagctggagcggacatttaacctgtctcttctagtgaccttgttttcccaaattaatctgagagagtatcccaatctggttaccatctatcggagtttcaagcgtgttggggcatcttatgaatggcagtcacgcgacacccctatcttactggaggcgccaactggtctcgccgagggatcctcgcttcatacgccgctggctcttccaccccctcaacctccacaaccttcttgtagcccctgtgcgccacgcgtgtccgaacccggaacttctagccaacagtccgacgagattctgagcgagagcccttcaccaagcgacccagttctgcctttgccagcattgatacaagaaggaagatctactagcgtgactaatgataaacttacctcaaagatgaatgcggaggaggactctgaggagatgccttcccttctaacatccaccgttcaagtcgcttctgacaatctgataccccaaatccgggacaaagaagatcctcaggaaatgccccacagtcctctgggttcaatgcctgaaattcgagacaattctcccgagcctaacgacccggaagagccccaggaggttagctccacaccaagcgataaaaaaggcaagaaaaggaagcggtgcatctggagcacgccaaagcgaagacacaagaaaaagtcactgcccggtggaacagccagctcccgccacggaatccaaaaaaagctaaagcgtgttgaccaggtgccacagaagaaagacgatagcacttgcaactccacagtggagactcgagcccagaaagcccgaaccgaatgcgcgcgaaagagtcgatccgaggaaatcatcgatggcacatcagaaatgaacgaaggtaaacggtctcagaagacaccatctactcccaggcgagtgactcagggcgctgctagtcctggccatggcattcaggagaaactgcaagtggttgacaaagttacgcagagaaaggacgatagcacgtggaatagcgaggtgatgatgagggtccagaaggccagaacaaagtgtgcccgtaaaagccggttaaaggaaaagaagaaagagaaggatatatgcagcagctctaaaagacgatttcaaaagaatatccaccgccgtgggaaacctaagtctgacactgtggacttccattgctcaaaactgcccgtgacatgcggtgaggctaaagggatactgtacaagaaaaaaatgaagcacggatcttccgtcaagtgcatccgtaatgaagatggcacctggctgacccccaacgagttcgaagtcgaaggtaaagggcgaaatgccaaaaactggaagcgcaatatacgatgtgaggggatgacactgggggagctccttaagcgcaagaactctgacgagtgcgaagtttgctgtcaaggcggacaacttctgtgttgcggcacttgcccgagagtttttcacgaggactgccacatacccccagtggaggcgaagaggatgctctggagctgcacattttgtcggatgaagcgttcctctggatctcaacaatgtcatcatgttagcaaaaccctggaaagacagatgcagccccaggaccagctgaaatgtgaattcctgctcctgaaagcctactgccacccccagtcatcctttttcactggcatcccttttaatattcgggattacggcgagccatttcaagaagctatgtggttggatctggttaaggaacgcctcatcaccgagatgtataccgtcgcctggtttgtcagagacatgagattgatgtttaggaaccacaagacgttctataaggcatcagatttcggccaggttggccttgacctcgaagcagagttcgagaaggatctgaaggatgtattagggtttcatgaggccaacgacggaggcttctggaccctgccttag

SEQ ID NO: 241995 - DNA, 1650 bp, Artificial Sequence
  Description of Artificial Sequence: Synthetic coding sequence
atgtttacaatgactagggccatggaggaagcactgtttcaacatttcatgcaccagaagcttggtattgcgtatgcaattcacaagccttttccctttttcgaaggacttctggacaactccatcatcactaagaggatgtacatggagtccctcgaagcatgtcggaacctgattccagtctcaagagtcgttcataatattcttactcagctcgagagaacattcaatcttagcctactggtgacccttttctcccagattaatctgagggagtatccaaatttagtaactatatacaggtcttttaaacgagtgggggcttcctacgagtggcagtccagggacacccccattttgctagaggccccaaccggtctggctgagggttccagtctgcacactcctctcgcactgcccccacctcagccccctcagccctcttgtagcccctgtgctcccagagtgtctgaacctggtacttcctctcaacaaagcgatgagattttgagcgaatcaccttccccttccgatcctgtactaccattacccgctttgattcaagaggggaggtctacttccgtgactaacgataagctgacgagtaagatgaatgccgaagaagattcagaagaaatgcccagtctgctgacatctaccgtgcaggtggcctctgataacctcatcccgcagatccgagataaggaggacccccaggaaatgccacacagcccgctcggcagcatgcctgagattagggacaactctcctgagcctaacgaccccgaggagccacaggaggtcagttcaacaccatcagacaagaaaggtaagaaacgcaaaagatgcatctggagtacccccaagaggcgccacaagaagaaaagcctcccaggcggaactgcttcttcgaggcatgggatacagaaaaaactcaaacgcgtggatcaagtgcctcaaaagaaggacgatagcacctgtaacagcacggtcgaaacacgggcacaaaaggcgcgaacagaatgtgctcggaagagtcgcagcgaggagattattgacggcaccagcgagatgaacgaaggcaagcggagccagaagaccccaagcacaccccgacgcgtgacccagggcgcagcttcccctggtcatggtatccaagagaagctgcaggtcgtcgataaggttacccagcggaaagatgactcgacttggaatagtgaggtcatgatgcgagtgcagaaagctaggaccaaatgtgctagaaaaagtagactcaaagagaaaaagaaggaaaaggacatctgctcctcctccaaacgccgattccagaagaatatccatcgaagggggaagcccaagtcagatacagttgactttcactgtagcaagttacccgtgacctgcggcgaggctaaggggatcctctacaagaagaagatgaaacatgggtcaagcgtgaaatgtatcagaaacgaggatggaacttggctcacccctaatgaatttgaggttgaggggaaaggccgtaatgctaagaattggaagcgaaacattcgctgcgaaggcatgaccctgggcgaattgctcaagagtggcctacttctttgccccccaagaataaatctaaagcgggagctcaactcaaagtag

SEQ ID NO: 241996 - DNA, 756 bp, Artificial Sequence
  Description of Artificial Sequence: Synthetic coding sequence
atgccagagatccgcgacaatagcccggagccgaacgacccagaggagcctcaggaagtcagctccaccccttctgataaaaaaggaaagaaacgaaagaggtgcatatggtccacacccaaacggcgacataaaaaaaagtctctgcctggagagataatcgacgggacatcagagatgaatgagggaaaacgtagccaaaagaccccaagcactcccagacgcgtgacacagggggctgcatcacccggacacgggatacaggaaaaactccaagtcgtggacaaagtaacacaacgtaaagatgacagcacctggaattcagaagtgatgatgcgagtgcaaaaggccagaaccaaatgcgcaagaaagagcaggctgaaggagaagaagaaagagaaggatatttgctcctcttctaaacgaaggtttcagaagaatattcatcggcgagggaagcctaagtctgatacggtggacttccactgcagcaaactgccagtgacctgtggggaagccaaggggatcctctataagaaaaagatgaaacatggcagcagtgttaaatgcatcaggaacgaagacggcacctggctgacccccaatgagtttgaggtggagggtaaagggagaaacgccaagaactggaagcgcaacatccgctgcgagggcatgactcttggagaacttctgaagagcggtttactcttgtgtccaccgcgtatcaaccttaaaagggagctgaattccaaatag

SEQ ID NO: 241997 - DNA, 2070 bp, Artificial Sequence
  Description of Artificial Sequence: Synthetic coding sequence
atgttcactatgacccgggcaatggaagaagctctgttccagcactttatgcatcagaagttgggaatcgcatatgccattcacaagccatttcctttttttgaaggactcctggacaacagtattatcacaaagagaatgtatatggagagcctcgaggcctgccggaatctcatcccagtgtctagggtggtacacaacatcctgactcagttggagcgcacattcaatctttcactattggtgaccctgttctcccaaatcaacctccgcgaatatcctaatctggtgacaatctaccgctcattcaaacgtgtcggcgcatcttacgagtggcagtcacgcgatacccccatcttgctggaggcccctactggccttgccgagggcagcagcttgcacacacctctggctctgccacctcctcagccgcctcagccttcttgttcaccctgcgccccacgcgtgtccgagccaggcacctcaagccagcaatcggacgagattctttccgaaagccctagcccttcagacccagttttgccgcttcccgcactgatacaagagggtcgcagtacaagtgttactaatgataagctgaccagcaagatgaatgccgaggaggattcagaggagatgcctagcctgttgacgtcaactgtgcaggtagctagcgataatctgatacctcagatcagagataaagaggatccccaggaaatgcctcattctcccctggggagcatgcctgagattcgtgacaatagtccagaacctaatgatccagaggaaccacaggaagttagcagcaccccctcagacaaaaaagggaaaaagagaaagcggtgtatctggtccactcctaagcggaggcacaagaagaagtcgctgccgggtggcaccgcgtcttcacgccacggtatccagaagaaactcaaacgggtcgatcaggtcccccagaagaaggacgacagtacttgtaactccacagtagaaactagggcacaaaaagccagaacggaatgtgctcgaaaaagtcgatccgaggagatcattgacggaacatccgaaatgaacgagggaaagaggagccaaaagaccccatccacacccagacgcgttacccagggagctgccagccccggacatggcatccaggagaagctccaagtggttgacaaggttacacagcgcaaggatgactctacttggaacagcgaagtgatgatgagggtccaaaaagccagaacaaaatgtgctcgcaagagccggttaaaagagaaaaaaaaggagaaagacatttgctcgtcgtctaagcgacgctttcagaaaaacatccaccgccgtggcaaacctaaaagcgataccgtggatttccactgttccaaacttccagtgacttgcggtgaggccaagggtattctctacaagaagaaaatgaagcacggctctagtgtgaaatgcattcggaatgaggatggaacctggctgacgcctaacgagtttgaggtggagggaaaagggagaaatgccaagaattggaagcgtaatattcgctgcgaagggatgacactcggggagttgctgaaacgcaagaacagcgacgagtgtgaggtctgctgccagggcggacaactgctctgttgtggaacatgtccgagagtgtttcacgaggactgtcacatccctcctgtggaagccaagagaatgctgtggtcatgtacgttctgcagaatgaagagatcgtcaggaagtcagcagtgccatcacgtatcgaaaacattggaaagacaaatgcaacctcaggaccagctaatccgggactatggcgaaccgttccaggaggccatgtggctggatttggtcaaagagaggcttatcaccgagatgtacactgtggcctggttcgtcagggacatgcggctgatgttccgtaaccataaaacattctacaaagcatccgatttcgggcaagtcggtctggacctcgaggcggaatttgagaaggaccttaaggacgttctcggctttcacgaagctaacgacgggggattctggacactcccttag

SEQ ID NO: 241998 - DNA, 1644 bp, Artificial Sequence
  Description of Artificial Sequence: Synthetic coding sequence
atgtttacaatgacaagggcaatggaggaggctttgtttcaacattttatgcaccagaaactgggcatagcttacgctatccacaagcccttcccctttttcgaagggctgctggataacagtattatcactaagcggatgtacatggagtctttagaggcttgtcgaaatctgatccccgttagtagagtagtgcataacattttgacacagctcgaaagaacttttaacctatcgctactagtgacgttattcagccagatcaatctccgtgaataccccaacctggtcacaatttaccgctcattcaaacgagtgggggcttcatatgagtggcaatcccgggatactccgatcctgctcgaagccccaactggcctcgctgaaggcagtagcttgcacacccccctggccctgcctcccccacagccaccacagcccagctgttctccatgcgccccaagagtcagcgagcccggaacctccagccagcagagcgacgagatactctccgaatcaccttctccctctgatcctgtcttacctcttcctgcactgattcaggaggggaggagcaccagtgtgactaatgacaagctgacaagcaagatgaacgcagaagaggacagcgaagagatgccatcactgctcactagcactgttcaggtggctagcgacaacctcatcccccagattagagataaggaggaccctcaagaaatgccgcactctccccttgggtccatgcccgaaattagggacaacagcccagagccaaatgaccccgaggagcctcaggaagttagttctaccccgtcagacaaaaagggcaagaagaggaaacgatgcatctggtcaacacctaaacgtcgccacaaaaaaaagtcacttccaggagcatcatcaaggcacgggatccaaaagaaattgaaaagggtggatcaagtgccacaaaaaaaagacgatagtacttgtaactccacagttgagacccgagcccagaaagccagaaccgaatgcgctcggaagtcacggagtgaagaaatcatcgacggcaccagtgagatgaatgaaggtaagcggtcacagaagactcccagtacgccgcgtcgggttacacagggggctgcttctcctgggcacggcattcaggaaaagctccaggttgttgacaaagtgacacagcgaaaggacgattccacctggaattcagaagttatgatgagggtacagaaagctagaacgaaatgtgcccgtaagagtcgccttaaagaaaagaagaaggagaaagacatctgtagcagctcaaaaagaagattccaaaagaacatccaccggaggggaaaaccaaagtcagatacagttgactttcactgtagtaagctgccggttacatgcggtgaagccaagggcattttgtacaaaaagaagatgaagcatgggagcagcgtcaagtgtattaggaatgaagacggcacctggctgaccccaaacgaattcgaggtggagggcaaaggcaggaacgccaaaaattggaagagaaacattcgctgtgagggaatgaccctaggagagcttctgaaaagcggccttcttctatgccctcccagaattaatctgaaaagagagctgaactcaaagtag

SEQ ID NO: 241999 - DNA, 666 bp, Artificial Sequence
  Description of Artificial Sequence: Synthetic coding sequence
atgttcaccatgacccgtgcgatggaggaggctctgtttcagcatttcatgcatcagaagctcggaatcgcctatgctattcataagccgtttcctttcttcgaaggtttactagacaactcgatcattacaaaacgcatgtacatggaatcattggaagcatgccgcaatttgatcccggtcagtagggtcgtccataatatcctaacacaactcgagcggacatttaacctgtctcttctcgtgaccctgttttcccaaattaatctgcgcgaatatcctaatctggtgacaatttaccggagtttcaagagggtgggggcatcttacgaatggcagagcagggatacccccattttgctggaggcacccacaggtctggcggagggttcatcactgcacacacccctggcactgccgcctcctcaaccccctcagcctagctgctcaccctgcgcccctcgtgtgtccgagcctgggacgtcttcacaacagtcagatgaaatcctgtccgaaagcccttcgccctcagaccccgtgcttcctttaccagccttaatccaggaaggaaggagcactagcgtcacaaacgataagctgacatccaaaatgaacgcggaggaggactcagaagagatgccgagcctcctcacgtccacagtttag

SEQ ID NO: 242000 - DNA, 306 bp, Artificial Sequence
  Description of Artificial Sequence: Synthetic coding sequence
atgttcaccatgactagggctatggaagaggccctgttccaacactttatgcaccagaagctaggaatcgcttacgccatccataagccctttcctttttttgagggcttgctcgataactctatcatcactaagcgcatgtacatggaaagcctagaggcttgcaggaacctcatcccagtgagcagggtggtgcataatatactgacacagcttgaacgtaccttcaatttgagcttgcttgtgactctgttctctcagattaacctcagagaatatccaaatctcgtgaccatttatagatag

SEQ ID NO: 242001 - DNA, 1668 bp, Artificial Sequence
  Description of Artificial Sequence: Synthetic coding sequence
atgggtcgcggatttcgcatgtttacgatgaccagagccatggaagaggccctctttcagcattttatgcatcaaaaactcggcatcgcttacgccatccataaaccattcccttttttcgaaggtcttctggataacagtattatcaccaaaagaatgtacatggagtcactggaagcctgcagaaatctgataccagttagcagggttgtgcacaatatcctgacacagttggaacgcacgttcaacctgtcccttctcgtaaccctgtttagccagattaatctgagggagtaccctaacctcgtcactatttaccgatcctttaaacgggtcggagcctcatacgagtggcagagccgggacacgcctatcctactagaggctccaactggtttagctgaaggaagctccctgcacaccccactggccctccccccacctcagcctccccagccaagctgcagcccgtgtgctccgagggtttctgagcctggtacttcaagtcagcagtccgacgagatcctatctgagagtccaagtcctagtgaccctgtactccctttgccagctttgattcaggaggggcgaagtacgagtgtgactaatgataaattgacgagcaagatgaacgccgaggaagactccgaagagatgccatccctgctgacttctaccgtgcaggtagcatcagacaacctcatacctcagattagggacaaggaagacccccaggagatgccacattcacccttggggagcatgccagagatccgagataattccccagagccaaatgatcccgaggagccgcaggaggtgagctcaaccccgagcgataagaagggcaagaagcgcaagcggtgcatctggtctaccccaaagcgacggcataagaaaaagagcctccccggagggacagccagcagcaggcatggtattcagaaaaaacttaaacgggttgaccaagtgccgcagaaaaaggatgacagcacatgcaattcgacagtcgagaccagagcccagaaggcacgtactgagtgtgctcgcaagtcccgctccgaggagattatcgacggcacgtcagagatgaatgagggtaaacgcagtcagaaaacaccttccactcctcgcagagttactcagggcgctgcctccccaggacatgggattcaggaaaaactgcaggtcgtggacaaggttacacagcggaaagacgactctacctggaactccgaggtgatgatgcgagtgcagaaggctcgtaccaagtgcgcacgaaaaagccggcttaaggagaagaagaaggaaaaagatatatgtagcagctccaaacgacggttccaaaagaacatccaccggagaggcaagcccaaaagtgatacagtcgactttcattgcagcaagttaccggtaacctgtggtgaagcaaaagggatactgtacaaaaagaagatgaagcacggctccagtgtgaagtgcatcaggaatgaggatggcacctggctgacccctaacgagttcgaggtagaaggcaaggggcgaaatgccaagaactggaaacgtaacatccggtgtgaggggatgactctgggcgagttgctgaagtccggtctgttgctatgtccaccaagaattaacttaaagcgcgaactaaattccaagtag

SEQ ID NO: 242002 - DNA, 2346 bp, Artificial Sequence
  Description of Artificial Sequence: Synthetic coding sequence
atgaccgcacccgagaaaccagtgaagcaggaagaaatggcagccttggatgtggattccgggggtgggggaggcggagggggtggacatggtgagtatcttcagcagcaacagcagcatggtaatggagctgttgctgcggcagctgctgcccaagatactcagccctccccattggctctgctcgccgctacttgctcaaagatcggcccaccctctccaggagatgatgaagaagaagctgctgcggctgccggagcccctgctgcagctggggcaacaggagacttggcgtcggcacagctgggcggtgcccctaaccggtgggaggtgctcagtgccacacccactaccattaaggacgaagccggaaatctggttcagatcccatctgccgcaacttcctcaggccaatatgtgcttcctttgcagaacttgcagaaccagcagatattcagtgtggctccagggtctgactcaagtaatgggaccgtatcgtctgtccagtaccaggtgattcctcagatccaaagcgccgatggtcagcaagtccaaattggctttaccggctcttccgataacggagggattaaccaagagagcagccagattcagatcatacccggaagtaaccagacactattagctagcgggacaccttcggctaacatccaaaatcttatcccacagaccggccaggtgcaggttcaaggtgtggccattggaggtagctccttcccaggtcaaacacaggtcgtggctaacgtacctctgggcctgcctggtaacattacattcgttccaatcaatagtgttgacctggacagccttggcctgagtgggagttcacagaccatgacagcaggaattaacgctgacgggcatttgattaacaccggacaggcaatggattcttccgacaacagcgaacggacaggcgagagagtgagccccgacattaatgagaccaatacagatacagacctgttcgtgcctacctcctctagttcacagttgccggtgaccatagacagcacggggattctgcaacagaatacgaatagcctcaccacttcatccggccaggtccacagctctgacctccagggtaactatatccagagcccagtgtctgaggaaacacaggcccagaatattcaagtgtctaccgctcaacctgtagtccagcatctccaattgcaggagtcccagcagcctacttcccaggctcagatcgtgcaggggataaccccccagacaatccacggagtccaggcgagcggacagaacatttctcagcaggctttgcagaacctgcagctgcagctgaatccaggaacctttctgatacaggcccagacagtgacccccagcggccaggtcacttggcagacgtttcaagtgcagggggttcaaaacctgcagaacctgcaaattcagaacaccgccgcacaacagattactctgacccccgtgcagaccttgactctcggtcaggtagctgccggtggtgccttcacctccactccagtctctttatctacaggccagttaccaaatctccagaccgtaacagtgaattccatagacagcgctggaatccagctgcatcctggagaaaacgccgacagtcccgctgacatccgcattaaggaagaagagcccgatccggaagagtggcagttatcaggggacagtactctgaataccaatgacctgacccatctgcgggtacaggtggttgacgaagagggcgatcagcagcatcaggaagggaaaagacttcgccgagtcgcctgtacctgcccaaactgtaaggaagggggaggccgtggaaccaatctgggcaagaaaaagcagcacatatgtcacatcccgggttgcggaaaagtatatggaaagaccagccacctaagggctcacctccgttggcacagtggagaaagaccatttgtgtgcaactggatgtactgtgggaagagatttacccgatcggacgagctgcagagacatagaaggacacacactggggaaaagaagtttgtgtgtcctgagtgtagcaaacgtttcatgcggtctgatcatctggccaagcatataaaaacccaccagaacaagaagggaatacattccagcagtaccgtgctagccagcgttgaggctgcacgagatgataccctgatcacggcaggcggaacaacactcatcctcgctaatattcagcagggctccgtgtcgggcatcgggactgttaacacaagcgccacaagcaatcaggacatcctgaccaacacagaaatcccactgcaactggtgactgtgtccggtaatgagactatggagtag

SEQ ID NO: 242003 - DNA, 2217 bp, Artificial Sequence
  Description of Artificial Sequence: Synthetic coding sequence
taacccgagaaaccagtgaaacaagaagagatggctgccttggatgtagacagcggcggaggtggcggtggtgggggaggacacggggagtatcttcaacagcagcaacagcacggcaacggggcagtggctgcagctgcagcagcacaaactggagacctggcctctgctcagctgggaggtgcccctaatagatgggaggtgttatccgctactcctactaccattaaggacgaagcaggtaacctggtgcagatcccttcagctgccacatcctccggccaatatgttcttcctttgcagaacctgcagaaccaacagatcttctctgtcgccccaggtagtgacagttcaaatggcaccgtgtcttcagttcaataccaagtgataccccagattcagtccgctgacggccagcaagtccagatcggctttaccggcagtagcgacaatggcggaattaatcaggaatcctcccagatccaaatcatcccaggctctaatcagaccctcctggccagtggcaccccatccgctaatattcagaacctgatcccacagactggacaagtgcaggtgcagggggtcgcgatcgggggaagcagtttccccggacaaacacaggtggtggccaatgtgccgttaggactgcccggtaatatcacatttgttcctattaactccgtcgacctggatagtctggggctgtccggctcctcccagaccatgactgctggtatcaacgcggacggacacctgattaacacgggccaggccatggatagcagcgacaattcagaacgcacaggggaaagagttagtccggatatcaacgagacaaataccgataccgatttgttcgttccaacatctagtagtagccagttaccagtgaccatcgactccaccggaatcctgcaacagaatactaatagtttaaccacctcttcaggtcaagtgcacagcagtgatcttcaaggaaactacatacaatctcccgtgtctgaggagacccaagcacagaacatccaggtgtccaccgcccagcctgtggtgcagcacttacaactgcaagagagccagcagccaacctcccaggcacagatagtccagggaattacaccgcagacaattcacggtgtgcaggcttctggtcaaaacatttcccagcaggcgctgcagaatctccaactccaattgaaccccggaacattcctgatacaggcacaaaccgtgacaccgagcggacaagtaacctggcagacgtttcaggtccagggcgtgcagaacctgcagaacctgcagatccagaacacagcggctcagcaaatcaccctgacccctgtgcagactttaacactgggacaagtcgccgcaggaggcgctttcacaagtactcccgtttctttgtccaccgggcagttgcccaacctgcagactgtaacggttaattctattgatagcgcagggattcagctacaccccggagaaaacgctgattctcccgctgacatccgcataaaggaagaggagccagaccccgaggaatggcaacttagcggcgattctacgcttaacactaacgatctgacacacctccgcgtccaggtggttgacgaggaaggggatcaacagcaccaggaaggaaagcggctgcgaagagtggcctgtacttgcccaaattgtaaggaaggtggaggcagagggaccaatcttgggaaaaagaaacaacatatctgccacattccgggatgtggtaaggtttacggaaaaacgtcacacctcagggcccatttaaggtggcatagcggagagcggccatttgtttgcaactggatgtactgtgggaagagatttaccaggtccgatgaactccaacggcatagaagaactcacacaggcgaaaagaaatttgtttgccccgaatgttctaagcgcttcatgcgatccgaccatctcgccaaacacatcaagacccaccagaacaagaagggcattcatagctctagcacagtcctggcgtccgtggaggcagcacgagacgacactctcatcaccgcgggtggtactacactaatcctcgctaatatccagcagggatcggtgagcgggattggtacagtgaacacctccgcaacctctaatcaagatatcctgaccaacaccgaaattcccctgcaactcgtgaccgtctcggggaatgagacaatggaatag

SEQ ID NO: 242004 - DNA, 2142 bp, Artificial Sequence
  Description of Artificial Sequence: Synthetic coding sequence
ataggtccaccctccccaggagacgacgaagaagaagctgctgctgccgcaggtgccccagcggcagccggagcgaccggggatctggctagtgcgcagttaggcggtgccccaaaccgctgggaggtccttagtgctactccaaccacaattaaagatgaggccggaaacttggtccagatcccctccgccgctacttcaagcggccagtatgtcctgcctcttcagaatctacagaatcaacagatttttagcgtggcacccggtagcgattctagcaacgggacagtgtcatctgtgcagtatcaggttattcctcagatccagagcgccgatggtcagcaggtccagatcggattcacgggatcctccgacaacgggggtataaatcaggagagttctcagatccagattatcccaggttccaatcaaacacttctggctagtggcactcctagcgcgaatatacagaatctgattcctcagaccgggcaggtacaggtgcagggcgtggccatcgggggatctagcttcccaggtcagactcaggtggttgctaacgtgcccctgggactgccagggaacataacttttgtgccaatcaactccgtagacctcgatagccttggactaagcggctcctcacagacaatgaccgccggaatcaacgccgatggccacctgatcaataccggacaggctatggactcatcagacaattctgagcgaaccggcgaaagagtgtcaccggatattaatgagaccaataccgataccgacctatttgttcccacttcaagcagtagtcaactgcctgtgaccatcgactccactggtatcctccagcagaacacgaatagtttgaccactagttccggtcaggtgcactcaagcgatctgcagggaaattacatccagtctccagtgtcagaggagacacaagctcagaatatccaggtcagcaccgctcagcctgtggtgcagcacctccagttgcaggagagccaacagccaacatcacaagctcagattgttcagggtattactccgcaaaccatccacggcgttcaggcttcaggccagaatatctctcagcaagcactacaaaacctgcaactgcagctgaatcctggtacttttctgattcaggcgcagacagtgaccccctctggacaggtgacttggcaaacgttccaggtgcagggcgttcagaacctgcagaacctgcagatccagaacaccgcagctcaacaaatcacccttactcctgtgcagacccttacccttggccaggtggctgctggcggagcttttacatctacgcccgtcagcctcagcactggacagctaccaaacctccaaacagtcaccgtgaattcgatagactccgccggtatccagctacacccaggagagaatgcggacagccctgcggacataagaatcaaggaggaagaacccgaccctgaggaatggcagctgagtggcgacagcaccctcaatactaacgacttgactcacctaagggtccaggtggtggacgaggagggggaccagcaacaccaggaaggcaagcggctgcggagggtggcgtgtacatgccccaactgtaaagaggggggaggcaggggcacaaatctgggtaagaaaaaacagcacatttgccacataccaggctgcgggaaggtctatgggaagaccagtcacctgagagcacacctgagatggcactccggagaacggccatttgtgtgcaattggatgtattgcggcaagagatttacaagatccgatgagctccagcggcatcgcaggacacacacgggcgagaagaagttcgtgtgccccgaatgttcaaagcgctttatgcgatctgaccatctcgcgaagcacattaagacgcatcaaaacaagaagggaatacactcttcaagtactgttctggcaagcgtggaggctgccagggatgatacccttatcaccgccggtggtaccactctaattcttgccaacatccagcagggctcagtgagcggcattgggaccgtgaataccagcgccacatctaaccaggacattcttaccaacaccgaaataccattacaactggttaccgttagtggaaatgaaacgatggagtag

SEQ ID NO: 242005 - DNA, 2187 bp, Artificial Sequence
  Description of Artificial Sequence: Synthetic coding sequence
atggccgctctcgacgtcgacagtggcggaggtggcggtggcggaggcggtcacggagagtatttgcagcagcagcagcaacacggaaacggagccgttgccgctgccgctgctgcccaaactggggatctggcgtccgcccagttgggcggtgcaccaaaccgctgggaggtcctgtccgccacacccaccaccatcaaagatgaggcgggtaacttagttcagatcccttcagccgctaccagcagtgggcaatatgtgctgcctctgcagaacctccagaaccaacagattttttcggtggctcctggatcggacagttcaaatggaacggtcagcagtgtgcaataccaggtcattccgcaaattcaaagcgccgatggacagcaagtacagatcggtttcactggttccagtgataacggtggaatcaaccaggagagtagtcaaatacaaatcatccccggtagcaaccagacactactggcctcgggaacaccttccgccaacattcaaaacctgataccacaaaccggccaggtgcaagtgcaaggcgtcgccatagggggatcaagctttcccggacagacccaggtagtggctaacgtaccccttggcctaccaggcaatatcaccttcgtcccaatcaattccgtcgatttagattccctgggattgtctgggtcaagccagacgatgaccgctggtatcaacgctgatggccacctaattaacacagggcaggctatggattcctctgataactctgaaagaaccggtgagcgggtatcgcctgatatcaacgagaccaacaccgacaccgatctgtttgtgcctacttcctcctcttcacagcttcccgtcaccatcgactccacaggaattctccagcagaataccaactcattaacaacttcaagcggtcaagtacacagtagcgatctgcaggggaattatatccaatctcctgtcagtgaggagacacaggcccagaatatccaagtgtctacagcccagcccgtggtgcagcatttacagctccaggagtcccagcagcccaccagccaggcccagattgtacagggaataactccccagactatccatggagtccaggcttctggacaaaacatttctcagcaggctctgcagaatctgcagctgcagctcaaccccggaaccttcctgattcaggcccagactgtaacgcccagcgggcaggttacatggcagacgttccaggtgcaaggcgtgcagaacctccagaacttgcagattcagaatacagcagcacagcagatcacactcacacctgtacagactctcacactcgggcaggtcgccgctgggggagcatttacctctacgcctgtatccctgagtaccggacagctgcccaacctccagaccgtgacggttaactccatagattccgctgggattcagctgcaccccggtgaaaacgccgacagccccgctgacatccgcatcaaggaggaggagcccgatcctgaggaatggcaattgtctggagacagcacactgaatactaacgacctgacacatctgagagtgcaggtggttgacgaagagggcgatcaacagcaccaggagggcaagcgactgcgaagagtagcttgcacgtgtcccaattgcaaagagggaggcggtaggggtacaaatttggggaaaaagaaacagcacatttgtcacattcccggatgcggtaaagtttacggaaaaaccagccacctcagagcgcacttgagatggcacagcggcgagcgcccttttgtgtgtaactggatgtactgcggcaaaaggttcacacgaagcgacgaattgcaacgacacagaagaacacatacaggtgagaaaaagtttgtatgtccagagtgctctaagcgcttcatgagatcggatcacctggccaagcatattaagacgcatcagaacaagaagggaattcactcatcctccactgtgctcgcttccgtggaggcagcaagagacgacacattgatcacagccggaggtacaacattaatcctggccaacatccagcagggatccgtaagtggcattggaaccgtgaacacatctgcaacaagcaatcaggatattttaaccaatactgagattccacttcagcttgtcactgtttccgggaacgagaccatggaatag

SEQ ID NO: 242006 - DNA, 1545 bp, Artificial Sequence
  Description of Artificial Sequence: Synthetic coding sequence
atggtgtgggaagtcaaaactaaccagatgcctaacgccgtgcagaaacttctgctggtgatggacaaacgggcaagtggaatgaatgacagccttgaacttctccagtgcaacgaaaacctcccatcatctcccggatacaatagttgtgatgagcatatggagctggacgaccttccagaattgcaggccgtgcagtcggacccgactcagagcggaatgtaccaactttcaagcgacgtgagccaccaggagtatccacgatcaagctggaatcagaataccagcgatatcccagaaacaacctatcgcgaaaacgaagttgactggctcacagagttagccaacatcgccacctcacctcagtcacccctgatgcagtgctctttctacaaccgctcctctcctgtccacattatagctacgagcaaatctttgcacagctatgctagaccacctccagtatctagctcatccaagtctgaacctgcttttccacaccaccattggaaggaagagactcccgtgcggcacgaacgcgcaaacagtgagagcgagagcgggattttctgcatgtcctcgctgtctgacgatgacgacctcgggtggtgcaactcttggccttctacagtgtggcattgtttcctgaaaggaaccaggctgtgcttccacaagggctccaacaaagagtggcaggacgtggaggattttgccagggcggagggatgcgataatgaggaggacctgcagatgggcattcataaggggtacggatccgacggccttaagctgctgagccacgaagaaagtgtgtccttcggggagtccgtgttaaaactcacatttgaccctggtacagtagaggacggccttttgacagtcgagtgtaagctcgaccaccctttttatgtgaaaaacaaaggttggtcaagcttttacccttctctgacggtagtgcagcatggaataccatgttgtgaagtgcacatcggagacgtttgcttgcctccgggacatccggacgctattaattttgatgactctggggtatttgatacatttaagtcctacgactttacgcccatggatagcagtgctgtttacgtcctcagtagcatggcgaggcagagaagggcctcactgtcttgtggtggcccaggcggtcaggatttcgccaggagtggattctccaaaaattgcggctctcccggttcaagccagctttcatcaaatagtctctacgccaaggccgtgaagaaccatagttccgggactgtctcagccacgtccccaaacaagtgcaaaagacctatgaatgccttcatgctgtttgctaagaagtatcgagttgaatacacgcagatgtatccaggcaaggataatcgtgctatctccgtcatactaggagaccgatggaagaaaatgaagaacgaggaacgtagaatgtacacgctggaggcaaaagcccttgctgaggagcaaaaacggttaaaccccgattgctggaagagaaagcgcaccaactcggggtcgcagcagcactag

SEQ ID NO: 242007 - DNA, 432 bp, Artificial Sequence
  Description of Artificial Sequence: Synthetic coding sequence
atgagtgaccagaagaaagaggaggaagaagaggcggcagcagcagctgctatggcgactgagggaggtaaaacctcggaacctgaaaataataacaaaaagccgaagacctcaggaagccaagactcacagccaagccctctggcattgctggctgcgacatgctcaaagattgggacccccggtgaaaaccaggccaccggacagcagcaaaggaatctccttgagacccttggaaacctgctccccccattgctgctgctgcaaaagcggattactttccttaaccagccgttggttcggctggtccttccggctgtaatcaccggagtccacctgttacagaaactcaaccaggtgatcctgccacccctcgtaaacttcaaatcctacaaatacaagatccaggtcgtcgtctactctactaaatag

SEQ ID NO: 242008 - DNA, 1296 bp, Artificial Sequence
  Description of Artificial Sequence: Synthetic coding sequence
atggcttcatccttgctggaggaggaagtgcactacggttcttctcctctggcaatgctcaccgccgcttgctctaagtttggtggcagctcgccgctgcgcgacagtacaacgttaggcaaggcgggaacaaaaaagccttatagcgtcggttcagatctgtccgcttcaaaaacaatgggggatgcatatccagcgccttttacatctaccaatggtctcctgagtccggctggatctccacccgcaccgacaagtggctatgctaatgactacccacctttctcccatagttttcccggacctaccgggacacaggatccgggtcttcttgtgcctaaagggcactcctcttctgattgtcttcccagtgtttatacttccctcgacatgacccatccctatggaagctggtacaaagcaggcattcacgcaggaatcagccctggacctggtaatacccccaccccttggtgggacatgcatcctggcggaaattggctgggcggtgggcaggggcagggtgatgggctccagggaacgcttccgacagggcctgctcagccacctttgaatcctcagcttcctacgtacccttcggatttcgctcccctgaatcccgcaccatatcctgctccgcacctccttcagcccggacctcagcacgtgctacctcaagatgtatacaagcctaaggcggtgggtaactcagggcagctagagggctccgggggagccaagccccctagaggggcatctacaggagggtccggtgggtacggtggctccggagcaggaagaagtagttgtgactgtccgaattgccaggaactggagaggctgggggcagcagcagcaggactgagaaaaaagcctattcactcttgccatattccgggatgcgggaaggtttacggcaaggccagccacttaaaggctcatctgcgttggcacaccggagagcgccctttcgtgtgcaactggctcttctgtggcaagagatttacccgatccgacgaactggagagacacgtgcgcacacatacacgagagaaaaaattcacttgcctgctctgcagcaagcggtttacaaggtctgaccacctgtctaagcaccagaggacacatggagaaccaggacccggacctcccccaagcggccctaaagagctaggggagggacgatcgactggggaggaggaagcaagccagacgcccagaccatcagcatcccccgcaactccagagaaggcccctggcggtagcccagaacaatccaatctgctcgagatctag

SEQ ID NO: 242009 - DNA, 1296 bp, Artificial Sequence
  Description of Artificial Sequence: Synthetic coding sequence
atggccagtagtctacttgaggaagaagtgcattatgggagttcgcccctagccatgttaacagctgcatgtagcaaattcggcggtagttctcccttgagggattccacaactttgggtaaggcaggaacgaagaagccatactctgtagggtctgatctttctgcctctaaaactatgggggacgcttacccagcacccttcacttctacaaacggcctgctcagtcctgcaggcagtccgccagctccgacatccggatatgccaacgactaccctcccttttcacattcatttccaggccctaccggaacacaagacccgggactcctggtgcctaaaggccacagtagctcggattgcctgccctccgtgtacacctctctcgatatgacacatccctacgggtcctggtacaaagccggtatccacgccggtatctccccagggccaggcaacacccccacgccttggtgggatatgcaccccggaggcaattggctgggaggtgggcagggccaaggggacgggcttcagggcacgctccctaccggccctgcacaaccaccgctgaatccacagctgcctacctatcctagcgatttcgccccattaaaccccgcaccatatccagccccacatctcctacagcccggaccccaacatgtcctcccacaggatgtttataaacctaaagcggtcggaaactcgggccagctggagggaagcgggggtgctaagccccctcggggtgcctctaccgggggtagcggcggatatggaggaagcggagccggtaggtcgagctgcgattgcccaaactgccaggagctggagagactcggcgctgctgcagctggtcttcggaaaaagcctattcactcctgccacattcccggatgcggaaaggtgtacggaaaagcctcccacctgaaggcacacctccgctggcacaccggcgaaagaccttttgtgtgcaattggctcttctgtggcaaaagatttacccgtagcgacgagttggagcgccacgtacgcacccacacccgggaaaaaaaattcacgtgtctgctgtgctcaaagagatttacgcgcagtgatcaccttagcaagcaccagcgcacccacggtgagccaggcccaggacctcctccttctggcccaaaagagctcggggagggacgctccaccggagaggaggaggccagtcagacacctcgcccaagtgccagtccagccacacccgaaaaggcacccggtgggagccccgagcagtctaatctgttagagatctag

SEQ ID NO: 242010 - DNA, 1242 bp, Artificial Sequence
  Description of Artificial Sequence: Synthetic coding sequence
atgctcacagccgcatgttcaaagtttggcggatcctcgcctttacgtgactctaccaccttgggtaaagccggtaccaaaaagccatacagtgtcggcagtgacttgagcgcttctaagaccatgggggatgcctatcccgcaccctttacctcaactaacggtcttctcagccccgcaggttcccctcctgcaccaactagcggttatgcaaatgattacccccctttttcccactcatttcctggcccaacaggaacacaggatccaggactgctcgtgccgaaaggtcactcttccagcgattgtctgccttccgtgtacacttccttagacatgacacacccttatggtagttggtacaaagcgggaatccatgccggtatttctcccggtcccggtaatacccccacaccttggtgggacatgcatccaggcggtaactggcttggaggaggccaggggcagggagacggactgcaaggcaccctgcccactgggccagctcaaccacccctgaaccctcagctgccaacttatccgagcgattttgcgccactcaatcctgcaccgtatcccgctcctcaccttcttcagcctggcccacagcacgtcctgcctcaggacgtgtacaagcctaaggccgtcggcaacagcggccagttagaaggctctggcggagcaaagccccctagaggtgcgtctacaggtgggtctggcggatacggcggatctggggcaggtcgatcctcatgtgactgcccgaactgtcaagagctagagcggctaggtgctgctgccgctgggctgagaaagaagcccatccactcctgtcatatccctggctgcgggaaagtctacggaaaagcatctcatctgaaggcccacctgaggtggcatactggcgagaggccatttgtatgtaactggttgttctgcggtaaaagattcactagatctgatgagctcgaacgccatgttcgcactcataccagagaaaaaaagtttacttgcctgctctgttctaagcggtttacacggtcggaccacctgagcaagcaccagaggacccacggcgaaccgggaccaggtccaccaccttctgggccaaaggagttgggcgaaggccgttctaccggcgaggaggaagcatcacagaccccccgaccatcagcctcacctgctacacctgagaaggctccagggggaagtcccgaacagtcgaacttgctggagatttag

SEQ ID NO: 242011 - DNA, 1401 bp, Artificial Sequence
  Description of Artificial Sequence: Synthetic coding sequence
atggccacatccctcttgggcgaagaaccacggcttggctctaccccattggctatgctggcggcaacatgtaataagatcgggtccccaagtccctcccccagcagcttgagcgactcctctagctcctttggcaaagggtttcacccatggaagaggtccagttcctcttcctcggcctcctgtaatgttgtgggaagctccctgtcttccttcggggtaagcggggctagccggaatgggggttccagcagcgctgcggcagctgccgctgctgcagctgctgctgccgcagccttggtgagtgactccttcagctgcggcggatcgcctggctctagtgctttcagcctgactagttcagggggttccagcgctcatagtcaagacggatctcaccagccggtttttattagcaaggtgcatacttctgtggatgggctgcaaggtatttacccgagggtggggatggcccacccgtacgaaagctggttcaaaccgagccacccaggattgggagccgctggcgaggtggggtccgccggagccagctcatggtgggacgtgggcgctggctggatcgacgtgcagaatccaaattcggcggctgccctcccgggatccctacatcccgctgccggtggactacagaccagcctccactcaccgctcggtgggtacaatagtgactactccgggcttagtcatagcgccttctcctcaggggcatctagccatcttttgtctcccgcaggtcaacatctcatggacggattcaagccagtattgccgggttcgtatcctgatagcgcgccaagccctctggctggggcaggtggcagcatgcttagtgccggtccttccgcccctctcggcggttccccaaggtcgtccgcacgccgatactctgggcgtgcgacatgtgattgtcctaactgccaggaagccgagcggcttgggccagcgggagccagtctgaggaggaagggcctgcattcgtgtcatatccctgggtgcggaaaagtgtacgggaagacctctcatttaaaagcccacctgaggtggcataccggtgagcgaccatttgtatgcaactggctgttctgcgggaagagattcactcgaagcgatgaactacagaggcatttacgcacacataccggagagaagcgttttgcatgtccggtctgcaacaaaagatttatgaggtcagaccacctctccaagcacgtcaagactcactctggcggagggggtgggggagggtcggcaggctccggttccgggggtaaaaaggggtctgatactgacagtgagcactcagcagcaggtagccctccttgtcactcgcccgaattacttcagccaccggagcctggccaccgaaacggactcgagtag

SEQ ID NO: 242012 - DNA, 1473 bp, Artificial Sequence
  Description of Artificial Sequence: Synthetic coding sequence
atgttggctgctacatgcaacaaaatcgggtccccaagtccatctccctcgagtctatcagatagctccagcagtttcggaaaaggatttcatccctggaaacgttcatcttcatcctccagcgcctcctgcaatgtggttggcagcagcctgagcagcttcggggtatcaggcgcaagtagaaatgggggatctagctctgctgccgctgcggctgctgctgctgctgctgccgcagctgccctggtgtcggacagcttcagctgtggtgggtcgccaggctcctctgcttttagcctcacatccagcagcgccgctgcggcagcagccgctgccgctgccgctgctagcagtagtccctttgcaaatgattacagtgtgtttcaggcccctggcgtaagtggaggtagtggtggcggaggaggcggtggaggcggaggatccagcgcccatagccaagacggatctcatcagccagtgtttatatcaaaagtccacaccagcgtggatggcttgcagggaatctaccctcgcgttggcatggcccacccatatgagtcctggttcaagccatcccacccaggcctaggcgcagctggagaggttggttctgccggtgcgagctcttggtgggatgtaggagccggttggatcgatgtccaaaaccccaatagcgctgccgcactgccaggatctcttcaccctgcggctgggggtctgcaaacatcccttcactcacccctcggagggtacaattctgattatagcggcctgagtcactcagcattttcatccggtgcgtctagccacctgcttagcccggcaggccagcatcttatggatggcttcaagcctgtcctgccagggagttatcctgactccgctccaagccctctcgcgggagcgggagggagcatgttgagcgcaggaccaagcgctccactagggggaagccctaggagttccgcaaggagatactccggcagagctacctgtgactgcccgaactgccaagaggccgaacgtctcggacctgccggtgcaagtctgagacgtaagggcctacactcatgtcacattcctgggtgtggcaaagtgtatggcaagacctcccacttaaaggcccatctgcgatggcacacaggagagcgaccttttgtctgcaactggcttttttgcggcaagcggttcacgcggtctgacgagctgcaacgacacctgagaacccacactggcgagaagcgctttgcatgccccgtgtgtaataagcggttcatgcgtagcgatcatttaagcaaacatgtgaagactcatagtgggggaggcggtggaggaggctccgccggatccgggtctgggggaaagaaggggtccgacacagatagcgagcacagtgccgctggctccccaccgtgccattcgccagagttgctccaaccccctgaacccggacatcggaatggccttgagtag

SEQ ID NO: 242013 - DNA, 1527 bp, Artificial Sequence
  Description of Artificial Sequence: Synthetic coding sequence
atggcgacatcgctgctgggagaggagccccgtctcggctcaacaccactggctatgctggcagcaacatgcaacaaaatcggctcgccaagtccttccccttcctctctgtcagacagttctagctccttcggcaagggatttcacccctggaagcggtcatcttcctcctcctcagcatcctgcaacgtcgtgggctcttctcttagctcctttggtgtaagcggtgccagccgcaacggaggcagctcaagcgccgctgccgctgcagctgctgcagccgctgctgctgccgcattggtcagtgactcttttagctgtggaggatctccaggttcaagcgccttttccctgactagtagctctgcagcggcagcggcagcagccgcagcggctgccgcttcatcgagccctttcgctaacgattacagcgtttttcaagcgcctggtgtttccggaggatccggcggtggtggcggagggggaggtgggggatctagtgcacattcacaggacggatctcaccaacctgtgtttatatccaaggtccatacatctgtcgacggcttacagggcatctatcccagagtcggtatggcgcacccctacgaatcctggtttaagccctcccaccccggtcttggtgcagctggtgaagtgggtagcgccggagcgagctcctggtgggatgtcggtgctggctggattgacgttcaaaatccaaactccgcagcagccctccccggatcgctgcatcccgctgcaggcggactccagacatccctgcatagtccattaggaggttataactctgactattctgggctttctcattcagcctttagcagtggagcaagttcacacctgcttagtccagcaggtcagcacctcatggacggcttcaagcccgtgctcccgggtagttacccagattcagccccatcacctttagccggtgcgggaggatcaatgctgtctgcgggaccctctgctcctctcggtggcagcccaagaagttccgcaaggcgttactcagggagggccacctgcgattgtcctaattgccaagaagcggaaagacttgggccagccggtgcatctctgcgccgtaagggactacattcttgccatatccctggatgtgggaaagtgtacggcaagacttcccacctgaaagctcacctgagatggcataccggcgagcgcccatttgtgtgtaactggctgttttgcgggaaacgatttacgcgctcagacgagttgcagcggcatctccgcacgcatacaggagaaaagaggttcgcctgcccagtgtgcaacaaaagatttatgagaagtgatcatctgagcaagcatgtcaagactcactctggtgggggaggcggaggcggatcagccggtagcggaagtggtggtaaaaaagggtctgacacagacagtgagcactctgccgcaggcagtcccccttgtcactcacccgaactgctccaaccacctgagccaggccatcgtaatgggctggagtag

SEQ ID NO: 242014 - DNA, 294 bp, Artificial Sequence
  Description of Artificial Sequence: Synthetic coding sequence
atggacaaacaatcctccgctggtggcgtgaagaggtcagttccgtgtgactctaatgaggcgaatgagatgatgccagagacacccacgggagactccgatcctcaacccgcaccaaagaagatgaaaactagtgagtcaagtacaattctggtggttcgatatagacggaactttaagagaaccagcccagaggaactactaaatgaccatgccagagaaaatcgaattaaccctctccagatggaagaagaggaattcatggagatcatggtcgagattcctgctaaatag

SEQ ID NO: 242015 - DNA, 294 bp, Artificial Sequence
  Description of Artificial Sequence: Synthetic coding sequence
atggacaaacaaagttccgcgggaggcgtcaaacgaagtgtgccttgtgagtctaacgaggtgaacgaaactatgcctgagacccccactggagactccgatccccaacctgctcccaagaagatgaagaccagtgagtccagtacaattctcgttgtccgctaccggagaaatgtgaagaggacctctcctgaagaactgctcaacgatcacgcgagagagaaccggataaacccactccagatggaagaagaagaattcatggagattatggtcgaaattcctgcaaagtag

SEQ ID NO: 242016 - DNA, 1308 bp, Artificial Sequence
  Description of Artificial Sequence: Synthetic coding sequence
atgctgcctgcacgatgcgcacggctgctgacccctcatctcctgctggtactggtccaattgtctcctgccaggggccaccgaactacaggccctcgctttttgatctctgacagagacccacagtgtaatttgcactgttcccgcactcagcccaaaccgatctgtgcctccgatggcaggtcttacgagtccatgtgcgagtaccagagagctaagtgcagggacccaacccttggggtggtacatcgcggtcggtgcaaggatgccggtcaatctaagtgtcggctggagagggctcaggcccttgaacaggccaaaaagccacaggaggccgtattcgtgccagagtgcggagaagacggcagtttcactcaggtgcagtgccacacatacaccgggtactgttggtgcgtgaccccagacggtaaaccaatatctgggtcttcagtccaaaataagacgccagtgtgttctggcagtgtaaccgacaagcccctgtcacagggaaactcgggtagaaaagatgacgggtctaagcccacacccaccatggaaacccagccggtgttcgacggggacgagatcaccgctcctactctctggattaagcatcttgttattaaggactctaagctgaataacaccaatattcggaattctgagaaggtctactcgtgtgatcaagaacggcagtcagctcttgaggaagcccagcagaacccacgcgaagggattgtgattccggagtgtgccccagggggactctacaaacccgttcaatgccaccaatcaactgggtattgttggtgtgtgctcgtagacacaggtcgaccccttcctggtacatccacaaggtatgtaatgccctcctgcgaatctgacgccagagccaagactaccgaggccgacgatcccttcaaggatagagaattgccaggatgcccagaggggaagaagatggagttcataaccagcctgctcgatgctctgactacagacatggtgcaggctattaactctgcagccccaaccggcggaggacggttctccgagcccgatccctctcacacattggaagagagggtcgtgcattggtacttcagccagctggatagcaatagcagcaacgatatcaataagcgtgaaatgaaacccttcaagcgatacgtgaaaaaaaaggctaagcccaaaaagtgcgcacgacgtttcaccgattactgtgacctgaacaaggacaaagtgattagccttcccgaattgaaaggctgcttaggagtgtctaaagaagtagggaggttggtgtag

SEQ ID NO: 242017 - DNA, 1305 bp, Artificial Sequence
  Description of Artificial Sequence: Synthetic coding sequence
atgctgccagcacgctgcgcaagactcctgactcctcacttgctgctggtgctggtgcaattgagccccgctaggggtcatcggaccaccggcccacgtttcctcatcagcgacagggatcctcagtgcaaccttcattgttcacgtacacagccgaaaccaatttgtgccagtgacggtagatcctacgaaagcatgtgcgagtatcaacgcgcaaagtgccgcgacccgaccctgggggttgtgcataggggaaggtgcaaagacgccggacagtccaagtgccggctggagcgggcacaggccctggaacaggctaagaagccccaggaggctgtttttgtccccgagtgcggcgaggatggttcctttacacaggtgcaatgccacacctacactggctattgttggtgcgtgactcctgacggcaagcccatctcaggatcctcagtgcagaacaagaccccagtatgtagcggctccgtaacggataagcctttgagtcagggtaacagcgggaggaaagatgatgggtcaaaaccgaccccgaccatggagacccagcccgtctttgatggcgatgagattaccgccccaactctctggatcaaacacctcgtgatcaaggactctaaactcaataatacaaacattagaaactcagaaaaagtttactcatgtgaccaggagagacagtccgcactggaggaggcacagcagaatcctagggaaggtatcgtgatcccagagtgcgcaccaggaggattgtacaaacccgtccagtgccatcagagtacaggctattgctggtgcgtgctggtggatacaggtcgcccattgcccggaacctccacgcgctacgtgatgcctagctgtgaatccgatgccagagctaaaacaacagaagctgacgacccgttcaaggatcgggaacttcccggatgcccggaaggtaagaagatggagtttataacgagcctgttagacgctcttacgacagatatggttcaagccatcaattctgctgcgccaactgggggaggtcgcttcagcgaacccgatccctctcacacactggaggaacgtgtggtccactggtatttcagccagctcgattctaattcgagcaatgacattaacaagagggaaatgaaaccattcaaaaggtacgtgaaaaagaaggcgaagccgaagaaatgcgcgagacgattcacggactactgtgatctgaataaggacaaagtcatttccctccccgagctgaaagggtgtcttggagtttcaaaagaagggcgactcgtttag

SEQ ID NO: 242018 - DNA, 1374 bp, Artificial Sequence
  Description of Artificial Sequence: Synthetic coding sequence
atgttgctcccacagctgtgttggttaccattgttggccggactgcttccacccgtgcccgctcagaaatttagcgccctcacctttctgagggtggaccaggataaggacaaagattgcagtctagattgcgcgggttccccccaaaagcctctgtgcgcctcagatggtcgaaccttcttgtcgcgttgtgagtttcagcgagctaaatgtaaagatcctcaacttgagatcgcttacaggggtaactgcaaggacgtgagtaggtgcgttgcagaacggaagtacacccaggaacaggcgcgtaaagagttccaacaggtattcattcccgaatgcaatgatgacggaacctattcacaggttcagtgccattcttacacgggatactgttggtgcgtgaccccaaatggcaggcccatcagtggaaccgccgtggctcataaaaccccgcgttgtccaggatctgttaacgaaaagctaccgcagcgagaaggtacgggaaaaaccgtaagcctacagattttttcagtgctaaactctgatgacgccgcagctccagccctggaaacacaaccacaaggagacgaagaagatattgccagtcggtaccctacactgtggacggagcaggtgaagtcaaggcagaataagaccaataagaactctgtgtccagctgcgaccaggaacaccagagtgctttagaagaagcgaagcagcccaaaaacgataacgtcgtgattcctgagtgtgcccacggcggtctctataaacctgtacagtgccaccccagcacaggttactgctggtgtgtgctggttgatacaggccgaccaataccaggtacatctacccggtatgagcagccaaaatgtgacaatacggcccgagctcacccagctaaagctcgagatctttacaaaggacgacagctgcaggggtgccccggagcaaaaaagcacgaattcctaaccagcgtcttggacgctttaagcactgatatggttcatgctgctagtgatcctagttcgagttctggaagattatcggagcccgatcctagtcatactctggaggagcgggtggtccactggtattttaaactactggataaaaacagtagcggggatataggtaaaaaagagatcaaacccttcaagaggtttttgagaaaaaaatctaaacccaagaaatgtgtgaagaagtttgtcgaatattgcgatgtgaacaatgataagagtatcagcgtccaagagctgatgggctgtctgggcgtcgccaaggaggacgggaaggcagacacaaaaaaaaggcatactccaagaggacatgctgaaagtacaagcaaccgccaacctcggaagcagggatag

SEQ ID NO: 242019 - DNA, 1341 bp, Artificial Sequence
  Description of Artificial Sequence: Synthetic coding sequence
atgctccttccccaactgtgttggttacccctccttgcgggtttactaccaccagtaccagcccagaagttttccgctttaacatttctccgcgtagaccaggacaaagacaaggattgcagtttagactgtgctggaagcccccagaaacctctgtgcgcatctgacggaaggaccttcctgagccgttgcgaatttcagcgggctaagtgtaaggatccgcagctggagatcgcctacagaggtaattgtaaggatgtctctcgttgcgtggctgaacggaagtatacacaggagcaagctagaaaggagttccagcaggtgtttataccagaatgtaacgacgacggcacatactctcaggtgcagtgccacagttacactggctattgttggtgcgtcactcctaacggccgaccaatcagcggaacagctgtcgcacacaagacgccgcgttgcccagggtcagtcaacgaaaagctgccacaaagggaagggaccgggaagactgatgacgcagcagccccagccctggaaacccagcctcagggggacgaagaggatatagcatccaggtacccaactttatggacagagcaggtaaagagtcgacagaacaagacaaataagaattctgtatcatcttgcgaccaggagcaccagtctgctttggaggaagctaaacagcccaaaaacgataatgtggtcattcctgaatgtgcgcacgggggactctacaagccggtgcagtgtcacccaagtactggctactgctggtgcgtcttggtagataccggacggcctattcctggcactagcacccgctacgagcagcctaaatgtgacaatactgcaagagcgcatccagctaaagccagggacctgtataagggaagacagttgcaaggctgtccaggggctaaaaagcacgaatttctcacgagcgtgttagacgccctgtctactgatatggttcatgcagccagtgacccgtcctcctcaagtgggagactgtccgaacccgatccttctcatacactcgaagagcgtgtcgtccattggtactttaagctgctcgacaagaactcctctggcgacattggcaaaaaggaaatcaagccattcaagagattcctgcggaaaaagtctaagccaaaaaaatgtgtgaaaaaatttgtcgagtactgcgacgtgaacaatgacaaatccatttctgtgcaagagcttatgggctgcctcggagtcgccaaggaggacggcaaggcggacactaagaagcgacacacacctagaggccacgccgaatctacatcaaatcgtcagcctcggaagcagggctag

SEQ ID NO: 242020 - DNA, 1347 bp, Artificial Sequence
  Description of Artificial Sequence: Synthetic coding sequence
atgctcctcccgcaattgtgttggctgccgctgctggcgggtcttctccctccagtacctgcacagaaattttcggccctgacctttctgagagttgaccaggacaaagacaaggactgctctctcgactgtgctggcagccctcagaagcctctttgcgcatccgacgggaggaccttcctctctcggtgtgaattccagcgcgctaaatgtaaggacccccagctggaaattgcctataggggtaattgtaaagatgtgagtagatgtgtcgccgagaggaaatatacacaggagcaggccagaaaagagttccaacaggtgttcattcctgagtgtaatgacgacggaacctattcacaggtgcagtgtcattcctatactggttactgttggtgtgttacacccaatgggagaccaataagcggcactgccgtggcccacaaaacccctcgttgtcccggttcagtgaatgaaaagttgccccaaagagagggaacgggcaaaactgacgacgctgctgcccctgctttagaaacccagcctcaaggtgatgaggaagatatcgcatcccggtaccctacactctggacagagcaggtgaaatctcggcaaaacaagacgaacaaaaactctgttagttcgtgcgaccaggaacatcagagtgcccttgaggaggccaaacagcccaaaaatgacaacgttgtaataccggagtgcgctcacggcggactgtataagcctgtacagtgtcacccttccactggctattgctggtgcgtccttgtggatacaggcaggccaatccctggaacctccactaggtacgaacagcctaagtgtgataataccgcccgagcacatccagccaaggcgcgagacctctacaaggggagacagctccagggctgccctggggctaagaaacacgagttcctcacatcagtgctggacgcgttgagtactgatatggtgcatgcggcttccgaccccagtagctcttccggacgacttagcgagcctgatcccagccataccctggaggaaagagtggtacattggtacttcaagttgctggacaaaaactccagcggcgatatcggcaagaaagaaattaaaccgtttaagcgcttcctcagaaagaaaagcaagccaaagaagtgcgttaaaaagttcgtagaatactgtgacgtcaacaatgacaaaagcatcagtgtacaggagctgatgggctgcctgggggtggccaaggaagatggcaaggcagacactaaaaagcgtcatacccccagggggcacgccgaatcaacaagcaatcgacaggagaatccacgaaaggagggctag

SEQ ID NO: 242021 - DNA, 255 bp, Artificial Sequence
  Description of Artificial Sequence: Synthetic coding sequence
aagaagagtaagccaaaaaagtgcgtcaaaaaattcgtcgagtactgcgacgtaaataatgacaaatctatctccgttcaggaactcatgggctgtctaggagtggccaaggaagacggaaaagcagacactaaaaaacgccacacacccagaggccatgctgaatcaacctcgaacaggcaggacgccatggtggtgtcatccaggcctaaagccacaacacaccgaaagagtagaaccttatctcggcgatag

SEQ ID NO: 242022 - DNA, 1275 bp, Artificial Sequence
  Description of Artificial Sequence: Synthetic coding sequence
atgcgagctcccggttgtggtcgcctggtgctccctctgctgctccttgccgctgcggctctggctgagggagatgctaaagggcttaaggaaggtgaaactcctggcaattttatggaagacgaacagtggcttagttccattagtcagtacagtggcaaaattaagcactggaatagattcagggatgaagtggaggacgactacattaagtcatgggaagataaccaacagggagacgaagccctggataccacaaaggatccgtgtcagaaagtcaagtgttcgaggcataaggtgtgtatcgcccaggggtaccaacgcgcaatgtgtatcagtcggaaaaagctggagcataggatcaagcagcctaccgtcaagttacatggcaataaagattcaatctgcaaaccatgtcacatggctcaattggcttcggtgtgtgggtccgatgggcacacctatagtagcgtgtgcaaactggagcagcaggcttgcctgtcttccaagcagcttgccgtgagatgtgagggaccttgtccctgtccaacagagcaggccgcaacttccaccgccgatggcaaacctgagacttgtactggacaggatctggcggatttgggggatcgactgagagattggtttcaattactccatgagaacagtaaacagaacggtagtgcatccagcgtagctgggccagcctctgggctcgacaagagtttgggagcgtcgtgtaaagactccattgggtggatgttcagtaaattggacacctcggccgatctcttcctggatcagaccgaacttgccgcaattaacttggataaatacgaagtgtgtattaggcccttttttaatagctgtgacacctacaaagacgggcgagtcagcacagctgaatggtgtttttgcttctggcgcgaaaagcctccctgtctcgccgagctggagcggattcagattcaagaggctgccaaaaaaaagccaggcatcttcattccatcatgcgatgaggacgggtactaccggaaaatgcagtgcgaccagtctagtggcgactgttggtgcgtggatcagttggggctagagctgacggggacaaggacccacggttctcccgactgcgatgatatcgtcggcttttcaggcgacttcgggtctggggtgggctgggaggacgaggaggaaaaagagaccgaagaggcaggtgaagaggccgaggaggaggagggtgaagctggcgaagctgacgatggaggatacatctggtag

SEQ ID NO: 242023 - DNA, 1266 bp, Artificial Sequence
  Description of Artificial Sequence: Synthetic coding sequence
atgcgagctcctgggtgtggcaggttagtacttcctctgcttctgttagccgcagccgctctggccgaaggcgacgcaaaaggactgaaggaaggggagactcctgggaatttcatggaagacgagcagtggctgtcatccatcagccagtacagtgggaagatcaaacattggaatcggttccgcgatgacgactacatcaaatcttgggaggacaatcagcagggggacgaggcattagacactacaaaagacccgtgtcaaaaggtgaagtgttctagacacaaggtgtgtattgctcaaggataccagagggcgatgtgtatttctaggaagaagctcgagcatcgcatcaagcaacccacagtgaagctacacggaaataaagactcaatttgtaagccttgccatatggcacaattagcatctgtgtgcgggtctgatgggcatacttattctagcgtctgtaagttggagcaacaggcatgcctttctagcaaacagctggctgtcagatgcgagggcccttgtccatgccccactgaacaggccgctacttccaccgccgacggtaagccagagacgtgcaccggccaggacctcgcagaccttggtgatagactgcgggattggttccagctgttgcatgagaattccaagcagaacggctccgcaagttcagtggcaggtccagcttccggactggataaaagcctgggcgcttcttgtaaagacagcattggctggatgttttcgaaactggacacctccgctgacctgtttctcgatcaaacggaattggcagccattaatctcgacaaatatgaagtgtgcatccgcccattttttaactcttgtgacacatacaaagatggacgggtgagtactgccgagtggtgcttctgcttctggcgagaaaaaccgccttgtctcgctgagctggagcgtatccagattcaggaggcggctaaaaagaaacctggaatcttcatcccatcttgcgacgaggacggctattacaggaaaatgcaatgtgatcagagctctggagactgctggtgtgtggatcaattgggattggagctcaccgggaccaggactcacggaagcccagactgcgacgacattgtgggtttctctggggattttggcagcggtgtcgggtgggaggatgaagaagagaaagagacagaggaagccggtgaagaagcagaagaggaagaaggtgaggccggagaggctgacgacggcggatatatttggtag

SEQ ID NO: 242024 - DNA, 234 bp, Artificial Sequence
  Description of Artificial Sequence: Synthetic coding sequence
atgagagccccaggatgcgggcgactcgtcctgcctctgttactactcgccgcagcagctctcgcagaaggtgacgccaagggcctgaaggagggagaaactcccggaaattttatggaagacgaacagtggctgtcttccatatcacagtactcaggcaaaattaagcactggaaccggttcagagatgtcccatcctccgatccaccatccaccactcaggccactccgtag

SEQ ID NO: 242025 - DNA, 1275 bp, Artificial Sequence
  Description of Artificial Sequence: Synthetic coding sequence
atgcgtgcccctggctgtggcagactcgtgttgccactcttgctattagccgctgccgctttagctgagggcgatgcaaaaggactgaaagagggggaaactcccggaaacttcatggaggacgagcagtggctttcttcaatttcccaatattctggcaaaataaaacattggaaccgattccgggacggcattgaagacgattatattaagagttgggaagacaatcagcagggagatgaagccttggacacaacaaaagatccttgccagaaagtgaagtgcagccgtcacaaggtttgcatcgcacaagggtaccagcgtgctatgtgcatttctagaaagaagcttgagcatcggatcaagcagcccactgtgaagttacacggcaacaaagatagtatttgtaagccatgccatatggcacagctggcatccgtctgcggatccgatggacacacttacagctctgtgtgtaaactggaacagcaagcttgcctgtcatcgaagcagcttgccgtgcgttgtgaggggccatgtccctgtcccacagagcaggctgcaacttccaccgctgatggcaagccagaaacttgtaccggacaggatcttgccgacttgggggacagactgcgcgactggtttcagctgctgcacgaaaattccaaacagaatggctctgcatcctctgtcgctgggccagcctccggtctggacaagtctttaggagcaagttgcaaggatagcataggatggatgttttctaagctcgacacctccgccgatctctttttagatcagactgagctcgcagccatcaacctggacaaatatgaggtgtgtatcagaccattcttcaatagctgtgatacatacaaagacggtcgcgtgtctaccgctgaatggtgcttctgcttttggcgggagaagcctccttgtctggccgaactggaacgaatccagattcaggaggctgcgaagaaaaagcccggaatcttcattccatcttgcgatgaagatgggtattatcgtaagatgcagtgtgaccagagctctggcgactgttggtgcgtagaccagctgggactcgaactgaccggcactcgcacccatgggtccccagattgtgatgacattgtaggtttttccggggattttggtagtggcgtcgggtgggaagacgaggaagaaaaagagacagaagaagccggtgaggaggcagaagaagaggagggcgaggcaggtgaggccgatgatggaggctacatctggtag

SEQ ID NO: 242026 - DNA, 1311 bp, Artificial Sequence
  Description of Artificial Sequence: Synthetic coding sequence
atgctcaaggtttctgcagtgttatgtgtgtgtgccgctgcctggtgctcacagagtctggcagcagctgccgctgtcgcagctgcgggagggaggtcagatggtgggaatttcttggatgataagcagtggttaaccaccatcagccagtatgataaagaggtaggtcagtggaataaattcagggatgaagttgaggacgactacttccggacctggtctcccggtaagcctttcgatcaggccctagacccagccaaagatccctgtctgaagatgaaatgttccagacataaagtgtgcatcgcccaagactcccagaccgctgtgtgcattagccaccggaggctgacacacaggatgaaagaggcaggcgttgaccacagacagtggcgcggtccaattctcagtacctgcaaacaatgtcctgtggtatatcccagccccgtgtgtgggtctgatggccacacgtacagcttccagtgtaagctagagtatcaggcctgtgtacttggtaagcagataagcgtgaagtgcgagggccactgcccctgcccgtccgataaaccaacaagcacaagccgcaatgtgaagcgtgcctgcagcgacctggagttccgcgaggtcgctaacagactgcgcgattggtttaaagccttgcatgagtccggttcccagaacaaaaaaaccaagaccctcttgcgtccagagagaagtcggtttgacacatcgatactaccaatttgcaaagacagcttgggttggatgtttaacagacttgataccaactatgaccttctactggaccaaagtgaactccggtcaatctacctggataagaatgagcagtgcacaaaggccttctttaatagctgcgacacctacaaagacagtctgattagtaacaacgagtggtgttattgctttcaaaggcagcaggaccctccttgtcagacagagctttcgaacattcagaagcggcagggcgtcaagaaattgttaggacaatacattcccctctgcgacgaagatggctactacaagcctactcagtgccatggttcagtgggtcagtgttggtgcgtggacaggtacggaaacgaggtcatgggtagtaggattaacggagtcgccgactgcgccatcgatttcgaaattagcggagactttgcaagtggtgattttcatgaatggaccgacgacgaagacgacgaagatgatataatgaacgacgaagacgagattgaagatgatgatgaggatgaaggggatgacgacgatggaggcgacgaccacgatgtgtacatttag

SEQ ID NO: 242027 - DNA, 1302 bp, Artificial Sequence
  Description of Artificial Sequence: Synthetic coding sequence
atgctgaaggtctctgccgtcctgtgtgtgtgtgcggcagcctggtgcagccagtctctggctgccgcagcagccgtggcggctgcaggtgggagatccgatggaggtaacttcctggatgataaacaatggctgacaactattagccaatatgataaagaggtcgggcagtggaataaatttagagatgacgattactttcggacatggagccctggtaaaccgtttgaccaggccctggacccagctaaagacccctgtttgaaaatgaaatgctccaggcataaggtttgtatcgctcaggactctcagacagccgtgtgtataagccaccggagacttacacacaggatgaaggaagcaggcgtcgatcacagacagtggagaggcccaatattaagcacctgcaaacagtgcccagtggtctatcctagccccgtctgtggctctgatggacacacttactccttccagtgcaagctggaataccaagcttgcgtcttaggtaagcagatctccgtgaagtgtgaggggcattgcccctgccccagtgataaaccgacctcaacttcaagaaacgtgaagcgcgcatgctccgacctagagttcagagaggttgcaaataggttgagagattggtttaaagcactccacgaatctggttctcagaacaaaaagaccaagacccttctcaggcctgagcgctcaaggttcgacacctcaatcctccctatttgcaaagactcgcttggctggatgttcaacagacttgacaccaattacgatttactactggatcagtctgaacttaggagtatttatctcgataagaatgaacaatgcactaaggcattctttaatagctgtgacacctataaagattccctcatttccaataacgaatggtgctactgctttcagagacaacaagatcctccatgtcagactgaactgtcaaatatccaaaagagacaaggggtgaaaaagctgcttggtcagtacattcccctgtgtgatgaagatggctactacaaacctacgcagtgtcatggctctgtcggacagtgttggtgtgtggatagatatggaaacgaggtgatgggatccagaatcaacggcgttgctgattgtgctatagactttgaaatctccggcgactttgcatccggtgatttccatgagtggacggatgatgaagatgacgaagacgacattatgaacgacgaggatgagattgaggacgacgatgaagatgaaggtgacgacgatgatggcggagacgatcatgatgtgtatatctag

SEQ ID NO: 242028 - DNA, 1158 bp, Artificial Sequence
  Description of Artificial Sequence: Synthetic coding sequence
atgatcacccaggatcatatccacatgagctccggtctctcgcaggacgactactttcgtacttggtcacccggtaagcccttcgaccaagcactggatccggctaaggacccatgtcttaagatgaagtgcagccgtcacaaggtttgtatagctcaggattcccagacggctgtgtgtatttctcaccgaaggctcacgcataggatgaaggaggctggagtggatcatagacagtggcggggaccaattctgtccacctgcaagcagtgtccagtggtgtacccttcccccgtctgtggcagcgacggtcatacttacagctttcagtgcaagcttgagtatcaggcttgtgttcttgggaaacagatctccgtgaagtgcgaaggccattgtccctgccctagtgacaagcctactagtacttctcgaaatgtcaagagagcatgttctgatctggaattccgagaggtggctaataggctgcgcgactggtttaaagccctgcacgagtccggctctcaaaataagaagacgaagacattgctgcggccagagagatctcggtttgatacatccatcctgccaatttgtaaggactccttgggttggatgttcaatcgcttggacaccaactacgacctgttgctcgatcagtccgaactacggtccatctaccttgataagaatgaacagtgcaccaaagcatttttcaacagctgcgacacgtataaagatagcctcatctcaaataatgagtggtgttactgctttcagagacaacaggaccctccctgtcagactgagctgagtaacattcagaaaagacagggggtcaagaagttactaggtcagtatatccctctatgtgatgaggacggatattacaagccaacacagtgccacggcagcgtgggccagtgttggtgtgtggataggtacgggaacgaggttatgggcagccggatcaacggggtggccgattgcgcgatcgactttgaaatctcaggggatttcgcctctggtgactttcacgagtggacagatgatgaagacgatgaggatgacatcatgaatgacgaagatgagatagaagatgacgacgaggacgaaggtgacgatgacgacggcggtgacgaccacgatgtatatatctag

SEQ ID NO: 242029 - DNA, 1311 bp, Artificial Sequence
  Description of Artificial Sequence: Synthetic coding sequence
atgctgaaagttagcgctgtcctgtgcgtgtgcgccgcagcctggtgttcacagtcgctggccgcagctgcggcagttgccgcagctggcggacgaagtgatgggggtaatttccttgatgataaacaatggctgaccacaatttcacagtatgacaaagaggttgggcaatggaacaaatttagggacgaagtagaggacgattacttccgcacttggtctccaggaaaaccttttgatcaagctctcgatcctgctaaagacccctgtcttaagatgaaatgcagccgtcacaaggtttgcatcgcacaagactctcagaccgcagtgtgcatatcccaccggcgtcttacacatcgcatgaaggaggccggtgtggaccaccgtcagtggagaggccctatcctgtcaacatgcaagcagtgcccagtcgtatatccgagtccagtgtgcggttcagatggccacacttacagcttccagtgcaaattggagtatcaggcgtgtgttctggggaagcagataagtgtcaaatgtgagggacactgcccatgcccttctgataagcctacttctacttcccggaacgttaagcgtgcctgtagtgatctagagttccgggaggttgccaatcgcttgcgggactggtttaaggccctgcacgagtcagggagccagaacaagaaaactaaaactctgttgaggccagaaagaagtcgcttcgataccagtattctcccaatctgtaaagacagtttagggtggatgtttaatcgcctcgacaccaactatgatctgctgctcgaccagtcagaactgcgttctatctatctagacaagaacgaacagtgtaccaaggccttcttcaacagttgcgacacgtacaaagattctctgataagcaataacgaatggtgttactgcttccaacggcagcaggaccctccatgtcagacagagttgtccaacattcagaaacgacagggcgtgaagaagctgctggggcagtatatccccctctgcgacgaagatggctactacaagccaactcagtgccacgggtctgtgggtcaatgctggtgtgtggaccggtatgggaatgaggtgatgggaagtaggatcaatggggttgctgattgtgcgattgattttgagatttcaggagacttcgcatcaggtgactttcatgagtggacagacgatgaggatgacgaagacgatattatgaacgatgaggatgagatagaggacgacgatgaggacgagggtgacgatgacgacggaggagacgaccatgatgtgtacatctag

SEQ ID NO: 242030 - DNA, 1302 bp, Artificial Sequence
  Description of Artificial Sequence: Synthetic coding sequence
atgctcaaagtctccgcagtgctgtgtgtgtgtgctgccgcttggtgctcacagtctctggctgccgcagcggcagtggctgcagcaggtggtcggagtgacggcggaaactttctggatgataaacaatggctaacaaccattagccagtacgacaaggaagtgggccagtggaataagttccgggacgatgattatttccggacctggagcccagggaagcctttcgaccaggcgctggatcctgcgaaggatccttgcttaaagatgaagtgttcacggcacaaggtgtgcatcgcccaggacagtcagaccgccgtttgcattagccatcggaggctcactcatcgcatgaaggaggccggtgtcgaccatagacagtggcgcggaccaatactcagtacatgcaaacagtgcccagtcgtatacccttcgccagtctgcggatcggatggtcacacctactcctttcagtgtaagctggagtaccaggcttgtgtccttgggaagcagatttccgtgaaatgtgagggacattgcccctgtccttccgacaagccaacatcgaccagtcgcaatgttaaaagggcgtgttctgaccttgaattccgcgaagttgccaataggctgagggattggtttaaggctctccatgaatccggcagccagaataagaaaaccaaaaccctgctgcggcctgaacgcagtcgtttcgacacaagcatcctgccaatctgtaaagacagtttaggatggatgtttaatagactggacacgaattacgacctccttctcgaccagtctgagctgcggtctatatatcttgataaaaatgagcagtgcacgaaagccttctttaacagctgcgacacttataaggacagcttgatttccaataacgagtggtgttactgtttccaacgtcaacaggaccctccttgtcagactgaactgagcaacatccagaagcgccaaggcgtcaagaagttgctggggcagtacatccctctatgcgatgaggatgggtactataaaccaacccagtgtcacgggagcgtcggacagtgctggtgtgtcgacagatacggaaatgaggtgatgggatcccgcatcaatggggtggctgactgtgccatcgacttcgagatctcaggtgattttgcctccggcgacttccatgagtggacagatgatgaggacgacgaagatgacatcatgaacgacgaggacgaaatcgaggacgacgacgaagatgaaggagacgacgacgatggcggtgatgatcatgacgtttatatctag

SEQ ID NO: 242031 - DNA, 348 bp, Artificial Sequence
  Description of Artificial Sequence: Synthetic coding sequence
atgctgaaagtgtctgctgtgttgtgcgtctgtgcagccgcttggtgctctcagtctttggcagccgcagcagcagtcgctgccgctgggggtagatccgatggcggtaattttctcgacgataagcagtggctgaccacaatctcccagtacgacaaagaagtcggtcagtggaataaattcagagacgaggtcgaagatgactacttcagaacatggtctcctggcaaaccatttgatcaggcactagatccagccaaggacccctgtctcaagatgaaatgctcacgacacaaggtgtgtattgcccaggacagccaaaccgctgtctgcatctctcatcgctag

SEQ ID NO: 242032 - DNA, 1311 bp, Artificial Sequence
  Description of Artificial Sequence: Synthetic coding sequence
atgttgaaggtgtcagccgttctctgcgtttgcgcagctgcttggtgttctcagagtctggcagccgcagctgccgtcgcggctgccggagggagatccgatggaggtaatttcctcgacgacaaacagtggcttactaccatttcgcaatacgacaaggaggttggtcaatggaataaatttcgtgatgaagtggaagatgactattttaggacatggtctcctgggaagccgttcgaccaggcgctcgacccggcaaaggacccctgcctcaaaatgaaatgcagtcgacataaggtgtgtatcgcacaggatagccagactgccgtatgtatttcccatagaagattgacccaccgcatgaaggaggcaggcgtcgatcaccgtcaatggcgtggcccaatcttatccacttgcaaacaatgcccagtcgtgtatccctctcccgtgtgtggttctgatggtcatacttactccttccagtgcaagcttgaatatcaggcctgtgtcctgggtaagcagatcagtgtaaaatgtgagggtcactgtccatgcccttctgataaacctacaagtacaagccgcaatgtcaagcgcgcttgcagtgatcttgaatttcgggaagtcgcaaacagactacgcgattggttcaaagcccttcacgagtccggatcccagaataagaaaaccaagacactgctcaggcctgagcgcagccgcttcgacaccagcatactgcctatttgcaaagactcacttggttggatgttcaaccgacttgatacgaattacgacttactactagaccaaagcgaactgcgtagtatatatctggacaagaatgaacagtgcaccaaggctttcttcaacagctgtgacacgtacaaagatagcctgatatctaataacgagtggtgctactgctttcagcggcagcaggacccaccctgccaaacagaactcagcaacattcaaaagaggcagggggtcaagaagctgctgggtcaatacatacccctgtgtgacgaggatgggtattacaagcctacccaatgtcacgggtccgtgggtcagtgctggtgcgtggatagatacggtaatgaggttatgggcagccggataaacggcgtcgccgactgtgcaatcgacttcgaaataagtggagactttgctagtggcgattttcatgagtggacagacgacgaggacgacgaggatgatattatgaacgacgaggatgagattgaagacgacgacgaggatgagggcgacgacgacgatggcggtgacgatcacgatgtgtatatctag

SEQ ID NO: 242033 - DNA, 486 bp, Artificial Sequence
  Description of Artificial Sequence: Synthetic coding sequence
atgctcaaagtgagcgcagtgctctgtgtctgcgccgctgcttggtgctcccagtccctcgccgctgccgcagcggtcgcagccgcaggaggcagaagcgacggcggtaacttccttgatgacaagcaatggttgaccacaattagccagtacgacaaggaagtggggcagtggaataagttcagagatgacgattattttagaacatggagcccaggaaaaccttttgaccaggcactggaccctgcaaaggacccttgtttgaagatgaagtgctccaggcataaggtgtgtattgcccaagattcgcagactgcagtgtgcattagccacagacggttgacccaccgaatgaaagaggcgggtgtggatcacagacagtggaggggaccgatcttatctacctgtaagcagtgtcctgtcgtctaccctagtccagtgtgtgggagcgacggtcacacatattcttttcaatgtaagctttag

SEQ ID NO: 242034 - DNA, 522 bp, Artificial Sequence
  Description of Artificial Sequence: Synthetic coding sequence
atgttaaaagtgagtgcggtcttgtgtgtttgtgcggctgcttggtgttctcagtctctggcagccgcagcagccgtggcagcagccggtgggagaagtgatggtggtaactttcttgatgacaaacagtggctgacaaccattagccagtacgacaaagaggtaggccagtggaataaatttagagatgatgattacttccggacatggtccccgggaaagcctttcgaccaggcatgcagcgatttggaattccgggaggttgctaacaggctgcgcgattggttcaaggccctgcacgagtctggcagccaaaacaaaaagacaaagaccctcctcagaccagagcgatcaagatttgatacctcaattttaccaatctgcaaagactccctcggatggatgttcaatcgactggacacaaactatgacctgctcctggaccagtcggagctccggtccatttacctcgataaaaacgagcagtgcacaaaggcttttttcaacagctgtgacacctag

SEQ ID NO: 242035 - DNA, 1182 bp, Artificial Sequence
  Description of Artificial Sequence: Synthetic coding sequence
atgctcaaggtctcagctgtgctttgtgtgtgtgcggctgcttggtgcagtcagtcattagcggcagccgcagcagttgcagctgctggtggcagatccgatggcggtaactttctggatgacaagcaatggctcaccactatatcccagtacgataaggaggtagggcaatggaacaaattcagagacgacgattacttcaggacctggagtcctgggaagccattcgatcaagcattagacccagccaaggatccttgcttaaaaatgaagtgctcacgccacaaggtgtgtatagcccaggatagtcagaccgctgtttgcatctcgcatcggagactgacccacagaatgaaggaggctggcgtagatcacagacagtggaggggtcctatcttatcaacttgcaaacagtgcccagtcgtctacccgtcaccagtttgtggctccgacggacatacgtatagcttccagtgtaagctcgagtatcaggcgtgcgtgctgggcaaacaaatttctgtcaaatgcgaaggacattgtccttgcccgagcgataaacccacctctacatctcgcaacgtcaagaggggtttcgatacatccatccttccaatttgcaaagattccttaggctggatgttcaatagactcgacactaactacgacctccttttggaccagtccgagctgaggtccatttatctcgacaagaacgaacagtgtacgaaagcgttcttcaactcctgcgatacctacaaggatagtttaatctccaataacgaatggtgttactgcttccagcggcagcaagaccctccctgccagacagaactcagcaacattcaaaagagacagggcgtgaagaagctactgggccagtacatacctctgtgtgacgaagatgggtattataaacctacccagtgccacggatccgtaggccagtgttggtgcgtagatcggtacggcaatgaggtgatgggaagcagaattaacggagttgctgattgtgccattgacttcgaaatctctggagactttgccagtggagattttcatgaatggacagatgatgaggacgatgaagacgacatcatgaacgatgaggacgaaattgaggatgatgatgaagacgagggcgacgacgacgatggaggcgatgaccacgacgtatatatatag

SEQ ID NO: 242036 - DNA, 1302 bp, Artificial Sequence
  Description of Artificial Sequence: Synthetic coding sequence
atgctcaaagtcagcgctgtgctgtgcgtgtgcgctgcagcttggtgtagccagtccctcgctgccgcagccgctgttgccgcagctggagggagatccgacgggggtaactttcttgacgataaacaatggctgacaactatttcacagtacgataaagaggtcggtcagtggaataaattccgggacgatgactacttcagaacttggagtccaggcaaaccttttgaccaggccctggatcccgctaaggacccatgcctaaagatgaagtgtagtagacacaaagtttgcatcgcccaggactcacagaccgcagtgtgcatctctcatcggagattgacgcatcggatgaaggaggccggagtagatcacagacagtggcgtgggcctatcctatcaacatgcaaacaatgccccgtcgtgtacccgtccccagtgtgtgggtccgatggtcacacctacagcttccagtgcaaactggaataccaagcttgcgtcctgggaaagcagataagtgtgaagtgtgaaggccactgcccctgtccaagtgacaaaccgacatctacatcgagaaatgtcaaacgtgcttgctcagacctggagtttcgcgaggttgcgaaccgcctccgcgactggttcaaagcactgcatgagtcagggagccagaataagaagacaaaaaccttactcagaccggagaggagccggtttgacacaagtatcctaccaatctgtaaggattcattaggttggatgttcaatcgcctggacaccaactatgatctattactcgatcagtcagaactcaggagcatatatctggacaagaatgaacagtgtaccaaagcgttctttaattcttgcgatacctataaagattcactgatctccaataacgagtggtgttactgtttccaaaggcaacaagatcccccatgtcagaccgaacttagcaatatccaaaaacggcaaggcgtaaagaaacttttaggacagtatatacccttatgcgacgaggacgggtactacaaacccacacagtgccacggttccgtgggtcagtgctggtgtgtggatagatacgggaatgaagtgatgggttctcgaattaacggcgtggctgattgcgcaatcgacttcgaaatatccggagatttcgcctccggcgattttcacgaatggacagacgatgaagacgatgaggacgacattatgaatgacgaggacgaaatcgaggacgacgatgaggatgagggggatgatgacgacggcggagacgaccacgacgtgtacatttag

SEQ ID NO: 242037 - DNA, 1311 bp, Artificial Sequence
  Description of Artificial Sequence: Synthetic coding sequence
atgctcaaggtgtctgctgtgctgtgcgtgtgcgccgctgcctggtgcagccagagtttggctgccgctgctgcagttgcggcagctggaggaaggtccgacggtggcaatttcctggacgacaagcagtggctgactaccatatcacagtacgacaaagaagtcggccagtggaacaaatttcgcgatgaagtggaggatgactactttcgtacttggagccctgggaagccatttgatcaagctctggacccggctaaggacccctgcttgaagatgaagtgcagcaggcacaaggtctgcattgcgcaagactcacagacagctgtgtgcatcagccatcgcagactgactcaccggatgaaggaggccggagttgaccacaggcagtggcgcggacctatactatccacctgcaagcaatgcccagttgtctatccttctccagtgtgtggcagtgatggccatacttactccttccagtgtaagctggagtaccaagcctgcgtactgggaaagcagatctcagtgaagtgcgagggccactgtccatgcccttctgacaagcccacctctaccagtagaaacgtaaagagggcttgcagcgatttggagttccgagaggtggccaatagattacgtgattggttcaaagccctgcacgaatccggaagtcaaaacaaaaagaccaagacattgctgcggccagagcggtctcggttcgatacatcaatccttcctatatgtaaagactcccttggctggatgtttaatagactcgatacgaactatgacctgctcctggatcagtccgaactccgtagtatatatctggataagaatgaacaatgcaccaaagccttcttcaatagttgcgatacctacaaggattctctaatttcaaacaacgaatggtgctactgcttccagcgccagcaggaccccccatgccagaccgagctgagtaacatacagaaacgccagggcgtcaaaaagctactgggtcaatacattcctctgtgcgacgaagacggctactacaaacccacccaatgtcatggatccgttggccaatgttggtgcgtcgaccggtacggtaacgaggtgatggggtccagaattaatggcgttgctgattgtgccatcgattttgagatttctggcgacttcgcatccggtgactttcacgagtggactgacgatgaggatgacgaagatgatatcatgaacgatgaagatgaaattgaggatgatgatgaggatgagggcgatgacgatgacggcggagacgatcacgacgtctatatctag

SEQ ID NO: 242038 - DNA, 348 bp, Artificial Sequence
  Description of Artificial Sequence: Synthetic coding sequence
atgctgaaggtcagcgccgtgttatgcgtgtgtgctgccgcttggtgttcccagtctctggccgctgccgcagctgtagcggctgctgggggacgatccgatggaggtaactttctggatgacaagcagtggctgactacaatcagccagtacgacaaagaagtgggacaatggaacaagttcagagacgaggtggaagatgactatttccgcacttggtctcccggaaagccgtttgatcaggccttggatcctgcaaaagatccctgcctgaagatgaaatgctctcgccacaaggtgtgcatcgcacaggactctcagaccgccgtttgtatatctcatagatag

SEQ ID NO: 242039 - DNA, 942 bp, Artificial Sequence
  Description of Artificial Sequence: Synthetic coding sequence
atgctgaaagtgagcgccgtcctctgtgtctgcgcagccgcttggtgctctcagtcactggccgctgctgctgctgtggccgctgctggtggcaggtcagacggagggaacttcctcgacgataagcagtggctcactaccatctcacagtacgacaaggaagtcggtcagtggaacaaattcagagacgacgattacttcaggacttggagccctggtaagccattcgaccaggctctggatcccgctaaggacccgtgtctgaaaatgaagtgctctcgccataaggtgtgcattgctcaggacagtcagacggccgtctgcatctctcacaggcggctgactcatcgaatgaaagaggcaggggtcgaccaccggcaatggcggggaccaatactgtccacctgtaaacagtgtccggtcgtctacccatctccggtatgcggaagtgacggccacacatactctttccaatgtaagcttgaatatcaggcctgtgtcttaggcaagcagatttccgtgaagtgtgagggtcactgcccatgcccatccgataagcctacatcgacatcccggaacgtcaagagggcatgttctgacctcgagtttagagaagtggccaacagacttagagactggtttaaagccctgcatgaaagtgggtcacagaataagaaaacgaaaacactgttacgacctgagaggtcacgttttgatacaagcatcctgccaatttgcaaagacagccttggttggatgttcaacagactcgacaccaattacgacctgcttctcgaccagtccgagcttcgatccatatacctcgacaaaaatgaacagtgtaccaaggcattctttaattcgtgtgatacttacaaggattcactcatctctaacaacgaatggtgctattgctttcagaggcagcagggcaagagatag

SEQ ID NO: 242040 - DNA, 1017 bp, Artificial Sequence
  Description of Artificial Sequence: Synthetic coding sequence
atgctgaaggtttccgcagtgctgtgcgtgtgcgcagctgcctggtgttcgcagtccctggccgctgccgctgctgtggccgcagccggaggacggagtgacggaggtaactttctggatgacaagcagtggctcaccacaattagtcaatacgacaaagaagtcggtcagtggaacaagttccgtgattgtaagctcgagtatcaagcctgcgtcctgggtaaacagatatccgtgaagtgtgagggccactgtccttgcccctctgataagcccacgtcaacctcgcgcaacgtgaaaagggcctgtagcgatctggagtttagggaagtggctaatcgcttgcgggactggttcaaggcgctgcacgagtctggctctcagaacaagaagaccaagacactcttacggcctgagagaagcagatttgatacatcaatccttccaatttgcaaagattctttaggctggatgttcaatcgattagatactaactacgacctgcttctggaccaatccgagctccgcagcatatatctcgacaagaacgaacagtgtactaaggccttcttcaactcatgtgacacctataaggattccctgatctctaataacgaatggtgctattgtttccagaggcagcaagacccaccctgtcagaccgagctttccaacatccagaagagacagggggttaaaaagctgttggggcagtacatcccactttgcgatgaggacgggtactataagccaacacaatgtcacggctctgtgggacagtgttggtgcgtggatcggtatgggaatgaagtgatgggctccaggatcaatggggttgcagattgtgcaatcgattttgagatctcaggggatttcgcttccggagactttcacgaatggacagacgatgaagacgatgaagatgatattatgaacgatgaggacgagatcgaggacgatgacgaagatgaaggtgatgacgatgacgggggagacgaccacgatgtctatatttag

SEQ ID NO: 242041 - DNA, 1023 bp, Artificial Sequence
  Description of Artificial Sequence: Synthetic coding sequence
atgatcaacaacgggtccccccagagcctctcaatgactcgcaaatctgatagtgggaccaatagtgaaacaatgaaagaagccggagttgatcaccgccaatggagaggacctatcctgtccacttgtaagcagtgccctgttgtctacccctcgccggtgtgcggcagcgacggccacacgtacagttttcagtgcaagctggagtatcaggcatgcgtcctcggtaagcaaattagcgtgaagtgcgaagggcactgcccatgtccatccgataagcctacctcgacctccagaaatgttaaaagagcctgctccgatctggagttccgtgaggtagcaaatagactccgtgactggttcaaagcactgcacgaatccggtagccagaataaaaaaaccaagacgctattgcgacccgaaagatcaagattcgacactagtattcttcctatctgtaaggattcactaggatggatgttcaacagattagacaccaattacgatttgcttttggatcagtctgagctacggagtatctacctggataaaaacgagcagtgcaccaaagcttttttcaacagctgtgacacatacaaagacagtctcatctccaacaacgaatggtgttactgcttccagcggcaacaagatcccccttgtcagacagagcttagcaatatccagaaacggcagggagtcaagaagcttctgggccaatatatcccgttatgtgacgaggatggatattacaagcctacgcaatgtcatggtagtgtcggccagtgctggtgtgtggataggtatgggaacgaggttatgggctctcgaatcaatggggtggcagactgcgctattgactttgagatcagcggcgattttgcctccggagactttcacgaatggacagatgacgaggacgacgaggatgatatcatgaatgacgaagacgagatcgaggacgatgatgaggacgaaggggatgatgatgacggtggagacgatcacgatgtgtacatttag

SEQ ID NO: 242042 - DNA, 915 bp, Artificial Sequence
  Description of Artificial Sequence: Synthetic coding sequence
atgaaatgtagccgtcacaaggtctgcatcgcccaggactcacagactgcagtctgcatatcacaccgccgattgactcacaggatgaaggaagcgggagtggaccataggcaatggcggggacctatattatccacctgcaagcagtgtcccgtagtgtacccttccccagtttgcggaagcgatggacacacttactcttttcaatgtaagctggagtatcaggcatgcgtgctcggcaagcagatttcagtgaaatgcgaaggacactgtccgtgcccaagcgataagcccaccagcaccagcagaaatgtcaagcggggatttgacacctctattctgccgatctgcaaggactctttgggctggatgtttaacaggttggatacaaattacgacctgctacttgaccagtctgagctgagaagcatttacctggacaagaatgagcagtgcaccaaggctttctttaattcatgtgacacatacaaggactccctaatcagcaacaatgagtggtgttactgtttccagagacagcaggatccaccatgccaaaccgaattgagcaacatccagaagcggcaaggcgtaaagaaactgctgggacaatatatacccctgtgcgatgaggacggctactataagcccacccagtgccacggttcggtcggtcaatgttggtgtgttgaccgttacgggaacgaagtcatgggttctaggatcaacggcgtcgctgactgtgccatcgatttcgagatctcaggcgactttgccagtggcgacttccatgaatggactgacgacgaggatgatgaggatgacattatgaatgacgaagacgagatcgaggatgacgacgaggatgagggagacgacgatgatggaggcgacgaccacgacgtgtacatctag

SEQ ID NO: 242043 - DNA, 951 bp, Artificial Sequence
  Description of Artificial Sequence: Synthetic coding sequence
atgaaagaagctggggtcgatcacagacagtggaggggcccaatactctctacttgcaagcagtgccctgtggtgtacccctcccccgtgtgcgggtcagacggccacacgtactcctttcagtgtaagttagagtatcaggcctgtgtcttgggcaagcagataagcgtgaaatgtgaagggcactgtccttgcccctcagataaacccaccagtacgagcaggaatgtgaagcgcgcatgttccgacctcgagtttcgggaggtggccaatcggctgcgagattggttcaaggcactccacgaatccggttctcagaataagaagactaagacgttattgagaccagaaaggtccagattcgataccagcattttgccaatctgcaaggactccctaggatggatgttcaaccgcctggataccaactatgacctgctcctggatcagagcgaattgagatctatctaccttgataaaaatgagcaatgcaccaaggcatttttcaactcctgtgacacgtataaggattcattgattagtaataatgaatggtgttactgcttccaaaggcagcaggatcccccttgtcagacagagctgtctaatatccagaagcggcagggcgtcaaaaagctgctgggccaatacatccctctgtgcgacgaggacggctactacaaaccaacacagtgtcatgggtctgtgggacaatgctggtgcgtcgaccgctacgggaatgaagtaatgggtagtagaatcaacggggtcgcggattgcgcgattgatttcgaaatttctggcgacttcgcttctggagattttcatgagtggaccgacgatgaagatgatgaggatgacattatgaatgatgaagatgaaatcgaggatgatgacgaggatgaaggggacgacgacgatgggggtgatgatcacgacgtgtatatttag

SEQ ID NO: 242044 - DNA, 1017 bp, Artificial Sequence
  Description of Artificial Sequence: Synthetic coding sequence
atgctcaaagtcagcgcagttctgtgcgtgtgtgcagcagcctggtgttcccaaagtttggccgcagctgcagctgttgccgcagcaggtggcaggtcagatggcggtaacttcctggatgataaacagtggctgaccacaatttcgcaatatgacaaagaggtgggccagtggaacaaattccgggattgcaaactggagtaccaggcctgcgtgttgggcaaacaaattagcgtgaagtgcgaggggcattgtccatgtccatctgataaaccaacttccacctcaaggaacgtgaagcgcgcttgcagtgatctggagtttcgggaagttgccaatcggctccgggactggttcaaggccttgcacgagtctggcagtcaaaacaaaaagaccaagaccctccttcggccagagcgcagcagattcgatacatccatacttcctatttgcaaggattcattagggtggatgttcaacaggctggacacaaattatgacctgttgctcgaccagtcagagcttagaagtatctacttagacaaaaacgaacaatgtactaaggctttcttcaatagctgcgacacgtataaagattctttgatctcaaacaatgagtggtgctactgctttcaaagacagcaagaccctccttgccagaccgagttgtccaacatacagaagcggcagggagtaaaaaagctgcttgggcagtacattcctctttgcgatgaagacggctactataagcccacacagtgccatggctccgtgggccaatgctggtgcgttgaccgctatggcaatgaggtaatgggatctcggattaacggtgtagctgactgtgctatcgacttcgagatatccggggactttgcttccggcgattttcatgaatggaccgatgatgaggatgatgaggatgacatcatgaatgacgaagatgagattgaggatgacgacgaggacgaaggggatgacgacgatggaggggacgaccatgatgtatatatctag

SEQ ID NO: 242045 - DNA, 13740 bp, Artificial Sequence
  Description of Artificial Sequence: Synthetic coding sequence
atggagactaaggaaaatagatgggtgcctgttaccgtcttaccgggttgcgtcgggtgcagaacggttgctgctctggcttcgtggacagtgagagacgtgaaggaaaggatcttcgctgagacagggtttccggtctctgaacagaggttatggagaggcggaagagaactctcggattggatcaaaattggggacctgacctccaaaaactgccacctttttgtcaacctgcaatccaagggccttaagggaggaggcaggtttggacagaccacacccccactggtggacttccttaaagacatcttaaggaggtatcctgaaggcggacagatcttgaaagaactgatccagaatgccgaagacgctggagccacagaggtgaagtttctctacgatgagactcaatacggcactgagaccttgtggtcaaaagatatggcaccatatcaggggcctgccctatacgtgtacaataacgcagtttttaccccagaggactggcacggaatccaggaaattgctagaagccggaaaaaggacgaccccttgaaagtgggacggtttgggataggatttaatagcgtgtatcatatcaccgacgttccctgcattttttctggcgaccagataggcatgcttgatccacatcagaccctttttggacctcacgagtccggccagtgttggaacctgaaggacgacagcaaggaaatttctgaactttcagaccagtttgccccttttgtcggcatctttggatcgacaaaagagactttcataaacggaaatttccccggaacattcttcaggtttcccctgagacttcagccatctcagctgagcagcaacctctataacaaacagaaagtgcttgagttgttcgagtcatttcgggctgatgctgatactgtgcttctcttccttaaaagtgtacaagacgtgtcgctgtacgtccgagaagccgacggcaccgaaaagcttgtgtttcgggttaccagtagcgagtctaaggccttgaagcacgagcgccctaactccatcaaaattttgggaactgcaattagtaattactgtaaaaaaacacccagtaataatattacttgtgttacctatcacgtcaatatcgtgctcgaagaggagagtactaaggacgctcagaaaactagctggctggtatgcaattcggttggcggtcggggaattagctccaaactggactcgctggcggacgaattgaagtttgtccccatcattggaattgccatgcccctgtctagccgggatgatgaagccaaaggggcaaccagtgatttcagcggaaaggctttttgcttcctcccactaccgcctggcgaggaatcaagcaccggcctgccggtgcatatctccggattctttggactgacagataaccggcgatccattaagtggcgagagctggatcagtggcgggatcccgctgccctctggaatgagtttttagtcatgaacgtcgtaccaaaggcatatgctaccttaattttggactccatcaaaagactggagatggagaagagctctgactttccactgagcgtcgacgtgatctacaagctgtggcccgaggcatccaaggttaaggtgcactggcagcccgtgctggagccccttttcagcgagctcctccaaaacgccgtgatctattccattagttgcgattgggtgaggctggagcaagtatacttttccgaactggatgaaaatctggaatatactaagaccgttctaaactacctccaatcgtccggaaagcagatcgctaaggtgccaggcaatgtcgacgcggctgtccagctgaccgctgcatctggaactacacccgtaagaaaagtcacacccgcttgggtccgacaagttctgaggaagtgtgctcaccttggctgtgctgaagaaaagctacatctactcgaatttgtgctgtcagatcaggcctacagcgaattgctggggctcgagcttctacctctccaaaacggcaactttgtacctttctcttctagtgtatcagaccaagatgtaatctatataaccagcgccgagtatccacggtcccttttcccctctctggagggccgattcatcttggacaacctcaagccacacttggttgcggctctgaaggaggccgctcaaacccggggacggccttgcacccagctgcagctacttaatcccgagcgatttgctcgcctgattaaggaggtgatgaacaccttctggccgggtcgcgaactgattgtgcaatggtacccatttgatgaaaaccgtaaccacccatcagtgtcttggctgaagatggtatggaagaatttgtatatacacttttctgaggacctgaccttatttgatgagatgcccctgatccctcgaactatattagaggaggggcaaacctgtgtcgaattaatacgtctgagaatcccttctctggtgattctcgatgacgaaagtgaagcccaactgcccgaatttttggctgacatcgttcagaagctggggggatttgttctgaagaagctcgatgcctctatacaacaccctttaataaagaaatacattcattccccactcccatcggccgtattacaaattatggagaaaatgccgctgcagaagctgtgcaatcaaattacctcgctcctccccacccacaaggacgcactcaggaaatttctggcaagcttaacggattcgagcgaaaaggaaaaacggatcatacaggaattggctatcttcaagagaataaatcactcgtcagaccagggcatttcttcatatactaaactaaagggctgcaaagttctccaccacacagctaaacttcccgcagatttgcggctctccatatcagtgatcgatagttccgatgaggctacgatccggttggcaaacatgttaaaaattgagcaacttaaaactacttcctgtttaaaactggtgctgaaggatatcgagaatgcattttactctcacgaggaagtaacacagcttatgctctgggtgcttgagaacttatcgtcgctgaagaatgaaaaccctaacgtgctcgagtggctaaccccattgaaattcatccagatctcacaagagcagatggttagtgctggtgagctcttcgaccccgacatcgaagtacttaaagatcttttctgtaacgaagagggcacttatttccctccgagtgtttttaccagtcctgatatactccattctttgcggcagattggactaaaaaacgaggccagcctgaaggaaaaagatgtcgtgcaggtggccaaaaagatcgaggctctgcaggtaggcgcttgccctgaccaggatgttcttttgaaaaaagcaaagactctgctactggtccttaacaagaaccacacactgcttcagagttctgaaggcaagatgactctcaaaaagatcaagtgggtgcccgcttgtaaagagcgccctcccaactatccagggtcgttggtgtggaagggcgatctttgtaatctgtgtgcgccaccagatatgtgtgatgtgggacacgcgatactcataggaagtagtcttcccctggtcgagagcatacacgtaaatctcgagaaagcgctcgggattttcaccaagccctctctgagcgctgtcctgaaacatttcaaaatcgtggtggattggtattcatccaagacctttagtgatgaggactactaccagtttcagcacatactgctggaaatctacggttttatgcatgaccacctaaacgagggtaaagactcctttagagcactgaaatttccatgggtctggactggcaaaaagttctgccccctggcccaggccgttatcaaacccatccacgatctggatttgcagccgtatttgcacaatgtccctaaaacaatggccaaatttcaccagctctttaaggtatgtggaagcattgaagagctcacctcagaccacatctctatggtgattcagaaaatttatcttaagtccgatcaggatcttagtgaacaggaaagcaaacagaacctgcatttaatgctaaacataatcaggtggctctattcaaatcagatacccgcttcccccaatacacccgtcccgatccaccattctaagaacccctccaaacttattatgaagcccatacacgagtgttgttactgcgatattaaagtggacgacctaaatgatctgttggaggattctgtggagcctattattctggtccatgaggatatcccaatgaaaaccgccgaatggctgaaggtaccttgccttagtactagactgatcaaccccgagaatatgggcttcgagcaatctggccagagagaacccttaaccgtccgtataaaaaatattctcgaagaataccccagcgtgtcagacattttcaaagaactgctccaaaatgccgacgacgccaacgcaactgagtgcagttttctgattgacatgcgaaggaatatggacattcgggagaatctgctggatccgggtatggctgcgtgtcatggacccgcactctggtctttcaacaacagccagttctcagactcagactttgtgaatatcacccgactgggcgagagtctgaagcgtggcgaggtagataaggtggggaagtttggcctgggctttaactcagtctatcacatcactgacattcccattattatgtcaagagaatttatgatcatgtttgaccctaatatcaaccatatcagcaagcacatcaaagataagagtaatccaggcatcaaaattaactggagcaagcagcaaaagagactgagaaaattccctaaccagttcaagccctttatagatgtttttggatgtcagttaccgctgacggttgaagctccatactcctacaatggtacattgttcaggcttagtttccggactcagcaggaagccaaggttagtgaggtgtccagcacctgctacaacaccgctgatatttatagtttggtcgatgagttttctttatgtgggcaccgactgatcatcttcacacagagtgtgaaatccatgtaccttaaatacctgaaaattgaggagactaacccaagtttagctcaagatacagtgataatcaagaaaaagtcatgctcatccaaggcactgaacacacccgttttgtctgtgctgaaggaggccgcaaagctaatgaagacgtgttctagctccaacaagaagttgccctccgatgagcccaagagtagttgcatcctacagatcaccgtggaggagttccaccatgtcttcaggcggatcgcagacctacagtcacccctgttcagagggcctgacgacgaccccgctgcattgttcgaaatggcaaaatccgggcaatccaaaaagccctccgatgagctgagtcaaaagacagtggaatgtactacatggctgctgtgtacgtgtatggacaccggggaagctctgaagttttcactgagcgagtctgggaggcgtcttggattagtgccctgcggcgctgtaggcgttcagctctcagagatccaagaccagaagtggaccgtgaaaccacatataggcgaagttttctgctacctgcccttgcggataaagaccggcctcccggtgcacattaatggatgtttcgccgtgacctccaaccgcaaagagatctggaagactgacactaaagggcgatggaatactacctttatgcgccacgtgatcgtgaaggcatatttgcaggtgctgtccgtcctgagggaccttgccacctctggagaactgatggactatacctattatgctgtgtggccggatcccgacctggtgcatgatgacttttctgtgatctgtcagggcttctatgaggatatagctcacgggaaggggaaggagttgacaaaagtcttttcagatggaagcacctgggtcagcatgaaaaatgtgaggtttttagacgattctatcctcaaacgtcgtgacgtcgggtccgccgctttcaaaatatttttaaagtacctcaaaaagacaggctccaaaaacctgtgtgctgtggagctgccctcttcagttaaactgggctttgaagaggccggatgcaagcagattctgctcgagaacaccttcagcgaaaagcagtttttctctgaagttttttttccaaatattcaggagattgaagctgaattgagagaccctctgatgatctttgtactaaacgagaaggtggatgagttctctggcgttctccgagtgactccatgtatcccctgcagcctggagggacaccccctggtcctacctagtcgactgattcatcccgaagggagagtggccaagttgttcgacatcaaagacggtagatttccatatggatctacacaggactatctcaaccccattattctcataaaactggtgcagctgggcatggccaaagacgacatcctatgggatgacatgctcgagagggccgtgagtgtggccgagatcaataaatccgatcatgtggccgcatgtcttaggtcaagtatccttctctcactcattgacgagaagcttaagattagagatcccagagctaaagatttcgccgcaaagtaccagacaatcaggttcctaccgtttttgacaaagcccgctggtttcagtctggactggaagggcaacagctttaagcctgagactatgttcgctgctactgatctgtatacagctgaacaccaggatattgtttgccttctgcaacctatcctgaacgaaaatagccactcgtttaggggctgtggaagcgttagcctggccgtaaaggagttcctagggcttctgaaaaagcccaccgtggacttagttatcaaccaactcaaagaagtcgctaaatccgtggatgatggcatcactctgtaccaggaaaacatcactaatgcttgttacaagtatttgcacgaggccctgatgcagaatgagatcactaagatgtccatcatagacaaacttaagcctttttctttcattctggttgaaaatgcctacgtggattccgagaaggtgagtttccacctgaatttcgaagcagccccttacctgtaccagctaccaaacaagtacaagaataatttccgtgagctgtttgaaactgtcggtgtgcggcaatcatgcaccgttgaggacttcgccctcgttctggagtccatcgaccaggagagagggaccaaacaaattacagaggagaatttccaattatgccgaagaatcatttcggaaggtatttggagcctgattagagagaagaagcaagagttctgcgaaaaaaattatgggaaaatattactacccgatacaaacttgatgcttttgcccgctaagagtttgtgttataatgactgtccctggattaaagtcaaggacactaccgttaaatactgccacgccgatattccacgcgaagttgctgtgaagcttggagcagtgcctaagagacataaggcattggaaagatatgctagcaatgtgtgcttcacaaccctcggcaccgaatttgggcaaaaagaaaaattgacctcaaggataaagagtatcctgaacgcttaccccagcgaaaaggaaatgctgaaggagcttctgcagaatgccgacgacgccaaggctaccgaaatctgcttcgtgttcgaccctcggcagcatccagtggataggatctttgacgataagtgggcaccactgcaaggaccagcactctgcgtatacaacaaccaaccatttacggaggacgacgtcagaggaattcagaacctgggcaagggcaccaaagagggcaacccctacaagaccggccagtatggtataggttttaactccgtatatcacatcaccgactgccccagcttcattagcggcaacgacattctttgcatattcgatccccacgccagatacgccccaggtgccacaagtatcagccctggcagaatgtttcgagatcttgacgccgattttagaactcagtttagtgatgtgctggacctgtatctgggaactcattttaaattggataactgtaccatgtttcggttcccattgcgtaatgccgagatggctaaggtttccgagatatcatccgttccagcgagtgacaggatggtacagaacctgctggacaagttacgtagcgatggcgctgagctactcatgttcctgaaccacatggagaagatttccatttgtgaaatagacaagtcgacaggggctctgaacgttttgtactcagtgaaaggtaagattaccgatggagatcggctgaagcggaaacagttccacgcttcagttatcgactcagtgactaaaaaaaggcagctgaaagatattccggtgcagcagatcacgtacaccatggacactgaggattccgagggaaacctgaccacttggctgatttgcaacaggagtggattcagctctatggaaaaagtttcaaagtccgtaattagtgctcacaaaaatcaggatatcaccctgttccccagaggtggtgtcgctgcctgtatcactcataactacaagaaaccgcacagagccttttgttttctcccactgagccttgaaactggtctacctttccatgtgaatggacatttcgctcttgattccgctaggcggaacctttggcgggatgacaatggagtaggcgtacggagcgattggaataattcacttatgactgcgctgatagcaccggcatacgtcgaacttttgatccagctgaaaaagcgctatttccctggctccgatcctactctcagcgtcctccagaataccccaattcatgttgtgaaggacaccttgaaaaaatttctgtccttcttccctgtcaacagactggatctgcagccagatctttactgtctggtgaaagccttgtataactgtatacatgaggacatgaagcggctcctgcctgtggtccgcgctcctaacattgacgggtcagatcttcactccgccgtgatcattacgtggataaatatgtccacctcaaacaaaactcgaccattcttcgataatctcctgcaggatgaactccagcatctgaagaacgcggactacaacatcactactaggaagaccgtagcagagaacgtgtaccgccttaagcatctgcttcttgaaattggattcaacctcgtatacaactgtgacgagacagctaacctgtatcactgccttatcgacgctgacattccagtgtcttatgtcacgcctgccgatatacgttcttttcttatgacctttagcagcccggatactaactgccatatcgggaaactaccttgtagactgcagcaaaccaatttgaaactgttccactccctgaagctgcttgtggattattgcttcaaggatgccgaggaaaatgagattgaagtggagggccttccactcctcatcaccctggactccgtgctgcagacttttgatgcgaagcggcctaagtttctcactacataccatgaactgatcccttcccggaaggacctatttatgaacactctatatctaaagtatagtaacattctcctgaattgtaaggtggccaaggtgttcgacatatcaagcttcgctgaccttctgagttcagtgctccccagggaatataaaaccaaatcctgcacgaagtggaaagacaacttcgcttccgagtcttggcttaaaaacgcgtggcatttcatatcggaaagcgtttccgttaaggaggaccaggaggaaaccaagccaacgttcgacattgtggtggacacgttaaaagactgggccctactaccaggtactaagtttacagtgtcggctaatcagctggtcgtgccagaaggggacgttctgcttcctctcagcctaatgcacattgctgtgttccctaacgctcagagtgacaaggtcttccacgccctgatgaaagcaggctgtatccagcttgccctgaataaaatttgcagcaaggattccgctttcgtgcctttattgtcatgccacacagccaacattgagagccctacctctattctgaaggctttgcattacatggtccagaccagcacatttcgggctgaaaagctggtagaaaatgatttcgaggccctgcttatgtactttaattgtaacctgaatcatcttatgtcacaagacgatatcaaaatactgaagagtctcccatgttataaatcaatatctggcaggtacgtgtccattggcaagttcggcacctgctacgtgctgactaaaagcatcccatcagccgaggtggaaaaatggacacagtcctcttcatccgcttttctggaagaaaagattcacttaaaggagctgtatgaagtcataggctgtgtgccagtcgatgatctggaggtgtacttgaagcacttgctgcctaaaatcgagaatctgagctatgatgccaagctggaacaccttatatacctgaaaaatagactgtcctccgccgaggagctgtccgaaatcaaggaacagctattcgagaagctggagagtctgctgataatccatgacgcaaattctaggctgaagcaggcaaaacatttctacgataggaccgtgcgagtatttgaggtgatgctgccagaaaagttattcattcctaatgattttttcaaaaagctggagcagttaataaagccgaagaatcacgtaacgtttatgaccagctgggtggagtttctacggaacatcggcttgaaatacattctctcacagcagcagctgttgcagtttgccaaagaaatatccgtccgcgcaaataccgagaactggtcaaaagaaacgttgcaaaataccgtcgatatcttattgcatcacatcttccaagaacgtatggaccttttatctggcaatttcttgaaagaactctctttaattcccttcctgtgcccggagcgtgctcctgcagagttcatccgctttcatccccagtaccaagaggtcaacggaacactgccactcatcaaatttaacggtgcgcaagttaacccgaagttcaagcagtgcgatgtgctacagttgctttggacgagctgtccaatcctgcccgagaaagctactcctttgtcgatcaaggaacaggagggttcggacctgggacctcaggagcaactggaacaggtcctgaacatgctgaatgtgaatctggatcccccacttgataaagtgatcaacaactgcagaaacatttgcaatatcaccacgctggacgaggagatggtaaagaccagggccaaagtactgcgcagcatatacgagttcctgagcgccgagaagcgggagttccgcttccagttaagaggagtggccttcgtgatggtcgaggacggctggaagctgcttaaaccggaagaggtggtaattaaccttgaatatgaaagtgactttaagccgtacctttacaagcttcccctggagttagggacatttcatcaactattcaagcaccttggcaccgaggacattatctccaccaaacaatatgttgaggtcctgtcaagaattttcaaaaattcagaaggaaagcagctagacccgaacgagatgaggaccgtcaagcgcgtcgtctccggcctctttcgatctctccagaatgactcagtcaaggtaagatctgatctggagaacgtacgagatttggccctgtatctgcctagccaggacggcaggctcgtcaagtccagtattctcgtgtttgatgacgctccacactacaaaagtcgcatacagggaaacattggggtacagatgttggttgatctgtcgcagtgttacctcgggaaagaccatggattccacactaagctgatcatgctgttcccccaaaagctccgcccaaggctgctatcaagcatcctggaggagcaattagacgaggaaactccaaaagtctgccaatttggagccctatgttccctgcagggcaggttacagctcctcctatcatctgagcagtttatcaccgggctgattagaatcatgaagcatgaaaatgacaatgcctttctggctaatgaggaaaaagccatcaggctctgcaaggcactcagggaaggactcaaagtgagttgtttcgagaagcttcagaccacgttgcgagtgaaagggtttaatccaattcctcacagcagaagtgagacttttgcctttctaaagcgatttggtaacgccgtcattctgctgtacatccaacactccgactctaaggatatcaacttcttgttagcccttgcgatgaccctaaaaagcgccaccgataaccttatctctgatacctcttacctgattgcaatgctggggtgcaatgatatatacaggatcggcgagaagctggattccctgggcgtcaagtacgacagttccgaacctagcaaactagaattgccaatgccgggaactcccattcctgctgaaatccattacacactgctgatggatccaatgaatgtgttttatcctggggaatacgtgggttacctggtcgatgcggagggcggagatatttatggcagctaccagcccacatatacgtacgcgattatagtgcaggaggtggagagggaggacgccgacaacagctccttcctcggcaaaatctaccagatcgacattggatactccgaatacaagatagtgagctctctagacctctacaagttctcacggccagaagagtcctctcagtcaagggactcggccccatctacacccactagccccacagaattcctgacaccaggcctaagaagtataccccctctcttttccgggagagagtcacacaagacttctagcaagcaccagtcccctaaaaagttgaaggtgaatagcctgcctgaaattctcaaagaggtgacgtcagttgtcgaacaggcctggaagctcccggagagcgagaggaagaagatcatccggagactatatctcaaatggcacccggataaaaatcctgagaatcatgatatcgccaatgaagtgtttaagcatctccagaatgaaattaaccgccttgagaaacaggcgtttttagaccagaacgcggacagagcatccaggcgaacgtttagcacttctgcttcgcgtttccagagcgataaatactcttttcagagattttatacctcttggaaccaggaggctacgtcacacaagagcgagaggcagcagcaaaataaagagaaatgcccgccaagcgctggtcaaacctattcacagcgcttctttgtgcctccgacctttaaaagcgtggggaatccagtcgaagcgcgtaggtggcttcgacaggcccgtgccaatttctccgccgcacgaaacgacctgcacaagaacgcaaacgaatgggtatgctttaagtgctatctttccaccaagctggcactcatagcggcagactacgcagttcgcggtaaatccgacaaggatgttaaaccaaccgcactggcccagaagatagaggagtacagccagcagctggaggggctaaccaatgacgtgcataccttagaagcatacggagttgattctctgaaaaccagataccccgatctgttgccctttccacaaattcccaacgaccggtttacaagcgaagttgcgatgcgggttatggaatgtacagcatgtataattattaagcttgagaatttcatgcaacagaaggtgtac

SEQ ID NO: 242046 - DNA, 13740 bp, Artificial Sequence
  Description of Artificial Sequence: Synthetic coding sequence
atggaaaccaaagagaacagatgggtacccgtgaccgtgctgccagggtgtgtgggatgcaggaccgtcgctgcgctggcatcttggacggtccgcgacgtgaaggagaggatattcgccgagacaggatttccagtctccgagcagcgattgtggcgtgggggtcgcgaactgtccgactggatcaagatcggagatctgacttcaaagaattgccacctattcgtaaatttgcagagcaaaggactgaagggtggcggtcggtttggtcagactactccgcctctcgtcgatttcctgaaagatattctgagaagataccccgaagggggacagattctgaaagaactgatacaaaacgccgaagatgcgggagcaacagaggtcaagttcctctacgacgaaactcagtacgggacagagaccctgtggagtaaggatatggcaccctaccagggcccagctctgtacgtgtacaataatgcagtgttcaccccagaagattggcatggcatacaggaaatcgccaggtctcggaaaaaggacgatcccctgaaggtgggtcgattcggtatcggctttaattccgtttatcatattacggacgtgccttgtatttttagtggagatcagattggcatgctcgacccgcaccagacgctctttggtccacacgagtccggccagtgttggaatctcaaggatgactctaaggagattagtgaactttctgaccagttcgccccattcgtgggcatttttggcagtacaaaagaaacgttcattaatggaaatttccctggtactttcttcaggttcccactacgcttgcagcctagccagctgagctccaacctgtacaacaagcaaaaagtgttggaactgttcgagtcattcagggccgacgctgataccgtgctgctgttcctgaaaagtgtccaggacgtaagcctgtacgttcgggaggcagacggaacagagaaactggtgtttcgtgtgaccagttccgaaagcaaggccctgaaacatgaaaggcccaattctatcaagatcctaggaactgccatcagtaattattgtaagaagactccttccaacaacattacttgcgtaacgtaccacgtcaatatagtgctggaagaagagagcaccaaggatgcgcagaagacatcatggcttgtgtgtaacagcgtgggaggaaggggaatatcttctaaattggattccttagccgacgaactcaagtttgtaccaattatcggcattgccatgcctctgtctagccgagacgatgaagccaagggtgccacttctgatttcagcgggaaggctttctgttttcttcccctgccaccgggagaagagagctctaccggactaccggtccatataagcgggttcttcggccttacagacaacagacgcagtatcaagtggagagagctcgatcaatggagagatccggcagccctgtggaatgaatttcttgtgatgaacgtagttccaaaagcctacgcgaccttgattctggacagtataaaacgccttgaaatggaaaaatcttcagactttcccctgtctgtcgatgtcatctataaactatggccagaagctagcaaagttaaggtgcattggcagcccgttctcgaaccactcttcagcgagctgctccagaacgctgtgatttattcaataagctgcgactgggtgcggttggaacaagtatatttttcagagcttgatgagaacttggaatacactaaaaccgttctcaactacttgcagtcttcaggaaagcagattgctaaagtaccaggcaacgtagatgccgcagtgcagttgaccgccgctagcggcaccacaccggtgaggaaggtcacccccgcttgggtgaggcaggtcctccgcaaatgtgcacaccttgggtgcgcagaggaaaagttacacctgttagagtttgtgctcagcgaccaggcatatagcgaactgctcggcctggagctcttgccactgcagaacggaaatttcgtgcccttcagttcatccgtatctgaccaagacgtcatctatattaccagcgccgaatatccacgcagcctgtttccttcgctggaagggaggtttatactcgacaacttgaaaccccaccttgtggctgcattgaaggaggccgctcagaccaggggcaggccttgtacccagctgcagttgttaaaccccgagcgcttcgctcgcctgataaaggaggtgatgaacactttttggcctgggagagagttgatcgttcagtggtatcctttcgacgaaaaccgcaatcacccttccgtatcctggctgaagatggtatggaaaaatctctacatccactttagcgaagatctcacactctttgacgagatgccgctgattcctcgtactatcttagaggaggggcagacatgtgttgagttaattaggttacgcattccctcactggtgattttggacgatgaaagcgaggcacagttgcctgagttcttagctgacatagtgcagaagctcgggggattcgtgctgaagaagctggatgctagcattcagcatccgctgattaaaaagtatattcatagccccctccctagcgccgttctgcaaatcatggagaaaatgccattacagaagctgtgcaaccaaataactagtctcctgcctactcacaaagatgcgctccgcaaattcctggcttcactaaccgatagtagtgagaaagagaagcgcatcatccaggagcttgccatttttaaacgcatcaatcacagtagcgatcagggtatcagctcttatactaaattaaagggttgtaaggtcctacatcacacggcaaagttgcccgctgatctcaggctaagtatcagtgtcattgactcgagcgacgaggctacaataagactcgccaatatgctgaagatcgagcagttaaagaccaccagctgtctgaagttggtgttgaaagatatcgagaacgcattctattcccacgaggaagtaacgcagctgatgctttgggttttggaaaacctatccagtctgaagaatgaaaaccctaatgttctcgagtggctcacaccgctcaagttcatccagatctcccaggagcagatggtctcggccggagagctattcgacccagatatagaggtgctcaaggatttattctgcaacgaggagggcacatattttcctcccagtgtgtttaccagtcctgacatcctgcattccctgaggcaaattggcctcaaaaacgaagcaagcctaaaagaaaaggatgttgtgcaagtggccaaaaagatagaggccctgcaagtaggggcatgtccggatcaggacgtcttactgaagaaagcgaagacgctgctccttgttctaaacaagaatcacactctcctgcagagtagtgagggcaaaatgacccttaagaaaattaagtgggtccctgcatgtaaagagaggcctcccaattaccccggtagtctggtgtggaagggcgacctgtgtaatttgtgtgcccctcccgatatgtgtgacgtggggcacgctatcctgattggcagcagtctccctttggttgagtcaattcacgtaaacctggagaaggccttggggatcttcactaaaccatccctttccgcggttcttaaacacttcaagatcgtggttgactggtactcttcaaagaccttctctgatgaggattattaccagtttcaacacatcctactggaaatctacgggtttatgcacgatcacctgaatgagggaaaggatagtttccgggcactgaagttcccttgggtgtggaccggaaagaagttctgcccactggctcaggcagtaattaagccgatccatgatctcgacctgcaaccatatcttcacaacgtcccaaagacaatggctaagttccaccagctgttcaaagtctgcggctccattgaggagctgaccagtgaccatatttctatggtgatccaaaagatctaccttaagtcagatcaggacctctccgaacaggagtcaaaacagaatttgcatttgatgctgaacatcatccggtggttgtacagcaaccagatccctgcttcgccaaacacgcctgtgccaattcatcattcgaaaaaccccagcaagttgatcatgaagccaattcacgagtgttgctactgtgatattaaagtggacgacttaaacgaccttcttgaagatagtgtggaaccgataatcttagtgcacgaggatattcccatgaagaccgctgaatggctcaaggtaccctgcctatctaccaggcttataaacccggagaatatgggtttcgagcagtccggacaacgcgaacccctgactgtgcggattaagaacattctggaggaatacccatccgtgagcgacatcttcaaggaattgctgcagaacgccgacgacgcgaatgccaccgaatgctcattcctgatcgatatgcggagaaatatggatatccgagaaaatttgctagacccaggcatggctgcctgccatggacccgcactgtggtcatttaataacagccagtttagtgattccgactttgtcaacatcactcggttgggggagagcctgaaacgcggagaggtggataaggttggcaaattcggcctgggcttcaattccgtctatcacatcaccgatatacctatcataatgagtcgcgaattcatgattatgtttgaccccaacataaaccacatttctaaacatatcaaggataagtccaacccgggaatcaagatcaattggagtaaacagcagaagaggctgaggaagttcccaaaccagtttaagccctttatcgacgtgtttggatgccaactgcccttaacggtggaggccccttactcatataacgggaccctgtttcgcctcagtttcaggactcagcaggaggccaaggtgtctgaggtgagcagtacttgttacaatacagcagatatttactcacttgtcgacgaattttccctctgtgggcatagactgatcatttttacccaaagtgtaaaatctatgtaccttaagtatcttaagatcgaggagactaacccatcattagcccaggacacagtgataataaaaaagaaaagctgctcttctaaggctttaaacacaccagttctctcagtcctgaaagaggctgccaaactcatgaaaacttgctcatcttcgaacaagaagctccctagcgatgagcccaaatcttcttgtatcctacagatcactgttgaggaatttcatcatgtctttaggcgaatcgcagacctgcaaagtccactcttccgcggaccagacgacgatcctgcagcactatttgagatggccaagtcaggacagagtaagaaaccctccgatgagctcagccaaaagacagtggaatgtacaacctggttgctgtgcacctgtatggacaccggcgaggctttgaagttttcacttagtgagtccggtcgcaggctgggcttggtgccctgtggagctgtgggcgtccagctatcagagatacaggatcagaaatggactgttaaaccgcatattggggaggtgttttgctacctgccattgagaattaagaccggactgccggtgcacatcaatggttgtttcgctgtgactagcaaccggaaagagatttggaagactgataccaagggtcgatggaatactacatttatgaggcatgtgattgttaaagcgtacctgcaggtgctctccgtcctccgggatctggctacgagtggggagctgatggattacacctactatgctgtatggcctgaccctgaccttgtgcacgatgacttcagtgtgatctgccaaggattttatgaggatatcgcacacgggaaaggcaaggagctcactaaggtgttttctgatggaagtacttgggtttctatgaaaaacgtcagatttctcgatgactccatcctaaagaggcgtgacgtcggtagcgctgcatttaagattttcttgaaatacctgaaaaaaacagggtctaagaatctctgtgctgtcgagttgccctcaagtgttaagctggggtttgaagaagctggatgcaagcagatcttactggaaaatacattttctgaaaagcagtttttttcagaagtattcttcccaaacatccaggaaatagaggccgagctacgtgatcccttgatgattttcgtcttgaatgagaaggtggacgagtttagcggtgtcttaagggttaccccttgtatcccctgctccctggaggggcacccactagtgttgccatctaggttgatacacccagaaggaagggtagctaaactctttgacattaaagatggcaggtttccatatggttctacacaggactacctgaacccaatcatactcattaagttagttcagttagggatggcaaaagacgacattctgtgggatgacatgctcgaaagggccgtgtctgttgcagaaatcaataagagtgatcacgtggccgcatgtttgcggtcctccattctgctgagcttaatagatgagaaactgaaaatacgggaccccagagcaaaggactttgctgccaagtatcaaactataagatttctgcctttccttaccaaacccgctggattttccctcgactggaagggcaactctttcaaaccagaaaccatgttcgccgcaacagatctgtatactgccgagcaccaagacattgtttgtctgttacagccgattttaaatgagaacagccatagctttagaggatgcggcagcgtgagtcttgccgtgaaagagtttctaggcctcctcaagaaacccaccgtggacctcgttatcaatcagctcaaggaagttgccaaatcagtcgatgacggcattacattataccaggaaaatatcacaaatgcatgctacaagtatctccacgaggccctcatgcaaaacgaaatcacgaagatgagcattatcgataagttaaaaccatttagcttcattctggtcgagaatgcctacgtggactcagaaaaagtcagcttccacttgaattttgaagcggcaccctatctgtaccagttaccaaataagtataagaataactttcgtgagctcttcgaaaccgtgggcgtgcgacagagctgcactgtggaggattttgcacttgttctggagagtatcgatcaagaacggggaaccaagcaaattacagaagaaaatttccaactttgccgcaggattatctcagaaggaatctggtcactgattcgggaaaaaaaacaagaattttgcgagaagaactatggtaaaatcctgcttcccgataccaatttgatgctgcttccagcaaaatctctctgttataatgactgtccgtggatcaaagtcaaggacacaactgttaagtattgtcacgctgacatcccacgggaggtcgcggtgaagctcggggctgtccccaagcggcacaaggccttggaaaggtacgcttctaacgtctgcttcactacactcggtacagaattcggtcaaaaagagaaactgacgtctagaattaaatccatccttaacgcttatccatcagagaaagaaatgctaaaggagctgttgcagaatgccgacgacgctaaggctaccgaaatttgtttcgtgttcgaccccaggcagcacccagttgaccgcattttcgacgacaagtgggcacctctgcagggacccgctttgtgtgtttataataaccagcccttcacggaggatgatgtgaggggcatccagaacctcggtaaaggaactaaggagggaaacccctacaagacaggccagtatgggattggatttaactcggtgtaccacatcaccgattgtccaagctttataagtggcaacgacattctgtgtattttcgacccgcatgctagatatgccccaggcgcaacatctatcagccctggcagaatgttcagggacctggacgctgactttaggacacagttctctgacgtcctcgatctgtatctgggtactcactttaaactggataattgtaccatgttccgctttcctctccgaaatgccgagatggcaaaagtgtctgaaatctcctccgtgcccgcatccgacagaatggtccagaacttacttgataaactgcggagtgacggtgcagagctcctgatgtttctgaaccacatggaaaaaatcagcatatgtgagatagacaagagcaccggggcactgaacgtcttgtattccgtcaaaggaaagattacagacggcgatagactgaagcgcaagcagtttcatgcaagtgtgatagatagtgtgacaaaaaagaggcagctcaaggacatccccgttcagcagatcacttacaccatggatacagaagattctgaagggaacctcactacgtggttgatttgtaacaggtcagggttctcctcaatggagaaggtgtctaagtctgtcatctctgctcacaagaatcaggatatcacgctctttccaagaggcggagtggccgcatgcataacacacaactacaagaaacctcacagggccttttgtttcctgcccctatcacttgagacggggttgcccttccacgtcaatggtcactttgcgctggatagcgcgagacgaaatctgtggcgcgatgacaacggggtgggcgtccggtcagattggaataattcactaatgaccgcccttatcgcaccggcttatgtggaactgctgatacaactgaaaaagcgatattttcctgggagcgatcctaccctgagcgtgctccaaaacacgcccatacacgtggtcaaagacacgctcaaaaagttcctgtccttctttcctgtcaatcgtttggatttacagcctgacctctactgtctggtgaaagccctatataattgtattcacgaggacatgaagcggctgctacccgtggtgcgggcaccgaacatcgatggaagcgacctgcactcagctgtcataattacatggatcaatatgagcacctccaacaaaacgcgcccattcttcgataatcttctgcaggatgaattgcaacacctgaaaaacgcggattacaatattaccaccaggaagacagtcgccgaaaacgtctacagactgaaacacctgttgctggaaattgggttcaacctggtttacaattgtgacgaaacagccaatctctatcactgtttaatcgatgcggatattcccgtctcctacgtgactcctgccgatattcgtagtttcctgatgactttctccagccctgatactaactgtcatatcggcaaactgccctgccgactgcagcagacaaaccttaagctctttcactccttgaagctgctagtagactattgttttaaggatgcagaagagaacgagattgaggtcgaaggactgcctctgctgatcacactggattccgtgctgcagacttttgacgccaagcgcccaaagtttcttacaacgtatcacgaattgattccaagccggaaagacctgtttatgaacaccctttaccttaagtacagcaatattttgctgaactgcaaagtcgcaaaagtgtttgatatttctagctttgccgaccttctctccagtgttctccccagagagtataagactaaatcctgcactaagtggaaagataacttcgccagtgaatcctggttgaagaacgcttggcacttcatttctgagtcagtgtccgtgaaagaggaccaagaagagaccaaacctacctttgatatcgtcgttgacaccttgaaagactgggctttgctccccggtaccaagtttaccgtctcagccaaccagctagtcgtgccagaaggcgatgtgctgcttcccctgtctctaatgcacatcgcagtgtttcctaacgcgcagtcagacaaagtctttcatgccctaatgaaggcaggctgcatacagctggctctgaataagatctgctcaaaggactctgcgtttgtaccccttctgagctgccacaccgccaacatcgaatcccccaccagcattctcaaggccctccactacatggtacaaaccagtaccttccgggcagagaagctggtcgaaaacgattttgaggccctattgatgtattttaattgtaatctgaaccaccttatgtcacaagacgacattaaaatcctaaagtcgctaccgtgttataagtccatctctggccgttacgtcagtatcggaaaattcggtacttgttacgtgcttacaaaaagcattccctccgctgaggtggagaagtggactcagtcaagctcttcagcatttctggaagaaaaaatccacctaaaggagctgtatgaggttatcgggtgtgtccctgttgacgatctggaggtgtatctgaaacatctgctcccaaagattgaaaacctgtcctatgacgccaagctggaacacctgatatatctcaaaaaccgtttaagtagcgctgaggagttgagcgaaattaaggagcagctgttcgagaagctagagtctttacttatcattcacgatgccaactcacgactgaagcaggccaagcacttttatgatagaaccgtcagagtcttcgaggttatgcttcctgaaaaactcttcatacctaatgatttcttcaagaagctagagcagctgatcaagcccaaaaatcacgtcacgtttatgacttcctgggtcgagtttttgcgaaatatcggcctgaagtacattctgtctcagcagcagctcttgcagtttgccaaagagatctccgtgcgcgctaacactgagaactggtctaaggaaacccttcagaataccgtggacatcctccttcatcatatatttcaggagagaatggatctgctcagcgggaactttttgaaggagctatccttgattccgttcttatgtccagagagggcgcctgcagaattcatccggttccacccccaatatcaggaggttaacgggaccctaccactgataaagttcaacggagcccaggtgaacccgaaattcaagcagtgtgatgtgcttcagttgttgtggacctcctgcccaatcctgcccgagaaagcaacgcccctgagcataaaggagcaggagggctctgatctggggcctcaggaacagctcgagcaggtcctcaacatgctgaacgtcaatctcgacccgccactcgataaggtgattaacaattgccggaacatttgtaatataactacgttggacgaagagatggtgaaaacgagagccaaggtcctgcggtcaatctatgaatttctgtcagccgagaagcgcgaattcaggttccagctgcgcggagtggcattcgtaatggtggaagatgggtggaaacttctcaaacccgaggaggtggtaattaatttggagtacgaatccgacttcaaaccttacttgtataaacttcctctcgagttgggaacatttcaccaactgttcaagcacctcggtactgaagacattatctccaccaaacagtatgtagaggtgttgagtcgaatttttaaaaattctgagggcaagcagctggacccaaatgaaatgcggacagtgaagcgggtggtaagcggcttgttcagaagcctgcaaaacgattcagtaaaagtcaggtccgacctggaaaacgtcagagacttggccctgtatctgccgagccaagatggaagattggtgaagtcatctatccttgtgtttgacgatgctccgcactataaatccagaattcagggaaatatcggagtgcagatgttggttgaccttagtcagtgctacttgggaaaagaccatggctttcacactaagcttattatgttgtttccccaaaagctcagacccaggctgctgagtagcatactcgaagaacagctcgacgaagagactcctaaagtgtgtcaattcggagcgctctgctcattacaaggccgtctgcagcttctgctgtctagtgagcagttcattaccggcctgattcggataatgaaacatgagaatgacaatgcatttttagcaaacgaagaaaaagctatacgcctttgcaaagccctcagagaagggctaaaggtatcctgctttgagaagctgcagaccactctgcgagttaaaggctttaacccaatcccccattctcggagtgaaacctttgcattcctaaagcgctttggcaatgctgtcatcttgctgtatatacaacattcagactctaaggacatcaactttcttctcgccctggccatgaccttgaagtctgctacagacaatttaattagcgacactagttaccttatcgctatgctgggttgcaacgacatttacagaatcggcgagaaactggactcactcggggtgaagtacgatagttctgagccgtccaaactggagctccctatgcccggtactccaatacccgcagagattcattataccctgttgatggatccaatgaacgtcttttaccctggggagtacgtgggctatctggtcgatgccgaagggggagacatatatggatcctaccagcctacctacacctatgcaataatcgtacaggaggtggagagagaggacgcagataactctagctttctcggcaaaatttaccaaattgacattgggtacagtgaatataagattgtttcttctctggacctctacaaattcagtcggccagaggaaagctcccagtcacgcgactcagccccatcaacacccacttctccgacagaatttctgaccccgggtctgcgatccatcccaccgctcttttctggcagagaatctcacaaaacatcttctaagcaccagagcccaaaaaaactgaaagtgaattctctcccagaaatcctcaaggaggtgactagcgtagtcgagcaggcttggaagctcccggagagcgagcggaagaagatcattagacgcctgtacttgaagtggcatccagataagaatcccgagaaccacgatattgccaacgaggtattcaagcatctccaaaacgagatcaaccggctggagaagcaggcgttcttagaccagaatgcagaccgggcttcaagaaggacattttccacatccgctagtcgctttcagagtgacaagtattcattccagcgtttttacacctcttggaatcaggaagccacatcgcacaagagcgagcgccaacaacagaataaagagaaatgcccccctagcgctgggcagacctacagtcagagattcttcgtgccccctacctttaagagcgtgggcaatcctgtcgaagccagacgctggctgcgtcaggcacgggctaatttcagtgcagccagaaatgacctgcacaagaacgcaaatgaatgggtgtgttttaagtgttatctcagcacaaagttagctctgatagccgctgattatgcagttcgtgggaagagtgacaaggacgtcaaacctacagctctggcacagaagatcgaggaatattcccagcagctggaggggctgactaatgacgttcatactctcgaggcgtacggtgtggacagtctgaaaacccgctaccccgacctgctcccttttccgcagatccccaatgaccgtttcacaagtgaggtcgctatgagggtaatggaatgtacagcatgcatcatcatcaagttggaaaattttatgcagcaaaaagtctac

SEQ ID NO: 242047 - DNA, 11490 bp, Artificial Sequence
  Description of Artificial Sequence: Synthetic coding sequence
atgaatacattctggcccggtcgcgaactgatagtccagtggtaccccttcgacgaaaatcggaaccacccttccgtgtcctggttgaagatggtgtggaagaatctgtatattcatttttctgaggatctgaccctgtttgatgaaatgccacttatccctcgaacgattctggaggaggggcagacttgtgtagagctgattcgcctgaggatccctagcctggtcatcctggacgacgaaagtgaagcccaactgcctgaattcttggcagacatagttcagaaactaggcggatttgttttgaaaaagctcgacgcttctattcagcaccctttgatcaagaagtacattcatagccctctgccatctgcggttctgcagatcatggagaaaatgcccctgcaaaaactgtgcaatcagatcacctcactgttaccgacccataaggatgcgttgcgtaagttcttggcctccctgaccgattcttcagaaaaagagaagagaatcattcaggagctggccatttttaagcgaatcaatcatagcagcgatcaaggcattagctcatacactaaattaaaaggctgtaaagtgctgcaccataccgccaagctgccagctgatctcaggctaagcattagcgtgattgactccagcgatgaggctacaataaggcttgcaaacatgctgaaaattgagcagctgaaaacaacctcctgcttaaaactggtgctcaaggacattgaaaacgctttctactcccatgaagaagtgacacaactgatgctctgggtgctcgagaatttgtcatctttgaagaacgagaaccccaacgtgctggagtggctaaccccgctgaaattcatccaaattagtcaggaacagatggtgagtgctggagagctgttcgacccagacatagaagttctcaaagacttgttctgcaacgaggaggggacttactttcctcccagtgtgttcacgagtcctgatatccttcacagccttaggcagatagggctcaagaacgaggccagccttaaggagaaggacgtggttcaggttgccaagaaaatcgaggccctgcaggtcggggcttgcccagaccaggatgttctgttgaaaaaagccaaaacattgctcctggtgctcaacaaaaatcacacactattgcagagctctgaggggaagatgacactgaaaaagattaagtgggtccccgcatgcaaagaaaggcccccaaattaccccggaagcctggtatggaagggggatctgtgcaatctgtgcgctcccccagacatgtgcgacgtagggcacgccatcttgatcggttcttccctgcccctggttgagagtattcatgtcaaccttgagaaggcgctcggaatattcaccaaaccatcgttgtcagctgtgctcaagcactttaaaatagtggttgattggtactctagcaagacattcagcgatgaggattattatcagtttcagcatatactgttggaaatttacggcttcatgcacgaccaccttaatgaagggaaggactcgtttcgggctctcaagtttccttgggtctggaccggaaagaagttctgtcccctggcccaggctgtcattaaaccgatccacgacctggacctgcagccttatctacacaacgtgcctaaaacgatggctaagttccatcaattgttcaaggtctgtggctccatcgaagagttaacatctgaccatatatcaatggtgatccaaaagatttatctgaagtctgaccaggatctgtccgagcaagagagcaagcaaaacctgcaccttatgttgaacatcatccgctggctctactccaaccagattcccgctagccccaataccccagtgcccatccaccactcaaagaacccttctaagctgatcatgaagccaattcatgaatgctgttattgcgacatcaaagttgacgacctgaatgacttgctcgaagattcggtcgagcccattattctagtgcacgaagatatccccatgaaaactgccgagtggctgaaggttccgtgcctgtcgacccggctcataaacccagaaaatatgggatttgaacagtccggacagcgggagccactgactgtgcggatcaagaacatcctggaggagtacccctccgtatcggacatttttaaggaactgctccaaaatgccgatgatgctaacgcaaccgagtgtagttttttaatcgatatgcgcagaaatatggacatcagagagaatctcctggatcctgggatggccgcttgtcacggccctgccctctggagctttaacaactctcagttctctgactctgactttgtgaatataactagactgggagaatctttgaaacgcggagaagtagataaagtgggtaaattcgggctcggcttcaactccgtttaccacattacagatatccctatcattatgagtcgagagtttatgattatgttcgatcctaatattaaccatatctccaagcacatcaaggataagtccaaccctgggataaagataaattggagcaagcagcagaaacgcctcagaaagttccctaaccagttcaaaccctttatagacgtatttggttgtcagttgccactgacagtggaagcaccttattcctacaacggcactctctttcgactgagcttccgtacgcaacaggaagccaaggtatctgaagtgagcagtacgtgttataacaccgccgatatctactccctggtcgatgagttttctttgtgcggtcacaggctgataatctttacacaatcagttaagtcaatgtacctgaaatacctgaaaattgaggaaactaaccccagcctagcccaggacactgtgataatcaaaaagaagagctgttcctcaaaagccttgaacactcctgtgttgtctgtgctgaaggaagctgcaaagctcatgaagacttgttcttcaagcaacaagaagctcccgtcagatgagcccaaatcgagttgcatcctccagattaccgtagaggagtttcatcatgtttttcggaggatcgccgatctgcaatcaccactgtttagggggcctgatgatgaccctgctgccctgtttgagatggctaaatccgggcagagcaagaagccatccgatgagttgtctcagaagaccgtggagtgcactacatggctgctctgtacttgcatggacaccggggaggccttgaaattttcactgtcagaaagtggcagacgcctggggctcgtgccctgcggcgcagtaggagtgcagttgtcggaaattcaggaccagaaatggacggttaaaccgcatatcggagaggtattctgttatttgcccctgagaattaaaaccggcctgccagtgcatatcaacggttgctttgcagttacctccaaccggaaggaaatttggaaaaccgacaccaaaggtcgctggaacacaacatttatgcggcatgtgatcgtgaaagcttacttgcaggtcctgtcagtgttacgggacctagcgacatccggggaactgatggactatacctactatgcggtttggcccgaccctgacctagtccacgacgactttagcgtgatttgccagggtttttatgaggacatcgcgcatgggaagggaaaagaattgacaaaagtgtttagcgacggctccacctgggtctccatgaaaaacgtgagattcctggatgactctatcttaaaaaggcgtgacgtgggaagcgctgcttttaagattttcctgaaatacctgaagaaaaccgggtccaagaacctgtgtgctgtagagttaccatcctccgtgaagttaggctttgaggaggcagggtgcaaacaaattttactggagaacacctttagcgaaaagcaatttttctctgaggtgttttttccgaacatacaggagatcgaggctgagctgagggatccactaatgattttcgtgctgaacgaaaaggtggatgagttctccggtgttctgcgcgtcactccatgcattccatgcagtttggagggccaccccttggtgctgccatctagactgatccaccctgagggcagagtggctaaactgtttgacattaaggatggtcgatttccatatggcagcacccaggactatctgaaccccattattctcatcaagttagtccagctcggaatggctaaagatgatatcctctgggatgacatgctggagcgagccgtgtcagttgcggaaatcaacaagagcgaccatgttgccgcatgtttgcggtcttccatcttgctgtccctgatcgacgagaaacttaagatacgggaccccagggcgaaagatttcgcggcaaagtatcagaccataagatttctgcccttcttaacaaagccagcaggattcagtctggactggaagggcaacagcttcaagcccgagaccatgtttgcggcaacagatctgtacactgccgaacaccaggacattgtgtgcttgttgcaacctatcctgaacgaaaattcgcattccttcagaggctgcgggtctgtttccttggctgtgaaggagttcctgggtctgctgaagaagcctactgttgacctggttattaaccagcttaaagaggtcgctaaatccgtggacgatggcatcacactgtatcaggaaaacattacaaatgcctgctacaaatatctccacgaagcattgatgcagaacgaaattaccaaaatgagcatcattgacaagttgaaacccttcagcttcattctagtcgaaaacgcttacgtggacagcgagaaggtgtcttttcatttaaacttcgaggcagctccttatctttatcagttgcctaacaagtacaaaaataacttccgggaattgttcgagacagtgggtgtccgacagagctgcaccgtggaggattttgcactcgtactggaatccattgaccaggagcgaggtaccaagcagattacagaagagaatttccaactctgtaggagaatcatttccgaaggaatttggagcctcatccgagaaaaaaagcaggagttctgtgagaagaattacgggaagatcctgttaccagatacaaatttgatgctgcttccggctaaaagcctatgctataatgattgcccctggatcaaggtgaaagatactaccgtgaagtactgtcatgccgacatccccagagaggtggcggtgaaactgggggctgtgccaaagaggcacaaggccctggaacggtatgcatctaacgtttgtttcaccacgcttggaaccgaattcggccaaaaagaaaagttgacaagccggatcaaaagcatcctgaatgcttacccaagcgagaaagagatgctaaaagagctgctgcaaaatgccgatgacgccaaagctacagaaatttgtttcgtatttgaccccaggcaacatcctgtggatcgtattttcgacgataaatgggccccactgcagggacctgcgctctgtgtttataataatcagccattcactgaggacgacgtccgtggcattcagaatcttggaaaaggaaccaaagagggtaatccatataaaaccgggcagtacggcataggcttcaattccgtgtaccacatcacagattgtcctagtttcatcagtggcaatgatatcttgtgcatctttgacccccatgcacggtacgctcctggggctactagcatcagtccgggacgtatgttccgggacctggatgctgacttccggacacagtttagtgacgtgcttgacctttatctagggacccattttaaactggataattgcacaatgtttagattcccattgcgtaatgctgaaatggccaaggttagcgagatttcctctgtgccggcaagcgataggatggtgcagaatctgcttgacaaactgcgatctgacggggctgaactgttaatgttccttaaccacatggagaagataagcatttgcgaaatcgacaagtccaccggagctttgaatgtgctgtattctgtgaaaggaaaaatcaccgacggcgatagactgaagcgcaagcagtttcacgcatccgtaatagacagtgttaccaagaagagacagctcaaggatatcccggttcagcagatcacttacaccatggatacggaggacagcgagggaaatttgactacatggcttatatgcaatcgatctggattcagctccatggagaaggtcagtaagtccgtgatctctgcccacaagaatcaagatataactctgttccctcgcggtggtgtggcagcatgtattactcacaactacaagaagccacatagggctttctgctttttgcctctctctctcgaaacgggtctgcccttccacgtgaacggccactttgcccttgattcggctagaaggaatttatggcgcgacgataacggtgtgggtgtcagatcggactggaataattccctgatgactgccttaattgctcccgcttacgtagagctcctgatccagcttaaaaaaaggtactttccaggatcggatcccactctctcagttctgcagaatacaccaatacacgtagtgaaagacaccctcaaaaagtttctgtccttcttccctgtgaatagattggatcttcagcctgacctctattgcttagtcaaagctttgtacaattgcatccacgaagacatgaaacggcttctacctgttgtgcgagcacctaacattgacggcagtgatctccatagtgccgtgattatcacctggataaatatgtcaacgagcaataagacacggccttttttcgataacctgctccaggatgaattgcagcacctgaaaaacgctgactataatattactacacgaaaaaccgtggccgaaaatgtgtatcgtcttaagcacctcttgcttgaaattggttttaatctggtctacaactgcgatgagacagctaacctctatcactgtttgatcgatgcggatattcccgtcagctatgtcacacctgctgatattcgatcgttcctgatgacgttctcaagtcccgacaccaattgtcatattggcaaacttccctgtaggctgcaacagaccaatctaaagctcttccattccctgaaactcctggtagactactgcttcaaggatgcggaagaaaatgaaattgaagtagagggactgcctttactcatcactcttgacagtgtgctgcagacatttgatgcaaaacggcctaagttcctgaccacctatcatgaacttatcccctcccgcaaagatctcttcatgaataccttgtacctgaagtacagcaacatattactcaattgtaaggtggctaaagtttttgatatttcaagctttgctgacctgctcagctcggtgctgcccagagagtataagacaaagtcctgcaccaagtggaaagacaacttcgcatcagagtcctggcttaaaaacgcttggcatttcatttccgaatccgtatctgtaaaggaagaccaagaggaaaccaaaccaaccttcgacattgtcgtggatactctgaaagattgggctttgctcccaggaacaaagtttacggtgtctgccaaccagctggtggtgccagaaggcgatgttctgctccccttgtcacttatgcatatcgcagtgtttcccaacgcacagtcagacaaagtattccacgccctgatgaaagctgggtgcattcagttagccttaaataagatctgttcgaaagacagcgcattcgtgccattgttgagctgccacaccgccaatatagagtcaccgacttcaattcttaaagcacttcactatatggtgcagacaagtactttcagggccgaaaagttagtcgaaaatgacttcgaggctctccttatgtacttcaattgcaatctcaaccatctgatgtctcaggacgatataaagatcttgaagtcactgccatgctataagtccattagtggtaggtacgtcagcatcgggaagttcgggacatgttatgtgctgaccaaatccatccccagcgccgaagtggaaaaatggacccagtcctctagctccgcttttctggaagaaaagatccacctcaaggaactctatgaagttatcggttgtgtgcctgtcgatgatttggaggtgtaccttaagcaccttcttcccaaaatcgagaacttgtcctacgatgctaaactagaacatctcatctacctcaagaatcgcctatcctcagccgaggagctgagcgagataaaagagcaattattcgagaagctcgagagtctgttgatcattcatgacgccaacagcagactcaagcaggcaaagcacttctatgatcgaacagtaagggtgtttgaggtcatgttgccagaaaagttgtttatccctaatgatttctttaagaagttggagcagctcattaagcctaaaaatcatgttacatttatgaccagttgggtggagtttctgcggaatatcggactcaaatacatcctcagtcagcagcagctccttcaatttgctaaagaaatctctgtcagagccaatactgaaaattggtccaaggaaaccctgcagaatactgtcgacatcctgctgcaccatatcttccaggaacggatggatctactgtcagggaatttcttgaaagaattaagcctcatcccgtttctgtgccccgaaagagcaccagccgaatttatccgctttcacccacagtaccaggaggttaacgggactctgcccttaatcaagttcaatggcgctcaggttaatcccaagtttaaacagtgtgatgtactgcagctcctttggacctcttgcccaatcctgcccgaaaaggccactcctctgtcaatcaaggagcaagaaggcagtgatcttggccctcaggagcagctggagcaggttctgaacatgctcaatgtgaatctggatccccctcttgacaaagtaatcaataactgcagaaacatctgcaacatcaccactctcgacgaagaaatggtaaagactcgggctaaggtgctgcgctctatatatgagtttctctccgcagaaaagcgggagtttaggttccagctgaggggcgtagcttttgtgatggtagaggacggctggaagctgctgaaaccagaggaggtagtgatcaacttagagtacgaatctgattttaagccgtatctttacaaattgccactggagctgggcactttccaccagctgttcaagcacctcggaacagaggatattatttcaacaaaacagtatgttgaagtgctgagcagaatattcaagaatagcgaaggtaagcagttggacccaaacgaaatgcgcacagtcaaacgagttgtcagtggtctctttcgcagccttcagaatgactccgttaaggttcgatccgacctcgaaaacgttagggatcttgccctttatctgccatctcaggacggtaggttagtgaaaagcagcatcctcgttttcgacgatgctcctcactataaatctcggatccaagggaacatcggagtgcagatgcttgtggacctatctcagtgttacctcggcaaggaccatggcttccacaccaaactgatcatgctcttcccgcagaagctccgcccacggcttctgtcttccattctggaggagcagctggacgaagagactcctaaggtttgtcagtttggggctctctgttctcttcagggcagacttcagttgttactttcatccgagcagtttattacaggtctgattagaatcatgaagcatgagaatgacaacgcttttctcgcaaatgaggaaaaagccattcgcttgtgtaaagcactgagggaggggctgaaggtgtcttgctttgaaaagttacagaccactctgagggtgaaggggttcaatccaatcccccactcgcgaagtgaaacatttgctttcctcaagaggtttggaaatgctgtgatcctcttgtacatccagcactccgactctaaagacattaacttcctgctcgcactcgcgatgacgcttaaatccgcgactgacaatctgatatccgatacctcatatctgattgctatgttaggatgcaatgatatttaccgcatcggggaaaagttggactccttaggagtgaaatacgattcgagtgagccatcaaagctggagttgccaatgcctggcactcccattcccgcagagatccactacactctcctcatggatccaatgaacgttttctacccgggtgagtacgtgggttacttagttgatgccgagggcggagacatttatgggtcatatcagcccacttatacctatgctattatagtccaggaagttgagagagaggatgccgacaactcttcctttctaggaaaaatttaccagatcgatattggatactcagaatataaaatcgtgagcagcctggacctttacaaatttagcagaccagaagagtctagtcaatcccgcgacagcgctccctctacccctaccagccctactgagtttcttacacccggactgcgcagcattccccctctcttctctgggcgagagtcccataagacctcttccaagcatcagagtcctaagaaactgaaagtcaatagcttaccggagatcctcaaagaagtgacatcagtggtagaacaagcctggaagctgcctgagtccgagagaaaaaaaattatcaggcgtctgtatctgaagtggcaccctgacaagaatcccgagaaccatgatatcgcaaatgaagtctttaaacatctgcagaacgaaattaaccgcctggagaagcaagccttcttagatcagaacgctgatagggcttccagaagaacttttagcacttcagcctcacgatttcagagcgataaatatagcttccagagattctacacatcatggaaccaggaggcaacgagccataagtctgagcgtcagcagcaaaataaagagaagtgtcccccatctgccggacaaacttactcacagaggttctttgtgcctcctacgtttaagagcgtcgggaacccagtggaggcgagacgatggctcaggcaggcccgagctaatttctcagcagcaagaaacgacctgcacaaaaatgcaaatgagtgggtctgctttaagtgttacctgagcactaagcttgccctcatcgcagctgactatgcagttcggggaaaatctgacaaggatgtaaaacctaccgctctggcccagaagatagaggaatacagtcagcagctggaagggttaacaaatgatgtccacacactcgaagcctatggagtggattcattgaagacccggtaccctgatctgcttcccttcccccagatccctaatgataggttcacgagcgaagtcgccatgcgggtcatggaatgcacagcctgcatcatcattaaactcgagaacttcatgcagcagaaggtgtac

SEQ ID NO: 242048 - DNA, 7331 bp, Artificial Sequence
  Description of Artificial Sequence: Synthetic coding sequence
atggccgctgaggaaggcgttgcgagcgctgctagcgctggaggcagctggggcacggcggctatggggagagtattgcccatgttgctggtgccagtgcccgctgaggctatgggacagctggggagtcgggcacaactacggacccagcccgaggccctaggatccctgacagcagcagggagtttacaagtcctgtccctgacgcccggttcacgcggtggtgggcgatgttgccttgaaggtcccttctggcattttctctgggaggactcccgaaactcctcaaccccaacagagaagcccaaactgctcgctctgggggaaaattacgaactgctgatctacgagttcaatttgaaagacggacgctgtgatgctaccattctgtactcatgttcgcgcgaagctctccagaagttgatagatgatcaggatatatcaatatctctgttatccctgagaatcctgtcgtttcacaataatacgtccctgctcttcattaacaaatgtgtgattctgcacatcatatttcctgaacgagacgcggctatcagggtgttgaactgcttcaccctccctcttccggctcaggctgtggacatgattattgatacacagctgtgtcgcggtatactctttgtcctttcctcccttggctggatctacattttcgatgttgtcgatggcacctatgtggcccacgttgacctcgccctccataaagaggacatgtgcaacgagcagcagcaggagcccgctaaaatctcgagtttcacctctttaaaagtcagtcaggatctggacgtggccgtcatcgttagcagtagcaacagtgcagtggcgttaaatctgaatctgtatttccgtcagcaccccggacacctgctgtgcgaaaggattttggaggatttgccgatacaaggtccaaagggagttgatgaggacgacccagtgaatagcgcatacaacatgaaactggcgaaatttagcttccagatcgaccggtcgtggaaggctcagctgagtagcctgaacgagaccatcaagaactctaaattagaagtgtcttgttgtgccccatggttccaagacattctgcacctagaatcccccgagtccggtaatcacagcaccagtgtccagagctgggcatttattcctcaggacattatgcatgggcagtacaacgtgctgcagaaggaccatgcaaaaacatcagaccccggacgttcttggaagatcatgcacatttctgaacaagaggagcccattgaactgaaatgcgtgtcggtgaccggtttcacagccctatttacatgggaggttgaacggatgggatatactataacactatgggatctggagacacaaggcatgcagtgcttcagcctggggaccaaatgtatcccagtggattcttccggggatcagcagctgtgctttgttctgacagaaaatggcctttcgctcatcctgtttggactaacacaggaggaatttctcaaccggctaatgattcacggatctgcgtccacagtcgataccctgtgtcatctgaatgggtggggcagatgttccatccccattcacgctcttgaagctggtatcgaaaatagacagctggacactgtgaacttctttctaaagagtaaggagaacttgttcaaccccagtagcaaaagctcggtgagcgaccaattcgatcacttgtcctcccatctttatttacgcaacgtagaggagctaatccccgcactagatttgttatgtagcgcaatccgtgagtcctatagcgaacctcaatcaaagcactttagcgaacaactgttgaatttaactctatcatttctgaataatcagatcaaagagctttttattcacactgaggaactggatgagcacctacaaaaaggggttaatatcctgacctcatatatcaacgagctgagaacattcatgattaagtttccttggaaacttactgacgccatcgatgagtacgatgtccacgaaaacgtccctaaggtaaaagaaagcaatatctggaagaaattgtcctttgaagaggtgattgcctcagccatactcaataataaaattcccgaggcacagaccttcttccgtattgattcccatagtgcccagaagctggaagaacttatagggatagggcttaacctcgtattcgataatttgaagaaaaacaacatcaaagaagcatctgagctgctgaaaaatatggggttcgacgttaagggtcagttactgaaaatctgcttctataccacaaacaaaaatatccgggatttccttgtcgagatattaaaagaaaaaaactatttctcggagaaagagaagaggaccattgactttgtgcatcaggtggagaagctctacctgggacactttcaggagaatatgcaaattcagagcttccctcgttactggatcaaagaacaggacttcttcaagcacaaatcagtgctggattccttcctgaaatatgactgcaaagatgagtttaacaagcaggaccatagaattgttctgaattgggcactgtggtgggatcagttgactcaggagtcaatactgctgcccaggatttctcccgaagaatacaagtcttactcgcctgaggccttgtggcgttatttgacagcgcgacatgactggttaaatatcatactttggattggagagtttcaaacccagcacagctatgcctcactgcagcaaaataagtggccacttctgaccgtggacgtcatcaatcaaaacacttcctgtaataactatatgcgaaatgagatactggacaagttggctagaaatggcgtatttctagcctcagagttggaggactttgagtgcttcctgttgcggctctcacgaattggaggtgtcatccaggacacacttcccgtacagaactacaaaactaaagaaggctgggatttccacagccaatttatcttgtactgcctggagcactctttgcagcaccttctgtacgtttatctggattgttacaagctgtcccccgagaattgccccttcctggagaaaaaagagctgcacgaagctcatccatggttcgagttccttgttcagtgccgccaggtggctagcaacctaaccgatccaaaactgatctttcaagcatctctggcaaacgctcaaatcctgatccccaccaaccaggccagtgtctcctcaatgcttctggaaggacacaccctgctggcactcgcaacaacaatgtactcccctggaggggtaagccaggtcgtacagaacgaagaaaatgagaactgcctcaaaaaggtggacccgcagctgctgaaaatggcgctgaccccttatccgaaattgaaaaccgccctattcccacaatgcactcctccaagcgtcctgccttccgatattaccatttatcacctaattcagtctctgtcccccttcgacccaagcagactgtttggctggcagtcagctaatactctcgcaattggcgatgcttggtcacatctccctcacttttcctctccggatctggtaaataagtacgccatcgtagaacgcttgaatttcgcatactatcttcacaatgggcgaccaagttttgcattcggcactttcctcgtccaggagctgataaagagcaagactcctaagcagcttatccagcaggtggggaatgaagcatatgttattggcttaagctccttccacatcccgtcgatcggggcagcatgcgtgtgcttcctcgaactcctcggacttgattcactgaagctgagggtagacatgaaagtggcgaatataatcctgagctataagtgcagaaacgaagatgcacagtacagcttcattagggagtcagtcgcagagaagctctcgaagttggccgatggagagaaaacgacaacggaggagctgcttgttctgctggaagaagggacttggaattctatccagcagcaggagatcaagcggttaagttccgaatcttcttcccaatgggcattggttgtgcagttttgtcgcctgcataacatgaaactgtccatctcctatcttcgggaatgcgctaaagccaatgactggctgcagtttatcattcatagccaactgcataactaccatccagccgaggtgaaatccctgatacaatacttcagcccagtgatccaagaccacctgcggctggctttcgagaatctgcccagcgttcctacaagtaaaatggacagcgatcaggtgtgcaataagtgcccacaagagctccagggctccaaacaggagatgacagacctgtttgagatattactacagtgttccgaggagccggatagttggcattggttactggttgaagctgtgaagcagcaggccccaatcctgtctgtgctcgcttcgtgtctgcagggggctagcgctatcagctgcctctgtgtgtggataataacttctgtagaggacaacgtggccacagaggcaatgggccacatccaggatagtaccgaggaccacacttggaacttggaggatctctccgttatttggcggacattattgacccggcagaagtccaaaacactcataagaggatttcaacttttcttcaaagacagccccctgctgctggtgatggagatgtacgagttgtgtatgtttttcaggaattataaagaagccgaagccaagctcttagagtttcagaagagcctagaaaccttgaatacagctgccaccaaagttcatcctgtgatacccgcaatgtggctggaggatcaggtgtgtttcttgctcaaactcatgttacagcaatgcaaaacccagtacgagctcggaaaacttctgcagctcttcgtggagagagagcacctgttctcagacggcccagacgtgaagaaactctgcattttatgtcaaattctgaaggacacctccatcgcaatcaaccacactattattacctcttacagcatcgaaaacctgcagcacgaatgcaggagtatcctggagcgcttgcaaacggatggtcagtttgctctggcaagaagggtcgccgagctggccgagctgccagtcgataacctcgtgatcaaggaaattactcaggaaatgcaaaccctcaaacacatagaacagtggtcattgaaacaagcccgtattgacttttggaagaagtgtcacgagaactttaagaagaactctataagctccaaagccgcaagcagcttttttagtactcaggcccatgtggcctgcgagcaccctaccggatggagcagcatggaagagcgccacctgctgttaaccctggccggtcattggctcgcccaggaggatgtggtgcctctggacaagctggaggaactggagaaacagatctggctatgtcgcatcacacagcataccctcggcaggaatcaggaagaaaccgaaccacggttttcgagacaaatctctactagtggggaactgagctttgactccctggctagcgagttttcattctctaaactcgctgctctgaatactagcaagtatttggagctcaattccttacccagcaaggagacctgcgaaaaccgcctggattggaaagaacaagagagtctgaatttcctgatcggccgtctgctggacgatggatgcgtgcacgaggcgtctagggtctgcagatatttccacttctacaatcccgatgtggccctggtgctccactgtcgggctctcgcttccggcgaagcaagtatggaggacctgcaccccgagattcatgcactgctccaaagcgccgagctgctggaggaggaagcccctgatattcccctgcggagggtgcactctacatcaagtctggatagccaaaagttcgtgaccgtcccttcgtctaacgaggtagtcactaacctcgaggtgttgacttctaagtgtttgcacggtaagaactattgccgacaggtgctttgtctctatgacttagctaaggagctggggtgtagctataccgatgtggccgcacaggatggcgaagctatgcttcgtaagattctggcctcacagcagcctgacagatgcaagagggcacaggctttcatctccacccaggggctcaaacccgacacagtcgctgaacttgtggctgaggaagtgacaagggaactcctcacttcttcacaaggcaccggccacaaacaaatgttcaaccctaccgaggagagccagacgttcctgcagttgaccactctctgccaggacagaacactggtcggaatgaaactcctcgataagatctcatctgtgccgcacggagaattgtcttgcacgactgagttactcattctagcgcaccactgctttaccctaacatgccacatggaggggattattcgagtcctgcaggcagcacacatgcttactgacaaccaccttgccccaagcgaagaatacggccttgtagttcggctcttgacaggtattgggcgatacaatgaaatgacttacatcttcgatttactccacaagaagcactactttgaagtgctgatgcgcaagaagctggacccttctggaacactgaaaaccgcgttgttagactatatcaaacgctgtcggccaggggatagcgagaagcataatatgattgccctttgtttttccatgtgcagggagattggtgaaaaccatgaggcagccgcacggattcaactcaaacttatcgaatctcagccgtgggaggattccttgaaggatggccaccagctcaaacagttgcttcttaaggctttaactctgatgctggacgcagccgaaagctatgccaaggacagctgcgtgcggcaggcccagcactgccagcgcctgaccaagctgatcacgttgcagattcactttctgaataccggccagaataccatgctgattaatctagggcgtcacaagctaatggattgtatcttagcactgccaaggttttatcaagcctcaatcgtggctgaggcatatgacttcgtcccagactgggcagagatcctgtaccagcaggtaatactgaagggtgacttcaattatttagaagaatttaaacagcagagactgcttaaatccagcatttttgaggagatttccaagaagtacaaacaacatcagcctaccgatatggttatggaaaacctaaagaagttgcttacatattgtgaggatgtgtatctttactacaagctggcatacgagcacaaattttatgagattgtcaatgtcctgctgaaagaccctcagaccggttgctgcctgaaggacatgctggctggtta

SEQ ID NO: 242049 - DNA, 6992 bp, Artificial Sequence
  Description of Artificial Sequence: Synthetic coding sequence
atggcggcagaggagggggtagccagtgccgcatctgctggcggtagctggggtacggcggctatgggccgtgttctgcccatgctgctcgtgccggtccccgctgaagccatggggcaactgggatccagggcgcaactgaggacgcagcctgaagctctgggcagccttacagccgctggaagccttcaggtgcttagtctgacaccgggaagtagagggggagggaggtgctgtctcgaaggacctttttggcactttctctgggaggattccaggaatagctcaacacctacggagaagcccaagttgctagctttaggcgagaactacgagctcctgatatacgaattcaacctgaaggacggcagatgcgatgctacaattctgtacagttgtagcagagaagctttgcagaaactgatcgacgaccaggacattagtatcagtctcctgtcgctgaggatcctcagtttccataataacacttccctgctgttcattaacaagtgcgtgatcctgcacatcatcttcccagaacgggatgctgccattcgagtgttgaattgcttcaccttgcccctcccagctcaggcagttgatatgattattgatacacagctctgccggggtatcctgttcgtactgtcaagtctaggatggatctatatttttgatgtggtggatgggacctatgtcgctcatgtcgatctggccctccacaaggaagacatgtgtaatgagcagcagcaagaacctgcaaagatctccagtttcacatcactgaaagtgtcacaggacttggacgtcgccgtgattgttagcagctcgaactctgctgtcgcactaaatctgaatctatatttccgccagcaccccggtcacctattatgcgagcgaattctcgaggacctgcccatccagggaccaaaaggagtggacgaggacgaccccgtgaattctgcgtataacatgaaacttgcgaaatttagtttccagattgaccggagctggaaggcccagctgtcaagtcttaacgagacaattaaaaacagcaagctcgaagtgagttgttgcgccccttggttccaggatatccttcatctagagagtccagaaagcggtaatcacagtacatcagtgcagtcctgggcctttattccacaggatataatgcatgggcaatacaacgtacttcagaaagaccatgccaagacctctgaccctggcaggtcgtggaaaataatgcacatctcagaacaggaagagccaatcgagcttaaatgtgtgagtgtgactggattcaccgccctgttcacatgggaggttgaacggatgggttacacaataaccctttgggatctggaaacgcagggcatgcagtgcttcagcctaggcactaagtgtattcctgtggattcctcaggcgaccagcagctttgtttcgtgctgacggaaaatggactgtctttgatcctttttggactgacacaggaggaatttttgaaccgccttatgatacacgggagtgccagcactgtcgatacactctgtcacctgaatggctggggcaggtgttcaataccaatccacgccctggaagctggtatcgaaaacaggcagctggacacagtaaacttcttcttgaaatctaaagagaatctgttcaatccgagttccaaaagctccgtctccgaccagtttgaccatctgagctcccacctctacctgcggaacgttgaagagctgatcccggcactggacctgttgtgttccgccattcgtgagtcgtattcagagccacagtccaaacatttttctgagcagctgcttaatctgacgctgagtttcctgaataatcagattaaagaactgtttatacacaccgaggaactggatgaacacctccagaaaggagtgaacattctcacctcctatattaacgagctgagaacgtttatgatcaagtttccctggaagctcaccgacgctattgacgagtatgatgtgcacgaaaacgttcccaaagtgaaggaaagcaatatctggaagaaactgtcattcgaggaggtgattgcctcagctatcctgaataacaagatacctgaggcacaaacattctttcgcatagactcccacagcgcccaaaaactcgaggagctcattgggattggactgaatctggtatttgataatcttaagaagaacaatataaaggaagcctctgagctcttaaagaatatgggatttgacgtcaagggacagctgcttaagatatgcttctatactaccaataagaatattagagatttcctggtcgagatcctcaaagaaaaaaactatttcagcgagaaagaaaagaggaccattgactttgtgcatcaggtggaaaaattatacctcggtcactttcaggagaatatgcagatacagagcttccccaggtactggattaaagaacaggatttctttaagcacaagagcgtgcttgactcgtttttaaaatacgattgtaaggatgagttcaataagcaggatcaccgcattgttcttaattgggcgttgtggtgggatcagctgacgcaggagagtatcctgctgcctcgcatctctccagaggaatacaaatcttactccccagaggctctgtggaggtatttgaccgcgagacatgactggctaaacatcattctgtggatcggcgaattccagacccagcactcctacgcttccctgcagcagaacaaatggcccctgctgacagtcgatgtcatcaatcagaatacgtcctgtaacaattacatgaggaatgaaatccttgacaaactggccaggaatggggtgttcctggcttccgaactagaagacttcgaatgcttcctgcttagactgagtaggattggtggagtaattcaggatacgctgccagtgcaaaactacaaaaccaaagaggggtgggattttcactcccagtttattctctattgtcttgagcatagcctgcagcatcttctgtacgtttacttggactgctataaactgagccccgaaaactgcccattcctagagaaaaaggagctacatgaagcgcatccatggttcgagtttctagttcagtgtaggcaagttgcgagcaatcttacagaccccaaactcatatttcaggcttccctggcaaatgcccaaatcttgatcccaaccaaccaggccagcgtgagttcaatgctgttagaggggcatacattactcgctctggccactaccatgtactctccgggtggcgtgtcccaggttgtgcagaacgaagagaatgagaactgcctgaaaaaagtcgacccccaactattgaaaatggccctaacaccttatccaaagctaaagaccgcactatttcctcagtgcaccccacccagcgtgctgccttcagatataaccatctatcaccttatacagtcgctgtccccatttgaccccagccgcctgttcggctggcaatcagccaatactctcgcgatcggagatgcttggtcacaccttcctcatttctcttcccccgacttagtaaataagtacgcaatcgttgagaggctcaattttgcatactacctgcacaacgggagaccatcttttgccttcggcacgttcttggtacaggagcttatcaagtcaaaaaccccgaaacaactgatccagcaagtaggcaatgaggcatacgtaattggcctcagttcattccatattcctagtatcggagcagcatgcgtgtgttttctggaactccttggactcgattctcttaagttgcgcgttgacatgaaggtggcaaatatcatcctctcctataagtgtcgaaacgaggacgctcaatactcattcataagagagtctgtggcagagaaactttcaaagcttgcagatggcgaaaagacaaccacagaggagctgctggtattgttggaggagggcacatggaattccattcaacagcaagaaatcaaaagattgagcagtgagtcttcgtcccagtgggccctggtcgtgcagttttgtcggctgcataacatgaaactgtcaatctcttatctcagggaatgtgcgaaagctaacgactggctgcagtttatcatccatagtcagctgcacaattaccacccagctgaggtgaagagtttgattcagtacttcagtccagtgatacaggaccacctccggctggcgttcgagaacctgccatcagtgccgacgagcaagatggactccgaccaggtctgcaacaagtgcccccaagaactccaagggtccaagcaggaaatgacagacttgtttgagatccttcttcagtgtagtgaagagcctgactcctggcattggctccttgtggaagctgtgaagcagcaagcccctatcttatctgtgctggcttcctgtcttcagggggcatccgcgatctcctgcctttgtgtttggattattacttctgtggaggataatgtcgctaccgaggcgatgggccatattcaggatagcacagaggatcatacatggaatctcgaagacttgagcgtcatttggcggacgcttttgaccagacagaaatcgaagaccctgattcggggatttcaactattctttaaggacagtccgttgcttctggtgatggaaatgtatgagctgtgtatgtttttcaggaattacaaagaggcagaggcaaagcttctggagtttcaaaaatccctggaaactctgaatacagctgctactaaggtgcacccagtaatccccgcaatgtggttagaagaccaggtatgttttctactgaagctgatgctgcaacagtgcaaaacccagtatgaattggggaagctgctccagttgtttgtagaacgtgagcatttattttctgacggacccgatgtgaagaagctctgcattctgtgccagatactgaaggacactagcatcgcgatcaatcacactatcattactagttactccattgagaacctgcaacacgagtgtcggtccatcctggaaaggcttcaaactgacggccagttcgccctcgctcgcagagtcgcggagctggcagagcttcctgtagacaatctagttataaaggagatcacacaggagatgcagacgctgaaacatattgaacagtggtccctcaagcaggccaggatcgatttctggaaaaagtgccatgagaattttaaaaagaatagcatcagcagtaaggcagcatcttctttcttttctacgcaagctcatgtagcctgtgaacacccaaccggatggtcatccatggaggaacgccacctcctcctgaccctggccggacactggttggctcaggaagacgtggtgccattagacaagcttgaagagctagagaaacaaatctggctctgcaggattacccagcacacccttggccgtaaccaggaagaaactgaaccacggttcagtagacagatttccacttctggagagctgtcattcgactccctcgcttccgagttctcctttagcaaactagcagctctcaacactagtaagtacctggaattgaacagccttccaagcaaggagacctgcgagaaccggttggattggaaggaacaggaaagtttaaattttttaattgggcgtttgctggatgacgggtgcgtccatgaggcttcgcgggtctgtcggtactttcatttctataaccccgacgtggccctagtgttgcattgccgcgcattggcctcaggagaagcttccatggaggacctgcaccctgagatccatgccttgttgcagtccgcggaactgctggaggaggaagcaccggatattcccctgaggcgcgttcactctagacataaacagatgttcaatccaactgaggaaagccagacctttctgcagctcactactctgtgtcaggaccgaacactcgtggggatgaagctgctcgacaagatctccagtgtgccacatggcgagctctcttgcacaacggaactgctgattctcgcccaccattgctttactctaacatgtcatatggagggaatcatccgcgtgctgcaggctgcgcatatgcttacagacaaccacctggccccttccgaagaatacggcctggtggtccggctccttacgggtatcggccgttacaacgagatgacatacatcttcgatctcctccataagaagcactatttcgaagtgctcatgaggaaaaagttagacccctctggcacccttaagacagcattactggactatattaagcgctgtaggcccggtgattcagaaaaacataacatgatcgccctttgctttagcatgtgtagagaaattggggagaaccacgaagccgctgctcggatacagctgaaactgattgaaagtcagccttgggaggattccttgaaggatgggcaccagcttaagcagttgctcctgaaggcgttgacattaatgctggacgctgcggaaagttacgcaaaagattcttgtgtccgccaggcccagcactgtcagagactgactaaattgattacccttcagattcatttcctgaacactggacaaaacactatgcttatcaaccttggacgtcataagctgatggattgcatactggcccttcccaggttttatcaggcctccatcgtggctgaggcgtatgactttgtcccggattgggctgagatcttgtaccaacaggttattcttaagggtgacttcaactatctagaggagttcaagcagcaaaggctactgaaatccagcatctttgaggagatcagcaagaagtataaacagcaccaaccaacagacatggtaatggaaaacctaaagaagcttctgacttactgcgaagatgtctacctgtactacaagctggcatacgaacataagttttatgagatcgttaacgtgctcctgaaagatccccaaaccgggtgttgcctaaaagacatgttggcgggtta

SEQ ID NO: 242050 - DNA, 6239 bp, Artificial Sequence
  Description of Artificial Sequence: Synthetic coding sequence
atggctgccgaagagggcgtagcgtcggctgcgtcagccggaggtagctggggtacagcagcgatgggacgcgtcctgccaatgttgctcgtccccgtgcctgcagaagctatggggcagttaggatccagggctcagctcagaacccagccggaagcccttggatcacttaccgcggcaggtagcctccaggttctcagcctcacccccggatcgagggggggaggtcgctgttgtttagaggggcctttctggcattttctttgggaagactccaggaactcctctacgcccactgagaaacccaaacttctcgcattgggggaaaattacgagctcctgatttatgaatttaatttgaaggacggtcggtgtgatgctaccatcctgtattcctgttctagggaggccttacagaaattaatcgacgatcaagacatttccatctcactcctgtccctgcgcatcttaagtttccacaataacacaagcctgctgtttatcaataaatgcgttattctgcacataattttcccagagagagacgctgctatccgggtcctgaactgctttacgcttcccctccccgctcaggccgtggatatgatcatcgacacacagctctgtcgtggcatccttttcgtccttagctcactcgggtggatctacatcttcgacgtcgtggacgggacctacgtggcccatgtcgacttggctctgcataaggaggatatgtgcaacgagcagcagcaggagccggcaaaaatttcatcatttacatcattgaaggtctcccaggatctcgatgttgctgtgatcgtgtcctcttccaattctgcggtggcgctgaacctgaacttatatttcaggcaacaccccggtcacctcctgtgcgaacgcatactggaggatctaccaatccaaggcccaaaaggtgtggacgaggatgatcccgttaattcggcatataacatgaagctggcgaagttctcatttcagattgacagatcctggaaagcccagctgagtagtctcaatgaaaccattaaaaactcaaagctagaggtttcttgctgtgctccctggttccaggatattctgcacctcgaaagcccggagtctgggaaccactcgacgtctgtgcagtcatgggccttcatcccacaggatatcatgcacgggcaatataacgttctacagaaagatcacgcaaagacaagtgatccagggcgatcttggaaaatcatgcatatatctgagcaggaggaaccaatcgagctcaaatgtgtgagcgtgactgggttcacagcccttttcacctgggaggtggagcgcatgggatataccatcacgctgtgggacctggaaacgcaggggatgcagtgtttttccctcggaactaagtgtattccggtggactcttcaggtgaccagcagctctgcttcgtcctcacagagaacgggctgtccctcattctgtttggacttacacaagaggagtttctcaatcgccttatgatccacgggtcagcatctaccgttgatacactttgccatctcaatgggtggggcagatgttctatcccgattcatgccctggaggccggtattgagaatcggcagttggacaccgtgaatttcttcctgaagagcaaggagaacctgttcaacccttcatccaagtccagcgtaagcgatcagtttgaccatttatctagccatctctatttacgaaatgtggaggagctgattcccgcactggatctgctgtgctccgctattagagagtcgtacagcgagccccagtccaaacacttcagcgagcaattactgaacctgaccctaagcttcctgaataatcaaattaaagagctgttcatccacaccgaagagcttgacgaacatttacagaaaggcgtaaatatactgacgtcctatatcaatgagctcaggacattcatgatcaaattcccctggaaactgaccgacgcaatcgacgagtacgatgtccatgagaatgttcctaaagtgaaagagagcaacatttggaagaaactttcttttgaggaggtaatcgcgagcgccatcctcaataacaagattcccgaggcacaaaccttttttcgtattgatagccactccgcacagaaactcgaggaattgattggcatcggcctcaatcttgtgtttgataatttaaaaaaaaacaatatcaaagaagcaagcgaactcctgaagaacatgggctttgacgtcaaagggcagctgctcaagatctgcttttatacaactaataaaaacatcagggacttcctggttgaaattctgaaggaaaagaattacttctcagaaaaagagaaaagaaccatcgattttgtccaccaagtcgagaagctgtacctgggtcatttccaagagaacatgcaaatccagagttttcccagatactggataaaggagcaggattttttcaagcacaagtcagtcctggattcattcctgaaatatgattgcaaggacgaattcaataaacaggatcaccgtattgtgttgaactgggccctgtggtgggatcagctgacgcaggagtctatactcctccctcgcatttcaccagaggagtacaaaagctacagccccgaagccctatggaggtatctcactgctcgacatgactggctgaatatcatcttgtggatcggagaattccagacacagcacagttacgcctccctgcaacagaacaaatggcctctcctgacggtggacgtgatcaatcagaatacctcctgtaacaactatatgcggaatgaaatcctagataaactcgcccgaaacggggtgttcctcgcttcggagctggaagatttcgagtgttttctgcttcggctgtctcgcattggcggagtgattcaagacacactgccagtgcaaaactacaaaacaaaggagggatgggacttccattcacagttcattctctactgcttggagcacagtctccaacaccttctttacgtctacctggattgctacaagctgagccctgagaattgcccattcttggagaagaaagagcttcatgaggcacatccttggtttgaatttctcgtgcaatgtagacaagtcgctagtaacctcacggaccctaaactgatttttcaggcgagcctggcgaacgctcaaatcctcattcctacaaaccaggcctcagtctcctcgatgctgttggaaggccacactctcctcgccctggccactacaatgtacagtcccggaggcgtgtcccaggtcgttcaaaacgaagagaacgagaattgtctgaaaaaggtcgaccctcagctcctgaaaatggcgcttaccccataccccaagttgaaaacggccctgttcccccaatgcactccaccaagcgtcttgccatctgacatcacaatttaccatctgattcaatcattaagccccttcgatcccagccggttgttcggctggcagtctgccaatactctggccattggcgacgcctggagccatttacctcacttttccagccccgacttggtaaacaagtacgctatcgtggagcggctgaatttcgcatattacctacataatggtcggcctagtttcgctttcggcacctttttggtgcaggagctgattaagtcgaaaactcccaagcaactgatccagcaggtgggaaacgaggcctacgtgattgggctctcttcttttcacatcccatcaatcggggcagcgtgtgtctgtttcctggaactactgggactagattccctcaagcttagagtggacatgaaagtagcgaatatcattctgtcttacaagtgtcggaacgaagacgcccagtattcatttatccgtgagagtgtggccgagaagttatccaaactggctgatggagagaagacaacgacagaagagctgctggtgctcttggaggaaggaacctggaacagcattcagcagcaggagattaaaaggctgagctccgagtcctcttcccaatgggccctggtggtgcagttttgtcgcctccacaacatgaaactctccatctcctacctaagagagtgcgcaaaagccaatgattggctgcagtttatcattcactcacaattgcacaattatcacccagctgaagttaaaagtttgatccagtattttagcccagtgatccaggaccacctccgcctcgctttcgaaaatctgccaagtgtaccaacttctaagatggacagcgaccaggtttgcaataaatgcccccaggagctgcaaggatctaagcaggagatgactgatctcttcgagatcttgcttcaatgtagtgaagagcccgatagctggcactggctcttagtggaagccgtgaaacagcaagctcccatactttctgtgctcgcttcatgcctgcagggtgcctctgcaatctcatgtttatgtgtgtggatcattacatctgtggaggataacgtggcgaccgaggccatgggtcacatacaggatagcacagaagaccacacatggaatctcgaggacctgtctgtgatctggaggactctactgacacgtcagaaatctaaaactttgatcagggggttccagctgttcttcaaagattctcctctcctcctcgttatggaaatgtatgaattgtgcatgtttttcaggaattataaagaggccgaggcgaagttgctcgagttccagaaaagccttgaaaccctgaataccgctgccacgaaggtgcacccagtcatacctgccatgtggctggaggaccaggtgtgtttccttctgaagctgatgctgcagcaatgcaaaactcagtatgaattgggcaagctgctgcagcttttcgtggagcgggaacacctcttctcagacggccctgacgtaaaaaaactgtgtatactctgtcagattctgaaggacactagcattgctataaatcacacaatcattaccagctatagtattgagaacctgcagcatgaatgcagaagcatccttgagaggctgcaaaccgatggtcagttcgcgctagcgagacgggttgcagaactggctgaactgcccgtggacaacttagtgatcaaagaaatcacccaggaaatgcagaccctcaagcacatcgaacagtggagcctgaaacaggccaggattgatttttggaaaaagtgtcacgaaaactttaagaagaatagcatcagcagcaaagcggctagttccttcttcagcacgcaagcccatgtagcctgcgagcacccaacagggtggagttctatggaggaaaggcacctgcttttgaccctcgccggacattggttggcccaggaggacgtggttccactggacaaactggaggaactcgaaaaacagatctggctgtgtcgtattacccaacacacacttggcagaaatcaggaagaaaccgagcctcgcttttccaggcagatttcgacatccggtgaactttcatttgattcattggcatctgagttctccttctccaaacttgccgcactaaacacgtctaagtatctagagcttaattcgctcccatccaaagagacatgcgaaaacaggctagattggaaggagcaggaatccctgaattttttgatagggagacttctagatgatgggtgtgtgcacgaggcttcaagagtgtgccgatatttccatttctacaatcccgacgtagcattggttctgcattgccgagcccttgccagcggcgaggcctccatggaggacttgcatccagagatccatgctctcttgcagtctgcagaattgctcgaagaagaggccccagacatccccctgcgacgggttcacagcaccagttccttagattcgcagaagttcgtgaccgtcccatcatcgaatgaagtggtaacaaacttagaggtactcacatccaagtgtcttcatgggaagaattattgtaggcaggtgctctgtctttatgacctggccaaagagctgggctgttcgtacaccgatgtggcagcacaggatggtgaggctatgttgaggaagattcttgcctcccaacaacccgaccggtgcaagagggcccaagcctttatttccacccaagggctcaagccagatacggtagccgagctcgtcgccgaggaggtcacccgggagcttcttacaagctctcagggcaccggcgctctgccaccgggagactcgcagcctttgta

SEQ ID NO: 242051 - DNA, 2001 bp, Artificial Sequence
  Description of Artificial Sequence: Synthetic coding sequence
atggagcaggagcctcagaacggcgaacccgcagagatcaaaatcattcgagaggcctacaagaaagcatttctgttcgtgaataagggcttaaacaccgacgaactgggacagaaagaagaggcaaaaaactattacaagcagggaataggtcatctgctgcggggtatctcaatctcctctaaagaatcggaacatacgggtccaggctgggagagcgctcggcagatgcagcagaaaatgaaggagaccctgcaaaatgttaggactcggctcgagattcttgaaaaggggctggccacttcactgcaaaacgatctgcaagaagtaccaaaattgtatcctgaatttccacccaaagatatgtgtgaaaagctgcctgagcctcagagttttagttcagctcctcagcacgccgaggtgaatggcaacacttccacaccctccgcaggcgctgttgcagcccctgcaagtctgtctcttccctctcagtcttgtccagccgaggcacctcctgcgtatactccgcaggctgccgaagggcactatacggtgtcttacggtacagacagcggagagttttccagcgtgggcgaagaattctataggaaccactcacaaccgccacccctggaaacgttggggctcgacgccgacgagcttatcctgattcctaatggtgtccaaatcttttttgtaaatcccgcaggcgaggttagcgcgccatcgtacccgggatatctgcgcatcgtgagatttctcgacaactcgctggacacggtgctgaatcggcctccgggatttctacaagtctgcgactggttgtatcccctggtgcccgaccgctctccagtcctcaagtgtactgccggtgcgtacatgttccctgacaccatgctccaagctgccggatgttttgtgggggtggtgctttcaagtgaactgccagaggatgatcgggagctgtttgaagacctcctgaggcagatgtcggacctccggttgcaagcgaattggaatagagcggaggaggagaacgagttccagattccgggtcggactagaccctcttctgatcagcttaaggaggcaagtggcactgatgttaagcagctggaccagggtaacaaagatgtcagacataagggcaaaagaggaaagcgagctaaagacaccagcagtgaagaggtaaacttgagtcacattgtgccttgcgaacccgtgccagaggaaaagcccaaggagcttccagagtggagtgaaaaggtggctcataacatattatcaggagcctcatgggtgtcatggggccttgtgaaaggtgccgaaatcaccggaaaggccatacaaaagggagcctccaaactgagggaacgcatccaaccggaagaaaagccagtggaggtgtccccagccgtgaccaaaggtctatacatcgccaagcaggcgaccgggggagctgccaaggtttcacaattcttggtggatggcgtgtgtacagtagccaattgtgtggggaaggagctggccccacatgtcaagaagcatggttccaagctggtgcccgagagcctcaaaaaagataaggatgggaaatccccgttggacggcgcaatggtggtggccgcttcttctgtgcagggatttagcaccgtctggcagggactagaatgtgccgctaagtgcatcgtcaataacgttagcgcagaaacagtccagacggtgcggtacaagtatggctataatgccggagaagccacacaccacgccgtagacagcgcagttaacgtgggcgtgacggcctataacataaataacatcggcataaaggctatggtgaagaagacggccacacagacaggccacacactgctggaagactatcagatcgtggacaattcacaaagagaaaaccaagaaggcgcagccaacgttaacgtacgtggtgagaaagacgaacagactaaggaggtgaaagaagctaaaaagaaagacaaatag

SEQ ID NO: 242052 - DNA, 2001 bp, Artificial Sequence
  Description of Artificial Sequence: Synthetic coding sequence
atggagcaggaacctcaaaacggcgaaccagccgagattaagatcatccgagaggcatataagaaggcttttctgtttgtcaacaagggccttaacaccgatgagctagggcaaaaggaggaggccaaaaactattacaaacagggcattggacacctactgcggggaatttcgatttcctcaaaggaaagtgaacacacaggacccggatgggaatcggcccgacagatgcaacaaaaaatgaaggaaaccctccagaatgttcggacacgccttgagattcttgagaaagggttggctacctctctgcagaatgacctgcaggaggtgcccaagttgtacccagagttcccaccgaaggacatgtgcgaaaagttgcctgaaccgcagagcttctccagtgcgccacagcacgccgaggtaaacgggaacactagtacgccttcggctggtgctgtggcagcacccgcaagcttgtctctaccatcacagtcttgccccgctgaggcccctccagcttatacacctcaggctgcagaagggcattacaccgtcagctatggcactgacagtggggaattctcgtctgtgggagaggagttttacaggaaccattctcagccgccacctttggagacactggggctggacgccgacgagctgattctgatccccaatggcgtgcagattttttttgttaaccctgccggagaggttagcgccccttcataccctgggtatcttcggatagtgcgtttcttagacaactcgctggacaccgttctgaatagaccgccaggtttcctgcaggtctgtgattggctctatcctttagtgcccgaccggtcaccagtgttaaagtgcactgctggagcttacatgtttccggatacaatgcttcaagcagccggatgcttcgtaggagtagtgctctcctccgaactgccagaggatgaccgggagctattcgaagatctcttacggcaaatgtcggatttgagactgcaggccaactggaaccgggctgaggaagagaatgaattccaaattccaggtcgcacccgccctagctccgatcagctgaaggaagcatccggaaccgatgtaaaacagctggatcagggcaataaagacgtccggcacaaagggaaaagaggtaagagagcaaaagataccagcagcgaggaggtgaacctgagccacatagttccttgtgaacccgtgcccgaggagaagccaaaagagctgcccgagtggtctgaaaaggtggctcataatattctaagcggagcctcgtgggtgtcttggggtctggttaagggggctgaaatcacaggtaaggcaatccaaaagggagcctccaagctcagggagaggatccagcctgaggaaaaaccagtcgaagtgagtcctgcggttaccaagggattatatatcgccaaacaagccaccgggggtgctgctaaggttagccagttcctggtggacggggtttgcaccgtggctaactgtgtgggaaaagaactggcaccccacgttaagaagcacggaagtaaactggttcccgagagcctgaaaaaagataaagatggaaagtcaccgctagacggggctatggtggttgccgcatctagtgtacagggatttagcaccgtctggcagggattagaatgtgccgcaaaatgcattgtgaacaacgtgtccgcagaaacagtgcagacggtaagatacaagtatggctataacgctggggaggcgacgcatcacgccgtcgactctgccgtgaacgtgggcgtgaccgcatataacataaacaacatcggaatcaaggccatggtcaagaagacagctacacaaacgggccatacacttctagaagactaccagatcgtggataactcccagagggaaaaccaggaaggggcagctaacgtaaacgtcaggggagaaaaagatgagcaaaccaaggaagtgaaagaggcaaagaaaaaagacaagtag

SEQ ID NO: 242053 - DNA, 2001 bp, Artificial Sequence
  Description of Artificial Sequence: Synthetic coding sequence
atggagcaagaaccacagaatggagaacccgctgagatcaaaatcatccgggaagcatataagaaggccttcctgtttgtgaataagggcctgaacactgacgaattgggacagaaagaggaggccaaaaactattacaagcaaggcattggtcaccttctgcgcggtatttcaatttccagcaaggagagcgaacatacagggccaggatgggagtccgcacgccagatgcagcagaagatgaaagaaacgctgcaaaacgtcaggacccgcttggagatcctggagaagggattggccacctcactgcagaacgacctgcaggaggtcccgaagctgtaccctgaatttcccccaaaggatatgtgtgagaagctccccgagccgcagagcttcagtagcgctccgcagcatgccgaggtcaatggaaacactagcaccccctcagcaggagctgtagcagcaccagcatctctcagcctgccgtcgcagtcttgcccagccgaggctccacctgcctacactcctcaggccgctgagggccactatacagtctcgtatggaacagactcaggcgagttcagttcagtgggagaagagttttacagaaaccacagccagcctccaccattggagacactgggcctggatgccgatgagctcatattaatcccgaacggagttcagatattttttgtcaaccctgccggagaggtcagcgcaccttcataccccggttatctgagaatagtgagatttctggataactctctggacacagtactgaaccgtccccctggttttctgcaagtctgcgattggttgtatccccttgtgccagatagaagcccagttctgaagtgcacggcaggggcttacatgttcccagacacaatgctgcaagctgcaggctgtttcgtaggcgtggtcctgtcaagcgagctgcctgaggacgatagggagctgtttgaagacctgctcagacagatgtccgatctgcggctgcaggcgaattggaaccgcgctgaggaggaaaacgagttccagatcccaggacgcacccgtccttcttccgatcagctcaaagaagccagcggaacagatgtcaagcaactggatcaggggaacaaggacgtgcgccataagggtaaacggggaaaacgcgcaaaagatacctcttccgaagaggtgaacctgagtcacatcgtcccgtgcgagccagtgccggaagagaaacccaaggagctgcccgaatggtcagaaaaagttgcccacaatatcctatctggcgcaagttgggtgagttgggggctggtaaagggcgctgagatcaccgggaaggccatacagaaaggagcttcaaaattacgggagcgcatccaacctgaagagaaacccgtggaggtgtctccagccgtgactaaagggttgtatatagcgaaacaggcgacgggcggtgccgctaaagtctcacaattcctggtggacggagtctgtactgtcgctaactgcgtgggcaaagaactcgccccacacgtaaaaaagcacgggtcaaaactggtcccagaatccctgaaaaaagataaggatgggaagtctcccctcgacggcgctatggtggtggcagcttcttctgtgcagggattttctacggtgtggcagggcctggagtgcgccgcaaagtgcattgtgaacaacgtaagcgccgaaactgtacagaccgtccgatacaagtatggctacaatgcgggagaagccacccatcatgcggttgactccgctgtcaacgtgggagtgaccgcttataacattaataatatcggcatcaaggccatggtaaagaagactgccactcaaacaggtcatactctgctcgaagattatcagatcgtggacaatagtcagcgggaaaatcaagagggagctgctaatgtgaatgtgcggggagagaaagacgagcagactaaagaagtgaaggaggccaaaaagaaagataagtag

SEQ ID NO: 242054 - DNA, 2001 bp, Artificial Sequence
  Description of Artificial Sequence: Synthetic coding sequence
atggagcaggagccacaaaacggtgaacccgcagaaatcaagattattcgcgaggcctacaaaaaggccttcctgtttgttaataaaggactcaacaccgacgagctgggacagaaagaagaagcaaaaaattattacaagcagggaatcggccacctccttaggggcataagcataagttcaaaggaatccgaacacaccggaccaggctgggaatcagcgagacagatgcaacagaaaatgaaagagactctgcagaatgtgcggactaggctggaaatactggagaagggcctggccacatctctgcaaaatgacttacaggaggttcccaagctgtaccccgagtttccaccaaaggacatgtgcgagaaattgcccgagccccagtcctttagctcagccccacagcacgcagaagttaatgggaatacttccacaccctctgcaggtgccgtagccgctcctgcctcactctcattgccgtcccagtcatgtccggcagaggcaccccctgcatatactccacaggcagccgagggtcactataccgtgtcttatggaacagattccggagagttctcctccgtgggcgaggaattctaccggaaccattctcaacccccaccgttggagactctcggcctcgatgccgacgaactgatattaattcctaacggagttcagatcttcttcgttaaccctgcaggagaagtgtccgcaccgtcatatccaggatatctacggatcgtgagatttctcgacaatagtcttgacaccgtgctcaacaggccacccggattcttacaggtttgtgattggctctacccactggtgcctgaccggtcgccagtgcttaagtgcaccgccggagcctatatgtttcctgacacgatgctgcaagctgcgggttgttttgtcggtgtggtgctttctagcgagcttccagaagatgatagagagcttttcgaggacctgctgcggcaaatgtccgacctccgcctgcaggcaaattggaaccgggcagaagaagagaatgaatttcaaatccctgggcgaacgaggccttcatccgaccaactcaaggaggccagtggtaccgacgtgaaacagctggaccagggaaataaggacgtgcggcacaagggcaaacggggtaagcgcgctaaggatacttcttcagaggaagtcaatctctcccacattgtcccttgtgagccagttccagaggagaagccaaaggaactgcccgagtggtctgagaaggtggctcacaacattttatcaggcgcttcttgggtgtcttgggggctcgttaagggagcagaaatcacaggcaaagccattcaaaagggcgcatctaagctgcgcgaaaggattcagccagaggaaaagccggtcgaagtctcaccagctgtgacaaaaggcctgtatatcgctaaacaggctactggcggagccgcaaaggtttcccagttcctcgtcgacggggtatgtacagttgccaactgtgtgggcaaagagcttgccccacacgtaaaaaaacacggctctaagctggttcctgaaagtctgaaaaaagacaaggacggcaagtctcccctagatggtgccatggtggtggcagcgagcagcgttcagggcttctcaactgtttggcaggggctcgagtgcgccgcaaagtgcattgtgaacaacgtctctgccgagactgtgcaaaccgtcagatataagtatggttacaatgccggtgaggccacacaccatgcagtggatagcgccgtgaacgtaggggtcaccgcctacaatataaataacatcggcatcaaggcaatggtgaagaaaactgccacacagacaggccacactctgctcgaggattaccagatcgttgataatagccagcgggaaaaccaggaaggagcggctaacgttaatgtgagaggagagaaggacgagcagaccaaggaagtcaaggaggctaaaaaaaaggacaagtag

SEQ ID NO: 242055 - DNA, 846 bp, Artificial Sequence
  Description of Artificial Sequence: Synthetic coding sequence
atgggagagatcaaggtgtcccctgattacaactggttccggggtactgttccgctcaaaaaaatcatcgtggatgatgatgacagcaagatctggtctctttacgatgctgggcctagatctataagatgtcctctgatttttctgcctcctgtgtctggcaccgcggacgtcttcttcaggcagatcctggcactcaccggttgggggtatcgcgtcatagccgtccacttgttcggggctagcttggggggatttctcgctcagaagttcgcagaatacactcacaagagtcccagagtacattcactcatcttgtgtaatagtttctctgatacgagcatctttaatcagacgtggactgcgaacagcttctggctcatgccagcttttatgctgaagaaaatcgtcttaggcaattttagctccggcccagtggatcctatgatggccgatgccatcgactttatggttgacagactggagtcgctggggcagtctgaactcgcttctaggttaaccctgaattgtcagaactcatatgtagaaccacataagatccgggatattcccgtcactatcatggatgtgttcgatcagtccgccttgtccacggaagccaaggaggagatgtacaagctgtaccctaacgcacgcagggcgcatctcaagacaggcggtaacttcccttatttgtgtcggtcagctgaagtgaacttatacgtgcaaatccatcttctgcagtttcatggtacaaaatacgcagcaatcgatccatctatggttagtgccgaagaacttgaggtgcagaaaggatccctgggaatcagccaagaggagcaatag

SEQ ID NO: 242056 - DNA, 927 bp, Artificial Sequence
  Description of Artificial Sequence: Synthetic coding sequence
atgggtgaaatcaaggtcagccctgattacaactggttcagagggaccgtcccactcaagaaaataatcgttgacgatgacgactcaaagatctggagcctctatgatgcaggaccaagatctatcaggtgtccactgatctttctgccccctgtatcagggaccgcggacgtcttcttcagacagattctggctcttactgggtggggctaccgcgtgatcgcgctgcaataccccgtgtattgggatcacctggagttttgcgacggatttcggaagctcctggatcatttgcaactcgacaaggtgcacctctttggggcttctctgggcggtttcctggcccagaaattcgcggagtacacacacaagtcacccagagtgcattcgctgatcttgtgtaactcattttccgacacgtcaattttcaaccagacgtggacagctaactctttttggctaatgccggcatttatgcttaagaagatagtacttggtaatttttccagcggcccagtggaccccatgatggcagatgccatcgacttcatggtcgacaggttggaaagcttaggccagtcagaactagcaagtcgcctcactctgaattgccagaacagctatgtggagccccataagatcagagacattccagtcaccataatggacgtgtttgaccaatcagcgctctctacggaggcaaaggaggaaatgtataagctatatcctaacgcgcgaagagcacacctgaaaacagggggtaactttccctacctatgccgctcagccgaagtaaacttgtacgttcaaattcacctgctgcaattccacgggacgaaatacgccgctatcgacccatcaatggttagcgctgaggagttagaagtccagaagggctcactgggaatttcccaggaggaacaatag

SEQ ID NO: 242057 - DNA, 927 bp, Artificial Sequence
  Description of Artificial Sequence: Synthetic coding sequence
atgggggagatcaaggtgagtccggattataattggtttcgcggaaccgtccctttaaagaaaatcatcgtggacgacgacgatagcaaaatctggagtctctatgacgccggaccgaggagtattcggtgtcccctcatattcctgccacctgtaagtggcacagcagatgtgttttttagacagatactcgcactgacaggatgggggtacagagtgattgcacttcagtatcccgtctactgggatcacctggaattctgcgacggctttcggaagctcctggaccacctgcagctcgataaagtccaccttttcggagcatccttaggaggctttctcgcccaaaagttcgccgaatatacacacaaatccccccgagtgcacagtctgatattgtgcaattcgttcagtgacacaagcatcttcaatcagacatggaccgctaactccttctggctgatgcctgcgtttatgttgaagaagatcgttctgggtaactttagctcaggccctgtcgatccaatgatggctgacgccatcgacttcatggtggatcgcctggaatcgctaggccagtcggagcttgcctcacgcctcactctgaattgccagaatagctacgtcgagccccataaaattagggacattcccgtgacgatcatggacgtgtttgatcagagtgccctgtccacggaggctaaagaggaaatgtataagctgtaccccaacgctcgcagggctcatctgaagaccggcggaaacttcccctatctttgtcgttccgcagaggttaacttgtacgtgcagatccatctgctgcaatttcacggaactaagtacgcggcaatcgatccttctatggtgtcagccgaggagctcgaggtccagaagggatccttagggatctctcaggaggaacaatag

SEQ ID NO: 242058 - DNA, 2388 bp, Artificial Sequence
  Description of Artificial Sequence: Synthetic coding sequence
atggcggtgctgttgctactgctgcgtgcattaagacgaggccctgggccaggtccgagacccctgtggggaccgggacctgcgtggtctcctgggtttcccgcacggccaggtcggggtagaccgtatatggccagtcgcccacctggcgatcttgccgaggctggcggacgggctctacagtccttacagttgcgcctcctaactcccacttttgaggggataaatgggctgcttctgaagcagcatctggttcaaaatccggtgagactctggcagttattgggcggtacattttacttcaatacttcccgacttaagcaaaagaacaaagaaaaagacaagagcaagggtaaagccccagaagaggacgaggaggagaggaggcgcagagaaagggacgatcaaatgtatagagagcggctgaggaccctgttggtgatcgctgtagtgatgtccttgttgaacgctctctctacaagcggtggtagcattagctggaatgattttgtgcacgagatgctggccaaaggggaggtgcaacgtgtgcaggtagtacccgagagtgatgttgttgaggtgtacctgcaccctggcgctgtggttttcgggagaccacgccttgcattgatgtacaggatgcaggtggccaatattgacaagttcgaggagaagctgcgcgctgcagaggacgagctgaatatcgaagcaaaagacagaatacccgtgtcttataaaagaaccggcttctttggaaatgcactctactcagtgggcatgaccgccgtgggtctggcaattctgtggtatgtcttcagactggcaggaatgaccggacgcgaggggggattttcagcctttaatcaactcaaaatggcccgtttcaccattgtcgacggcaagatggggaaaggggtgtcctttaaagacgtggccggtatgcatgaagccaagctcgaggtgagagaattcgtagactatctgaaaagtcccgaacggttcctgcagctaggtgctaaagtgccgaaaggggctttgttattagggccaccaggatgtggcaagacgttactagccaaagcagtggctacggaggcacaggtcccctttctggctatggcagggccagaatttgtcgaggttatcggaggactgggagccgcacgggtgagaagtctgtttaaagaagccagggcgcgtgctccatgtatcgtatatattgacgagatcgacgccgtcggaaagaagcgtagcacaacgatgagcggttttagcaatacggaggaagaacagacactgaaccagctgcttgtcgagatggacggaatggggacaacggaccacgtaattgtgttagcttcaacaaatagggctgacattttggacggtgccctaatgaggccaggacgactggatcgccatgtgttcatagacctccccacgctgcaggagcggagagagatctttgaacagcacctgaagtcgctgaaactgacccaaagcagcaccttttatagccagagattggcagagctgactccaggattctccggtgcagatatcgccaacatttgcaatgaggccgcattgcacgctgctcgcgagggccacacatctgtgcacacactaaatttcgagtacgcggttgagagagttcttgccggaacagctaagaagagtaaaatactatctaaggaagaacagaaggtcgtggccttccacgaatctgggcacgcccttgtgggctggatgctcgaacacaccgaagctgtgatgaaagtcagtattactcccagaacaaatgccgctctgggttttgcccaaatgctacctcgggaccagcacttgttcactaaggagcaacttttcgaaagaatgtgcatggcgctcggaggtagggcatctgaggcactgagttttaatgaagtgacttccggcgcacaggatgacctgcgaaaggtcacaagaattgcttattctatggtgaaacaatttgggatggctcccggtatcggacccatttcgttccccgaagcacaggagggactgatgggcataggtaggcgaccattttcacagggactccagcagatgatggatcacgaggcaagactgctcgtggccaaggcttaccgtcacaccgaaaaggtcctgcaagacaaccttgacaagctacaggcactcgccaacgccctgctcgaaaaggaggtcatcaattatgaagatatagaagctttgattggacctccgccacacggacctaaaaaaatgatagctcctcagcgctggatagacgctcagcgcgagaagcaggatctgggcgaagaagagacagaggaaacccagcagcctcccttggggggtgaggagccgacctggccaaagtag

SEQ ID NO: 242059 - DNA, 672 bp, Artificial Sequence
  Description of Artificial Sequence: Synthetic coding sequence
atgaggcttaggtgtactcgaagggggagggatactttgccctgcacactcagcactagcagcaccccctggagtgcctccagccaagttcccagggcacagttgggaaaagctgtcggcagctgccgcggagtgggctcctgctgtgcgagacactgtaaaacccacctggcctctctgcggcagccttgtggggagcgcacaggcgcagcttgtgttctgctgatctacttccgcgtgactatctacttctatgtagaaatcgaaaagcttctgattatcgtggccaagcaagaaggtctgtccgggaatcataaacccgttgagcgcaaatacatgacttacctgagcgcacaggatcacgagctgattcaggttgtccagaacggacaccttcagatgtgtggaaaatccgagacgggcaatgaagcctctcccggactgcctaaaagagccaggtcatgtcctcgcaagaataggaagtggctgaggtttatgtctcgtgccacgccctggtgggcaggatgttggtccacacggagggacgagggtctccacaatccttcgaccaacgctgcgttagggttcgcacaggccccacagcgccctgctcccctgcatgagcagctttttgaacgtatgtgcatggcattaggaggtcgtgctagctag

SEQ ID NO: 242060 - DNA, 618 bp, Artificial Sequence
  Description of Artificial Sequence: Synthetic coding sequence
cttggaccccaggcatgtactgtcgtcccacgtagcaaatgcttcgatctggagatggtgtcctctagatgggagccactccttcttctcaccgaggtgacatccgcaaatgaggtgtgggtcacgagcaactccacagcacttgtgttcgtgtccgataatgtccgcgaggaacttgaggaggttcaagatctgctttgtcgcacattgcctctgccagtgcaactgtcttttcccgaagaagcgctcgacgtcgctcgcgtagctcacgtttttgtgagtccgttttgcttcagtgctggatccgaagaacgcaggcgcagagagcgcgacgatcagatgtaccgggagcgactgcgcacactgctggtgatcgcggtggtcatgtcacttctgaatgctctttctacctcaggtggttccatctcatggaatgatttcgtgcacgaaatgctggcaaaaggagaagtgcagcgcgtgcaggtagtccccgagtctgacgtggttgaagtctaccttcaccccggagcggtcgtcttcggacgacccagactagcgttaatgtatcgaatgcaggtggcaaacatcgataaattcgaggagaagttaagagcttag

SEQ ID NO: 242061 - DNA, 1470 bp, Artificial Sequence
  Description of Artificial Sequence: Synthetic coding sequence
atggctgtcctgctgcttttgcttcgggcactacgaagaggccctggacccggaccaaggccattgtgggggccaggaccagcctggtcccccggattcccggctcgcccagggaggggcaggccttacatggcctcccgaccacccggtgatctcgctgaagctgggggacgcgctctgcagtccttgcagttgagactgctgactccgacttttgaaggcataaatggactgctgttaaaacagcacttagtgcagaatccagtccggttatggcagcttttgggcggaaccttctatttcaacacctccagattgaagcagaagaacaaggagaaggacaagtccaaagggaaggctcctgaagaggacgaagaggagcgcaggagaagagaaagagacgatcaaatgtacagggaaaggctcagaacccttttagtgatcgcggtcgttatgtccctgctcaatgccttaagtacgagcggtggtagcatcagctggaatgacttcgtccacgaaatgctcgccaagggagaggttcaacgagtgcaggtggtccctgaatcggacgtcgtggaggtgtatttgcatcccggtgcggtggtgttcggtcggccacggctggctcttatgtacagaatgcaggtcgcgaatatcgacaaattcgaagagaaactgagggcagccgaggacgaactgaacatcgaggccaaggatagaattcccgtgagttataagcgtaccggcttttttggcaacgctctatatagtgtgggaatgaccgcagtaggtctggccattctctggtacgtattcaggctggccggtatgacggggcgtgagggtggcttcagcgcgtttaaccagctgaaaatggccaggtttactatcgtcgacggcaagatgggaaagggcgtatccttcaaggatgtcgctgggatgcacgaggccaagctggaggtgagagagttcgtagattatcttaaatccccagagaggtttttgcagctgggagctaaagtgcctaaaggtgcactgctgctcggcccaccaggctgtggcaaaacactcctggccaaggcagtcgctaccgaagcccaggtgccgttcttggctatggccggacccgagttcgtggaggttattggtggtctgggggctgcacgcgttcgctcactgtttaaagaggccagagcccgtgctccttgcatcgtttacatcgacgagatcgatgctgtgggcaagaaacgatcgactaccatgtctgggttttcaaataccgaggaggaacagaccctcaaccagctgttggtggagatggatggggcatccctcgaccagctgccctctcagggcacgatgagaaagctccgaggcaagactcccgcttgctcgtgtttgactgaacctacaggcagtcgcagagcaatggaaggccatagtctctgttggggctgccttctgcactag

SEQ ID NO: 242062 - DNA, 1851 bp, Artificial Sequence
  Description of Artificial Sequence: Synthetic coding sequence
atgaactccccaggcggacgaggcaagaaaaaaggatctggcggtgcctctaatccggtgccccctcggcctcctcctccgtgcctcgcaccagcacctcctgccgctggcccagcccctccacctgagtcgcctcataagcgcaacctctactatttttcctacccattgttcgtgggtttcgccttgctacggctggtggcattccatctgggccttctcttcgtgtggctctgtcagcggttcagtcgcgcattgatggccgctaagaggtcttcaggagccgctccagcgcctgcttccgcctccgcaccagcccctgtgcctgggggagaggccgaacgcgtccgggtctttcacaaacaggcctttgagtacatttcaatcgccctcagaatagacgaagacgaaaaggctggtcagaaggagcaagccgtggaatggtataagaaggggatagaagagctcgaaaagggtatcgcggtaatcgtgacgggccagggggaacagtgtgagcgtgcgagaaggcttcaggccaaaatgatgactaacctggtaatggcaaaggatcgcctgcagctgctggaaaaaatgcagcccgtactacccttttccaaaagtcaaaccgatgtctacaacgacagcacgaatctggcatgtcgaaatggtcatcttcagtctgagagtggtgcagtccccaaaaggaaggatcctctaacccacacgagtaactcactgccaagaagtaaaacggtgatgaagacgggttcagctgggcttagcggccaccatcgcgcaccctcatactctggcctgtcaatggtatccggggtcaagcagggaagcgggcctgctcctactacgcacaaaggcacaccgaagactaaccggaccaacaagccttccacaccaaccacagcgacccgcaaaaaaaaggacctgaaaaacttcagaaacgttgatagtaacttagcgaacctgataatgaacgagatcgtggacaatggcaccgccgtgaaattcgacgacattgcgggtcaggacctggcgaaacaagccctccaggagatcgtgattttgccaagcctccgcccagagctttttaccggcctgcgcgcaccggctagaggtttactgctctttgggccaccaggaaacggaaaaactatgcttgctaaggccgtcgcggcagaaagtaacgccaccttcttcaatattagcgcagcttcacttacctccaagtatgtgggcgagggagaaaaacttgtgcgagcactctttgcagtagcgagggagctacaaccgtctattatttttatcgatgaagtggattcactgttgtgcgaaagacgcgaaggggaacacgacgcgtcacgccgattgaaaactgaattccttattgaatttgacggggtgcagagcgccggagatgaccgggtcttggttatgggggctacaaataggccccaggagctcgatgaggcagtgctgagaagatttattaaacgggtctatgtctcgctccccaacgaggagactcgccttctccttctaaagaaccttctgtgtaagcaaggctcaccgctaacacagaaagaactggcgcaattggcccgaatgacagatggttacagtgggtctgatttgacagcactggctaaggacgctgctctgggccctatacgcgaactgaagcctgaacaggtcaaaaacatgagcgcctccgaaatgagaaatattagattgagcgattttacggaatccctgaaaaagatcaaacgctctgtgtccccgcagactcttgaggcatacattagatggaataaagatttcggtgacactaccgtgtag

SEQ ID NO: 242063 - DNA, 1755 bp, Artificial Sequence
  Description of Artificial Sequence: Synthetic coding sequence
atgaactccccgggtgggaggggaaagaagaaggggagcggaggagccagtaaccctgtacccccacgaccacccccaccctgcttggcaccggcaccaccagccgcagggcctgcaccacctcctgagagcccacataagcggaatctgtactacttttcctacccgctcttcgtgggcttcgctttgctgcgacttgtggctttccacctcgggctcttgttcgtgtggctctgtcagcggttcagtcgtgctctcatggcagcaaaacgttctagtggcgcagccccagcgccagctagcgcttcagcccctgccccagttccgggaggggaggcagagcgggtgcgggtgtttcacaaacaggcgttcgaatatatctccattgccttgagaatcgatgaagatgaaaaggcgggacaaaaggaacaggcggtggagtggtataagaaggggatagaggaactggaaaaaggcatcgccgtgatcgtgacaggccaaggggaacaatgtgaacgcgctaggcgcctgcaagccaaaatgatgacaaatctcgtgatggctaaggatcgtttgcagctgttggagtcaggagcggtcccaaagcggaaggaccctctgacgcacacctctaactcccttccaagatcaaagacagtcatgaagacgggatcagcagggctctcaggacaccaccgagcccctagctacagcggcctcagtatggtctcgggcgtaaaacagggctcggggcctgcccctaccacacataaaggcacccccaagaccaacaggacaaataaacccagcactcctaccaccgctactcggaagaagaaagatttgaagaacttccggaacgttgattcgaacttggctaatttgattatgaatgagatagtggataacggaacagccgtgaagtttgacgacatcgcaggacaggatttagccaagcaggcattgcaggagatcgttatcctgccttccctgcggcctgaactgtttaccggcttacgggctcccgctcgcggactccttcttttcggcccacctggaaacggcaagacaatgctggccaaggctgtggctgcagagagtaacgccacctttttcaatatctctgccgcatcactaacttcaaagtacgtcggtgagggggagaagctagtccgtgccttgttcgcggtcgccagggagttgcagccatcaattatattcatcgacgaggtcgactccctgctgtgtgagagaagggaaggagagcatgatgcctcacgtcgtctcaagaccgaattcctcatcgagttcgacggagtgcagagcgcaggtgatgaccgagtgctggtgatgggggcaactaacaggccacaggagctagatgaagcagtcctgcgtcgtttcattaaacgcgtgtacgttagtctgccaaatgaggagactagactgctgttactcaaaaatctgctctgcaaacagggttcccccctgacacagaaagaattggcgcagctcgctcgcatgaccgatggctattcggggtcagatttgaccgccctcgctaaggacgcagccctagggcctatccgagaactgaagccagaacaggtgaaaaacatgtccgcgtccgaaatgcgtaatatccgtctgagcgatttcacagaatctctgaagaagatcaagcggtctgtgtctccacagacattagaggcctacatacgctggaacaaagatttcggggatactactgtgtag

SEQ ID NO: 242064 - DNA, 26393 bp, Artificial Sequence
  Description of Artificial Sequence: Synthetic coding sequence
atggcgaccagtagaggcgcaagtcgatgtcctcgggacatcgcgaacgttatgcaacggttacaagatgaacaggagattgtgcagaagagaacattcaccaagtggatcaattcccacctggctaaacggaaacctcccatggtggtcgacgatctgtttgaggacatgaaagacggggtgaagctgctggccctcttggaagtgctttcgggccagaagctgccctgcgaacaaggaaggcggatgaaacggatccacgccgtagctaacataggcaccgccctgaaattcctcgaaggcaggaagattaaacttgtcaatattaactctaccgatatcgccgatggcaggccatccatagtgctgggactcatgtggacaattatcctctattttcagatcgaggagttgaccagcaacctccctcagcttcagagcctgtcatcctccgcctcttctgtggattccattgtcagctcagaaactccctcccctccttccaaaaggaaggtaacaactaagatccaaggcaatgcaaagaaagccctgttgaaatgggtgcagtacacggccggtaaacaaaccggaattgaggtgaaagactttggaaagtcctggaggtccggcgttgccttccacagtgtcattcacgcgatcaggccagagctcgtggacctcgagactgtgaaaggcagaagcaaccgagaaaacctagaagatgcattcacaatagctgaaaccgagcttggtattcccagacttctggacccagaggacgtggacgttgacaaacccgatgaaaagagtatcatgacatacgtggcgcagtttctgaagcactatccagatatacacaacgcatccaccgatggccaggaagacgacgaaatcctgcccggatttcccagttttgccaattctgtgcagaactttaagcgggaggaccgtgtgatctttaaagagatgaaggtgtggattgagcagtttgaacgggacctaacccgcgctcaaatggtcgagtccaacttgcaggataaatatcagtccttcaagcattttcgagtccagtacgagatgaaacgaaagcagatcgagcacctgattcagcccctccatagggatgggaagttgtctctggatcaagccctcgtcaaacaatcctgggatagggttacttcgcggttatttgactggcacatacagttggacaagtccctgcccgctcctctcggaaccatcggagcgtggctctaccgggcagaggtcgcgcttcgcgaagaaatcactgtgcagcaggtacatgaggagaccgccaacactattcagcgaaagttagagcaacacaaagacctcttacaaaataccgatgcccataagcgagcgttccatgagatatatcgtactagaagcgtgaatggcattcccgtaccaccagaccagctggaggacatggccgaacgatttcattttgtctctagtaccagtgaattacacctgatgaagatggagttcttggagctgaaatataggctcctgtccctgcttgtgctcgctgaaagtaagctcaagtcatggatcattaaatatggtagaagagagtccgttgaacagctgctgcagaattacgtttccttcatcgagaatagcaaattttttgagcaatatgaggtaacataccagattctgaagcaaaccgctgagatgtacgtgaaggctgatgggagcgtggaggaggctgagaacgtgatgaaatttatgaatgagacgaccgctcagtggagaaatctctccgttgaagtccggtcagttagatctatgctcgaggaggtaataagcaattgggatagatatggtaacactgttgcgtcactgcaagcatggttagaagacgccgagaagatgctgaaccaatccgaaaacgccaagaaggatttcttccgaaatttacctcactggatccagcagcacaccgccatgaacgatgctggcaatttcctaatcgagacgtgcgacgagatggtgagccgggatctaaaacaacaacttctgctgcttaacggaaggtggcgggaattgtttatggaggtgaaacagtatgcccaggctgatgagatggaccgcatgaaaaaggaatacacagactgcgtggtgaccctgtcagctttcgccactgaagctcacaagaagttgtctgagcccttggaagtttcctttatgaatgtaaagctacttatccaggatttggaagacattgagcagagggtaccagtaatggacgcccagtataaaatcatcactaagaccgctcatctaataaccaaggaatcccctcaggaggagggtaaggaaatgttcgccaccatgagtaaactgaaagagcagctcacaaaagttaaggagtgttactctcccctgctgtacgaatcccagcaattgctcatcccactggaggaactagagaaacagatgaccagcttttatgatagccttgggaagatcaacgagatcatcactgtgctggaacgagaagctcagagctctgcactgtttaagcagaaacatcaggagctactggcctgtcaggagaactgcaagaaaaccctgaccctgattgaaaaaggatcacagagtgtccagaagttcgtgacccttagcaacgttctgaaacactttgaccaaacaaggctgcagcgccagatcgctgatatccacgtggcgttccagagcatggtcaaaaagacaggtgactggaaaaaacatgtggagaccaatagcagacttatgaaaaaattcgaggaatccagagcagagctggaaaaagtcctgcgaattgcccaagaaggactcgaggagaaaggagaccctgaagaattactgagacgacatactgagttcttcagtcagctcgaccaaagagtactcaacgcattccttaaagcctgtgatgaactaacggacattctccctgagcaggagcagcaaggtcttcaggaagccgtgaggaagctgcataagcaatggaaagatcttcaaggcgaagccccatatcatctcttacacttgaagattgacgtcgaaaaaaacagattcttggcctccgtggaggagtgtagaactgaactggaccgtgagacaaagctgatgccccaggaggggagcgaaaagattatcaaagaacaccgagtctttttcagtgacaagggtcctcaccacctctgtgaaaaaaggctgcagctgattgaagagctgtgcgtgaagctacctgttcgggatcctgtgagggacacaccaggaacttgtcacgttactcttaaggagctacgggctgcaatagactctacctaccgcaagcttatggaggaccccgacaagtggaaggactataccagccggttctccgagtttagcagctggatatctactaacgagacacagctgaaggggatcaagggggaggccatcgacacagctaaccatggcgaggtaaagagggcggtcgaagagatacgaaatggggtgaccaaacgaggcgaaacgcttagttggttgaaaagccgactcaaagtgctgactgaggttagcagcgagaacgaagctcagaagcagggagatgagctcgccaagctgtcgagtagttttaaggctttggttacgctgctgtcagaagtggagaaaatgctctccaacttcggggactgtgtgcaatacaaggagatcgtcaaaaacagccttgaggagctcatctcgggtagtaaggaggttcaagagcaagctgagaagatcttggacactgagaacctttttgaggcccaacaactcttgctgcaccaccaacagaagacaaagcgcatcagtgccaagaagagggatgtgcagcaacagatcgcccaggcccagcagggggaaggaggcctgcccgaccgcggacacgaagagctgaggaaacttgagagcactctggacgggctcgagagaagcagagagcggcaggaacggaggatccaggtgaccctgagaaagtgggaaaggttcgagaccaacaaagaaaccgttgtcagatacttgttccagaccggcagtagccacgagcggttcctctcctttagttctctcgaatccctgtcatcagaactggagcaaaccaaggagttttcgaagcgaaccgagtctatagctgtgcaggctgagaacctcgtcaaagaagcatcggaaattcctctaggaccccagaataaacagttactccaacaacaagccaagagcatcaaggagcaagtgaagaagttggaagatacactcgaggaagatattaagacgatggagatggtaaagaccaagtgggaccacttcggctcaaacttcgagacactgagcgtgtggatcaccgagaaggagaaggagctcaatgctttggaaaccagctctagcgccatggacatgcagattagccagatcaaggtgaccatacaggagattgaaagcaaactttctagcattgtagggctcgaggaagaggcccaaagtttcgcccagtttgttactacaggcgagtccgcacgaataaaggccaagctcactcaaatccgcaggtacggcgaagagctcagggaacatgctcagtgcctggaaggaaccattttgggacacctgagccagcagcagaagttcgaagagaatctgcgcaagattcagcagtccgtgtccgaattcgaggacaagctcgcagtgcccattaagatatgctctagcgccacagagacatacaaggttctccaagaacatatggatctgtgccaggccttagaaagcctgtccagcgcaattaccgcattcagcgcaagcgcccgaaaagttgtgaatcgagattcctgcgtgcaggaagcagcagcgttacagcagcagtatgaagacattctgagacgggcaaaagagcggcagaccgccctggagaacctccttgctcattggcagcgcctcgagaaggagttgagtagctttttgacctggctggagcggggtgaagccaaggcttcttcacccgagatggacatttccgctgatcgtgttaaggtcgagggagaactccaattaatccaagcactgcagaatgaggtggtttctcaggccagcttctacagcaaactgctccagttaaaagagtcactttttagcgttgcttccaaggatgatgtcaagatgatgaagctgcatcttgagcagctggatgagcggtggcgggacctccctcagatcattaataaaagaattaatttcctgcagtctgtagtggctgagcaccagcaattcgatgagctattgctctctttttctgtgtggatcaaactgtttctctccgaactccagacaacgagcgaaatctcaattatggatcaccaggtggccctgactcgacacaaggatcatgcagccgaggttgagtctaaaaagggtgaacttcagagtctgcagggacacctggcgaaacttgggtccctgggacgggctgaagatctgcatctcttacaggggaaggcagaggattgttttcagctgtttgaagaggcctcccaggtggtggagcggaggcaattagccttgagccacttagctgagttccttcagtcgcatgcttctctgtccggtatcctgcgtcagttgaggcagaccgtagaagctacgaatagcatgaacaaaaatgagtctgacctcattgagaaagacctcaacgacgcgctacaaaatgcgaaagccctggagtcagctgccgtcagcctggacggcatcctttctaaggcgcagtatcatctgaaaataggctccagcgagcaacggacctcttgcagggcgacagccgatcagctgtgcggagaagtcgagcgcatacaaaacctgctcggcaccaagcagtctgaggccgacgcgctggccgtacttaaaaaagcatttcaagaccaaaaggaggagttactaaaaagcattgaggatatcgaagaacggactgataaagagcgcctgaaggaacctacgagacaggctctgcaacagagacttcgggtgttcaaccagctcgaggatgagctcaatagccatgagcacgagctttgttggttgaaagataaggcaaagcagatcgcccagaaggatgtggccttcgctcccgaagtggaccgggaaattaatcggctggaggtgacctgggatgacacaaaaaggttgatccatgagaatcaaggtcagtgctgcgggttaatcgaccttatgcgtgaataccagaatctcaaatctgcagtctcaaaggttctcgagaatgcgagctcggtgatagtgactaggaccactattaaggaccaggaggatctgaagtgggcattttcaaagcatgaaacagctaagaacaaaatgaattacaaacagaaggatctggataactttaccagtaaaggtaaacacctcctgagcgaactaaagaagattcacagtagcgattttagcctggtgaagaccgacatggaaagcactgtcgacaaatggttggacgtatctgagaagctagaggagaacatggacagattgcgcgtgtcactgagtatctgggacgacgttctcagcactagagatgaaatagagggctggagcaacaattgtgtcccacagatggctgaaaacatcagtaatctggacaatcacttgcgagcagaggagctgttaaaggagtttgagtcagaagtgaagaacaaggcgctgcggctggaggagttgcattcgaaggtgaacgacctgaaagagttgactaagaacctggagactcctccagacctccagttcatcgaggccgacctgatgcagaaactggagcatgccaaagagataacagaagtagccaaaggaacactgaaggatttcacagctcagagcactcaagttgagaaattcattaacgacatcaccacatggtttactaaggtggaggaatcgttgatgaattgtgctcagaacgagacgtgcgaagcacttaagaaagttaaggacattcagaaggagttgcaatcccagcagtctaacatctcctcgacccaagagaatcttaactctctctgcagaaagtatcatagcgcagagctggagtctctgggccgtgctatgactggactgataaaaaagcatgaggcagtaagtcagctttgcagcaagactcaggcatccctgcaagagtcactggagaagcacttcagcgagagcatgcaggagtttcaggagtggttcctaggggcaaaagccgctgccaaagaaagctctgaccgcacgggcgattctaaagttctggaggccaagctgcacgatttgcagaatatcctggactctgtgtcggacggacaatcaaaattggacgccgtcacacaagagggccaaacactgtacgcgcacctttctaagcaaatcgtctcctcaatccaagagcagatcaccaaggctaacgaagagttccaggcatttttgaagcagtgtcttaaggacaagcaagcactgcaagattgcgcctccgagctgggatcgtttgaggatcagcaccggaaacttaacctctggattcacgagatggaagagagatttaatacagagaatctaggtgagagtaaacagcacataccagaaaagaaaaatgaggtccataaggtggaaatgtttttaggcgagctgctggcagcacgggaatctcttgataaactatctcagcgcggacagcttctaagcgaggagggacacggggctggacaggagggccgtctgtgcagccagctgcttacctcccaccagaacctcctgaggatgactaaggagaagctgcgcagctgccaggtcgccttacaggaacatgaggccttggaggaagccttgcagagtatgtggttctgggttaaagctatccaagatcgactggcctgtgcggaaagcactcttggctctaaagacacactcgaaaagaggcttagccagatccaggatatattgctcatgaagggtgagggcgaagttaaacttaacatggctatcgggaaaggcgagcaggctctcagatcttccaataaagaggggcagagagtcatccagacccagttagagaccctcaaggaggtttgggccgatatcatgtccagctcggtgcatgcacaaagtacactggagtctgttatctcacagtggaacgattatgttgagcgcaaaaatcagcttgagcagtggatggaatcagtggatcagaagatcgagcaccccttacagccccagcctgggcttaaggaaaagttcgtgctgttggaccacctacagtccatcctcagcgaagctgaggaccacacgcgcgcactgcacaggctgattgcaaaatccagggagctgtatgagaagaccgaggatgaatcttttaaagacacagctcaagaagagctaaagacccagtttaacgatatcatgaccgtggcaaaggaaaaaatgcggaaagtggaagagattgtaaaggatcacctgatgtacctggacgctgtccacgagttcaccgattggctgcactccgcaaaggaagagctgcatcggtggagcgacatgtccggcgactccagtgcaacacaaaagaagctttccaaaatcaaggaattaatcgacagtagagagatcggagcaagtaggctgtctagagtggagtctctcgctccagaggtcaaacaaaatactaccgccagcggctgcgagttgatgcacactgaaatgcaggccctgcgggcagactggaaacaatgggaggacagtgtattccaaacccagagttgcctggagaacctggtgtctcaaatggcgctttcagagcaggaattcagcgggcaggtggcccagctggaacaggcactcgaacagttcagcgctctgctgaagacctgggcacagcagctcaccttactcgagggtaagaatacagatgaagaaatcgtcgagtgctggcataaaggccaagaaatcctcgatgcgctacagaaagctgagccccgtacagaggatctcaagagtcagctaaatgaactctgcagattttcccgtgatctgtctacatactctggtaaagtttctggattgattaaggaatacaactgtctctgtctgcaggcctcaaaagggtgtcagaacaaagaacagatcctgcagcagcggtttaggaaagccttccgagacttccaacagtggctagtgaatgcgaagatcacaacagcaaagtgtttcgacattccgcagaacatctccgaagtttccacctctttgcaaaaaatccaggagttcctttcggaatcggagaatgggcagcataagctcaacatgatgctttctaagggtgaactgctatcaactctgctgactaaagaaaaggcaaaaggtattcaggcaaaggttaccgcagccaaggaggactggaagaattttcatagcaacctgcatcagaaggagtcagcgcttgagaatcttaagatacagatgaaggatttcgaagtgtccgctgagcctattcaagattggctatctaagactgaaaagatggtgcacgagtctagcaatcggttatacgacctgcctgctaagcgcagggaacagcagaaactgcagtctgtactcgaagaaatacattgttatgagcctcagttgaatcggttgaaggagaaggcccaacagctctgggaaggacaggcggcatccaaaagctttcgccaccgggtctcgcagctgtcttcccaatatctggccttatcaaatttgacgaaggagaaggtgtccagactcgacaggatcgtggccgagcacaatcagttctctctggggattaaagagctccaagactggatgactgatgctatccacatgctcgatagttattgtcatccaacttccgataaaagcgtgcttgattcgcggacattgaagctggaggccctcctctcagtgaaacaggagaaggaaatccagatgaaaatgattgtgactagaggggaaagcgtcctgcagaacacctcaccagaaggtatacccactattcagcagcagctgcagtccgtaaaagatatgtgggcttctttgctgagcgctggcatcaggtgtaaatcacagctggaaggtgcactgtcgaagtggacaagctaccaggatggagtgcgccagtttagcggctggatggactcaatggaagctaacctcaacgaaagcgaacggcaacacgccgagttacgggacaaaaccaccatgctcggaaaggcaaaactcctcaatgaggaagtgctcagttattcttcgctgctggaaaccatcgaggtcaaaggcgcaggcatgactgagcactacgtcacacagctcgagttacaggacttacaggaacgctaccgggcaatccaagagagagcaaaggaggctgttactaagtctgagaaattggtcagactgcaccaagagtaccaacgagacctcaaggcattcgaagtttggcttggccaggagcaagagaagctggaccagtattcagtgctggaaggagacgcccatactcacgaaaccacgctccgtgacctgcaggaacttcaggtacactgtgctgaagggcaggccctgctcaacagcgtgcttcacacccgggaagatgtcatcccgtcagggatccctcaggctgaagatagggccctggaaagtctcagacaagactggcaggcgtaccagcacagactctcagaaactagaacacagttcaacaatgtcgtgaataagctgcggttaatggagcagaaatttcaacaagtggacgaatggctgaaaacagctgaggagaaagtttcacctagaacccgccgtcagagcaacagagcgactaaggaaatacagttgcatcaaatgaagaaatggcatgaggaggtcactgcctatcgcgatgaggtagaggaagttggcgcacgcgcacaagaaatcctagatgagtcccacgtaaacagcaggatggggtgtcaagctacacagctgacttctaggtatcaggctctcctcctgcaagtcttggagcaaatcaaattcctggaggaggaaatacagtccctggaggaaagcgagtcctctctttcctcatacagtgattggtacgggtctacacacaaaaactttaaaaatgttgccacaaagatcgacaaggtggacacagtgatgatgggcaagaagctgaaaacactcgaggtgctgttgaaagacatggaaaagggtcattcactgctgaagagtgcacgggaaaagggtgagcgcgctgtcaaatacctggaagagggagaggcggagcgactgcgaaaggagatccatgaccacatggaacagttgaaggaactaacatcaaccgttaggaaggagcatatgacgctcgaaaaagggctgcacctggccaaagagttctcagataagtgtaaagccctcacccagtggatagccgagtaccaagagatcctgcatgtaccagaggagcctaagatggagttgtatgaaaagaaagcgcagcttagcaagtataagtctctacaacagacagtcctgtctcacgagcctagtgtgaagagtgtgagagagaaaggcgaggcattgttggaactggtgcaggacgtcacgctgaaggacaaaatagatcagctgcagtctgattatcaggacctgtgcagtattgggaaggagcacgtcttcagcttggaggccaaggtcaaagatcatgaggactataacagtgagttgcaggaagtggagaaatggttgctgcagatgagcggccgtctggtggctcccgacttactcgagacttcaagccttgagacaattacacaacagctggcccatcataaagctatgatggaggaaatcgccggatttgaggataggttgaacaaccttcagatgaagggtgatacactgattggacagtgtgcagaccatctgcaggccaaattgaaacagaacgtgcacgcccatctgcagggcaccaaagatagctatagcgctatatgttctacagctcagcggatgtaccagagcctcgaacatgaactccagaagcatgtgagcagacaagacacgttgcagcaatgccaggcatggctgagcgccgttcaacccgacctggagcctagccctcagccaccgctatctcgtgccgaagctatcaagcaagtgaagcattttcgggcactgcaggagcaggccaggacatacctcgacctcctgtgcagcatgtgcgatctgtctaatgcctcagtgaaaacaaccgccaaggacattcagcagaccgaacagacaatcgagcagaaactggtgcaggcccaaaatctcacccagggatgggaagagattaaacacttgaaatccgagctctggatatacctccaggatgctgatcaacagctgcagaatatgaagcgtcgtcacagcgagttagagctgaacatagcacagaatatggttagccaggtgaaagactttgtgaaaaagctccagagtaagcaggcctctgtgaatactatcattgaaaaggtcaacaagctcacgaagaaagaggagagtcctgaacataaggagatcaaccaccttaacgatcagtggcttgacctctgcagacagtcaaacaacctatgcttgcagcgagaggaggatctccagcggactagagactatcacgactgtatgaacgtagttgaagttttcttggagaagtttaccacagagtgggataacttggcgcgttccgatgcagaatcaactgccgtacacctcgaggcgctgaagaagctggcccttgcactgcaggaacgcaagtacgctatcgaagatctgaaggaccagaagcagaagatgattgaacacctgaatctggacgacaaggagcttgtaaaggagcagacaagtcacctggaacagcggtggttccagctggaggacctcatcaagcggaagatccaggtatccgttaccaatctggaggagctgaacgttgtgcagagccgatttcaggagctgatggagtgggcagaagaacagcagcccaacatagccgaagctctgaaacaatcgccccctccagatatggcacaaaacctgctgatggatcacctggccatatgctcagagctcgaggctaaacagatgctcctgaagagtctgatcaaggatgcagatcgggtcatggctgacttaggactgaacgaacggcaggtgattcagaaggcactgagcgatgcacagtctcacgttaattgtttgagcgatcttgtgggccagagaagaaagtacttgaacaaggcactgtctgaaaagacccagtttctgatggctgtgttccaggccacttcccagattcaacagcacgagcgcaagattatgttcagggagcacatttgtctgctgccagatgacgtctctaagcaggtcaaaacttgcaagtccgctcaggcttcacttaagacttaccagaacgaggtgactggtctatgggcgcagggacgcgagttgatgaaagaggttaccgaacaggaaaagtccgaggtactgggaaagctgcaggaactccaaagcgtctatgattcagtgctgcagaagtgcagccatcgccttcaggaacttgagaaaaatctcgtgtctcgcaagcactttaaggaggactttgacaaggcatgccattggctgaaacaggctgatattgtaactttcccggaaatcaacctgatgaacgaaagcagtgagctgcatacgcaactggccaaataccagaacattctcgagcagagcccagaatacgagaatttactattaactttgcagaggaccggtcaaactattctgccatccctgaatgaggtggaccattcctatctttcagagaaacttaacgcccttcccagacagttcaatgtcattgtagccctggcgaaagacaagttctacaaagtacaggaggctatacttgctaggaaagagtatgccagtctcatcgagctgacaacccagagtctatctgaattggaggcccagttcctgcgaatgagtaaagtgcctacagacctggctgtggaggaagctctctcattgcaggacggctgtcgggcaattctggatgaagtagccggactgggcgaagcggttgacgaactgaaccagaagaaggagggcttccgcagtacaggtcaaccatggcagcccgacaagatgttgcacctggtgacactatatcataggctgaaaagacagaccgagcagagagtgagcctgttggaagatacaacctcagcatatcaagagcacgagaaaatgtgtcagcaactggagcgacaacttaagagtgtgaaagaggaacagagtaaggtgaacgaagagacattaccggcagaggagaagctaaagatgtaccattctctggcgggatcactgcaagactccgggatcgttctgaagcgggtaacaatccacttggaagatctggctccacatctggacccactggcatatgagaaggccagacatcaaattcaatcctggcagggggaactcaagctgctgacatctgctattggggaaactgtaacagaatgtgagagtaggatggttcaatctatcgatttccagacagagatgtcccgatccctggattggttgcgcagagtgaaggcagaactttcagggcctgtctatctggacttaaatctccaggatatccaggaggaaattcggaaaattcagattcaccaggaagaagtgcagtcatccctgaggataatgaatgccttaagccacaaagagaaagaaaaatttacaaaagctaaagagctgattagcgcagacttggagcattccctagcagagctgagcgagctggacggtgatatacaggaggcactccgaaccaggcaagccacgctgaccgagatatactcgcagtgtcagcgctactatcaggtgtttcaggcagctaacgattggctggaagacgcccaagagctgctgcagctggcgggaaatggattggacgtggaatcagcagaagagaacctgaaatcccacatggagtttttctcaacagaggaccagttccattcgaaccttgaagaacttcatagcctggtggcaaccctcgatccattgatcaagccaacaggcaaagaagatctagagcagaaagttgccagtcttgagctgaggagccagagaatgagccgtgattcaggggctcaggtcgatctactgcagagatgcactgcacagtggcacgactaccagaaggctagggaggaggtcatcgaactgatgaacgacaccgagaagaaactcagtgaattttcgttactcaaaacctcctctagccacgaggctgaagagaagctgtcagagcataaagccctggtaagtgttgtgaacagttttcatgaaaagatcgtggcccttgaagagaaagccagtcaacttgaaaagaccgggaacgacgctagcaaagccaccctgagccgctctatgacaacagtgtggcagcgatggaccagactcagagctgtggcgcaggaccaggaaaagattctggaggacgccgtggatgagtggaccggctttaataacaaagttaagaaggctacggaaatgatcgatcagctgcaggataagctgcctgggtcgtccgctgaaaaagctagcaaagctgagctgcttaccctccttgagtaccacgacaccttcgtcctggagttagagcaacagcaaagcgcgctggggatgcttcgacagcagactctttctatgttgcaggacggggcagcacccacaccgggagaagagccacctttgatgcaggaaataaccgctatgcaagatcggtgcctgaatatgcaggaaaaagttaagacaaatggaaaactggtcaaacaagagcttaaagatcgcgaaatggttgagacccagattaactctgttaagtgttgggtgcaagagacaaaggaatatctcggcaatcctaccatcgaaatcgacgcacagctggaagagctgcagatcctgctgaccgaagctacgaaccatcggcaaaacattgagaaaatggctgaggagcagaaggagaaatacctgggactctataccatcctgcccagcgagttgtcactacagttggccgaggtagccttggacctgaagatcagagatcagatccaggacaagataaaggaggtggagcagtccaaagccacgtcacaagagctaagccgacagattcagaagctcgctaaggatttaacaacaattctaaccaagttgaaagctaagactgataacgttgtacaggcgaaaactgatcagaaggtcttgggcgaagagctggatggatgcaatagcaagctgatggaactagatgccgcagtgcaaaaattcctcgagcagaatggccagctcggaaagccactggcaaaaaaaatcggcaagctgaccgaactccaccaacagacgattcgtcaagcagaaaataggttgagtaagctgaatcaggctgcatcccacctcgaagaatataatgaaatgttggaactcattctgaagtggattgaaaaggcaaaagtgctggcccacggaaccatcgcttggaactccgcctctcagttgcgcgagcagtatatactgcatcagacactgcttgaagagtcgaaagagattgactccgaattggaagccatgacagagaaactacaataccttacatccgtgtactgcaccgaaaagatgtctcagcaggtcgccgagcttggaagagaaaccgaagagctcaggcagatgataaagattcgcctccaaaacctacaggatgcagcaaaagatatgaaaaagttcgaggctgagctgaaaaagctgcaggccgcacttgaacaggcccaggccactctgacctcaccggaggtgggccgactgtccctgaaagagcagcttagccatcgacagcatctgcttagcgagatggagtctctgaaacccaaagtccaggcagttcagctctgtcagtcagctctgaggattcccgaggacgttgtggccagccttcccctgtgtcatgccgcattgcggctccaggaagaggcctcgcgtttgcagcacacagctatccaacagtgcaatattatgcaggcagccgtcgtgcaatatgagcaatacgagcaggagatgaagcacctgcagcagctcatcgaaggcgctcatagagaaatagaggacaaacccgtcgccaccagtaatatccaggaacttcaggcccaaatttccaggcacgaggaactcgcacaaaaaattaagggataccaagaacaaatcgcgtctctgaatagtaagtgcaagatgttgacaatgaaagcgaaacacgcgacaatgctactcacagtcactgaagtagagggtttggccgaaggcactgaggacctcgatggcgagttgctgcctaccccctcagcccacccctccgtggtcatgatgactgctggtcgctgtcacaccttgctgtccccggtgacagaggaatccggggaggaagggaccaatagcgaaatctctagcccaccggcatgtagaagtccgtcccccgtagccaatactgacgctagtgtcaaccaggacattgcctactaccaggctctgagtgctgagcgattgcaaacagatgctgccaaaatccacccaagcacctccgcttcgcaggagttttacgagccgggactggaacctagtgccacagccaagctgggggatcttcagagatcctgggaaacgctgaaaaacgtaatcagcgagaagcaaagaacattatacgaagccctagagcgacagcagaagtatcaggactcccttcaatccataagtacaaagatggaagcaatcgagctgaagctatcagagtcccctgaacccggaagaagtcctgaaagtcaaatggctgagcaccaggccttgatggacgagatactgatgctgcaagatgaaataaacgagctgcagtctagtcttgcagaggaactggtgtccgaatcctgtgaagcagatcccgctgagcaactggccctccagagcactttgacggttcttgccgaacggatgtctaccatcagaatgaaagcttctgggaaaaggcaacttctggaggagaagctgaatgaccagcttgaggaacagcgtcaggaacaggcgttgcaaagatatagatgtgaggcagacgaactcgatagctggcttctgagcacaaaggccacactggataccgccctgtcgccccctaaggagccgatggacatggaagcccagctgatggactgccaaaacatgcttgttgaaatcgagcagaaggttgtggcccttagtgaactgagcgttcataatgagaatcttctccttgaggggaaagctcacactaaagatgaggccgagcagctcgcagggaaattgaggcgacttaaggggtcccttcttgagttacaacgtgcgttacacgataagcagcttaatatgcagggaaccgcccaggaaaaggaggagtccgacgtcgatctaacggctacccaaagtcccggtgttcaagagtggctcgcccaggccaggaccacctggacacagcagagacagtcctccctacaacagcagaaagagttggagcaagaactcgccgagcaaaagtctcttctaaggtccgtggccagtagaggcgaggagatcttaatacagcactcggccgctgagacatcaggagatgccggagagaaacctgatgtactctcacaagagctcggtatggagggtgagaagagtagtgctgaggatcagatgcgcatgaaatgggagagtctgcaccaggaattttctaccaagcagaagctacttcagaatgtgctcgagcaggagcaggaacaggtcctctacagccggcctaatcgcctcctgtccggggtgccactgtacaagggtgacgttcccacccaggacaaatctgctgtaacctcgctgctcgatggtctgaaccaggcctttgaggaggtctctagccagagcgggggtgccaagcggcagtcgattcatctggagcaaaagctctacgacggggtgtctgcaacatcaacctggctggatgatgtggaggagagactcttcgtggcaaccgcactgttgccggaggaaaccgagacatgtctgttcaaccaggagatcttagccaaagatataaaagaaatgagcgaggaaatggataaaaataagaatctgttcagtcaagcatttcccgagaatggtgacaatcgggatgttattgaggacaccttgggctgcctcttggggagactttcccttcttgactccgtcgtgaatcagcggtgtcaccagatgaaagagagactgcagcagatacttaacttccaaaatgatctcaaagtgctcttcaccagtctagccgataataaatacatcatacttcaaaaactcgctaacgtgttcgagcagccagtggccgaacagattgaagccatacagcaggctgaggacggcctcaaggaatttgacgccggaataatcgagctgaaaagaagaggggacaagcttcaggttgagcagccctcaatgcaggaacttagcaaactgcaagacatgtacgacgagctcatgatgatcatcggcagccgcagatccggcctgaaccagaatctcacattgaagagccagtacgagcgcgctctacaggacctcgccgacttattggaaacgggccaggaaaaaatggccggagatcagaagataattgtgtcttctaaggaggaaattcagcagctcttagacaaacacaaagagtactttcaaggactggaaagtcatatgatattgaccgaaacactttttcgcaagatcatttccttcgcagtgcagaaggaaacccagttccacacagaactgatggcccaggcctcagcggtcctaaaaagggcgcacaagagaggtgtcgaactggaatacatactggagacctggagtcatttggatgaggaccagcaggaactgagcaggcagctggaggtggtggagagctctatcccgagcgttggcctggtggaggaaaacgaggatcgcctaatagaccgcatcaccctctaccagcatttgaagtcatccctcaacgagtatcaacccaaactgtaccaggtgctcgacgacggcaagagactactgattagcatctcatgtagcgacctggagtctcagctgaaccagttgggcgagtgttggctgagcaacaccaataaaatgtctaaagaactgcaccgcctcgagactatcctgaagcactggacccgttatcaaagtgagtcggctgacttaatacactggcttcagtccgccaaagatcgactcgagttttggactcagcaaagcgttactgtcccgcaggagctcgagatggtgagagatcacctgaacgcatttcttgaattttcaaaggaggtcgatgcccagtcctccctgaagtcttctgttttgtctaccggaaaccaactcttgaggctgaaaaaagtggataccgcgactctgagaagcgaactgagccgtattgattctcagtggactgacctgctgacgaacattccagcagtccaggaaaaactccatcaattgcagatggataaacttccaagccgtcatgctatctccgaagtgatgagttggatctcactgatggagaatgtgatccagaaggacgaagacaacatcaagaactccatcggctataaggcaatccatgaataccttcagaagtacaagggattcaaaattgatatcaactgcaagcaactgaccgtggatttcgttaatcagtccgtactacagatctcatcgcaggacgttgagagcaagcgctccgacaagaccgacttcgctgaacagctgggagctatgaataaatcttggcagattctccagggattagtaacagagaaaatccagctgctcgaggggctgctcgaaagttggtctgagtacgagaacaatgtccagtgccttaagacatggtttgagacccaggaaaagagactgaagcaacagcatcgtataggagaccaggcttccgtgcaaaatgcactgaaagactgccaagatcttgaggacctgatcaaggcgaaggagaaagaggttgagaagatcgagcagaatgggctcgctctgattcagaacaagaaggaggacgtctcttctatcgtcatgtcaacactgcgagagctcggacagacctgggctaatctggaccacatggtgggacaattaaaaattctgctgaaaagtgttctcgaccagtggagttcacacaaggtcgctttcgacaaaattaactcttatcttatggaggccagatattcactgtccaggtttcggcttttgactggctctctggaagcagttcaagttcaggtggacaatttacaaaatctccaagacgacctggaaaagcaggagcgaagcctgcagaagttcggctccatcacaaaccagttacttaaagagtgtcatcctcctgtgacagagacactcaccaacaccctgaaggaggtgaatatgagatggaacaatctgctggaagagatcgccgaacagcttcagtccagtaaagccctcctgcagctgtggcaaaggtacaaagactactccaagcaatgtgccagcactgtacaacagcaggaagaccgtactaacgagttgctgaaggctgccaccaataaagatatcgctgatgacgaagtggcgacatggatacaggattgtaatgacttgttaaagggcctcggcaccgttaaagactctctgtttttcctgcacgagctgggggaacagctcaagcagcaggtggatgccagcgccgctagtgccattcaatccgaccagctcagcctgagccaacacctctgcgctttagaacaggcactgtgtaagcagcagacgtctttgcaggccggagtcctggactacgaaacctttgcgaaatctttagaggcgctggaagcttggatcgttgaggctgaggagatactccaaggacaggaccccagccattctagtgacctgagtacgattcaagagagaatggaggaattgaagggacagatgctgaaattttcctctatggcgccagacctcgatcgactcaatgagctgggctataggctaccgttgaatgacaaggagatcaaaagaatgcagaatctgaacagacactggtctctgatcagcagccaaaccacggagcgctttagtaagctgcagtctttcctgctgcagcaccagacgttcttggagaaatgcgaaacatggatggagtttctcgtgcaaacggaacagaagctcgccgttgagattagcgggaactatcagcacctactagagcagcagagagcccatgaactgtttcaggcagagatgttctcacgccaacagatcttacactccataataatcgatggtcagcgcttgctcgagcagggacaggtggatgacagagacgaattcaatcttaaattgactttgcttagcaaccaatggcagggcgtgattagaagagcccagcagaggcgcggtattattgacagccagatccgccagtggcagaggtaccgagagatggccgagaagctgcgtaaatggctcgtcgaggtgtcctatttgcctatgagtgggctggggagcgtgccgatccctctgcagcaagctcgcaccctgttcgacgaagttcagtttaaagaaaaggtgttcctaaggcagcagggcagttatatccttacggtggaggcaggaaaacagctgctcctatccgcagacagcggtgcagaagctgcattgcaggccgagttggcagaaatccaagagaagtggaaatccgcgagtatgcgcctggaggagcagaagaagaaattggcctttttgttgaaggattgggagaagtgtgaaaaaggaatcgccgattccttggagaagttgcggacatttaaaaagaagctaagccagtcactacccgaccatcacgaagaactccacgcagaacagatgcgctgcaaggaattagagaatgctgtgggaagctggactgacgatctgactcagctttccctccttaaggatactttgagcgcctacatttccgcagatgacataagtatcctaaacgagcgcgtggagttacttcaacggcagtgggaagagctgtgtcatcagctgagtttgagacggcagcagataggcgaacgtctcaacgagtgggcggtattttccgagaagaacaaggaactgtgcgagtggctgactcaaatggagtcgaaggtttcccagaacggcgacatccttatcgaagagatgatcgaaaaacttaagaaggattaccaggaggaaatagctatagcccaggaaaataaaatccagctgcagcaaatgggggaaagactggccaaggcttcccatgaatcaaaggccagcgaaatcgaatataagttagggaaggtgaacgatcgctggcagcacctgttagatctcatcgccgcaagggtgaaaaagctcaaggaaacattagtggccgttcagcaactcgacaaaaacatgtccagcttaaggacatggctggcacatatcgaatcagaactggcaaagccaattgtgtacgattcttgcaattcagaagaaatacaacgcaaacttaacgagcaacaggagctgcagagagacattgagaaacacagtactggcgtcgcttccgtcctaaacctgtgcgaggtacttctccacgactgcgacgcctgcgccacggacgctgaatgtgattccatacaacaggccacgaggaacctggatcgcagatggagaaatatttgcgcaatgtccatggagcgaaggctcaaaatcgaggaaacatggcggctttggcagaaattcctcgacgactatagcagattcgaggattggctcaagtcaagcgaaagaacagctgcattcccaagctccagcggcgtgatctacactgtggccaaagaagagctaaaaaaattcgaggccttccagagacaggtgcatgaatgtttgacacagctcgagctgatcaacaagcagtacagacgactggccagagaaaataggactgactcggcatgcagcctcaaacagatggtccatgagggcaaccagcggtgggataatctgcagaagcgtgtgacctctatcctgcggcgtcttaagcactttatcgggcagcgcgaagagtttgagaccgctcgggatagcatcctcgtctggctgacagagatggacctccagctgactaatatcgagcattttagcgaatgcgacgtccaagcgaaaatcaaacagcttaaggcatttcagcaggaaatctctctcaatcacaataaaattgagcagatcattgctcaaggagagcagcttattgagaagtccgagcccctagacgctgccataatcgaagaggagttggatgaacttcgccgatactgtcaggaagtctttggccgagtggagagatatcataagaagctgatccgactgcctttgcccgacgacgaacacgacctctccgaccgcgaacttgaactcgaagatagcgcagcgttatctgatctgcactggcatgatcgcagcgccgactctctgctgtcaccacaaccatcttccaacctcagcttatccctcgctcagccgttgcggtctgaaaggtctggtcgcgatacaccggcatcagtggatagcattcccctggagtgggatcacgactacgacctgagtcgggacctggaaagcgctatgagcagggccctgcctagcgaggacgaagaggggcaggatgataaagatttctacctgcgtggcgctgttggcctgagcggagatcactccgctttggagtcacagatccgacagctgggtaaggccctcgatgactctcggttccagatacagcaaactgagaatattatccgcagcaagacgccgaccggcccagagttagacactagctataaaggctacatgaaactactcggcgagtgctccagcagcatagactccgtgaaaaggcttgagcataagcttaaggaagaagaagaatccctgcctggcttcgtcaacctgcactcaactgagacccagaccgcaggagtaatcgaccgctgggaactgctgcaggcacaggcattgtctaaagagttaagaatgaagcagaacctgcagaaatggcagcagtttaactcggacctgaactcgatttgggcttggctgggcgatacagaggaagagctggagcagctgcaacgactggaactgtccaccgacattcaaactatagagttgcagatcaagaagctgaaggaactgcagaaggcagtggaccaccgaaaagccataatccttagtattaacctgtgttcccccgagttcactcaggcggattccaaggagagcagggacctgcaggaccgtctttcacagatgaatggaaggtgggatcgggtatgcagcctgctggaggagtggcgaggtctcctgcaagacgcactaatgcagtgccagggcttccatgagatgtcccacggcttgcttctgatgctggagaatatagatagaaggaagaatgaaattgtgcccatcgactccaatctggacgcagaaattttgcaagaccaccacaaacagctgatgcagatcaagcatgaactgctggagtcccaacttcgggtcgcgtctttgcaggatatgagttgccagcttctcgtgaatgcagaaggcacagactgtttggaggccaaagagaaagtacacgtgataggtaatcgactcaagctcctgcttaaggaagtatctaggcacataaaggagcttgagaagctgctagatgtgtcttcctcacagcaggatctctcatcatggagtagcgctgacgaactagacacatccggttccgtgagcccaaccagtggacgcagcactcctaaccgtcaaaaaactcctaggggtaaatgttctctgagtcagcctggtccttcagttagttcaccccactcccgcagtactaagggagggtctgactccagtctcagtgaaccaggaccaggccgatctggcaggggctttctgttccgtgtgctccgagctgctctccccttacagctcttgctcttgctgctaatcggcctggcttgcctggtgcctatgtccgaagaggactactcatgcgctctgagtaataatttcgctaggtcatttcatccaatgctgaggtataccaacggaccccctccactata

SEQ ID NO: 242065 - DNA, 25230 bp, Artificial Sequence
  Description of Artificial Sequence: Synthetic coding sequence
atggctacctcgcgcggagcctcacgatgccctcgcgatattgctaatgtcatgcaaagactgcaggacgaacaggaaatagtccagaaaagaacttttacaaaatggatcaacagtcacctcgcgaaacgcaagccgcctatggttgtcgacgacctgttcgaggatatgaaggatggcgtgaagctcctcgccctgctcgaggtgctgtcaggacagaaactgccctgtgaacagggtagaaggatgaagcggatccatgcagttgccaacatcggaacagctctgaaatttcttgaagggaggaagatcaagctggtgaatattaactccacagatatagccgacgggagaccctcgattgttctcggccttatgtggacaattatcctttattttcaaattgaggaattaacttctaacctcccacagctccaatcactgagtagttcggcgagttccgtggactcaatagtctccagcgaaacgccatccccccctagcaagcgtaaggtcaccactaagatccagggtaacgcaaagaaagctctcctaaaatgggtgcagtacacagcaggcaagcaaactgggatcgaggtaaaggattttggtaaatcttggagatccggggtcgctttccactccgtgattcacgccatcagaccagagctcgtcgatctcgagaccgtgaaggggcgatctaatcgagagaatctggaggatgcgtttacaattgctgagacggagcttggcattccgaggctgctcgaccctgaggacgtggacgtagacaaaccagatgaaaagtcgatcatgacatacgtcgcccaattcctgaagcattaccctgacattcacaacgcatctacagacggacaagaagacgacgaaattctccctggttttccaagtttcgctaactctgtgcagaacttcaagcgcgaagacagagttatttttaaagagatgaaggtgtggatcgaacaattcgaacgggacctcacgagggcgcagatggttgaatcgaatctgcaggacaagtatcaatctttcaagcacttccgtgtacagtacgagatgaagcggaagcaaatcgagcatctcatccagcctcttcatcgggatggcaagctgtctctagaccaagctctagttaagcagagctgggatagagtcacctctaggctcttcgattggcatatccagctggataagtcacttcccgcaccacttggcaccatcggcgcttggttgtaccgcgctgaagtcgcccttagagaagaaatcacggtgcagcaggtccacgaagagacagcgaataccatccagcggaaactggaacagcacaagcgtaaattgagaaatgtcatcgatctgctccagaacaccgatgctcacaaacgggcttttcacgagatctaccgaactcgctcggttaatggtatacccgtgcccccagaccagctggaggacatggctgagcggtttcactttgtgtcttccacaagtgaactccacttgatgaagatggagttcctcgaattgaaatatcggctgctgagtctactggtcctggccgaaagcaaactgaagagctggatcataaaatacggcaggcgcgaatcagtagagcagcttctgcaaaattatgtgagcttcatcgaaaatagtaagttttttgaacagtatgaagtcacgtatcagattctgaagcagactgctgagatgtatgtcaaggcggatggatctgtggaagaagccgagaacgtgatgaagtttatgaacgagaccacagcccagtggcgaaacctgagtgtggaagtgcgaagcgtccgctccatgctagaagaggtaatatctaactgggaccggtacggcaataccgtggcatctctgcaagcttggctggaagacgccgagaagatgctgaatcagtccgagaatgccaaaaaggacttcttcagaaatctgccacattggattcaacagcatacagccatgaacgatgctggtaattttctcattgagacctgcgacgagatggtgagccgagatttaaagcagcaactgctgctgctcaatggacgctggcgagagctgttcatggaggtgaagcaatatgcccaggcggatgaaatggatagaatgaaaaaagagtatacagactgtgtggtgacccttagcgctttcgcaactgaggcgcacaagaagctgagcgagcccctggaggtctcttttatgaatgtgaaactcttgatccaggacctggaggatatcgagcaacgggtccctgtaatggacgcccagtacaaaatcatcacgaagactgcccacctcattacgaaagagtcaccacaggaggagggcaaggagatgtttgcgacaatgtcaaagcttaaagagcagctgaccaaggtgaaagagtgttattctcccttgctttacgaatcacaacagctccttattcccctggaagaactcgagaagcagatgaccagcttttacgattccctggggaagattaatgaaatcataacggttctggagagggaggcccagtcctcggctctgtttaaacagaagcaccaattgaggatcctcaagtgcaagtggtgcaactcatcccaaaagatgaccctctgcttggttcttggatctatgattagcatgctgagcaccgctaagattaccattgcaggttataagtctgaggtagaggtcagcgagctactggcatgtcaagaaaattgcaagaaaaccctgacacttatcgaaaagggtagtcagagcgttcagaagtttgtgaccctgtctaacgtcctgaagcatttcgatcagaccaggctgcagactgactgtagatacagttgttgcttttcagtgatgcggaagcagcatcacatcatgattgtcttccacatcaagtctatggtgaaaaagaccggtgactggaaaaagcacgtggaaaccaacagcaggctgatgaaaaagttcgaagaatctagagccgagttggaaaaggtccttcgaatagcgcaggaaggtctcgaagaaaaaggggacccagaggagctactgcggagacacaccgaattttttagccagctggatcagagggtgctgaatgctttcctgaaggcatgtgatgaactgaccgatatcttacccgaacaagaacagcaggggctgcaggaggccgtgaggaagctgcataagcagtggaaggacctgcagggagaagctccataccacctgcttcacctcaaaatcgatgtcgaaaagaacagatttctggccagtgtggaggagtgcagaaccgagctggaccgtgagactaagctgatgccccaagagggcagtgagaaaattatcaaagaacatagagtgtttttctcagacaagggaccccatcacttgtgtgagaagagacttcagctaattgaggaactgtgcgttaagctccctgttagggacccggtgagggacacacccggtacatgtcatgtgacactaaaagagctgcgagccgcaatagattcaacctacaggaagcttatggaggacccggataagtggaaggattatacaagccggttttccgaattttccagttggatttctactaacgagacacagctcaagggcatcaagggagaggccatcgataccgctaaccatggtgaggtgaagcgagcagttgaggaaattaggaacggggtaaccaaaaggggagaaactctgagctggctgaaatctcgcctgaaggtactaacagaagtgagcagcgagaatgaggcccagaagcaaggcgacgaactggccaagctaagttcttcttttaaagcattggtgacacttctcagcgaggtggaaaagatgctaagcaactttggcgattgtgtgcaatataaagagatcgtcaagaattctctcgaggagctcatctcaggctccaaggaagtgcaggagcaagcagaaaagatcctcgataccgagaacctcttcgaagcacagcagcttcttctgcatcatcagcagaagactaagagaatcagtgccaaaaaacgagacgtccagcagcagattgctcaagcacaacagggtgagggaggactcccagaccggggtcacgaggagctgcggaagctggagagtactctggatggcttggagcgatcaagagaacgccaggagagaagaatacaggtgactttgaggaaatgggagagatttgagaccaacaaagaaacggtggtgagatacctgttccagacaggatctagtcacgagcgctttctctcattcagtagccttgaatcccttagcagcgaactggaacagaccaaggagtttagcaagagaaccgagagtattgcggtgcaggcggagaacctggtcaaagaggccagcgaaattcccctcggccctcagaacaagcagctactccagcaacaagctaaaagtataaaggagcaagtcaagaagctcgaagacactttagaagaggagtatgtgatagacaataaaacgatggagatggtaaagactaagtgggaccattttgggtcaaacttcgagactttgtcggtgtggattaccgaaaaggagaaagagcttaatgccctagagactagcagcagcgctatggatatgcagatctcccaaatcaaagtgactattcaagagatcgagtccaagctcagcagtatcgtgggactcgaggaggaggcacaaagcttcgcgcagtttgtcacaaccggggaatctgcccgaataaaggcaaaactgacacagatccgcaggtatggcgaggagttgagggaacacgcccagtgcctggaaggcactatcctcggtcacctctcccagcagcagaaatttgaagagaatttgagaaagatccagcagtctgtctcagagttcgaagataaactcgccgtacccatcaagatttgttcctcagcgactgaaacttataaggtgctccaagagcacatggatctttgtcaggccctcgagagtttgagctctgcaatcactgctttctctgcgtccgcccgaaaggtggtcaaccgggactcctgtgtccaagaggccgctgccctgcagcagcagtatgaagatatcttgcgacgggcaaaggagaggcaaacagctctggaaaacctgctggcccattggcagaggctggagaaggagctctcatccttcttgacgtggctggaacggggagaagcaaaggcaagcagccccgagatggatatctccgccgaccgggtgaaggttgaggcctccaaagatgatgtaaagatgatgaagttacatcttgagcagctcgacgaaaggtggagggacctgccccaaataattaacaaaagaattaactttctccagtccgttgtggccgaacatcagcagttcgacgaactcttgttatcgttctctgtctggataaagttgttcttatcagagcttcaaactacaagcgagatctcaatcatggatcatcaagttgctctcacgaggcacaaagaccacgccgctgaggtggaatccaaaaaaggcgaactgcaatctcttcagggtcatcttgccaagctgggcagtctgggcagggcagaggatctccatttactgcaggggaaggccgaagattgtttccaacttttcgaggaggcctcccaagttgtggaacgtcggcagctggccctgtcacacctagctgagttcctacaaagccatgcaagcctgtccggaatattgcggcaactgcggcagacagttgaggctactaactccatgaacaagaacgagtccgacctgattgaaaaggatttgaacgatgcgctgcaaaacgccaaggctctggagtctgcagcagtgtccctcgatggaattctcagtaaggcccagtaccatctcaagattggttccagcgagcagagaacctcctgcagagctactgcagaccagctctgcggtgaagtggagcgcatccagaacctgttagggacgaagcagtctgaggcagatgccttggctgtgcttaagaaggcatttcaggatcagaaggaggagctgttgaagtcaatcgaggacatagaggaacggactgacaaggaaagactgaaggagcccacacggcaggctctccagcagcggctgagagtgtttaatcaactggaggatgaactgaacagccacgaacatgagctatgttggctgaaagacaaagccaagcaaattgctcagaaggatgtagccttcgcaccggaggtggaccgggagattaatcgattggaggtgacatgggatgacacaaagcggctcatccatgaaaaccagggccagtgttgtggactgatcgacctgatgcgcgagtatcagaacctgaaatcagctgtgagcaaagtgcttgagaacgcatcatccgtgatcgtcactagaactaccattaaagaccaggaggatctgaagtgggctttttcaaaacatgaaaccgctaaaaacaaaatgaactataaacagaaggacctcgataatttcacctccaagggaaagcacctgcttagtgaactcaaaaagattcactcttccgactttagcctggtgaagacggacatggaatccacggtggacaagtggcttgatgtaagtgaaaaattggaagaaaacatggaccgcctgagggtcagtctatccatctgggacgatgttttgagcaccagggacgaaattgaggggtggtccaataattgcgtaccccagatggctgaaaacataagtaatctggataaccacctaagggccgaggaactgctgaaagagttcgaaagcgaagtcaagaacaaggcactcaggctagaggaacttcactcaaaggtcaacgacttgaaggagttgacaaaaaacctcgagacacctcctgatctgcagttcatcgaagccgatctgatgcagaaactggaacacgccaaggaaataaccgaggttgccaagggcaccttgaaagattttactgcacagtccacccaggtggaaaaattcatcaacgacatcaccacatggtttacgaaggtggaagaatccctgatgaattgtgctcagaacgagacatgcgaggcgctgaagaaagttaaagatatacagaaggagttacagagtcagcagtctaacatcagctccacccaggaaaacctgaatagtctgtgtcgtaagtaccattcagcggagcttgagtcactaggaagagctatgacaggcttgattaagaaacacgaagcagtcagtcagttatgttcgaagacccaggcctcactccaggaatccctggagaagcacttctccgaagagtctatgcaagagttccaggaatggtttctgggggcaaaagcagccgctaaggagtcttccgataggacaggtgacagtaaggtgctcgaggcaaagctccacgatctgcagcagaatatcctggactccgttagtgatggacaatctaaacttgacgccgtgactcaggaagggcagactctgtacgcacatctgtctaagcaaattgtcagttctatccaggaacaaattaccaaggccaacgaggagttccaggcgttcctcaagcagtgtttgaaggacaagcaggcgctgcaggactgcgcatctgagcttggatccttcgaggatcagcatcggaaactgaacctgtggattcacgagatggaggagcgcttcaatactgaaaacctgggtgagtctaagcaacacatccctgagaagaaaaacgaagtgcataaagttgaaatgttcctgggcgagcttctagcggctagggagagtctcgataaactaagccagcgcggtcagctgctctcagaggagggtcacggcgcaggtcaagaaggcaggctttgttctcaactcctaacctcccaccaaaacctgttgcgaatgacgaaagagaagctccggagttgtcaagttgcccttcaggagcacgaagcgttagaggaggccttacaatccatgtggttctgggtgaaggcaatacaggacagactagcttgtgcagaaagtactctcggcagtaaggacacgctggagaaacgtctgagtcaaatccaagacatcctcctgatgaaaggcgagggcgaagttaaattaaacatggccatcggcaagggtgagcaggctcttcgatcctccaataaggaggggcagagggtgatccagacacagttagaaaccctaaaggaggtatgggccgacattatgagctcctccgtgcacgcgcagtccaccttggagtctgtaattagccagtggaatgattatgtggaacggaagaaccagttggagcaatggatggaatcagtcgatcagaagatcgagcaccccctccagccacaaccaggtctcaaggagaagttcgtactgctagaccatctccagtcgattctgagcgaagcggaggatcatactcgtgcactgcacagactgatcgcaaaatctcgagaactgtacgaaaaaaccgaggatgagagcttcaaggacactgcccaggaagagctgaagactcagtttaacgacataatgaccgtagctaaggaaaaaatgagaaaagttgaggagatcgtgaaggaccatcttatgtatctggacgccgtgcacgagttcactgattggctccattcggctaaagaggaactccaccgctggtctgacatgagcggggatagctcggccactcaaaaaaaactgtccaaaattaaagaactcatcgattcccgcgaaattggtgcttctcgcctatcgagggtggagtctctagcacccgaagttaagcagaatacaactgctagtggatgcgagctcatgcacaccgaaatgcaagccctgcgcgcagactggaaacagtgggaagattcagtgttccagacacaatcatgcctagaaaacttggtatcccagatggctctgagcgagcaagaattttccggccaggtggcgcagctggaacaagctctggaacagttttctgccctcctgaaaacctgggcacagcagctcactctgcttgagggaaagaatacagacgaggagatcgtggagtgttggcacaagggacaggagattcttgacgctctgcagaaagccgaacccagaacagaggatctgaagtctcaactcaacgagctctgccgtttcagcagagatcttagtacatattccgggaaggtctcaggcttgatcaaggaatacaactgcctgtgtcttcaagcctccaaaggctgtcaaaacaaagagcaaatcttgcagcagaggtttcgtaaggcctttagagatttccagcagtggctggtaaacgctaagattaccaccgctaagtgctttgatattccacagaacatctcagaggttagtacgagtttacaaaagatccaggagttcttgagcgagtccgagaacggacagcacaagttgaatatgatgttatcaaaaggagagctactcagcactttgttgacaaaagaaaaggccaagggaatccaggccaaggtcacagctgccaaggaagactggaaaaactttcactctaatctgcaccagaaggaaagtgccctcgagaacctaaaaattcagatgaaggattttgaggtgtccgccgagccaatccaggactggttgagtaaaaccgaaaagatggttcacgaatcttccaatcgcctgtacgatctccccgcaaagcggagagaacagcaaaagctccagtccgtgttagaagagatacattgttatgaaccacagcttaaccgactgaaagagaaggctcagcaactatgggaggggcaggcagcctccaagagtttccgacatcgggtcagtcaattgtcctcacagtacctggctctctccaacttgaccaaagagaaggtgagccgactagacaggatcgttgctgaacataaccagttttcccttggtataaaggaactgcaagactggatgaccgacgccatacatatgctggactcctactgtcatcccacctctgataagagcgtcctcgatagcagaacactgaagctagaggccctgctttcagtgaaacaagaaaaggagatacagatgaagatgatagtcaccagaggcgaatctgtcctgcagaacaccagcccggaggggatccccacaatccagcagcagctgcagtcagtgaaggatatgtgggcgtctttgttgtctgccggtatccgatgcaagagagtgagacttccctgtgcctacatcgcccttaagctgagggtgcatcagcacgcagagctcagagacaaaactactatgttaggtaaagcgaaagaggccgtgactaagagtgagaaactggttaggctgcatcaggagtatcagcgtgatctcaaagcctttgaagtatggttaggccaagagcaggaaaaactggaccagtatagcgtactggagggggatgcacacactcacgaaacgacacttagggacctccaagagctacaggtccactgtgcagaaggacaggcccttctgaacagtgtgttgcacacaagggaagatgtgattcctagcggaataccccaggcagaagacagggccctggagagcctcaggcaggactggcaagcctatcagcaccgattaagcgaaaccaggactcagttcaacaacgtggtgaacaagttgcggctgatggagcaaaaatttcaacaggtggatgagtggttgaagacagccgaagaaaaggtgtccccgaggactcgccgtcagagtaatcgcgctacaaaggaaatccaactccaccagatgaaaaagtggcacgaggaggtgaccgcttatagggatgaagtggaggaggtgggcgctcgcgctcaggagatcctcgacgaatcccacgtgaattccagaatgggatgtcaagcgacacaactgacgtcgagatatcaggccctcttgctccaggtgcttgagcagatcaaattcctggaggaggaaatacagtctctggaggagtctgagtcaagcctcagtagttattctgattggtatggcagcacgcacaaaaacttcaagaatgtcgcgacaaagattgacaaagttgacacggtcatgatgggtaagaagttgaagacactcgaggtactccttaaggacatggagaagggacattccctgctgaaatctgcgagagaaaagggggagcgtgccgtaaagtatctggaagaaggcgaggctgagcgcctgcgaaaggagattcatgatcatatggaacagctgaaagagctgacatctacagtcagaaaggagcatatgactctggagaagtcactgcagcagacagtgcttagccacgagccctccgtgaagagcgtgcgcgagaaaggggaagccctgctggagctggtacaggacgttactctcaaggacaaaatcgatcagctgcagtcagactaccaggacctttgttctatcggcaaagagcacgtgtttagcctggaagcgaaggtcaaggatcatgaggactataattccgagttgcaagaagttgagaagtggttgctgcaaatgagcggccgattagtcgctccagaccttcttgaaacaagctccttagagactattacccagcagctggcccatcacaagatgtatcagtccctggagcatgagttgcagaaacacgttagcaggcaggatacattgcagcaatgccaggcatggctcagcgctgtgcagcccgatctcgaacccagtccgcagccaccccttagccgcgctgaggctataaagcaggtgaagcactttcgggctctgcaggagcaggcgaggacctatctcgacttactctgttcaatgtgtgacctaagcaacgccagcgtgaagaccaccgctaaggacatccaacagacagagcaaacaatagagcagaaactggtacaagcccagaatcttacccagggttgggaggaaattaaacatctcaagtccgagttgtggatatacctgcaggacgctgatcagcagctccagaacatgaaaagaaggcacagtgaactagagttaaatatcgcacagaatatggtatcgcaggtgaaggacttcgtgaaaaaactccagtctaaacaggcctctgtaaatacaataattgaaaaagtgaacaaactgactaaaaaagaggaatcccccgagcacaaagagattaatcatctgaatgaccagtggttggacctgtgcagacaaagtaacaacctttgtcttcagcgtgaggaagacctccagaggactcgggattatcacgactgcatgaacgtggtggaggtgttcctggagaagttcacaacggagtgggataatctggcgaggagcgatgccgagtccacagcagtgcacttggaggccttgaaaaagctcgccctagctctgcaagagaggaagtacgctattgaagatttgaaggatcagaagcagaagatgattgaacaccttaatcttgatgacaaggagcttgtgaaggaacagacatctcacctcgaacaaagatggttccagttagaggaccttatcaagcgtaagatacaggtgtcagttaccaacctggaggaactgaatgtggtgcaaagtagattccaggagctgatggaatgggccgaggagcagcaacctaatatagcagaagccttaaagcagtcccctcctcctgacatggcccaaaaccttctgatggatcatttggctatttgcagtgaacttgaagccaaacagatgctcctcaaatctttgataaaagatgccgatcgagttatggcagacctcggcctaaatgagagacaagttatacagaaagccctttctgatgctcagtcccacgtgaattgcctgtcagacctcgtcggccagaggagaaaaaagcacttcaaagaggacttcgataaagcctgtcattggcttaagcaggccgatatagtgactttccccgaaatcaatttaatgaatgagtcttcagaactgcatacacaactggccaagtaccagaacatcctcgagcagtctcccgagtacgagaacctcctgttaactctccagcgaaccggtcagacgatcctcccttctctcaatgaagttgatcactcctacctatccgagaagctcaatgccctgcctcggcagtttaatgttatcgtggctctggcgaaggacaagttttataaggttcaggaggcaatcctggctcgaaaggagtacgctagcctgatagagttaactactcagtccctgtctgagctggaggctcagttcctccggatgtccaaagtgcccactgatctcgccgttgaagaagccttgtcactgcaagacgggtgccgagcaatcctggacgaggtggcgggactgggcgaagctgtggacgagctgaatcagaaaaaggagggcttcaggagcacaggccaaccctggcagcccgacaagatgctccacctcgtcaccctgtatcacaggctgaagcgccaaaccgagcagcgggtttccctgcttgaagacactactagcgcataccaggaacatgagaagatgtgtcaacagctcgagaggcaactaaagagtgtgaaagaggagcaatcaaaagtgaacgaagaaacactcccagctgaggaaaaactcaagatgtaccactccctggccggaagcctgcaggacagtggaattgttcttaagagggtcaccatacacctcgaggacctggctccacacctggacccactggcctatgagaaggccagacaccagattcagtcctggcagggtgaacttaagttactcaccagtgccattggagagaccgtcacagaatgtgaatcacggatggtccagtcaatcgactttcaaacagaaatgtcacggtctctcgactggttacggagggtcaaggccgagttaagtgggccagtctatttagacctgaatctccaggacattcaggaagagattcgcaaaatccaaatccaccaggaggaggtgcagtcctcccttcggataatgaacgcactgtcacataaagagaaggagaagttcacaaaggctaaggagttgatcagtgccgatctggagcacagcctcgctgaactgtctgaattggatggtgacatacaggaggccttgagaactcgccaggctacgctcactgaaatttactcacagtgtcagcggtactaccaagtgttccaagcagctaatgactggctcgaagacgcacaggagctgctgcaactagccggaaatggtctcgatgtcgagagtgcggaggaaaatctgaagagccacatggagttctttagcaccgaagatcaatttcatagcaatctggaggagctgcattccctcgtggctacgcttgaccccttaataaagcccactgggaaagaagatctagagcaaaaggtggcctccctcgagctgcgatcccagcgcatgtccagagatagtggtgctcaggctctggttagcgttgtgaatagctttcacgaaaagatagtggcactcgaggagaaagcctcccagctggaaaagaccggaaatgacgctagcaaagccacactgagcagatctatgaccaccgtctggcagagatggacccggctgagggccgtggcccaggaccaagagaagatactggaagacgccgttgatgagtggaccggctttaacaacaaagtaaaaaaggctactgagatgattgaccagctgcaggacaaacttcctggttcaagtgcggaaaaagcctccaaggcggagctgctgaccctcctcgagtaccacgatacattcgttctggagctggagcaacagcaatccgcccttggcatgcttcggcagcagactttgagtatgttacaggacggagctgcccctacaccgggagaagaaccgcctcttatgcaagagataacagccatgcaagatcgatgtctcaaaatggtagagactcagattaactcagtcaagtgttgggtccaggagacaaaggagtatctgggcaatcctactatagagattgatgcgcagctggaggagctccagatactgctgactgaggccacgaatcatcgtcaaaatatcgagaagatggccgaagagcaaaaggagaagtacctcgggttgtataccattctccctagtgagctgagtttgcagctcgctgaagttgctctggatctgaaaattagggatcagatccaggacaaaatcaaggaggtcgaacagagcaaggctacatcccaggagctctctcgccagattcagaaactcgctaaggacttaaccaccattttaacaaagctcaaagcaaagacagacaacgtcgtccaggctaagaccgatcaaaaggcagcatcacaccttgaagagtacaacgagatgctggaattgattctcaaatggatcgagaaggccaaggtgctagcgcacgggaccatcgcctggaacagtgcttcccagttacgcgaacagtacattcttcaccagacgttgctggaggagagtaaagagattgactccgaattagaagcgatgaccgagaagctacagtatctgacatccgtgtactgtactgagaagatgtcccagcaggtggccgaacttggcagagaaacagaagaacttcggcagatgatcaaaattcgactacagaacctccaggatgccgcaaaggacatgaaaaagttcgaggcagaactgaaaaaacttcaggctgctctggaacaagcacaggctacgttgacgtccccagaggttggaaggttgagcctgaaagaacagctgtcccatcggcagcatcttctaagtgagatggaatcactgaagcccaaggtccaggcggtgcaactctgccagagcgctttgcgtatccctgaagacgttgtagccagcctccccctctgtcacgcagcgctgcggctccaggaggaggcaagtcggcttcaacacactgcgatccaacagtgtaacatcatgcaggaggccgttgtgcagtacgaacaatatgagcaggagatgaagcacctacagcagctgattgagggtgcacacagggaaatcgaagataagcccgtggccacctctaatatacaagagctccaggctcagataagtcgccacgaggaactggctcagaagattaagggctaccaggagcaaatcgcctccctgaactctaagtgcaagatgctgaccatgaaggcgaaacatgccaccatgttactcaccgtgacggaagtcgaaggcctggccgagggtaccgaagatctggacggtgagttactcccgacaccctccgcccatccctctgtggtcatgatgactgccggtcgctgtcataccctcctctcacccgttacagaggaaagcggcgaggagggcaccaacagcgagatctcttcccctcccgcatgtaggtctccgagtcctgtggcaaacaccgacgcctctgtgaaccaggacattgcttactaccaagccttgtccgccgagagactgcagacggacgctgcaaagatacacccctctacctcagcttctcaggaattctacgagccgggactggagcctagcgctacagcaaagttaggcgatctgcagcgctcgtgggaaactctgaaaaacgttatctctgagaagcagaggacgctatatgaagctctagaaagacagcaaaagtaccaggatagcttacagtcgatcagcacaaagatggaggccatagaactgaagttgtcagagtcccctgagcccggaagatcccccgaatcacagatggctgagcaccaggcactgatggacgagatccttatgttacaggacgaaatcaacgagttgcagagctccctcgctgaagaactcgtgagtgagtcgtgcgaggccgaccccgctgagcagctcgccctgcagagcacgctgacagtactcgccgagagaatgagcacgataagaatgaaagccagcgggaagagacagttactggaagaaaaactcaatgatcaactggaggagcaaagacaggaacaagcactgcagaggtatcggtgtgaggcagacgagctggacagctggctcctgagcacaaaggcaaccctggacacagccttaagtccacctaaggagccgatggacatggaagcccagcttatggattgtcagaatatgctagtggagatcgagcagaaggtggtggccctgagtgaactctccgtccataatgagaacttactcctagaggggaaggctcataccaaagacgaggcggaacaattggcaggtaagctacgccgtctgaagggctctttattggagctccaaagggccttacacgacaagcagcttaatatgcaggggacagcccaggaaaaagaagaatctgacgtggatctgaccgctactcaatcacctggggttcaggagtggctggcccaggccagaacaacctggacccagcagcggcagagttcacttcagcagcagaaggagctggagcaggaactcgcggaacagaaatcactgctgagatcggtggcgagtaggggcgaagaaatcctaatacaacactccgcagcagagacctcaggtgatgcgggagaaaaacctgacgtactgagtcaagaactgggaatggagggcgagaaaagcagcgccgaagaccagatgagaatgaagtgggagagtctgcaccaggagttttccacaaaacagaagctgttacagaatgtcttagaacaggaacaagaacaggtgctttacagccggcctaacaggttgctcagtggtgttccactgtacaagggcgacgttccgacccaggacaaaagtgccgtgacatccctgctagatggtttgaaccaagctttcgaggaggtgagcagccagagcggtggggctaaaagacagtcgatccacctagagcaaaaactttatgatggagtgtccgcaaccagcacctggctcgacgacgtcgaggagagactcttcgtggcaaccgctctcttacctgaggagacggagacttgcctattcaatcaggaaatactggcgaaggacattaaagagatgtctgaggaaatggataaaaacaagaatcttttttctcaggccttcccagaaaacggcgataatagggatgtgatcgaggataccctgggctgccttctggggagactgagcctcctcgattctgtggtgaatcagcgttgccaccaaatgaaggaacgcctgcagcagatcctgaatttccaaaacgaccttaaagtgctttttacctcactggctgacaataaatatattatattgcagaagctcgctaacgtgttcgagcagcctgtcgctgaacagatcgaggccatccagcaagcggaagatggactaaaggagttcgacgccggaatcatcgaattgaagcggcgaggcgataagttgcaggtcgagcagccctctatgcaggaactgtctaagttacaggatatgtatgatgagctcatgatgataatcggcagtagaagaagcggtctgaaccagaatttgacactgaaatctcaatatgaacgcgctctccaggacctggctgatttgctggagactgggcaggaaaagatggcaggagaccaaaagatcattgtcagcagtaaagaagagatacagcagctcctcgataagcacaaggagtactttcagggcctcgaatctcacatgattcttactgaaaccctgttcaggaaaatcatttccttcgctgtccagaaagagacacaattccatacagaattgatggcacaggcttcggctgttttgaagagagctcataagcgcggagtcgaactcgagtatatactagagacttggagccatctcgatgaggaccaacaagaactttcccggcaacttgaagtggtggaatcttcgattccctctgtgggcctggtggaggaaaatgaagataggctcatcgaccggatcaccctgtaccaacacctcaagtcaagccttaacgagtatcaaccgaagctttatcaggtccttgatgacggaaagagactcttaatttccatctcctgcagcgacttagaatcgcagctgaaccagctcggcgaatgttggctgagtaacaccaataaaatgtctaaagaactgcacagattggaaacgatcttgaagcattggaccagatatcagagtgagagtgctgaccttatccattggctgcagtccgcaaaggacagactggaattctggactcagcaatccgtgaccgtgccccaggagcttgaaatggtgagagatcacttgaatgccttcctcgagttctcaaaggaagtggacgctcaatctagcctgaagtctagcgtcctcagcacgggtaatcagctactgaggttaaaaaaggtggacactgccacgctgcgaagcgaactgagtcgaatcgacagccaatggactgacttactaacaaatattcccgcagtgcaggaaaagcttcaccagctgcagatggataaactcccaagcagacacgccattagcgaggtgatgagttggatctcccttatggaaaatgtcattcagaaggacgaggacaacatcaaaaattccatcggttacaaagctattcacgagtaccttcagaagtacaaggggttcaagatcgatataaactgtaaacaactgactgtggacttcgttaaccaatcggtgcttcagatctcctcccaggacgtagagtcaaagagatctgataagaccgacttcgcagaacagttgggggcaatgaacaagtcatggcaaattttgcagggccttgtgaccgagaagattcaattactggaaggtctgctggagtcctggtctgaatacgagaataacgtgcagtgtctgaaaacttggttcgaaacacaggaaaagagattgaagcagcaacacaggataggggatcaagcaagcgtccaaaatgccctcaaagattgccaggatctagaggacttgatcaaagcaaaggagaaagaagtggagaaaatcgaacagaacggtctggcactgatacagaataagaaagaggatgtgtcgagcattgtgatgtcgacgctgcgggagctcggacagacatgggctaacctagaccatatggtcgggcagctcaagattttattaaaatctgttcttgatcagtggagctctcacaaagtagcattcgataagataaacagctacctcatggaagcccgatacagtctctcccgattcaggctcctgactgggtcacttgaagccgtacaggtgcaagtggataatctccagaatctccaggatgacctcgagaaacaggagcgctccctgcaaaaattcgggtccatcactaatcagttgctcaaggagtgccaccctcctgtcacagaaaccttgacaaacaccctgaaggaggttaatatgcgctggaacaacctcctcgaagaaatcgcagagcagctgcaatcttcgaaagctttgctccaactatggcagaggtataaagactattccaaacaatgcgccagtaccgttcaacagcaagaagaccgcactaatgagttgctgaaagccgcaacgaacaaggacattgccgacgatgaggtggcaacctggattcaagactgtaatgaccttctcaaaggattggggacagtcaaagattccctgttcttcctccacgaactgggagagcaactgaaacagcaggttgatgcatctgctgcctctgcaattcagtcagatcaactgtccctctctcagcatctgtgtgctctggagcaggccctgtgtaaacagcaaacatctcttcaggcgggagtcctggattacgagacctttgcaaaatctttagaggctctggaggcatggatcgtggaggcagaggagatcctgcagggacaggaccccagccacagttcagacctaagtactatacaggagcgcatggaggaattaaaaggccagatgttaaagttcagcagcatggctcctgatctggatcggctcaacgagctgggctacagactgccgcttaacgataaagagatcaagcgcatgcagaacttgaaccgccattggtcactaattagtagccaaacaaccgagagattcagcaagcttcagagtttcctgctacaacatcagacctttctcgagaagtgtgagacatggatggaatttttagtgcagaccgaacaaaagctggcagtggaaatcagcggcaactaccagcacttacttgagcaacagagagcacatgaattgttccaggctgagatgttctcgagacagcagattctgcacagcatcatcatcgatggccagagattattggagcaggggcaggtggacgatcgtgacgagtttaatctgaaactcactcttctgagcaaccagtggcagggagtgatacgacgggctcaacaacgcaggggcattattgattctcagattcggcaatggcagcgatatcgcgaaatggccgaaaaattaaggaagtggttagtggaagtatcctatctccctatgtctggcctgggttccgtccccatccctcttcaacaagccagaaccctgtttgatgaagtccagttcaaggaaaaagtttttctgagacaacaggggagctatattctgaccgtggaagctggtaagcagctcttgctgtcggccgatagtggagcggaagccgctttacaggccgaactggcagaaatacaggagaagtggaagtctgcatcaatgcggctggaggaacagaaaaagaagctggccttcctcttgaaagattgggagaaatgtgagaaggggattgcagatagcttggaaaaactgcggaccttcaaaaagaagttgtctcagtccttgcctgatcaccacgaagaattgcacgccgagcagatgaggtgcaaggaattagagaatgctgtgggcagttggactgatgatcttacgcaactttcacttctgaaggacactctgagtgcatatatcagcgcagatgatatctcaattctgaacgagagggtcgaactgctgcaaaggcagtgggaagagctgtgtcaccaattgtctttacgacgtcagcagataggagagagactcaatgagtgggcggtctttagcgagaaaaacaaggagctatgcgaatggcttacacagatggaaagcaaagtctcccaaaatggcgacatcttaatcgaggagatgattgaaaaactgaagaaagattaccaggaagaaatagccatcgcccaggagaataagatccagctgcagcagatgggcgaacggcttgcaaaggccagccatgagtcgaaagctagcgagatcgaatacaaacttggtaaggtcaatgaccgttggcagcacctgttggatctcattgctgccagagtgaagaagctcaaagagacactcgtggctgtccagcagttggacaaaaatatgagcagtttgcgtacttggctggcacacatcgagtcagagcttgcaaaaccgatcgtttacgacagctgtaatagcgaagaaatccaacgaaagctgaatgagcagcaggagctccagagagacatcgagaagcattcgacgggtgtggcctctgtgctcaatctttgtgaggtgctgctgcacgactgcgatgcgtgtgcaaccgacgctgaatgcgacagcatccagcaagccacgcgtaatttggaccggaggtggaggaacatttgcgccatgtctatggagcgcaggctgaagatcgaagagacttggaggttatggcagaagtttctggatgattacagcagatttgaagattggctgaagagctctgaacgcaccgccgcattcccaagctcaagcggggtgatctacacagtggctaaagaagaattgaagaagttcgaagcgtttcagcgccaggtgcatgagtgtctgacccagctagagctcatcaataagcagtacaggaggctggccagagagaatcgcacagactcagcttgttcactgaaacagatggtgcatgagggcaatcaaagatgggacaacctgcaaaagcgcgttactagcattctccgcagactgaagcacttcatcgggcagcgggaggagtttgaaaccgcacgggactcaattcttgtgtggctcactgagatggatttacagctgacaaacatcgagcactttagtgaatgcgacgtgcaggcaaaaataaaacagctgaaggcattccagcaagagatttcacttaaccacaacaagattgaacaaataatcgcccagggagaacagctcatagagaagtctgagccccttgacgccgctatcatcgaagaagagcttgatgagctgaggcgatattgccaagaggtcttcggacgcgttgagagataccacaaaaagctaattcggttaccactacccgatgacgagcacgacctgtccgatcgagagctggagttggaggactccgccgcactctccgaccttcattggcacgatcgatcagctgatagcctactcagcccacagccaagcagcaatctgtctctgtcactggctcagccactcagatccgagcggagtggtcgcgacactcccgcttcagttgattctattcctctggagtgggaccacgactacgacttatcacgggacctggaaagcgctatgagccgggcattgccctccgaggacgaggaaggtcaggatgataaggacttctatcttagaggcgctgtggggctgagcggggaccacagtgctctggaatcccagatccggcagctaggaaaagcactcgatgacagccggtttcagatccagcagaccgagaatatcattagatctaaaacccctactggacctgagctggacacatcatacaaaggatacatgaagctgcttggggagtgttcatcctctatcgattcggtgaagcggctggaacacaagctgaaggaggaggaggagtccctgcccggatttgtgaacctgcactcgactgagactcaaactgcaggggtcatcgataggtgggagcttctgcaggctcaggccctgtcaaaggaactgcgcatgaagcaaaacctccagaaatggcagcagtttaattccgacctgaatagtatctgggcttggcttggagacaccgaggaagagctggaacaactgcagaggctggagctcagtaccgacatccagacaattgagctgcaaattaagaagctcaaagaattgcagaaggccgttgatcatagaaaggcgataatcctatcaattaacctgtgctcacctgagtttacacaggctgattcgaaggaaagtagggatcttcaagacagactgagtcagatgaacggacgctgggatagagtgtgcagcctgctcgaagaatggaggggcctgcttcaggacgcgctgatgcagtgccagggattccacgagatgtctcacgggctgctgttgatgctcgagaatatcgataggcgtaagaacgagattgttcctatagacagtaacctcgacgccgaaattctgcaggatcaccacaaacagctgatgcaaatcaagcatgaactgcttgagtctcagttacgcgtagcatccctgcaagatatgagctgtcaactactggtgaacgctgaggggactgactgcctcgaagcaaaagaaaaggtccacgtgatcggaaacagactgaaacttctgctgaaggaggtgagccggcatatcaaagaactggagaaactcctcgatgtcagttccagtcagcaggatctctcttcctggtcatcagccgacgaactcgatacatccgggagcgtcagccccacatccgggcgaagcacccctaaccggcagaaaacaccacgaggcaagtgtagtttgtcacagcccggtcccagtgtttcttctccacattctcgcagcactaaggggggaagtgactcttctctaagtgaacctggtcccggacggagcggaagggggtttctgttcagagttttgcgagctgcacttcctctccagctgctcctattgttgttaatcggcttggcttgtttggtacccatgtctgaggaagattactcatgtgcattgagcaacaacttcgcgagatcttttcatccgatgctgaggtatacgaacggtcctcctcctctttag

SEQ ID NO: 242066 - DNA, 9965 bp, Artificial Sequence
  Description of Artificial Sequence: Synthetic coding sequence
atggaactggacgccgctgttcagaaatttcttgagcagaacggtcagttagggaaacccctcgcaaagaagatcggcaaactcacggagctccaccagcaaactatacgacaggcagaaaaccgcctgtccaaattgaatcaggcggcttctcacctggaggaatataacgaaatgctggagctaatactcaaatggattgagaaggctaaagtgctagcacacggcacaattgcctggaattccgcctcccagttacgggagcaatacattcttcatcagacattattggaagagagcaaggagattgacagtgagctcgaagctatgaccgaaaagctccagtacctgaccagcgtttactgtactgagaagatgtcccagcaggttgccgagctggggagggagaccgaagagctccgacagatgattaagatcagactgcaaaatctgcaagacgctgcaaaggacatgaagaaattcgaggccgagctaaagaagctccaggcagctctcgagcaggctcaggcaacattgacatcacctgaggtgggaagactcagtcttaaagaacagctcagccaccgccagcacctcttgtcggagatggagtccttaaaaccgaaagtccaggccgtgcaactgtgccagtcagccctcaggattccagaggatgtcgtggcctcgctcccactttgccatgctgcacttagactccaagaggaggccagcaggcttcaacatactgctattcaacaatgcaacattatgcaggccgctgttgtccagtatgagcagtacgaacaagagatgaagcacctgcagcagctcattgaaggagcccatagagaaatagaggacaaacccgtcgcaacctccaatattcaggaacttcaggcgcagatatctcgacatgaggagctcgcccagaaaatcaaaggctaccaggagcagatcgcatcactgaattcaaaatgcaagatgttaactatgaaggccaaacatgcaacaatgctgctgactgtgaccgaggtggaagggctggccgaagggaccgaagacttagatggcgagctgctgcctacacctagcgcccatccctccgttgtaatgatgaccgccggtaggtgccacactttactgtcgcccgtaactgaggaatctggcgaagaaggtacaaatagtgagatcagcagtccaccagcttgcaggagcccatccccagttgccaacactgacgcctcagtgaatcaggatatagcctattatcaggccctatcagcagaaagactccagactgacgcggcaaaaattcatccatcgaccagcgctagtcaagagttttacgaacctgggctggaaccaagcgctaccgccaaattgggagatctccaacgatcttgggaaactctgaagaacgtcattagtgagaaacagcgcactctgtacgaagcgctcgagaggcaacagaagtatcaggactcactccagtcaattagtaccaagatggaggcgattgaactgaagttgtctgaaagcccagagcccggaaggtcccccgagtctcaaatggcagagcatcaggctctgatggatgaaatactaatgctccaggacgaaattaatgaactccagtcctcactagctgaagaactcgtgtccgagtcttgtgaggccgaccctgcagagcagctggcattgcagagcacactgacggtgctcgcggagcgaatgagcaccattcgcatgaaggccagcgggaaacgccaactgctggaggaaaaattgaacgatcagctcgaggaacagcgccaggagcaggcacttcagagataccggtgtgaggctgatgagctggatagttggctactgtctaccaaagctacactggacaccgctttatctccaccaaaggagcccatggacatggaagctcagctgatggactgtcagaatatgctcgtcgagattgaacagaaggtggttgcgctcagcgagttgagcgtgcacaacgagaacctcctcctggaaggaaaggcacacaccaaagatgaggccgagcagctggcagggaagctacgtagactcaaggggagtctgctggaactgcagcgtgccttgcacgataaacaattaaacatgcagggcacagcacaagaaaaggaggagagcgatgttgatctgaccgccacacagagcccaggagtccaggagtggctcgcccaagcaagaaccacctggacccaacaacggcagagctccctgcagcagcagaaagagctcgagcaggagctggctgaacagaagtccctgctccgctccgtagcttcaagaggcgaagaaatcttgatccagcatagcgctgcagaaactagcggcgacgctggggagaagcccgacgtgctaagtcaagaactcgggatggaaggagagaagtcatctgcggaagaccagatgcgtatgaaatgggagtcactgcaccaggagtttagtacgaagcagaaactgttgcaaaacgtgcttgaacaggaacaggaacaggtgctgtatagcagacctaaccgcctactcagcggagtaccattgtacaaaggcgacgtccctacacaggacaaatccgccgtcacgtctttgctggatggtctgaaccaagcctttgaggaggtgtccagccagtcaggaggagcaaaaagacagagtatacacttggaacaaaagctgtacgacggagtgtcggcaacttccacatggctggatgacgtcgaagagcggcttttcgtggctacagcgctgctcccagaggagacggagacatgcctgtttaaccaggaaatcctagccaaggacatcaaggaaatgtcagaggaaatggacaaaaataaaaacctgttctcacaggcattccccgagaacggcgataaccgagatgtaatcgaggataccctagggtgtcttctcggcagattgtccttactggacagtgtcgttaatcagagatgccatcagatgaaggagcgcctgcagcagatcctgaactttcaaaacgacctgaaggtactattcacctctctcgccgacaacaaatatatcatcctccagaagcttgccaatgtgttcgagcagccggtggcggagcagatcgaagccatccaacaagccgaggacggactgaaagagtttgatgcaggtatcatcgagctgaaacgacggggtgataaattacaggttgagcagccgagcatgcaggagttaagtaagttacaggatatgtacgacgaactcatgatgataatcggatccaggcgaagtgggttgaaccagaacttgaccctcaaaagccagtacgagagagccctgcaggacctggcagatttattagagactggccaggaaaaaatggccggagatcagaagatcatcgtgagtagcaaggaggagattcagcagctactggataagcacaaggaatatttccagggcctggaatcccatatgattctcactgagaccctgttcagaaaaattatcagctttgctgtacaaaaagaaactcagttccataccgaactgatggcccaggcttccgcagtgctgaaacgagcacacaaacggggtgtagaactcgagtatattctggaaacatggtcacatctggacgaagaccagcaggaattgagtagacagctagaggtagtggagtctagtattccttcagtgggcctagtggaggagaacgaggacaggttgatcgaccggatcactctgtaccagcatctgaagtcctctctgaacgaataccagccgaagctgtaccaggtgttagatgatgggaagagactgttgataagtatcagttgctccgacttggagtcccagctgaatcagcttggggaatgttggctgagcaacaccaataaaatgtccaaagaactgcatcggctggaaaccatccttaaacattggactagatatcagtccgagagcgccgacttaatccactggctgcagtcggctaaggaccgcttagagttctggacccagcagagcgtgaccgtaccccaggagttggagatggtgcgagaccaccttaacgcatttctggagttttcgaaagaagtagacgctcagtcttccctgaagtccagtgtgctttccaccgggaaccagcttctgagactaaagaaagtcgacacagcaacacttagatcagagctgagtcggatcgacagtcaatggacagatctgctgacaaacattcccgcagtgcaggaaaagcttcaccagctgcagatggataagcttccaagtaggcacgccattagcgaggtcatgtcatggatctccctgatggagaatgtcatccagaaggacgaggacaacattaagaatagcatcggatataaagccatccatgagtacctgcagaaatataaggggttcaaaatcgacattaactgcaagcagctgactgtggacttcgtgaatcagtctgtgttgcagatatcctctcaggatgtggaaagtaaaaggagcgacaagaccgactttgctgagcagctgggggctatgaacaagtcatggcaaattctgcaagggctggtaaccgagaaaatccagctgttggagggcctactggagagttggtctgaatacgagaataatgttcagtgcctgaagacctggttcgaaactcaggagaaacgcttgaaacagcagcaccggattggcgaccaggccagtgtccagaacgccctgaaggactgtcaggatctggaggatcttattaaagccaaagagaaggaggtggagaagatcgaacagaatggccttgccctaatacagaacaaaaaggaagacgtgtcatccatcgttatgtccaccctgagagagcttggccagacctgggcaaatctcgatcatatggtcggccaactcaagatcttgcttaagagcgttctggatcagtggtccagccataaggttgctttcgacaagatcaattcgtatcttatggaggcccgttactctctgagccgctttaggctcctgacaggaagtcttgaagcggtgcaggtgcaggtggacaacctgcaaaatctccaagatgacctcgagaaacaggagcgatctttgcagaagttcggttccataactaaccaattgttgaaggagtgtcatccacccgttacagaaacactcaccaacacactgaaagaagtgaacatgagatggaacaacctactggaagaaatcgcagaacagctgcaatccagtaaggccttattacagctgtggcagcgctacaaggattatagtaagcagtgcgctagcactgtgcaacagcaggaggatagaaccaatgagctcctgaaagcagctacgaacaaggacattgccgacgatgaagttgccacctggatccaggattgcaatgatctgctaaaaggactgggcactgtgaaggattcactcttctttcttcacgaactgggtgagcagctcaagcaacaggttgatgcctctgcagcatccgcgatccagtctgatcagctcagcctgtcacagcatctgtgtgccctcgagcaggcattatgcaagcagcagacaagcctccaggccggagtcctcgactatgagacattcgcaaagtccctcgaagcgcttgaagcctggattgtggaggctgaggaaattctccagggccaggacccgtcccactcttctgatttgtcaacaatccaggagcggatggaagagctgaagggccagatgctcaaattctccagtatggctcccgacctggatcgcttgaatgagctgggctaccgcctcccactgaacgacaaagaaatcaaaaggatgcagaatctgaacagacactggagcctgatttcaagccagactaccgaaaggttcagcaagctccagtcatttttgttgcagcatcagactttccttgaaaaatgtgaaacatggatggaattcttagtgcagactgaacagaagctggccgtggagatatctggaaactatcagcacttattggaacagcagagagcccatgagctgttccaagccgagatgttcagtagacaacaaatccttcactctataatcatcgacggccagaggctccttgaacaggggcaggtggacgacagggatgaatttaacctgaaactcactttgctatctaatcagtggcagggggtgattcgcagagcccagcagcggcgaggcattattgattctcaaattaggcagtggcagcggtaccgcgagatggccgagaagcttcgtaagtggctggtggaagtgtcatacctgcctatgtccggcctgggcagtgtgcctatccccctgcagcaggccagaacactctttgacgaggtgcagttcaaggagaaggtgtttctcagacagcaaggttcttacatcctgacagtggaggccggaaaacagctgctgctctccgctgactccggcgctgaggctgctctgcaggctgaactggcagagattcaggagaaatggaaatctgcctcaatgaggctagaggagcagaagaagaaactcgcttttttgctgaaggactgggagaagtgcgagaagggcatcgcggattcccttgagaagctgaggaccttcaaaaaaaaattgagccagtctttacccgaccaccacgaggaactccatgcagagcagatgagatgcaaggagctcgaaaatgctgtggggtcctggacagacgacctgacacagctgtccctgctgaaggatacactctctgcatatatatctgcggacgatatctccatcttgaacgagcgggtggaactcctgcagcggcagtgggaggaactgtgccaccaactcagcctgcgcagacagcagatcggtgaacgactaaacgagtgggccgtgttttccgagaagaacaaggagctttgcgaatggttaactcagatggaaagcaaagtttcacaaaatggtgatatactgattgaagaaatgatcgagaaattaaaaaaggactaccaagaggaaatagcgattgcacaggaaaataagatccagttgcagcagatgggggagagactggcgaaggcatcccacgaatcaaaggcaagcgaaattgagtataaactgggaaaggtcaatgatcggtggcagcacctgcttgatctgatcgctgcgcgagtgaaaaagttgaaagaaactctcgtggcggtgcaacagttggataaaaatatgtccagcctgcgtacctggctggcccacattgagtcagaacttgcgaagcctatagtttatgatagctgcaactccgaggagatccagaggaaactcaatgagcagcaagaactgcagagggatatcgagaagcacagcaccggagtcgcctctgtcttaaacctgtgtgaggtcctcctgcacgattgcgacgcttgcgcgaccgacgctgagtgcgattctattcagcaggctacacgcaatctggacagaaggtggcgaaatatttgtgccatgagcatggagcgcagactaaagatcgaggagacatggaggctctggcaaaagtttctcgatgattattcccgatttgaggattggcttaagtcttccgagagaacagccgctttccccagttcatctggcgtaatttacacagtcgctaaagaagaactgaagaaatttgaagccttccagaggcaggtgcatgagtgtctgacacaattggagttgatcaacaaacaataccgaaggctcgcacgagagaaccggacagacagcgcttgcagcttaaaacagatggtgcatgaaggcaatcagcggtgggacaacctgcagaaacgcgtgacaagtatcctgagaagactgaaacattttataggacagcgtgaagagttcgagaccgctagggattctattctggtttggctgacggaaatggatctgcaactgacgaacatcgaacacttttccgaatgtgacgtgcaggcaaaaatcaagcagctgaaggccttccagcaggaaataagcttgaaccataacaaaattgagcagatcatcgcccagggcgagcagctcattgaaaagtctgagccattagatgctgccataatcgaagaggaactcgacgagcttagaaggtactgccaggaagtatttggcagagtggaacggtaccataaaaaactcattaggttacctctaccagacgatgaacacgaccttagcgatcgggaactggaactggaagatagtgcagccttatccgatttacattggcacgatcgctcagccgattctctgttgagcccccaacctagtagcaacctgagcttatccctggcccagccactccgttcagagaggtctggaagagatacaccagcaagcgttgactccatccctctggaatgggatcacgattacgacttgagccgagatttggaatcggctatgtctagagcccttccgtccgaagatgaggaaggccaggatgataaggatttctatctccggggagctgtcggactgtctggcgatcatagtgccctcgaatcacagatccggcagctgggtaaggcactggacgacagccgtttccagattcagcagactgagaacattatccggtctaagacacctacaggcccagagttggataccagctacaaaggatacatgaagctgcttggagagtgctcgtcttccattgatagtgtgaagcgactcgaacacaagctcaaggaagaggaggagtcattacccggtttcgtgaatctccactccactgagactcaaacagctggggtcatcgataggtgggagctgttgcaggcacaggcactcagtaaggaactgaggatgaagcagaacctgcagaagtggcagcagtttaactctgatttgaattctatctgggcctggctcggggacaccgaggaggaactggagcaattgcaacggctggagctcagcactgacatccagactatagagttgcagatcaaaaagctgaaggaacttcagaaggcagtggaccaccggaaggcaatcattctttccattaacctgtgctcacccgaattcactcaggcagactccaaagagtcaagggatctgcaggacagacttagccagatgaacggaagatgggaccgtgtgtgctctcttttggaggaatggagggggctgctccaagacgcactgatgcagtgccagggctttcatgagatgtctcacggcctgctgttgatgctagagaacattgaccgcaggaagaatgaaatcgtgccaattgactcaaacctcgacgctgagatactgcaggaccaccataaacagctgatgcaaattaaacatgaattgctggagagccaactgcgggtggcgtctcttcaagatatgagctgtcagcttctcgtgaatgccgagggcacagactgcctggaagccaaggagaaggtccacgtgatcgggaacagattgaaactgcttctgaaagaagtgagtagacacatcaaagaacttgagaaattgctggatgtctcctcatcccagcaggacctctcatcgtggagcagcgctgacgaattagatactagcggtagtgttagccccacatccggcagaagtacccccaaccgccaaaagacacccaggggtaaatgcagtctctcacagccaggtccaagcgtttccagcccgcattctagaagcaccaaaggtggcagcgactcttccctgagtgaacccggtcccggaaggtccggcagaggctttcttttccgagtgttgagagctgcattgccgctccaactgctgctcctcctgctgatcggcctggcctgtctggtgcctatgtccgaggaggactactcttgtgcactgagcaataattttgcccgtagttttcatcctatgctcaggtacaccaatggtccgccacccctgta

SEQ ID NO: 242067 - DNA, 2934 bp, Artificial Sequence
  Description of Artificial Sequence: Synthetic coding sequence
atggttgtcgccgaagatctcagtgcgctgaggatggctgaggattcttgcgttgatgcagatctgcctgattgtaattgcgatgtgactcggcagagggttaagaagctaaaagagactcttgttgctgtccaacagctcgacaagaatatgtccagcctgagaacttggctagcgcacatagagtcagagctcgccaagcccattgtgtacgattcttgtaattccgaggaaatccaaaggaagttgaacgaacaacaggagttacagcgcgatattgagaagcactctacaggcgttgcgagcgtactaaatttgtgtgaagtgctgttgcatgattgtgacgcttgcgccaccgatgcagagtgtgattctatccagcaggccactcgtaacttggaccggagatggcgcaatatttgcgccatgtcaatggagcgcaggttgaagattgaagagacatggcgcctgtggcaaaaatttcttgatgattactcccgattcgaggactggctgaagtcttcagaacgcacagctgcatttccctcgtcctccggggtgatttataccgtagctaaggaagagttaaaaaagtttgaagcctttcagcggcaggtgcacgagtgcctcactcagttagaactgataaacaagcaatatagacgcttggcgagagagaaccgaaccgattctgcgtgcagtttaaagcaaatggtacacgagggtaaccagagatgggacaacctgcagaaaagggtgacatctatcctgagaagacttaagcattttatcgggcagagggaggagtttgagactgccagggactcaattctggtgtggctcacagaaatggaccttcagctcaccaatatagaacacttttccgagtgcgacgtgcaggccaaaatcaagcaattgaaggcttttcagcaggaaatctctttgaaccataacaagatagaacagatcatcgcccaaggggagcagctgattgagaagagtgagccactggatgctgcaataattgaggaggaacttgacgagctccgcaggtattgccaggaggtgtttgggagagtggagcgttatcataagaagttgattagactgcctctcccagatgacgagcatgatctttctgatagggagttagaactagaagacagcgccgctttgagtgacctgcactggcacgaccgatctgcagattccttgttatctcctcagccatcctccaacttatctctgagtctcgcccaaccccttcggagtgaacgctcagggagagacacacccgcatccgtggatagcatcccactcgagtgggaccatgactatgacctctccagagatctagagtccgctatgtcccgcgctctgcctagtgaagacgaggagggacaggacgacaaggacttctacctccgcggagctgtgggtctgtccgatgtaatgattccggagtcccctgaagcttacgttaagctcacggagaatgcaattaagaatacgtctggagatcattccgcccttgagagccagatccgccagttgggaaaggctctggacgatagcaggtttcaaatccagcagacagaaaacattattaggtccaaaactcccaccggcccagagctggataccagttataaaggatacatgaaactcctgggcgaatgttcatcttctatcgactctgtgaagcgactggagcacaagctgaaggaagaagaggaatcccttcccggattcgtcaatctgcacagtacagaaacacaaacggcgggagtaatcgatcgatgggaactgctccaggctcaggcgcttagcaaggaacttaggatgaagcagaaccttcagaaatggcagcagttcaactctgatctcaacagcatctgggcttggctgggagacaccgaggaagaattagaacagctccagcgcctcgagttgtccactgacatccaaacgatcgaactccagattaaaaagttgaaggagctacagaaagcagtggatcaccgcaaggctattatactgtcaattaacctatgtagcccagaattcacccaggcggacagtaaggaaagtcgggacctccaagataggttatcacagatgaacggcaggtgggaccgtgtgtgttcactcctggaagagtggaggggactgctacaggacgcactaatgcaatgccaggggtttcatgagatgagtcacggcctactgctgatgctggagaatatcgatcgacgaaagaatgaaatcgtgcctattgactctaatctggatgccgaaatcttgcaagaccatcacaagcagctgatgcagataaaacacgagcttctagagagtcagctccgcgtcgcgagcctacaggatatgagttgccagctgctggtgaatgctgagggaaccgactgtctcgaagcaaaagaaaaggtgcacgtgatagggaatagactcaagttgttattaaaagaagtgagtcgccatataaaagagctggagaagctgcttgatgtgagctcatctcaacaggacttgagttcttggagctcagcggatgaactggatacctccgggagcgtcagtcctaccagcgggcgatccaccccaaaccgccagaaaacacctcggggaaaatgctcactgtcccagccaggtccctccgttagctccccccacagtcgcagtaccaaaggaggctccgattccagtctcagcgagccaggtcctggcaggtccggacggggattccttttcagggtgctgcgcgcagcacttccattgcagctgctgttactgctgttgatagggcttgcttgtctggtcccgatgtccgaggaagattactcctgcgctttgtcaaacaattttgcacggtctttccacccaatgttacgatacaccaatggaccgcctcccctgtag

SEQ ID NO: 242068 - DNA, 26393 bp, Artificial Sequence
  Description of Artificial Sequence: Synthetic coding sequence
atggccacgtcacgaggggcaagtagatgccctagagacattgccaatgtgatgcagcggttgcaagatgagcaggaaatagtccagaaacggactttcactaagtggataaattcacaccttgcgaaaagaaaacctcctatggtagtggatgacctgtttgaagacatgaaagacggggtgaagctgctagctctgctcgaggtactctccggacaaaaactgccttgtgagcaagggaggaggatgaagaggatccacgcagtggccaacattggcacagccctaaagttcctggaggggcgtaaaatcaaattggtcaatatcaacagtacagatatcgccgatggcaggcctagcatcgtgttgggactgatgtggacaatcatactttatttccagatcgaggagcttacttctaatttgccacagttgcaaagtttgtctagcagcgcttcctccgttgatagcatagtgtcgtccgagacaccaagccccccaagtaaacggaaggtgaccacgaagatccaggggaacgctaagaaagcgctcctgaaatgggtccagtacaccgcagggaaacagactggtatagaggtcaaagacttcgggaaaagctggcggtctggagtcgcttttcacagtgtgattcatgctatcagaccagaattggtcgatttggaaaccgtgaaagggaggtctaacagggagaatctggaagacgccttcactatcgcggaaactgaattagggatccctcgactgctcgaccctgaagatgtggacgtggacaagcccgacgagaaaagcattatgacatacgttgcccagttcttaaaacattacccagacatccataatgcctctaccgatggccaggaggatgatgagattcttcccggttttccatcctttgccaactctgtccaaaactttaagagagaggacagggtcattttcaaagagatgaaggtgtggattgaacaatttgaacgagacttgaccagagcccagatggtggaaagtaacctgcaggataaataccagagctttaaacacttcagggtgcagtacgaaatgaaaaggaagcagattgaacacctcatccagcctctccacagagacgggaaactgtcccttgaccaggcattggtcaagcagtcctgggatcgggtaaccagccgtctcttcgattggcacattcagctggataaaagtctgcctgccccactgggaacaataggcgcttggctctatagggctgaagtcgccctccgggaggagatcacggtccagcaggtgcatgaggaaaccgcaaacacaatacagcggaaactcgaacagcataaagacctgctccagaatacagacgcacacaagcgcgcatttcatgagatttataggaccagatccgtaaacggcattccggttcctccggatcagctcgaggacatggcagaacggtttcacttcgtttcgtccacgtccgaactgcatcttatgaagatggagtttctggagctgaaatacaggctgctgtcgttgcttgtgctggcagagagtaaactgaaaagttggattatcaagtatggccgacgagagtcagtggagcagctgctgcagaattacgtgtctttcatcgagaatagtaaattcttcgagcagtacgaagtgacttaccaaattctgaagcaaacagccgaaatgtatgtgaaagcggatggtagtgtcgaggaggccgagaacgtgatgaaattcatgaacgagaccactgctcagtggagaaatttgtccgtcgaggtgcgctcggtgcgctctatgctcgaggaggttatcagtaactgggatcgatacgggaacaccgtggcctctctgcaagcttggctggaagacgctgagaaaatgctcaatcagtctgaaaacgctaaaaaggactttttcaggaatctaccccactggatacaacagcacactgccatgaacgatgccggaaactttctgatagagacatgtgatgagatggtttcgcgcgatctaaaacaacagcttctgttactgaatggacggtggcgagagttgttcatggaagtgaagcagtacgcccaggctgatgagatggacagaatgaagaaggagtacacggactgcgtagtcactctcagcgccttcgccacagaagctcacaaaaagctgagtgaaccgctcgaagtaagctttatgaatgtgaagctgctgatccaggatttagaagatatcgaacagagggtgccagtgatggacgcccaatataagatcatcacaaaaacggcacacctcattactaaagagtctcctcaggaggagggtaaggaaatgtttgctactatgtccaaacttaaggagcagttgacaaaggttaaagaatgctactctcccttgttgtacgaatcccagcagctactgatacctctggaggagctggaaaagcagatgacatcattttacgattccctgggcaagatcaatgaaatcatcacagtactagagcgagaggctcagtcatctgcactgttcaagcagaagcaccaggagcttcttgcttgccaggaaaattgcaagaaaacactcactctgatcgagaagggaagccagtccgttcaaaagtttgttactctaagtaacgtgctcaagcatttcgatcaaacgagacttcaaagacagatcgcagacattcatgtcgcctttcagagtatggtgaaaaaaacgggtgactggaagaaacacgtggaaacaaactcaagactgatgaagaagttcgaagagagccgagcagaactggagaaggtgttgcgaatcgctcaagaaggacttgaggaaaagggtgatcccgaggagctgctgagacgccatactgaattcttctcccagctagaccagcgggtgctgaacgcctttcttaaagcttgtgatgagttgacagatatcttgcccgagcaggaacagcagggtctccaggaggcagtgcgaaaactgcacaaacagtggaaggatctgcaaggagaggctccataccatctgctccatctgaagattgacgtggaaaaaaatagattccttgcatctgtggaggagtgccgcaccgaactggatcgggagaccaagctaatgccgcaagaagggtctgagaagatcatcaaggagcatcgggtgtttttctctgacaagggccctcaccacctgtgcgaaaaaagactccagctgattgaggagctctgcgtcaaactcccggtgagggatcccgtccgagataccccaggcacttgtcacgtgacgctcaaggagttaagagctgccattgatagcacttataggaagctgatggaggatcctgacaagtggaaggattataccagtcgcttctctgagttttcttcctggattagtacaaatgagacgcagctgaagggtattaagggagaggctattgacaccgcaaaccatggagaggttaaacgtgctgtagaagagattcggaatggggtgaccaagcggggtgaaacattatcttggctgaagtcgaggctgaaggtacttacagaagtaagctctgagaacgaagcacaaaaacagggagacgaactggcaaagctgagtagctcttttaaggctctggtaacactcctgagtgaggtggagaaaatgttatctaactttggggactgcgtgcaatataaggaaatcgtcaagaactcgctcgaggagttgatatctggaagtaaggaggtgcaagaacaggccgagaagatcctcgatactgagaacctgttcgaagcccagcagctgcttctgcaccatcagcaaaaaaccaagcgaatatcagccaaaaaacgcgatgttcaacagcagatcgcacaggcccaacagggcgaggggggactgccggaccgcggacacgaagaactgagaaaactggaatctacactggacgggttagagcggagccgcgaacggcaggaacgacgtattcaggtaaccctgagaaagtgggaacgatttgagacaaacaaagaaaccgtggtcaggtatttgttccagactggctcgagtcacgagcgatttctgtcatttagctccttagagtcactgagtagtgagctcgagcagaccaaagaattttctaagcggacagagagtatagccgttcaggcagaaaaccttgtgaaggaagcctctgaaattcctttggggccacagaacaaacagctgcttcagcagcaggcaaagtcaatcaaagagcaggtaaagaaactcgaggacaccttagaggaggacattaagactatggaaatggtcaagaccaaatgggaccactttggttcaaatttcgagaccctgagtgtctggattaccgagaaagagaaggaactcaacgcactcgagactagctccagtgctatggacatgcagataagccagataaaggtgactatccaggagattgagagcaaactctcttcaattgtcggacttgaggaggaagctcagtccttcgcccaatttgttacaacgggagagtcagccagaattaaggcgaagctgacccagatcaggcggtacggggaagaattaagggaacacgcccaatgtctcgaagggaccatactcggccacctttcacagcaacaaaaatttgaagaaaacctgagaaagatccagcagagcgtttctgagttcgaagacaagctggccgtacctataaagatctgttctagcgctacagagacatataaggtactacaggagcatatggacttgtgccaggccctggagagtctctcctcagcgattacggcattcagcgcgtccgccaggaaggtggtgaaccgggacagctgcgtacaggaagcagctgcactgcagcaacagtatgaggatattctcagaagggctaaggagaggcagactgctttggaaaaccttctggcacattggcagcgcctcgaaaaggagctgtcaagctttcttacttggcttgagcgtggggaagcgaaggcgtcaagccccgaaatggacatctctgcagatcgcgtgaaggtggaaggtgagctacagctgatccaggccctccaaaacgaagtggtgagccaagccagcttctatagtaagctcctgcagctcaaagagtccctgttcagcgtggcgtccaaggacgacgtaaagatgatgaaactgcatctcgaacagctggacgaacgctggagagatctgccccagattattaacaagaggattaacttcctgcaatcagtggtcgctgaacaccaacaatttgacgagctacttctctccttttcagtgtggatcaagctgtttttgtcagagttgcagactacttccgagatcagcatcatggaccaccaggtcgctctaaccagacacaaggatcatgcagccgaggtcgagtctaagaagggcgagctccaatccctgcagggccacctggccaagctcggatctctcgggcgagcagaggacctgcacctcctgcagggcaaagcagaagactgctttcaattattcgaagaggcctcacaggttgtcgagaggcgccagttggccctgtcccatctggctgagtttcttcagtcccatgcaagcttgagtgggatcctgagacagctaaggcagacagtagaggcaacaaattccatgaacaagaacgagagcgaccttatcgagaaggatctaaacgacgccctgcaaaatgccaaagcccttgagtcggcagccgtgagtctcgacggcatcctctccaaggcgcaatatcaccttaaaatcggttcatccgagcagcgaacctcctgtcgcgcaactgccgaccagctatgcggggaagtcgagcgtatacagaatctcctgggaaccaagcaaagcgaggccgacgcactggccgttctgaagaaagccttccaagaccagaaagaggagctcctgaaatcaatcgaggacatagaagaacggaccgataaggaaaggctgaaggaacccacaaggcaagccttgcagcaaagactgcgagtgttcaatcagctggaagatgaactcaacagccatgagcacgagctatgctggctgaaagataaggctaagcagattgcccagaaagatgtagccttcgccccagaggtagacagggagattaacagactggaggtaacctgggacgatacgaagagactgatccacgaaaaccagggccaatgttgtggactgattgacttgatgagagagtatcaaaacctcaagagcgccgtatcaaaggtcctagaaaacgcttcaagcgtaatcgtcactcgcacgacaatcaaggaccaggaggatctcaagtgggcctttagcaagcacgaaacagcgaagaataagatgaattacaagcagaaagacctcgataactttacctccaaaggcaagcacttactgagcgagctgaagaaaatacacagcagtgatttctcactggtgaagacggatatggagtcaactgtggataagtggctcgacgtgtctgaaaagcttgaagagaatatggatcgtctgcgggtctcactgtctatttgggatgatgtgttatcaacccgggatgaaatcgagggttggtcaaataattgtgttcctcaaatggcagagaatatctcaaacctcgataaccatctgcgggcagaggagttgctcaaggaattcgaatccgaggtgaagaacaaggctctgcggctcgaagagttacacagcaaggtgaacgacctcaaggagttgaccaaaaacctcgagacaccccctgacctgcagttcattgaggctgacttgatgcaaaaacttgaacacgctaaggagatcacggaagtagccaaaggcactttgaaggattttaccgcccagagtacgcaggtggaaaaattcatcaatgatattaccacctggtttacaaaggtggaggagtcactgatgaactgcgctcagaatgagacatgtgaggcactgaagaaagtaaaggacatccaaaaagaattgcaatcacagcagagcaacattagcagcacacaggagaacctaaatagcctgtgcagaaaataccactccgctgagctggaatctctgggaagagccatgaccgggctgattaaaaagcacgaagctgtgtcccagctgtgtagcaagacccaggcatccctacaggaaagtctggagaagcatttctcggaatctatgcaggagtttcaggagtggttccttggggctaaagccgctgccaaagagagtagtgatcgaacaggcgacagtaaggtgttggaggcgaaattgcacgacttacagaatatcttggattccgtgtctgacggtcagtccaaactcgatgcagtcacccaggaggggcagaccctgtacgcccacttgtccaaacagatagtcagtagcattcaggaacagatcacgaaagctaacgaggagtttcaggcattcctgaagcagtgtctcaaggacaagcaggccctccaagactgcgcttccgaattgggctctttcgaggaccagcaccgcaaactcaacttgtggattcacgagatggaggagcgcttcaacacagaaaacctgggcgagtctaaacaacacattccggagaaaaagaatgaagtgcataaggtagaaatgttcctgggagagctcctggccgctcgcgagtccctggacaaactttcccagaggggccagctgttatccgaggagggccacggcgctggacaggaagggcgtctgtgttcacagttactcaccagccaccaaaacctgctgcggatgactaaagaaaagctgcggagctgccaggtggcattgcaagaacatgaagcacttgaggaggccttacagagcatgtggttctgggtgaaagctattcaggatagacttgcctgcgccgagtccaccttggggtctaaggacacattagagaagcgcctttcacagatccaggatatcctcttaatgaagggcgagggtgaagtcaaattgaacatggctattgggaagggggaacaggccctacggtcctcgaataaagaaggacagcgggtgatccagacccagctcgagacactcaaagaagtttgggccgacatcatgtcgagtagcgtgcacgcacagtcaaccctggagagtgtgatctcacagtggaatgattacgtcgagcggaagaaccagttggaacagtggatggagagcgtagaccagaagattgagcacccactgcaaccacaacccggactcaaggagaagttcgtgcttcttgatcacctgcagtctatcctgtctgaagcggaggaccatacacgagccctgcatcgcctgatcgcgaagagccgagagctgtatgagaagacagaggacgaaagcttcaaagataccgcccaagaagaactcaaaacacagtttaacgatattatgacagtggctaaggagaaaatgcggaaggtcgaggagatcgtcaaggatcacctcatgtatctggatgccgttcacgagtttacggactggctgcactctgcaaaggaggaactgcaccgctggagtgacatgagcggggattcctcggccacacaaaaaaaattgtccaagataaaggaactgattgactcccgcgaaattggagcctcaaggttatctagagtcgagagcctggcacccgaagtgaaacagaatacaactgcatctgggtgtgagctgatgcatacagagatgcaggctttacgcgctgactggaaacagtgggaggattccgtattccagacacagtcttgcctcgagaacttagtgtctcagatggccctaagcgaacaggaattctccgggcaggttgcccagctggaacaggctctggagcagttctcagcgctcttgaagacctgggcacagcagttaacacttctagaaggtaagaacacagacgaagaaatagtagaatgctggcacaagggtcaggaaatcctggacgcactgcagaaagccgaaccaaggactgaggatctgaaatctcagctgaatgaactgtgtcgcttctctagagacctcagcacatattcaggaaaagtcagcgggctcatcaaagagtacaattgcctttgcctccaggcttccaaaggatgccagaacaaggagcagatcctccagcagcgattcaggaaggcttttagagattttcagcaatggctggtaaacgcaaagatcacaacagctaaatgcttcgacatcccccagaacatctccgaggtctccacaagcctgcagaaaattcaggaattcttgtccgagagcgagaatggacagcataaactgaatatgatgctttcgaaaggggagctgctgtccacacttttgactaaggagaaggcaaaagggattcaggctaaggtcactgccgcaaaggaagattggaagaattttcactccaatctgcaccagaaggagtcagcattagagaatcttaaaattcagatgaaggatttcgaggtctctgcggaaccgatccaggactggttgagcaagacagaaaagatggtgcatgaaagtagcaaccgactgtatgacttaccagcaaagaggagagaacagcagaaattgcagagcgttctggaggaaatccattgctatgaacctcagttaaatcggttgaaggagaaagcccagcagctatgggaagggcaagccgcttccaaatcatttaggcaccgggtaagtcaattgtctagccaatatttggcattatccaacctcacaaaagaaaaggtgagtaggctcgataggatcgttgcggagcataatcagttcagtctgggaatcaaggagctgcaggattggatgactgatgccatccacatgctggacagctactgccatcctacgagtgacaaatcagtgctcgattccaggactttaaaactggaggccctgctgagtgttaaacaggaaaaagagatccaaatgaagatgatcgtcacacgcggagaatccgtcctgcaaaatacctctccagagggcattccaactattcagcaacagctccaatcagtaaaagatatgtgggccagcttacttagcgccggaattaggtgtaagagccagctcgagggggcactttctaagtggaccagctatcaggacggcgtgcggcaattttcaggctggatggactcaatggaagcgaacctaaacgaaagcgaaaggcagcacgccgagctgcgagataagacaaccatgctcgggaaggctaagcttctcaatgaagaggtgcttagctattcaagtctcttagagactatcgaggtcaagggggctggcatgacagagcattacgtcactcagcttgagctgcaggacctacaggagagataccgcgctatccaggaaagagcaaaggaggccgttacaaaatccgaaaagctggtgaggttgcaccaagagtatcagcgcgacctcaaagcctttgaagtgtggttgggtcaagagcaagagaaactagaccagtacagcgtactcgaaggtgacgcccatacacatgagacgactctgcgagatctccaggaactgcaggtgcactgcgcagagggccaagccctccttaactcagtgttgcatactcgggaagatgtgatcccaagtgggattccacaagccgaggacagggctttggaatcactgcgccaggactggcaggcctatcagcataggctcagcgagacacgcacccagttcaataatgttgtcaacaagcttcgactgatggagcaaaagtttcagcaggtggatgagtggcttaagacagcggaggaaaaagtaagtccacgcacccgacgacagtcaaatagggctacaaaagagatccagctgcaccaaatgaagaagtggcacgaggaagtcacagcctatagagacgaggtggaagaggtgggcgcacgcgctcaggagatccttgatgaatcccacgtgaacagcagaatggggtgccaggccacacaactgacctcccggtatcaggcactacttctgcaggttctggaacagattaagttcctagaggaagagatccaaagtctggaagagtccgaatcctcactctccagctatagcgattggtatggttccacccataagaatttcaagaacgtcgctacaaagatcgataaggtcgacacagtgatgatgggaaagaaactgaagactctagaggtgctgctgaaagacatggaaaaggggcactcactgcttaagtccgcaagggagaaaggggagagggcagtcaaatacctagaggagggggaagccgagcggctgcgaaaagagatccatgatcacatggagcagctgaaggaactgacatccaccgtgagaaaagagcacatgaccctcgaaaagggcctgcacctcgctaaggagttcagcgacaaatgtaaggctttaacgcagtggattgcagagtaccaggagattctacacgtgcccgaggagcctaagatggaactatatgagaaaaaagcccagttatccaagtacaaatcgcttcagcaaaccgtcttgtcacacgaaccatctgtgaaaagcgtgagagaaaaaggggaggccctgctggaactcgtgcaggatgtcactctcaaagacaaaatcgaccaattgcagtccgattaccaggacctgtgctcgatcgggaaagagcatgttttctccctggaggccaaggtaaaagatcatgaggattataacagcgaactccaggaggtagagaagtggctcctgcagatgtccggtaggctagtggctcctgacctgctggagacatccagtctggagaccataacacaacagctggctcatcataaagcgatgatggaggaaattgctggctttgaagaccgacttaataatctgcagatgaaaggcgataccttaattgggcagtgcgcagaccacctgcaggcgaagttaaagcagaatgttcacgcccatctacagggaaccaaagatagctactcagctatctgcagcacagcccagcgcatgtatcagtctttggagcacgagctgcagaaacacgtatctcgccaggacactttgcaacagtgccaggcctggctctcagccgtgcagccagaccttgaacccagcccccagccccctctgagccgcgcagaggccatcaagcaggtcaagcactttagggccctccaagagcaagcccgaacttaccttgacctcctttgcagcatgtgcgaccttagcaatgcgagcgtgaaaactaccgccaaggacattcagcagacggaacagaccatcgaacagaagttggtccaagcgcagaatctgactcagggatgggaagagataaaacatttgaaatcagagctgtggatttaccttcaggacgcagaccaacaactacagaatatgaaacggaggcattccgaactggaacttaacatagctcagaacatggtctcgcaggtgaaggacttcgtcaagaaactccagtctaaacaggcatctgttaataccattatcgaaaaggtgaataaactcacaaagaaagaggagtcaccagaacacaaggagatcaaccaccttaacgaccagtggctggacctctgtcgccagtccaacaatctgtgtttgcagcgcgaagaagatctccagaggactcgcgactaccacgattgcatgaatgtggtggaagttttcctggagaagttcactaccgaatgggacaatttagctcggtccgatgccgaaagtaccgcagtgcacctcgaagctctgaagaagctcgccctggctctccaggagaggaagtatgccattgaggacctgaaggaccagaagcagaaaatgatcgagcacctcaacctagatgataaagagctcgttaaagagcagacatctcacctggagcagcgctggttccagctggaggaccttatcaagaggaaaatccaggtgtccgttactaacttagaggaattgaatgtggttcaatccagattccaagaattgatggaatgggctgaggagcagcagcctaatattgctgaagctttaaagcaaagtccaccaccagacatggcccagaacctgctaatggaccatttggctatttgctcggaattggaagccaagcagatgctgctgaagtcccttataaaggacgcagaccgagttatggctgacctcgggctcaacgaacggcaggtgatacagaaagccttgtccgatgcacagtctcatgtcaattgtttatccgacctggttggccagcgaaggaaatatctcaataaggcactgtctgaaaagacgcagttcctaatggcggtctttcaggccacctcacagatccagcagcacgaacggaaaatcatgttccgggagcatatttgcctgttaccagacgacgtgtctaagcaggtaaaaacgtgtaaatccgcacaggcgagccttaagacctaccagaacgaggtgactggtctatgggcgcagggtcgggagctgatgaaggaagtgaccgagcaagaaaagtcagaggttctgggaaagctgcaggagctgcaaagcgtgtacgacagcgttcttcaaaagtgttcgcaccggttacaagagctcgaaaagaacctcgtctctcgaaaacactttaaggaggatttcgacaaagcgtgccattggcttaagcaagccgatatcgtgacattccccgaaatcaacctgatgaatgagagtagtgagctccacacacagctggccaagtaccagaatattcttgagcagtctccagagtacgaaaatctgctgctcacccttcagagaactggccaaaccatcctcccttctttgaacgaagttgatcactcatatttgagcgagaaactaaacgcactgcccagacagttcaacgtgattgtggcacttgcaaaggacaagttttacaaagttcaagaagcaattttagccagaaaggagtacgcctcacttatcgaacttacaacacagagcctcagcgagctggaggcacagttcctgagaatgagtaaggttccgaccgatttggcagtcgaggaagcactgagcctacaagacggttgtcgggctatactggacgaagtggccggtctgggcgaggcagtggatgagctaaaccagaagaaagaaggctttcggtccactggccagccttggcagcctgataagatgttacatctcgtgactctttaccacaggcttaaaaggcagacagagcagcgcgtgagtttgctggaggatacaacctccgcttatcaagaacatgagaagatgtgtcagcagctggaacgccagctgaagtccgtcaaagaggagcagtccaaagtcaatgaggaaactctgcctgctgaggagaagcttaagatgtatcatagccttgcaggcagtttgcaggacagcggaattgttttgaagcgcgtaactattcatttggaggatcttgcaccacatttggacccgctcgcttatgaaaaagccagacatcaaatacagagctggcagggtgagctgaaactgctgactagcgcgatcggcgagactgttaccgagtgcgagtcacggatggttcagtcaattgacttccagactgagatgagcaggtctctggactggctgcgaagggtgaaagctgaattgtcgggtcctgtctacctggatctcaatctccaggatatccaggaggaaattcgcaagattcagatccatcaggaagaggtgcaatcttccttacgcattatgaatgcactatcgcacaaagaaaaggaaaagtttaccaaagccaaggaactgatatcagcagatctggaacactccttggcggaactgagtgagctggacggagatattcaggaggccctgaggaccagacaagctacactgaccgagatctactcccagtgccaacggtattaccaggttttccaggctgccaatgactggctcgaggatgcccaggaattgctccagctcgcaggaaatggcctggatgtcgaatccgccgaagaaaaccttaagagtcacatggagtttttttccaccgaagatcagtttcatagtaacttggaggagcttcacagtttggttgctaccctggaccctcttataaagccaactggcaaggaggacttagagcagaaagtagccagcctggagctaagatctcagaggatgtcccgcgactctggtgctcaggtggatctgcttcaacggtgtacggctcagtggcacgattaccagaaggcccgagaagaggtgatcgagctaatgaatgacacggaaaaaaaattatccgaattcagtctccttaaaaccagctccagccatgaggcagaggaaaagttatcagaacataaggctctggtttcggtcgtgaatagcttccatgaaaagattgtggcgttggaagagaaagcctcgcagctggagaagaccggaaacgatgcatccaaagccacacttagccggagcatgaccactgtttggcagagatggacccgcctccgagccgtggcacaggaccaggagaaaatccttgaagatgccgtggatgaatggactggcttcaacaacaaagtgaagaaggccactgagatgatcgatcaactgcaggataagctgcctggaagctccgcagagaaggcctctaaagctgagctcttaacgctgttggaatatcatgacacgtttgtgcttgagctggagcagcaacaatcagccctagggatgttaagacagcagacattgtctatgctgcaggatggggctgctcccactcccggtgaagagcctcccctgatgcaagaaatcaccgccatgcaggatagatgtcttaatatgcaggagaaggtgaaaactaacggcaagcttgttaagcaggagctgaaggacagagagatggtggagacccagattaattctgtgaagtgctgggtccaggagacaaaagaatatttaggaaatccgactatcgagatcgacgcacagcttgaggaacttcagattctgctaacagaagctaccaatcacaggcaaaatatcgagaaaatggccgaggaacagaaagaaaagtatctgggtctgtacacaattctgcccagcgagctatccctgcagctggctgaggttgccctggatctgaagattcgggatcaaatccaggacaagataaaagaggtcgaacaatctaaagcaacttcccaggaactgagtaggcagatacaaaagttggcaaaggacctcactacgattttgacgaagctcaaagccaagactgataacgtggtacaggcgaaaaccgatcagaaggtgctgggcgaagagcttgatggctgtaactcaaagttgatggaactcgatgcagccgtgcagaagtttttagagcagaatgggcaactgggtaaaccccttgcgaaaaaaattggaaaactcacagagcttcaccagcagacaattcgtcaagccgaaaatcggttgtctaaacttaatcaggccgctagtcacctcgaggaatataatgagatgcttgagctaattctcaagtggattgagaaagctaaagtgctggcgcacggaaccatcgcttggaactccgctagccagcttcgcgagcagtacattctccaccaaactctgctggaggagtcaaaggagattgactccgaactcgaagctatgacagaaaaattacagtacttgacgtcagtgtactgtactgaaaagatgtcacagcaggtagccgagctaggccgagagaccgaggagctgaggcagatgatcaaaattcgcttgcagaatcttcaagatgcagcgaaggatatgaagaaatttgaggccgaactgaagaagctgcaggccgctctagaacaggcccaggccactctgacatcaccagaagtgggcagactttcgttgaaggagcaactgtcccatcgccagcatctgcttagtgagatggagtctctgaaaccaaaagtccaagcggtgcagctgtgccagagcgcattgagaatcccggaggacgtggtggcttcactcccactctgccatgccgcattgcgattgcaagaggaggctagtcggctgcagcacaccgcaatacagcagtgtaacatcatgcaagaggcagtcgtgcaatatgaacaatatgagcaggaaatgaagcatctccagcagctcatagagggcgcacaccgggaaattgaggataagcctgtagccactagcaacatccaggaactgcaagctcagatttcaaggcacgaggagttagcccagaagattaaggggtaccaggaacaaatagcctccctgaactcaaagtgcaaaatgctgacgatgaaggccaaacacgcaacaatgctgttaaccgttaccgaggttgaaggtctggcagagggaaccgaggacttagatggagagctgctcccgacccccagtgcacacccctcagtcgttatgatgactgccggtcggtgccacaccctcctcagtccagtgactgaggagagtggagaagagggtacaaattccgagataagcagccctccggcttgtaggtcacccagcccggtggcaaatacggatgcctccgtgaatcaggacattgcatattaccaggctctgagcgccgagcgcctccagacggatgctgcaaagattcacccctccacctccgcaagccaagaattctatgagcccggattggagccaagtgcaacagccaaacttggcgacctgcaaagatcctgggaaacactcaagaatgtgatatccgaaaagcaaagaaccctgtatgaggctcttgagcgtcagcagaagtaccaagatagcttgcagagcatctcaactaaaatggaggccatagagctgaagttaagtgagagccccgaacctggaaggtccccggagagtcaaatggcagagcaccaggcactgatggacgagatcctcatgctgcaggacgaaatcaatgagctccagtcctctcttgcagaggagctcgtttctgaaagctgtgaggctgatcccgctgaacagctggctctgcagtctaccctgaccgtactggctgagcgaatgtcaactatcaggatgaaggccagcgggaagcggcagctgctggaggagaagcttaatgatcagctcgaagaacagagacaagagcaggctctacagcggtaccgatgtgaagcagacgagcttgactcctggctgctctcaaccaaagctaccttggacactgccttgagccctcctaaggaacccatggacatggaagcccagctgatggactgccagaatatgctggtggagattgagcaaaaagttgtagctctgagcgagctttctgtacacaatgagaaccttctcctggagggtaaagctcacacaaaagacgaggctgagcagctggctggcaaactgcggagactgaaggggtcattgctggagcttcaacgcgctttgcacgataaacaattgaacatgcaggggactgctcaggagaaggaagagtctgatgtcgatctgacggccactcaatcacccggtgtacaagagtggctggctcaggcccgaacgacttggactcagcagcgacagtcctccctgcagcagcagaaagagctggaacaggagctggctgaacagaagtcgctcctcaggtcagtggcttcacgaggcgaggaaatacttattcagcactcagccgctgagacatcgggggacgccggagaaaagccagacgtgctttcccaggagctcgggatggagggggagaagagcagcgcagaggatcaaatgagaatgaaatgggagtcccttcaccaggagtttagcacaaaacagaaattattacagaatgtgctggagcaagagcaggagcaggtactgtattcaaggcccaataggctcctttctggcgttcccctgtacaagggggatgtcccgactcaggataaaagtgccgtgacttctttgctcgacggcctgaaccaggccttcgaagaagtctcctcacagtcagggggagctaaacggcagtctattcatttagaacaaaagttgtatgacggggtgtcagcaacttctacttggttggatgatgttgaggaacgcttattcgtggccactgctttgttgcccgaggagaccgagacatgtctgttcaatcaggagattttggctaaagacatcaaagagatgtcagaggagatggataaaaacaaaaacctgttctcccaggctttccctgagaatggagataacagggatgtgattgaggacacacttggctgtttattaggtcgcctcagccttctagactctgtcgtgaaccagcgttgccatcagatgaaagagaggcttcagcagatcctgaactttcagaacgatctcaaagtgttgttcacctcactggctgataacaagtacattatcctgcagaagctggcgaatgtctttgaacagcccgtcgccgagcagattgaggccatccaacaggctgaagacggcttgaaggaattcgacgctggtatcatcgagctgaaaaggaggggggataagctgcaagtggagcagccttctatgcaggagctctcaaaactccaagatatgtacgacgagctgatgatgataattggcagtcggagaagtggattgaatcagaacctcactttgaagagccaatatgaaagggctctgcaggatctggccgacctgctagagaccggccaggaaaagatggcaggagaccagaagatcatcgtcagctccaaggaggagattcagcagttgctggataaacacaaggaatacttccaaggactggagagccatatgatactgacagagacgttattccggaaaattataagctttgccgtgcagaaagagacccagttccataccgagctgatggcacaggcctccgccgtgctgaagagggcgcacaagaggggtgtggagctggagtacattctcgaaacttggtctcatctggacgaagaccagcaggagctgtctaggcagctggaggttgtggaaagtagtatcccctctgtgggcctggtcgaagagaatgaggatcggctaatcgatagaattacactgtaccagcatcttaagagcagtcttaacgaataccagcccaaactctatcaggttctggatgatggaaagagactgctcatttcaatttcctgttccgatttggagtcgcagctcaaccagttgggcgagtgttggctgtccaacaccaacaaaatgtccaaagagttgcacagactggaaaccattctcaaacactggaccagatatcagtctgagagtgccgatcttattcactggttgcagtccgcaaaagacagactggagttttggacacagcaaagcgttaccgtccctcaggaacttgaaatggtgcgggaccatttgaacgcctttctcgaatttagtaaggaagtggacgcacagtccagtttaaagagctccgtcctttctacaggtaaccagcttctcaggctgaaaaaggtggacactgctactctgcgctctgagttgagccggatcgattcccagtggaccgatcttctgaccaatattcccgctgttcaggaaaaactacaccagctgcagatggacaagctaccaagccggcatgcaattagcgaggtgatgagttggatttctctgatggagaatgtgatccaaaaggatgaggataacatcaaaaactctataggatacaaagccattcacgaatacctccagaagtacaagggcttcaagatcgatatcaactgcaagcaactaaccgtcgatttcgtaaatcagtcagtgctgcaaatttctagtcaggatgtggagtccaagcgatcagacaagaccgattttgctgagcagctaggagctatgaacaaaagttggcagattcttcagggtctcgttaccgaaaagatccagctgctcgagggactgctggaaagctggagtgagtacgagaacaatgtccagtgtcttaagacatggttcgaaacccaggagaagcggctgaagcagcaacacagaatcggcgaccaagcctccgtgcagaatgctttaaaggactgccaggatctggaagacctgatcaaggccaaggaaaaagaagtggaaaagattgagcaaaatggactggcactgattcagaacaagaaagaggacgtatcctccattgtcatgagtacactgagggagttgggccaaacttgggcgaatcttgatcacatggtgggccagttaaagattttgttgaaatcagtccttgatcaatggtcctctcataaagtcgcatttgacaaaattaactcatacctgatggaggcaagatattcacttagtagatttaggcttttgacaggatccttggaagcagtgcaggttcaggtggataatctccagaacctgcaggacgaccttgagaaacaagaaaggagccttcagaaattcggttcaatcacaaaccagctcctgaaagaatgccaccctcccgttactgagaccttaaccaatacactgaaagaggtgaacatgcgttggaacaatctcctggaggaaattgccgagcagctacaatcatccaaggctcttctccagctatggcagcggtacaaggactactctaaacaatgtgcatccacagtccagcagcaggaggatcgcacgaacgaactattgaaggcagctactaacaaggatatcgccgacgacgaagtggccacatggattcaggactgcaatgatttactcaagggcttagggaccgtgaaggactcgctgttctttctgcacgagctaggcgagcaactcaaacagcaggtcgatgcatctgctgcgtctgcaattcaatccgaccagctttccttatcacaacacttgtgtgctctggagcaagctctatgtaagcaacagacctcccttcaagccggagtgctggactatgagactttcgctaagtctctcgaagctctggaggcatggatcgttgaggcagaagagattttacagggccaggacccaagccactctagcgatttgtccaccattcaggaacggatggaggaattaaagggacagatgctcaaattctcttctatggcccctgacctagacagattgaatgagttaggctaccgtctccctttgaatgataaagaaattaaacggatgcagaacctgaaccgacactggtccctgatctctagccagactaccgaaagattcagtaaattgcagtcatttctcctccagcatcagacattccttgagaagtgcgaaacttggatggaattccttgtgcagaccgagcaaaagctggccgtcgaaattagtggtaactatcagcatttactggaacaacagagagctcacgaactgtttcaggcagaaatgttctcccgtcagcagattctccactcaattattattgacggacaaagactactcgaacagggccaagtggatgatagggacgagttcaacctgaaactgaccctactgagcaatcaatggcagggcgttattagacgggctcagcagcgcagaggcattattgattcacagatcagacagtggcagcggtaccgggaaatggctgaaaaattgcgcaagtggctggtggaggtcagttatctgcctatgagcgggctgggttctgttcctatcccactgcagcaggctagaactctgtttgatgaagttcaatttaaggagaaagtgtttctgcgacagcaggggagttacattctgacggtcgaggccggtaaacaactcttacttagcgcggatagtggagcggaggccgcactccaggcggaactagcggaaatccaggagaaatggaaatctgcatcaatgcgccttgaggaacagaagaagaagctcgctttcctgctgaaagattgggaaaagtgcgagaaagggattgcggatagccttgaaaaactacggacctttaagaaaaaattgtcacagtctttgcctgatcaccacgaggagctgcacgccgagcaaatgcggtgcaaagagctggagaacgctgtcggctcttggaccgacgacctcacacaactgtcgctgctgaaggacacactttccgcctacattagcgctgatgacatctccattctcaacgaacgcgtggaactgttgcagcgccagtgggaggaactgtgccatcaactctccctgcggcgacagcagataggagagcggttgaacgaatgggcggttttttcagaaaagaacaaagaattgtgtgaatggcttactcagatggagagcaaggttagccagaacggggatatcttgatcgaggagatgattgagaaattaaagaaggattatcaggaggaaatcgccattgcacaggagaacaaaattcagctgcaacagatgggcgagagactcgcaaaggcatctcacgaaagcaaggcctctgaaattgaatataagcttggcaaggtcaatgatcgctggcagcatctcctggaccttatagcagcacgggtgaaaaagctgaaggagacactggtggctgttcaacaactggacaagaatatgtcaagtttgcggacatggctcgcccacatcgagtccgaactggcgaaacccatcgtctacgacagctgtaatagtgaggagatacagcggaagttaaatgagcagcaggagctgcagagagatatcgagaagcatagcactggggtagcctctgttctgaacctgtgtgaagttttacttcacgactgcgatgcatgtgctactgatgcagaatgtgattcaattcagcaggctactagaaatctggacagaaggtggcgaaatatttgtgcgatgagtatggaacgcagacttaaaatcgaggaaacttggcgcttgtggcagaaatttttggatgattattccaggttcgaggactggttgaagtcaagcgagcggaccgccgctttccccagcagctcgggagttatatatacagtggccaaggaagaattgaagaaatttgaagccttccagcgtcaggtccatgaatgtttgacacagttggagctgattaacaaacagtacagacgtctcgctagggaaaaccgcactgatagcgcttgttccctcaaacagatggtgcacgagggcaaccagcgctgggacaacctccagaagagagtaacgtccattcttcggagactcaaacacttcattggtcaacgcgaggagttcgagacagccagggactctattttggtctggctcactgaaatggatctgcagctgactaatattgagcatttctctgagtgtgatgttcaggcaaaaatcaagcagctgaaggcattccaacaggagatctccctgaaccacaacaagatcgagcagatcatcgcccagggtgagcagctgatcgagaaatcggagccattggatgctgcaatcatcgaggaagagctggatgagctccggcgatactgccaagaggtcttcgggagggtggaacgatatcataaaaaattgataaggctccctctccccgatgatgaacacgacttgtccgacagagagcttgagttagaggatagcgccgcactgtccgatctgcattggcacgacaggagtgcagactcccttttgagtccccaacctagtagcaacttgtctcttagcctggcccagccgctgcggtctgaacgatcggggagagacactccagcctccgttgactcaatcccacttgaatgggaccacgactacgatttatctagggatttagaatctgcaatgtccagagcactgcctagcgaagatgaagagggccaggacgataaggatttttatctgcggggagccgtaggcctgagtggtgaccactccgcactggaatcccagattcgccagctcgggaaggctttggacgattctcgctttcagatccagcagactgagaacatcatacgatcgaaaaccccgactggacctgagttggacaccagctataaaggctacatgaagttactgggcgagtgtagctcttcaatagacagcgtgaagcggttggagcacaaactgaaagaagaggaagaatctcttccgggtttcgtgaacttacattccaccgagacacagaccgcaggagttatcgataggtgggaactgcttcaggctcaggcactctccaaagagcttcggatgaagcaaaacctgcaaaaatggcaacaattcaacagcgacttgaactccatctgggcatggctcggcgataccgaagaagagttagaacagctgcagcgtctcgagttgtccactgacatacaaaccattgagttgcagatcaagaaactgaaagagctgcagaaagccgtcgaccaccgcaaggcaataatccttagtatcaacctatgttctcctgaattcacccaagcggatagtaaagagtctagggacctccaggaccgtttaagtcagatgaacgggaggtgggacagagtgtgtagcctgctggaggaatggcggggtctgctgcaggatgccctcatgcagtgtcagggtttccacgagatgtcccatgggctgctcctgatgctggaaaatatcgacagacggaaaaacgaaatcgtgcccattgacagcaatttggacgccgagattctgcaagaccaccataagcagctcatgcagatcaagcacgagctgctggagagccagctccgagtcgcgtctctgcaagatatgtcgtgccaactacttgtgaatgccgagggtaccgattgtttggaggctaaggaaaaggtccacgttattgggaacaggctcaagttactgcttaaggaagtgtcacgacatatcaaggagttggaaaaactgcttgacgtctcttcttctcagcaggatctgtcctcctggagctcagcagacgagctggacacgtctgggtccgtgagccccacctccgggaggtccactccgaatcggcaaaaaacccctcggggtaagtgttccctgtcccaacctgggcctagtgtatcttctccacacagccgtagtacaaaagggggatccgatagcagcttgtctgaacccggaccaggtaggagcggaaggggattcctctttcgcgtgctcagggcagccctccctctgcaattattattgcttttgctgatcggcctcgcctgtttggtaccaatgtcggaggaggattatagctgcgctctgtcgaataacttcgccaggtcgtttcatcccatgctgcgctatactaacggtcctcccccactcta

SEQ ID NO: 242069 - DNA, 26250 bp, Artificial Sequence
  Description of Artificial Sequence: Synthetic coding sequence
atggcaacaagtagaggagcatcgcggtgccctcgggatattgccaacgttatgcagcgcctccaagacgagcaagaaattgtgcagaaaagaacattcacgaaatggataaatagtcatctcgccaagcggaagccacccatggtggtggatgatcttttcgaggatatgaaagacggcgtgaagctgttagctttactggaagtccttagtggacagaagctaccatgcgagcagggccgtaggatgaaaaggatccacgctgttgcgaatatcgggacagcactgaagttcttagagggcagaaaatctatgcatcggggtagccccatcaagctcgtgaacattaatagtacagacatcgccgacgggaggccctccatagttctcggtcttatgtggactataattttgtattttcagattgaagagttaacgtctaaccttcctcagctgcagtccctgtctagctccgccagttccgttgattctatcgtgtccagcgaaacaccatcgcctccaagtaaacgtaaggtgactacaaaaatacaaggaaatgcaaaaaaagctctgcttaaatgggtccagtataccgccggaaaacaaaccggcatagaagtaaaagacttcggtaagtcctggaggtccggcgtagcttttcactccgtaattcatgctatccgtcccgagctcgtagacctcgaaaccgtcaaaggcagatctaatagggaaaacttggaggacgcttttaccattgcagaaactgagctgggtattccacggctgctggatcccgaggacgtggatgtggacaagcccgatgagaagtccatcatgacctacgtggctcagttcctcaagcattatcccgatattcacaatgcctccacagacggccaagaggacgacgagatccttcccggatttccgagctttgcaaactcggtgcagaatttcaagcgcgaggatcgcgtgatatttaaagagatgaaagtctggatcgagcaattcgagcgtgatttgacacgcgcacaaatggttgagagtaacctccaagacaagtaccagagctttaagcacttcagggtacagtacgagatgaaacggaagcagatcgagcacctgattcagcctctccacagggatggcaagctgtctctcgatcaggcactggttaaacagtcatgggaccgcgtgacttctagattgttcgactggcacattcagctcgacaagtccctgcctgcacccctgggcacaattggcgcatggctctaccgggcagaggttgccctgcgcgaggaaattactgtccagcaggtgcacgaggagaccgctaacaccatacaacggaagctcgaacagcataaggacctcctgcaaaatacggatgcccacaagagggcgtttcacgagatttatcgaactagaagcgtcaacgggatcccagttcctcctgaccagctggaagatatggccgagagatttcatttcgttagtagtacctccgagctgcaccttatgaagatggaatttttagaactgaaataccgtctccttagcctgttagtgttagccgagtctaagctcaaaagctggatcatcaagtatggccgtagagagtccgttgaacagttgcttcaaaactacgtatcattcatagaaaactcaaaattcttcgagcagtacgaggtgacttaccagattctcaaacagactgcagagatgtatgttaaggctgatggatctgtagaggaggcagagaacgtaatgaagtttatgaacgaaaccacagctcagtggagaaatctgtcagtggaagtgcgtagtgtccggtctatgctggaggaggtgataagcaactgggacaggtatggcaatactgtggcaagtctccaggcatggctggaggatgccgagaaaatgctgaaccagagtgaaaatgccaagaaggatttcttccgcaacctcccacattggatccagcagcataccgcaatgaatgatgctggtaactttctgattgagacgtgtgatgaaatggtgagccgcgacctgaagcagcaactgctgcttcttaatgggcgttggcgcgagctgtttatggaggtgaaacagtatgcgcaggccgatgaaatggacagaatgaaaaaagaatacactgactgtgtcgtaacacttagcgcttttgctactgaagcccacaaaaaattgagcgaacccctcgaagtatctttcatgaacgtcaagttgctcatccaggatctggaagacattgagcagcgtgttccagttatggatgcacaatacaaaatcataacgaagaccgctcacctgattaccaaagaatcaccacaggaggaaggcaaagagatgtttgcaacaatgtccaagctgaaagagcagctcaccaaagttaaggagtgttactccccgctgctatatgaatcacaacaactgttgatcccgctcgaagagttagagaagcagatgacctccttctatgacagcctgggcaagatcaacgagatcattactgtactcgagcgggaggcccaaagcagcgcccttttcaagcagaaacatcaggagctcctggcctgtcaggaaaattgtaaaaaaaccctgacactgattgagaagggtagccagtcagtgcagaagtttgttactttgtccaatgtgttgaagcattttgatcagaccaggctgcagaggcagattgccgatatccatgtggccttccagtccatggtgaagaagacaggggactggaaaaaacacgtggagacaaattctcgactgatgaaaaaatttgaggaaagccgcgctgaattagagaaggtattaaggatcgcgcaagagggcctggaggagaagggagacccggaggaactgttaaggaggcataccgaatttttcagccagctcgatcagagggtccttaatgcatttctcaaggcttgtgacgaactcacagacattctccccgagcaagaacagcagggactccaggaggcggtgagaaagctgcacaagcagtggaaggatctccagggcgaggccccttaccacctgctgcaccttaaaatcgatgtggagaaaaatcggtttctggcttccgtggaagagtgcaggaccgaactcgatcgagagactaaacttatgcctcaagagggatccgaaaaaataattaaggagcaccgggtctttttttcggacaagggtcctcaccacttgtgtgagaagcgtctacagctcattgaggaactgtgtgtgaagttgccagtgcgggatcctgttagggacacacctggcacttgtcatgtcacccttaaagaactccgggcagctattgacagcacatatcggaagctgatggaagatccagataagtggaaagactatacttcgaggtttagcgagtttagcagctggatcagcactaatgagacccagctgaaggggattaaaggcgaagcaatagatacagctaatcacggggaggtcaaacgagccgtcgaagaaataaggaatggcgttacaaagagaggggagactctgtcctggcttaaatcaaggcttaaggtgctgacggaagtgagtagcgagaacgaggctcagaagcagggcgacgagctggccaaattatcctcctcctttaaagccctggtcacacttctatctgaggtcgaaaagatgctgtctaattttggagactgcgttcagtacaaggaaattgttaagaattccctggaggagctgatatccggcagcaaagaggttcaggagcaggctgaaaagattctggacaccgaaaatctcttcgaggctcagcagctcctcctccatcatcaacaaaagactaagaggatttcagcgaaaaaaagagacgttcaacagcagattgctcaggcacagcaaggtgaaggtgggctcccagatcgaggccatgaagagctaagaaaactcgaaagtaccctggacggcctggaaagatcacgcgagagacaggagaggaggattcaggtcacactcagaaagtgggagcggtttgagacgaacaaggaaacagtggtacgatacctttttcagacaggctcttcccacgagagatttttatcttttagttccttggagtcactgtcatccgagcttgaacaaacaaaggaattctcgaaacggactgagtcaatcgctgtgcaggctgagaacctggtgaaagaagccagtgaaatcccgctggggcctcagaacaagcagctcctgcaacagcaagcgaaatcaatcaaggaacaggtgaagaagttagaagacacccttgaggaagacattaaaactatggagatggtgaaaaccaaatgggaccattttggctctaacttcgagaccctgtcagtgtggattacagagaaagagaaggagctaaacgcattagaaacctcctctagcgccatggatatgcagatctctcagattaaagtgaccattcaggagatcgaatccaaactttctagcatcgtggggctagaggaagaggctcagagctttgcgcaattcgtgacaacaggtgaatccgcaaggatcaaggccaaattgacgcagattcgtcgctacggcgaggagcttcgagaacacgcacagtgtctggagggaacaatcctggggcaccttagccagcagcagaaatttgaagagaatctcaggaagatccagcagtccgttagtgaattcgaagataaacttgcagtacctattaagatatgctcatctgccactgagacatataaagtacttcaggaacacatggatctatgccaggctctggagtctctgagcagcgcaattactgccttttccgcctctgcgaggaaggtggtaaaccgtgatagctgcgtccaagaggccgctgccctccagcagcagtatgaggacatcctgcgccgtgcgaaggagaggcagactgctctcgaaaaccttctggcccactggcagcgcctcgaaaaagagctctcctctttcctgacctggctggagcggggagaggctaaggcaagttcccccgaaatggacattagcgcggacagagtaaaagtggagggagaactgcagttgatccaggccttgcagaacgaagtggtgtcccaggcctctttttactcaaaactgttgcagctcaaggagagtctgttttctgtagcttcaaaagacgacgttaaaatgatgaaacttcatctcgagcagctggacgagagatggcgggacctgccccaaatcatcaacaagagaatcaatttcctacaatccgttgtcgcagagcaccagcagttcgatgaactccttttatcattctcagtctggataaagcttttcctctctgagctccagacaacaagcgagatctctatcatggatcatcaggttgcactcacacgtcacaaagaccacgctgctgaagtggaatctaagaaaggcgagctgcaatctctgcagggccatctggccaaattgggctctttaggacgagcagaagacttacacctgctccaggggaaagccgaagactgtttccagttatttgaagaggcgagccaagtcgtggagcggcgtcagctggctctgtctcacttagccgagtttttgcagtcgcacgccagtctttccggtattctgagacagttaagacaaacagtggaggcaaccaattcaatgaataaaaacgagtcagatctgatcgagaaagacttaaacgacgccctccaaaatgctaaggccctggaatcagccgcagtgtccctggacggcatcctttccaaggcccagtaccacttgaaaatcggctcatcagaacagcgaacctcttgcagagccaccgccgatcagctttgcggggaggtcgagcgcattcaaaacctgttggggacaaagcagagcgaggctgatgccttagctgtacttaaaaaagccttccaggatcagaaggaggagctgttgaagagtattgaggacatcgaagagcgcacagacaaagaacgcctaaaggagccaaccagacaggcccttcagcagcgcctgcgcgtgtttaatcagctggaagatgaactcaacagccacgaacacgaactgtgttggctcaaggacaaggccaagcagattgcccagaaggatgtagcttttgctcctgaggtcgacagagaaatcaaccgacttgaggtgacctgggatgatacaaaacgtctaattcatgagaaccagggacaatgttgcgggctcatcgatttgatgcgggaataccagaatctgaagtctgctgtgtccaaagtcctagagaatgccagctccgtgattgtgacccggactacgattaaagatcaggaggatcttaagtgggcgttcagtaaacacgagacagccaaaaacaaaatgaattacaaacagaaggacctggataactttacaagcaaggggaagcatctcctctcagagctgaagaagatccatagttctgattttagcctggtcaaaacagatatggagagcacagttgataagtggcttgatgtgtccgagaagcttgaggagaatatggaccgattgagagtgtccctgtcaatttgggatgacgtcctgagtacgcgcgacgaaatcgaaggctggtcaaacaattgtgtgccacagatggctgaaaacatttctaacctggataatcacctccgcgcagaggagcttttgaaagaattcgaatccgaagtcaaaaataaagcactgcgactcgaggaactccacagcaaggtcaacgacctcaaggaactcaccaagaatttagaaacacctcctgacttacagttcatcgaagcggatctcatgcaaaagctggagcatgccaaggaaatcacagaagtggcaaaggggaccctcaaagacttcaccgcccagtccacccaagtcgaaaagtttattaacgacatcacgacgtggttcacgaaggttgaggaatctttaatgaattgcgcccagaatgagacttgcgaagccctgaagaaggtgaaggacatccaaaaagaactgcagagccaacaatccaatataagctccactcaggaaaacttgaactccctctgtcgtaagtatcacagcgctgagttagagagcctgggaagagcaatgactggcctgatcaagaagcacgaggcggtgtctcagctgtgctccaagactcaagcatccctgcaggagagcctcgagaaacacttcagcgaatcgatgcaggagtttcaggaatggttcctgggtgccaaggccgctgccaaggagagcagcgaccgtactggggactctaaggtgctcgaagccaagctgcacgatctacaaaatattctggacagcgtgtctgatggccagtctaagctggacgcggttacacaagagggtcaaacgctgtacgcccacctctcaaagcagattgtgtcatccattcaggaacagattacaaaggctaacgaagagtttcaggccttcctgaagcagtgcctgaaggacaaacaggccctgcaggactgtgcctctgaactgggtagttttgaggaccagcaccgcaaacttaacctttggattcacgaaatggaagaacgatttaacaccgaaaacctgggcgagtccaagcagcatattcctgagaagaagaacgaagtgcacaaggtggagatgttcctgggcgagcttttagctgcaagagaaagtcttgataagctgtcacaaaggggtcagcttctgagtgaggagggtcacggggctggccaagaagggcgactctgctctcagctgcttacctcccaccaaaacttattacgaatgaccaaagaaaagctgcggagctgtcaggtcgctcttcaggaacatgaggccctggaggaggcgctgcaatcaatgtggttttgggtgaaggctattcaggatcggctggcctgcgctgagtcaacactaggcagcaaggataccctggagaaacgcctcagtcagatccaggatattctattgatgaaaggtgaaggtgaagtgaaactaaacatggcgatcgggaagggggagcaagccctgaggtcctccaacaaagaaggtcaaagagttattcaaacgcagctggagactctcaaggaagtctgggccgacatcatgagctcttccgtgcatgctcagtccactctggaaagcgtcatcagccaatggaatgactacgtcgagagaaaaaatcaactcgagcagtggatggaatccgtggaccagaagatcgagcaccctctccagcctcaacccggactaaaagagaagtttgtccttctggaccatttgcagtccatcttgtcggaggctgaagatcacactagagccctgcatcgactgatcgcaaaatcacgggaactttacgagaaaaccgaagatgagtccttcaaggataccgcgcaggaggaactaaagacccagtttaacgacatcatgactgttgcaaaggagaaaatgcgcaaggttgaggagatcgtaaaagaccacctgatgtatctcgatgcagtgcatgagtttaccgattggctgcacagcgccaaggaagaactgcacagatggtccgacatgtcaggcgactcctcggccacacagaaaaaactgtcgaaaatcaaagagctgattgattccagagagatcggggcaagcaggttgagcagagtggaatccctggcccctgaggtcaaacagaatacaactgcctccggatgtgaactcatgcataccgaaatgcaggcactccgggcagactggaaacaatgggaagacagtgtttttcagactcaaagctgcctggagaatctcgtctctcaaatggctcttagcgagcaggagttttctggccaggttgctcagctagaacaggctctggaacaattctctgccctcctgaagacatgggcacagcagctgaccctcctggaagggaagaacacggatgaggagatcgtggagtgttggcataaaggacaagaaattctagatgctctacaaaaggctgagccccgtacagaggacctcaaaagccagctcaatgaattgtgcagattttcaagagatctgtccacttatagtggtaaggtatccggtctcatcaaggaatataactgcctgtgtttacaggcctcgaaggggtgccagaataaagagcagattctgcaacagcggttccgaaaggcctttcgggacttccagcagtggcttgtgaatgcaaaaattaccaccgcaaaatgttttgatatccctcaaaacatcagcgaagtttcgacgtcattgcagaagatccaggagtttctcagtgagtccgaaaatggacagcataaactgaacatgatgttgtcaaagggggagctgctctcaacgcttttaactaaggagaaggccaaagggatccaagctaaggtaactgccgcaaaagaggattggaaaaacttccacagcaatttacaccagaaggagtctgcactcgaaaatctgaagattcagatgaaggactttgaagtttccgctgagccaatccaggactggctcagcaaaaccgaaaaaatggttcacgagagcagcaatagactctacgacctgcccgcaaagagacgagagcagcagaagctgcaatctgtgctggaggagattcattgctatgaaccccagctcaacaggctgaaggagaaggcccagcagctctgggaaggccaagccgcttctaagtcatttagacatcgggtcagtcaattgtcgtctcagtatctcgcactgagcaacctgacgaaggagaaggtcagcagactggatcgaatcgtggctgagcataaccagttctcattaggcataaaagaactgcaggactggatgacggatgcaattcatatgttagactcttattgtcatcctactagcgacaagtcagtgctggacagcaggactctgaagctggaagcccttctctcggtcaaacaggaaaaagaaattcagatgaagatgattgtgacgcgtggcgagagcgttctccagaacaccagtcccgagggcatcccaacaattcagcagcagctgcaaagcgtaaaagacatgtgggccagcctgctcagcgcaggaattagatgcaaaagccagctggagggcgctctgagcaaatggacgagttaccaggatggcgttcggcaattcagcgggtggatggattctatggaagccaacctgaacgaaagcgaaagacaacacgccgagctcagggacaagacaacaatgcttggtaaagccaaacttctgaatgaagaggttcttagttatagctccctacttgaaacaattgaggtgaagggggctgggatgaccgaacactacgtgacccagttggaattgcaggacctgcaggaacggtacagagctattcaggagcgagctaaagaagcagtcactaagagcgaaaaactggtcaggcttcatcaagagtaccagagggacttgaaagcatttgaagtctggctgggccaggagcaggaaaagctcgaccagtactctgtgctggaaggcgatgcgcacacacacgagacaacccttcgggaccttcaggagctgcaagtacattgcgccgagggccaggccctgctgaacagtgtgcttcataccagagaggacgtcatcccgtcaggaatccctcaggctgaggaccgcgcattggagtccctccggcaggactggcaggcctaccaacaccgtctctccgaaactcgaactcagttcaacaatgtagtgaataaactaagactgatggagcagaagtttcagcaagtggatgaatggcttaaaacagcagaggagaaaaaatggcacgaggaagtcaccgcgtatcgcgatgaggtggaggaagtgggtgccagagctcaggaaatattggacgaatcccacgtgaattcgcgcatggggtgccaggccacgcagctcacaagtcgatatcaagccctgctgctgcaggtgctagaacaaattaagttcctggaggaggaaattcagtccctggaagagtctgaaagctccttgtcttcctattctgactggtacggtagcacacacaaaaactttaagaatgttgccaccaagatagataaagttgacaccgtcatgatgggaaaaaaactgaaaacccttgaggtcctcctgaaggatatggagaaggggcatagcctgctcaagtccgcaagagaaaaaggcgagcgggcagttaaataccttgaggaaggcgaggcggagcggctgcgcaaagaaatccatgaccacatggaacagctgaaggagttgactagcaccgttagaaaagaacacatgacgctggagaagggcctccatttagccaaggagttcagcgataagtgcaaagccctgacccagtggatcgcagagtatcaagagattttgcacgtgcccgaggaacctaagatggagctgtacgaaaagaaagcgcagctctctaaatataaaagtctccagcagacagttctttcgcacgagcctagcgtgaaaagtgttcgcgagaagggagaggctttactagaactcgttcaggacgttactctcaaggacaagattgaccagctacagtccgattatcaggatctctgtagtatcggcaaagccatgatggaagagatcgctgggttcgaggaccgtttgaataatcttcagatgaagggcgacactctgatcggccagtgcgctgaccacctgcaggctaagctgaagcagaacgtgcacgcgcatctgcaggggactaaggatagttatagtgcgatctgtagcaccgcacagaggatgtatcagagtctggaacacgagctgcagaagcacgtatccaggcaggacacgctgcaacagtgtcaagcatggctttcagccgtgcaacctgatttggagcctagcccccagccaccgttgagccgggcagaagctattaaacaagtgaagcactttagagcgctgcaggagcaggccagaacttatcttgacttactctgctccatgtgcgatctgagtaatgcctctgtgaagaccaccgccaaggatatccaacagacagagcagactattgaacaaaagctcgtgcaggcgcagaacttaacacaaggttgggaggagataaagcatttaaagagcgaactgtggatttacttacaggacgctgatcagcaactgcagaacatgaaacgacggcattctgaactcgaacttaacatagcgcagaatatggtttcgcaggttaaagacttcgtgaagaagcttcagtccaaacaagccagtgtgaataccattattgagaaagtgaataagctgactaagaaggaagaaagcccagagcataaggaaatcaatcacctgaacgatcagtggttggatctgtgccgccagagcaacaacctgtgtcttcagagagaggaggatttgcaaaggacgagagattatcatgattgtatgaacgtggttgaggtcttccttgagaagttcacaactgagtgggataacctcgcccgatcggatgccgaaagtactgccgtacacctggaagccttgaaaaagctggcactcgccttacaagagcgcaagtacgcaattgaagatcttaaggaccaaaaacaaaagatgattgagcacctgaacctggacgataaagagctcgtgaaggagcaaacgtctcatttggagcaacgctggttccagctcgaagacctcatcaagcgcaaaatacaggtttctgtgactaacctagaggagcttaatgtcgtccagtcgaggttccaggagctgatggagtgggcagaggaacaacaacccaacatagccgaagcattgaagcaatcaccaccaccagatatggcacaaaatctgcttatggaccaccttgccatctgttccgagttggaggcaaaacagatgctgcttaagagtctcatcaaggacgcggaccgagtcatggcagacttgggacttaatgaacggcaagtgatccagaaggctctgagcgatgcccagtctcacgtgaattgcctgagtgatctggtcggacagcgcagaaagtatcttaataaggccctcagcgaaaagacccagttcctcatggccgtgtttcaggctacgagccaaatccagcagcacgaaagaaagatcatgttccgagagcatatatgtctgttgcccgatgacgtgtccaaacaggttaagacctgtaaaagcgcccaggccagtctgaagacatatcagaatgaagtgaccggactttgggctcaaggcagagaactgatgaaggaagtcactgaacaggaaaagtctgaagtgctgggcaagttgcaggagctccagtccgtgtatgactccgtgctccagaagtgtagccatcgcctgcaggagctggaaaaaaatttggtttcaaggaaacatttcaaagaagattttgataaagcgtgccattggctcaaacaggctgatattgtgacctttcccgagattaatcttatgaacgagagctcagaattgcatacccagctggcgaaatatcaaaatattttggagcagagcccagaatacgagaacttgctcttgacactgcagcgaaccggccagaccatcctgcctagcttgaacgaagtagaccattcctacctgtcagagaagctgaacgcactgcctcggcaatttaacgtgattgtggcactcgccaaagacaagttctataaggtgcaagaagctatcctggcccgtaaggagtacgcatctcttatagagcttaccactcagtctcttagtgaattggaagctcagttcctcaggatgagcaaagtgcccaccgatctcgctgtcgaggaagctctgagtcttcaggatggctgtcgggcaatattagacgaagtggcgggactgggagaggccgtcgatgagttgaatcagaaaaaggaaggattccgctccacgggacaaccatggcagcccgacaaaatgttgcatctggtcaccctataccaccgactgaaacgtcagactgagcaacgggtttcactcctggaggacactacatcggcttatcaggaacacgagaaaatgtgccagcaacttgagagacagctcaagagtgttaaagaggagcagagcaaagtgaacgaggaaaccctgcccgctgaggaaaagctcaaaatgtatcacagtttggccggtagtttgcaagatagcggtatcgtcttgaagcgggtgactatccatttggaggacttggcccctcacctggatcctctggcctacgaaaaggctcgtcatcagatacaaagttggcaaggagaactgaagctgctgaccagtgccataggtgagacagtgactgaatgtgagagccggatggtgcagagcatcgatttccagaccgagatgtccagatcacttgattggctacgtcgcgtgaaagccgagttgtccggccctgtgtatctggacttgaatttgcaggatattcaggaagaaattcggaagatacagatccatcaggaagaagtccagagtagtctgcggatcatgaatgcactgtctcacaaggagaaggaaaagtttacaaaagccaaagaattgattagtgcggacttggaacactcactggcggagctcagcgaactagatggcgacattcaggaggcactgaggaccagacaagccaccctgacagaaatttactcccaatgtcagaggtattaccaggtattccaggcagcaaatgattggctggaagacgcacaggaattactgcaactcgctggaaacggcctggacgtggaaagcgccgaagagaacttgaagagccacatggaattcttttcgaccgaggaccagttccactcgaatctggaggaactccactccctggttgcaacactcgatcccctgatcaaaccaaccggaaaggaggaccttgagcagaaagtggcatcgttggagctgcgttcccaaagaatgtcccgagatagtggggcacaagtggacctacttcagcgttgtactgcacagtggcacgactaccaaaaagccagggaggaagtcatcgagctgatgaacgacaccgaaaagaagttgtcagaattcagtcttcttaaaacctcttcttctcatgaggcagaagagaagctctcagagcacaaagccctagtatcagtcgttaactccttccatgagaagatcgtggccctggaggagaaggcatcacagcttgagaagaccggcaacgatgcctctaaagcaacactcagccgctcaatgaccacggtttggcagcgttggacccgactaagggctgtggcccaggatcaagagaagatcttggaggatgctgtggatgagtggaccggcttcaacaacaaggtcaaaaaggccacagagatgatagatcagctgcaggacaagctgcccggttcttccgctgagaaggcttctaaagccgagctgctcaccctccttgaatatcatgatacattcgtactcgagctcgagcagcagcaatccgccctgggcatgttaagacagcaaactttgtctatgctgcaggatggcgctgctcccactcccggagaggagcctccgctgatgcaggagataacagccatgcaggacaggtgcttgaacatgcaggaaaaagtcaaaacgaatggaaaactggtgaagcaggagctcaaggatcgggagatggtggagactcaaataaatagcgtcaagtgttgggttcaggagaccaaagaatacctgggtaatcccactatagagatcgatgctcaactggaggaactccagatcctgttaaccgaggccacaaatcacagacagaatattgaaaaaatggcggaagagcagaaagagaagtacctgggactctacacaatcctcccttcagagttgtctctgcagctggccgaagtggctctcgatctgaaaattcgcgatcaaattcaggacaaaatcaaggaggtggaacagtccaaggccacatctcaggaactgtccaggcagatccagaaactggccaaggacctcaccacaatacttactaagcttaaagccaagactgacaacgtggtgcaggctaagaccgaccagaaggtgttgggtgaagagctggacgggtgcaactccaagctgatggaattggatgccgctgtgcagaagtttctcgaacagaacggacagctgggaaaacccctggcgaagaagattggaaaactcacagaactgcatcagcagacaattcgccaggcggaaaaccgactgtcaaaacttaaccaggcggcttcccatcttgaagaatacaacgagatgctagaactgatcctgaagtggatagagaaggccaaagtgttggctcatgggaccatcgcctggaatagcgcaagtcaacttcgagagcagtatattctgcaccagactctactagaagaatctaaagagatcgacagcgagctcgaagccatgactgagaagctgcagtatctgacctcagtgtactgcacagaaaagatgagccagcaggtcgctgaactgggcagggaaactgaggagctgaggcagatgattaaaatcagattgcagaacctgcaggatgctgctaaagatatgaagaagttcgaagccgagctaaagaaactgcaggcagcactggaacaggcacaggcgaccctgacatctcccgaagtgggcaggctctctctcaaggaacagctcagccaccgccagcatctactgagcgagatggagtccctgaagccgaaggtgcaggccgtccagctgtgccaatctgctctccggatcccagaagatgtagtggcttcactgcctctatgtcatgcagcgctccgcctgcaggaggaggccagcagactgcagcataccgcgattcaacaatgtaatatcatgcaggcagctgtggtccaatatgagcagtacgaacaggagatgaaacatctgcagcaactgatcgaaggcgctcaccgggaaatcgaggataagcccgtggcaacgtcgaatatccaggagctgcaggcgcagatatcgaggcacgaagaactggcgcagaaaatcaagggctaccaagaacaaatcgcaagcctcaacagcaaatgtaagatgctcaccatgaaggccaaacacgccaccatgctccttactgtcacagaggtggaaggtttagccgaaggcacggaggacctggatggtgagctgctccccacccccagtgcacacccttcagtggtgatgatgacggccggacgatgccacacgctgctgagccctgtgactgaggaatcaggagaagaagggacaaactccgaaatttccagcccacctgcctgccgttccccctcacccgtggccaacaccgatgcaagcgtcaatcaagacatcgcctactaccaggctctcagtgcagagcgcttgcagaccgatgctgccaagatccacccatctacaagcgcgtctcaggagttctacgagcctggcctggagccttccgccactgccaagttaggggacctgcagcggtcttgggaaactctgaaaaacgtgatttctgaaaaacagcgcactctctacgaagccttggaacgccagcaaaaatatcaagacagtcttcagtctatctctaccaagatggaagccatcgaactaaaactttccgaatcccctgaaccgggacgatctcctgagtcccaaatggctgaacaccaagctttgatggatgagatacttatgctccaggacgagattaacgaactgcagtcctcgctggcagaagagctggttagcgagtcttgcgaggcggaccccgctgaacagctggccctgcagtcgacactcacggtgcttgccgagcggatgagcacaatccgcatgaaagcctccgggaagcgccaactgttagaggagaagcttaacgaccagcttgaggagcagagacaagagcaggccttacaacggtaccgatgtgaggccgacgaactggactcttggttattgagcactaaagccacccttgacaccgccttatcacctcctaaggaacctatggacatggaagcacagctcatggattgccaaaacatgctagtcgaaatcgaacaaaaagtggtcgcactctccgagttaagtgtacataatgaaaatctgctactggagggaaaagcccacacaaaggacgaagcagagcagctggccggaaagttacggaggttgaaggggtctctcctggagctgcagcgcgctctacacgataagcagctgaatatgcagggcacagctcaggagaaagaggagagcgatgttgatctaaccgccactcagagccctggcgtccaggaatggctggctcaggcacgcacaacttggacacagcagcgccagtctagcctgcagcagcagaaggagctggaacaagagttagctgagcagaagagcctcctgcggtcggtcgccagtaggggagaagaaatccttatacagcactctgcggctgagacttctggcgacgctggggagaaaccggacgtcctcagtcaggaactaggcatggagggcgagaagtcttctgcggaagatcagatgcgcatgaagtgggaatcgctgcatcaggagttctcaacaaagcagaagttgctacaaaatgtgcttgagcaggaacaggagcaggtcttatacagccggccaaacagactgttatcaggcgtacctctgtacaagggcgatgtacctacgcaggataaaagcgctgtgacttccctgttggacggcttgaaccaggcattcgaggaagtatcatcacaatctggcggtgccaaaagacagagtattcacctggagcagaaattatatgacggggtgagtgcaacctcaacctggctggacgacgtcgaagagcgactgttcgtcgccaccgcacttttgcccgaggagaccgagacctgtctgttcaaccaggaaatcttagccaaagatattaaagagatgtcagaagagatggacaagaacaaaaacctatttagccaggcctttcctgagaacggcgacaaccgtgatgtaatcgaagacactttgggctgtctactgggcagactatccctcctggactccgtggtcaatcagcggtgccatcaaatgaaggaaaggttgcagcagattttgaacttccagaatgacctaaaagttttattcacttccctagctgataacaagtatatcattttgcagaagctggcgaacgtgttcgaacaaccagtggcagagcaaatcgaggctatccaacaggccgaggatgggctgaaagagttcgacgcagggattatcgagctgaagagacgcggagataagctgcaggtcgaacagcccagtatgcaggagctgagcaagctgcaggacatgtacgatgagcttatgatgattatcggatccagaaggtcaggtctgaaccagaacctgacactcaagagccagtacgaaagggctctgcaggacctggcggatctgttagaaactggccaggagaaaatggcaggcgaccagaagattattgtgtcctccaaggaagagatccaacagttactggacaaacacaaagagtattttcaggggctcgagagccacatgattttgactgaaacattatttaggaaaatcatatcttttgcagttcagaaagaaacccagttccacactgagctgatggctcaagcgagcgcggtgctgaaacgtgcacacaaaagaggtgtggagctggaatatatactggaaacatggagtcacctggatgaggaccagcaggagctcagcaggcaactggaagtcgtagagagttccatcccgagcgttgggctggtggaagaaaatgaagataggttgatcgatcgaatcacgctgtaccagcaccttaagtcttctctcaacgagtaccagccaaagctgtatcaggtcttggacgatggaaagagactcctcatcagcatctcatgcagcgacttggaatcccagctgaaccaacttggggaatgttggctgtcgaacaccaataagatgtcaaaggagttgcaccggctcgaaacaatccttaagcactggacccggtaccagagcgagagcgcggacctgatacattggctgcagagtgccaaggatagacttgagttctggacccagcagtccgtcactgtgccccaagaacttgagatggtgcgcgaccacttgaacgcatttttggagtttagcaaggaggtggacgctcaaagctccctgaagagctccgtcctctccacagggaaccagctactacgattgaagaaagtagacactgctaccttacgctctgaactatcccggattgattctcaatggacggacctcctgaccaacatcccagctgtccaggagaagctgcatcagctccagatggacaaattgccaagccgtcatgccatatccgaggtgatgtcctggatatccctgatggaaaatgttatccagaaagatgaggataatatcaaaaacagtatcggttataaggccatccatgagtatctgcagaaatacaaggggtttaagatagatatcaactgcaaacagttaacagtcgacttcgtgaaccagtcagtgctccagatctcaagccaggatgtggagagcaaacgaagcgacaagacagacttcgccgaacagcttggcgctatgaataaaagctggcagattctgcagggcctagtcaccgaaaaaattcagttattagagggactgttagagagctggtccgagtatgagaacaatgtacagtgcctcaaaacctggtttgaaacccaggagaagcggctgaagcaacagcatcgcataggagaccaagcttcagtgcagaacgcactgaaggactgtcaagatctggaggatttaataaaggccaaggagaaggaggtggaaaaaattgaacaaaatggactggcacttatccagaacaagaaggaggatgtgtctagcatcgtcatgagtacacttagagagctgggccagacctgggctaatttggaccacatggtggggcaactgaaaatcctgctgaagagcgtactggaccaatggtctagccacaaggttgcttttgataaaatcaattcttacttgatggaggccagatatagtctgtcaagatttagactactcacaggtagccttgaggccgtgcaggtgcaggtggacaacctccaaaacctgcaagacgatttggaaaaacaggagaggagcctgcaaaaattcggatctataactaatcagctgctcaaagaatgtcatcctcctgttacagaaactctcactaatacactcaaagaggtgaatatgcgctggaacaacttactggaggagatcgccgagcaattacagtcttccaaggccttgctccagttgtggcaacgatacaaggactactccaagcagtgcgcgtctaccgtgcagcaacaagaggaccgcactaacgagttactcaaggctgccacgaataaagacatcgcagacgatgaagtggccacttggattcaggactgcaatgatcttctgaagggactcggaacagtaaaagatagcctttttttcctgcatgagctgggtgagcagttgaaacagcaagtggacgccagcgctgcaagcgcaatacagagtgaccagcttagccttagccagcacctgtgtgccttggagcaggccctatgcaagcaacagacctcactacaggccggagtgcttgattatgaaactttcgcaaagtccctggaagctcttgaggcctggatagttgaggcggaggaaatcctccagggacaggatccttctcattctagcgacctctcaacgattcaggaacgaatggaagaactgaagggccagatgttaaaatttagctctatggctccggacctggacaggcttaatgagttgggctatagactgcccctcaatgataaagaaattaagcgtatgcagaatctaaatcggcattggtctttgatatcttcccagacaacagaacggttctctaaactccagagcttcttgctacaacaccaaacattcctggagaagtgcgaaacatggatggaatttcttgtgcagaccgagcagaaactggctgttgagataagcggcaattaccagcaccttctggagcaacagagggcccacgaactcttccaagcggaaatgttttcccggcagcagattttgcactccattatcatcgacggccagcgattgctagaacaaggccaggtcgacgacagggatgaatttaatctcaaactcactttactctccaatcagtggcagggcgttatcagacgggctcagcagcggcgagggataatcgacagccagattcggcagtggcagagataccgggagatggctgaaaaactaagaaaatggctggttgaggtcagttatctccccatgtctgggctggggtcagtgccaatacctctgcaacaggccaggacattatttgacgaggtgcagttcaaggagaaagtgtttctgcgacagcagggatcctatatcctgacagtggaggccggaaaacagctgctgttgagcgctgacagtggcgctgaagccgctctgcaggctgagctggcagagattcaggagaagtggaagtcagcatctatgaggttggaggaacagaaaaagaaactggcctttctactgaaggactgggaaaagtgtgagaaggggattgccgactcgctggagaagctgagaaccttcaagaaaaagctgtcgcagtccctccccgaccatcatgaagaactgcatgcagagcaaatgcgttgcaaggaactggagaacgccgtgggatcatggacagatgacctaacccaactgtctctgctgaaagacacactttccgcctatatttctgctgatgatatcagcatattgaacgagcgtgtggaactcctgcagcggcaatgggaggaattgtgccatcagttgtccctcagacggcagcagattggcgaacgcttgaacgaatgggccgtattcagtgaaaagaacaaggaactgtgcgaatggctgacacagatggaaagcaaggtgtctcagaacggggacatcttaatagaggagatgatcgaaaaactgaagaaggactaccaagaggagatcgcaattgcacaagagaataaaattcagctccagcagatgggcgaacggctggcgaaagctagtcatgagtctaaggccagcgagatcgagtacaagctcggaaaggtgaatgacagatggcagcatttgctcgatcttattgctgccagggtgaaaaagttaaaggaaacactggttgcagtccagcagctggacaagaatatgagcagcctgcgaacatggctggcccatattgaatcagaacttgcaaagccaatcgtgtatgacagttgtaatagcgaggaaatccagcgcaaactgaacgagcagcaggagttgcagcgggatatcgagaagcactcaacaggggtagcctcagtattgaacctctgcgaggtgttattgcacgactgcgacgcctgtgcaaccgatgccgagtgtgacagtatacagcaggccacgaggaacttggatagaaggtggaggaacatctgtgccatgtcgatggaacgaaggctgaagattgaagagacatggagactgtggcaaaagttcctcgacgattactcccgcttcgaagattggctgaagtccagtgagagaaccgcagcttttccatccagttcaggtgtaatttacaccgtcgcaaaggaagaactaaagaaatttgaggcttttcaacggcaggttcatgaatgtctgactcagctcgaactgattaacaaacagtataggcgccttgcaagggagaataggactgacagcgcctgttctctaaaacaaatggtgcacgaaggcaaccagcgctgggataatctgcagaaacgggtcaccagcatcctgcggagactaaagcattttattggccagagggaagagtttgagactgccagggattctatcctcgtctggctgaccgagatggacctgcagctgaccaacatcgaacacttttcagagtgcgacgtacaagccaagattaagcagttgaaggcatttcagcaggaaatcagcctaaaccataataagatcgagcaaatcatcgcccagggcgaacagcttattgagaagtcagagcctctggatgcagcaataattgaggaagagctagacgagctcagacgctactgccaggaggtcttcgggagggtggagcgttaccacaaaaagctcattcgcttgcccctgccagacgacgaacacgacctgtctgatcgcgagcttgaactggaggatagtgcggcactctcagatctccactggcacgatcgatctgcagatagcctcctctccccacagccgagctcgaacttgagtctcagccttgcacagcccctccggagcgagcggtcaggccgtgatacacccgctagtgtggacagcattcccctcgagtgggaccacgattacgatttgagtcgagaccttgaatccgcaatgtccagggccttgcctagtgaggatgaagaagggcaggatgacaaagacttctatcttcgtggcgcagtgggcctgtctgacgtgatgattcctgaaagcccagaggcgtatgtcaagttaactgagaacgcaataaaaaataccagtggagaccattccgccctggaatctcaaatccggcagcttgggaaagcactcgatgactctcggtttcaaatccaacagactgaaaatatcatacggtccaaaacacccacaggacccgagctcgacacgtcatacaagggctacatgaagctcctgggtgagtgcagttccagtatcgattccgtgaagaggctggaacataagctgaaggaagaagaggaaagcctccccggtttcgttaatctgcattcaactgaaactcaaaccgctggcgtgatagaccggtgggaacttctgcaagctcaggctctgtccaaggagctccgcatgaagcagaacctgcagaaatggcagcagttcaactccgacttgaattccatctgggcctggctgggagatacagaagaggaactggagcaactccaaagactggaactctctactgatatacagactattgagctccagatcaaaaaattaaaggagttgcaaaaagctgttgaccataggaaggccatcatcttgagcattaacctatgctcaccagagttcacccaggccgatagcaaggagtctcgggatcttcaagatcggctgagccaaatgaacggcagatgggatcgcgtgtgctctctgttggaggaatggcgagggttactacaggatgctcttatgcaatgccagggctttcatgaaatgagccacgggctgcttctaatgctggagaatatcgatcggcgaaagaatgagattgtgcctatcgattcaaatctggacgctgagattctccaggaccaccacaaacagctgatgcagatcaaacacgagctgctggaaagccagctccgagtggcaagtttgcaggacatgagctgccagctgcttgtgaacgccgagggtacagactgtctagaggcaaaggagaaggtccacgttatcggaaatcgactcaagttacttctcaaagaagtgtcacggcacataaaagaactggaaaaactacttgatgtttcaagtagccagcaagatctctcatcctggagtagcgcagatgagctcgacacgagcggctccgtctctccaacttccggtagaagcaccccgaacaggcagaaaacgcccagaggaaagtgctcgctctctcagcccggaccctccgtcagttcaccccacagccgatctactaagggaggcagtgattcgagcctctccgaacccggacctggcaggagcggccgagggttcttgtttcgcgtgctgcgcgctgcactccctttacaacttctgttactgctgttaatcggcctggcctgcttagtgcccatgtctgaggaggactatagctgcgcactgtctaataactttgctcgcagctttcatcctatgttgagatacacgaacggtccccctcctctatac

SEQ ID NO: 242070 - DNA, 26249 bp, Artificial Sequence
  Description of Artificial Sequence: Synthetic coding sequence
atggccacgtctcgcggagcctcccggtgcccacgagacattgctaacgttatgcagaggctgcaggatgagcaggaaattgttcagaaaaggacgttcacgaagtggattaactctcatttagcgaagcgaaaacctcccatggtggtcgacgacctgttcgaggacatgaaggatggggtcaagctgctggcacttctggaggtgttaagcggccagaaactgccctgtgaacagggtagacgcatgaagcggatccacgcagtggccaacattggtacagccttgaaatttttggagggaagaaagtcaatgcacaggggcagccctattaagctcgtgaacatcaattctaccgacattgccgacgggcgaccttccattgtgctaggtttgatgtggactattatcctgtacttccaaatcgaagaattgacaagcaatttaccccagctccagtccctgtcctcctcagcatcatctgttgacagcatcgtctcgagtgaaaccccctcaccaccctctaagagaaaggtcacgaccaaaattcaggggaatgccaagaaggctttgttaaaatgggtacagtacactgcaggaaaacagacgggaatagaagttaaagattttgggaaatcctggaggagcggcgttgcctttcactccgttatccacgccatcagaccagaactcgtggacttagaaaccgtgaagggtagatcgaaccgtgaaaacctggaagatgcatttacgattgccgaaaccgaactcggaatcccaaggttactggatcctgaagacgtcgacgtggataagcccgatgagaagtccatcatgacttatgtggcccaatttctgaagcactatccagacattcataatgcctctactgacggacaggaggacgatgagatactcccgggattcccttcgtttgcaaattctgtgcagaactttaagagggaagaccgcgtgatctttaaagagatgaaggtgtggattgagcagttcgagagagacctgacgcgggctcagatggtagagtctaaccttcaggacaaatatcagagtttcaagcactttcgcgttcagtatgaaatgaagcgaaaacagatagaacacctgatccagccccttcaccgagacggtaagttatccctggaccaagccttagtgaaacagagttgggacagagttacgagccgcctctttgactggcatatacagctggacaaatcccttccagctcccctgggcacaatcggcgcatggctctatcgcgcagaggtggcgctgcgtgaagagattacagtccagcaggtgcatgaggagacagctaacaccattcagcgtaaactcgagcagcataaggacctgctgcagaatacggatgcccataaacgggcatttcatgagatatatcgcacccgttctgtcaacgggatacctgtccctcccgatcaactggaagacatggccgaacgctttcacttcgtgagtagcaccagtgaactacaccttatgaagatggagtttctggagctcaagtatcgactcctttccctcctcgtgctggcagagtccaaactgaagagctggattattaaatatggaaggagagagtctgttgaacaactgctgcagaattatgtaagttttatcgaaaattctaagttcttcgagcagtacgaagtgacataccagatccttaaacagaccgccgaaatgtatgtgaaggctgacgggagcgttgaggaagctgagaacgtcatgaagtttatgaacgagaccaccgctcaatggaggaacctctcagtggaagtgagatccgtgcggagtatgctggaagaagtgatctcgaattgggacagatacggaaacaccgtagcttcactgcaagcctggctggaggatgccgaaaaaatgctcaatcagagcgaaaatgccaaaaaggacttctttcgaaatctgccccactggatccagcagcacacggctatgaacgatgcaggaaattttttgatcgagacatgcgacgagatggtcagtcgggatttgaagcagcagttgctgctgctcaacggtcgctggcgagaactgttcatggaagtgaagcagtacgcacaggccgacgaaatggacaggatgaaaaaggagtacacagattgcgtggtcaccctgtccgccttcgccaccgaagcccataagaagctttccgagccccttgaagtatcattcatgaacgttaagctgctcatacaggacctcgaggacatcgagcagagggtgcccgtgatggacgcacagtacaagatcatcaccaaaactgcgcacctcatcaccaaagaaagtcctcaggaagagggcaaagagatgttcgcaaccatgtcgaagcttaaggagcaactcacgaaggtgaaggagtgctattctccactgctctacgaaagccagcagctcctgatccccctagaagaactcgagaaacagatgacctcgttttacgatagcctgggaaagattaacgaaatcataacagtgctggagagggaagctcaaagcagcgctctctttaagcaaaaacaccaggagctcttagcatgtcaggagaattgtaaaaagactctgacactaattgaaaagggatctcaaagtgtccagaagttcgtgacactctcaaacgtgctcaagcatttcgaccagacacggcttcagcgccagatagcagatatccatgtcgccttccagtctatggtgaagaaaacgggagattggaagaaacatgtagaaacaaattcccgactcatgaaaaagttcgaggagagtagagccgagctggagaaagtcctgcgcatcgctcaggagggtcttgaagagaagggcgatcccgaggagctcctgaggcggcacactgagtttttttcccaacttgaccagagggtcctaaatgccttcctgaaggcctgcgacgagctaactgacatcttgccagagcaggagcagcagggactgcaggaagcggttcggaaattgcacaaacagtggaaagacctccagggggaggccccttaccacttgcttcatctgaagatcgatgtcgagaaaaacagattcctggcctccgtggaggagtgtagaactgaactcgaccgcgagacaaagcttatgccccaagaaggctcggaaaagattatcaaggaacatcgcgtgttttttagcgataaggggcctcaccatttgtgtgagaagaggcttcagctgatcgaggaactgtgcgtaaagctgcctgtccgtgatcccgtccgcgatacaccaggaacgtgccacgtcactctcaaagaattgcgagccgctattgacagcacttaccggaagcttatggaggaccccgacaagtggaaggactatacctcccgtttcagtgaattcagtagttggatctctaccaatgagactcagctgaagggcatcaaaggagaagcgatagataccgcgaatcacggcgaagtgaaacgcgctgtcgaggaaattaggaacggggtgaccaaaaggggtgaaacattatcttggctcaaatctcgtctgaaagtgctgacagaagtatcttccgaaaacgaggctcaaaagcagggagatgagcttgccaaactgagctccagcttcaaggctctcgtaacgctgctgtctgaagtagagaagatgctatcaaattttggtgattgtgtacagtacaaggagattgtcaaaaacagcttggaagaacttatctccggaagtaaagaagtgcaggagcaagcggaaaaaattctggataccgagaacctattcgaggcacaacaactgctgcttcaccaccaacagaaaactaagcggatctctgccaaaaagagggatgtacagcagcaaatcgcacaggcccagcagggagaggggggtcttccagataggggtcacgaggaactgcggaaactggaaagcaccctggatggcctggagcgttcgagggagaggcaggaacgacgcatacaggtgactctgagaaaatgggagcgttttgaaactaacaaagagacggtcgtaaggtatctgttccagactggaagcagtcatgaacggtttctttcattctccagcttggaatcactcagcagtgaattggaacagaccaaagagttctccaaacgcaccgagagcatcgcggttcaagcagagaacctggtaaaggaggcttcagaaatccctctgggtcctcaaaacaagcaactgctgcagcagcaggccaaatccatcaaggagcaggtcaagaaactggaggacacgctcgaagaggatattaaaactatggagatggtgaagacaaagtgggaccactttggatccaatttcgagacgctgagtgtgtggattacagaaaaggaaaaggaactgaacgcgctggaaacttcctcttccgcgatggatatgcaaatttcccaaatcaaagtgactatacaggagattgagagcaagttgtcgtccatagtgggacttgaggaggaagcacagtccttcgcacaattcgttaccactggggaaagcgccaggataaaggccaagcttacacagattcggcgttacggcgaggagctccgcgagcatgctcagtgcctagaagggacgattctaggacacctttctcagcagcagaagttcgaagagaatctccgcaagatccagcagagtgttagcgagttcgaggacaagctggccgtccccattaagatttgctcttcagcgaccgagacctacaaggtattgcaggaacacatggatctgtgccaggcattggaatccctctcatccgccatcacagcatttagcgctagcgcgagaaaagtcgtcaaccgcgactcgtgcgtgcaggaggccgcagcattacagcagcagtatgaagatatattgcgccgagctaaagagcggcaaaccgctctggaaaatttgctggcacactggcaacgcctggagaaagagctgtcctcctttcttacttggttagaacgtggcgaggccaaagctagtagcccagagatggatatctcggccgacagggtaaaagtcgagggcgaactgcagctgattcaggcaagcagcagaaaatttgttagtcaggcctccttctacagcaagctcttgcagcttaaggagtccctgttttcagtcgcctcgaaagatgacgtgaagatgatgaaattgcacctggagcaactggacgagcgttggagagatttacctcaaatcattaataagaggattaacttcttgcagagcgttgtcgctgagcatcagcagtttgatgagctgcttctgtccttctcagtctggataaaattgttcctgagtgagctacagacgacatcggaaatcagcatcatggatcaccaggtggctctcacccgccacaaagaccatgcagctgaggtggagagcaagaagggagagctccagtctctgcagggacatctggccaagctgggcagtttgggaagggctgaggacttgcacctgttgcaggggaaggcagaggattgtttccaactgtttgaggaggcttctcaggtggtggaacggagacaactcgccctgtcccacttggcggagtttctgcagtcgcacgcctcgctgagcggaattttacggcaattaaggcagactgttgaagccaccaattctatgaacaaaaacgagtctgacttgattgaaaaagatcttaatgatgctttacagaacgcaaaagccctggaatcggctgccgtgtctctcgacgggatcctctctaaggcccaatatcatctgaagatcggcagctctgagcaaagaacaagttgtcgagccactgcagaccagctgtgcggggaagtggagcgcattcagaatttacttggtactaaacaatctgaagccgatgctttagcagtacttaaaaaagctttccaggaccagaaagaagagctgctaaagagcatcgaggacattgaggagcgcactgataaggagaggctcaaggagcccactcgccaggcactgcagcagcgactccgcgtttttaatcagctggaggacgagctgaattcccatgagcacgagctgtgctggctgaaagataaggcaaaacagatcgcccagaaggatgtggcatttgcgccagaggttgacagagaaatcaaccgcctcgaagtaacatgggatgacaccaaaagactgattcacgaaaatcagggccaatgctgtgggctgatcgatctgatgagagagtaccaaaatctcaagtccgctgtctccaaggtgctggagaatgcaagctctgtgatcgtcacgcggacaactattaaggaccaagaagacctgaagtgggccttcagcaagcacgagaccgccaagaataagatgaactacaagcaaaaagacttggataatttcacaagtaaaggaaagcatttgttaagtgaactaaaaaaaatccacagctcagatttttcacttgttaaaactgacatggaatcgaccgtggacaagtggttggatgtcagtgagaagctagaggagaatatggatagactgagagtctcactctctatttgggatgacgtgctgtccacacgggacgaaatagaggggtggagcaacaattgcgtgcctcaaatggcagagaacatatccaatctggacaatcacctccgagcagaggagctgctaaaagaattcgagagcgaggtgaagaacaaggccctgaggctcgaggaactacactcaaaggtaaacgacctcaaggagctgactaagaatctcgagactccacctgacctccagttcatagaagccgaccttatgcaaaagctcgaacacgctaaggagattactgaggtagccaaaggcactttgaaggactttactgcacaaagtacacaggtggagaagttcattaatgacataacaacttggttcacgaaggtggaagagtctctgatgaactgcgcccagaacgaaacgtgcgaagccctcaagaaggtgaaagatatccagaaggagttgcagagtcaacagtccaatataagctctactcaggagaatctcaactctctgtgccggaaatatcacagcgccgagctggagtcactgggaagggcaatgacagggctgataaaaaagcatgaagccgtcagccagctgtgctcaaaaacgcaggcttcactgcaggagagcttggagaagcatttcagtgagagcatgcaagagtttcaggaatggtttctcggggctaaagcagccgctaaggaatcaagcgatcggactggagactctaaagtgttggaggctaaactgcacgatctccaaaacattctggactcggtatctgacggccagagtaaactcgatgcagttacacaggaggggcagactttatatgcccatctgagcaaacagattgtgagctcaattcaggagcagattaccaaggctaatgaagagttccaagcatttcttaagcaatgcttgaaggacaagcaagccctccaagattgtgcttccgaactggggtcctttgaggatcagcacaggaaactcaatctgtggattcatgaaatggaagagcgattcaatacggagaatttaggagaaagcaaacagcacattcctgagaagaaaaatgaagtgcataaagttgagatgttcttaggagagctgttggccgcaagagagtcgctggataagctgagtcaacgtggtcaactactttcagaggaggggcacggtgcgggacaggagggtcgcctctgctcccagctcctcacaagccaccagaacctgctcagaatgactaaggagaaactcaggtcttgccaggtggcactgcaggaacacgaggcactggaggaggctctgcaatcaatgtggttttgggtcaaagctatccaggaccggctggcatgcgccgaaagtactttagggtccaaggatacgctggagaaacgcttatctcaaattcaggacatcctgcttatgaaaggcgagggggaagttaagctgaacatggctattgggaagggagagcaggccctaaggagcagcaacaaggagggtcagcgggttatacagacacagctggaaactctgaaggaagtgtgggcagacataatgtcctcatccgttcacgcacagtctaccttagagtctgtgattagtcagtggaatgactacgtcgagcgcaagaaccagctggagcagtggatggagtcagtggaccaaaagatagagcatcccctgcagccccagcccggtctgaaggagaaattcgtgctgctggatcatctccagtccattttgagcgaagcggaagaccacaccagggccctacaccgattaatcgccaagtctagagagttgtacgagaagacagaagatgaatcctttaaggacactgctcaagaggaactgaaaactcagtttaacgacatcatgaccgtcgcaaaggaaaagatgcgaaaggtggaggaaatcgtgaaagatcacctgatgtacctcgacgctgtacacgagttcactgattggctccatagcgctaaggaagaacttcaccgatggtctgatatgagcggcgatagtagcgccactcagaagaagctgtcgaagataaaagaactgatcgactcccgggaaataggtgcatctagactatccagagttgagtctctggcccctgaggttaagcagaatactaccgcaagcggttgtgagttgatgcacaccgagatgcaagcactgcgcgctgattggaaacagtgggaggactccgtctttcagacacagtcctgcctggaaaatcttgtgagtcagatggcactcagcgaacaagaattttctggccaggtggcccaactcgagcaggcacttgaacagtttagtgccttgctgaaaacatgggcacaacagctcactttactagagggcaagaataccgacgaagaaatcgtggagtgttggcacaaaggacaggaaattctggacgctttacagaaggctgaaccgcgaacggaggatcttaaatcccagctcaacgagctttgcaggtttagccgcgacttgagcacttatagcggaaaagtgagcggcttgataaaggagtataattgcctttgtctgcaggcctcaaaaggttgtcagaataaggagcaaatcttgcagcagaggttccgtaaggccttccgagattttcagcagtggctcgttaacgcaaagatcacaaccgctaagtgcttcgatataccccagaatataagtgaggtgagcacctccctgcaaaaaatccaggagttccttagcgagtccgagaacggtcagcacaaactgaatatgatgttgtccaagggggaactattgtcaaccttattgacaaaagaaaaggccaagggcatacaggccaaggtgactgcggcaaaggaggattggaagaacttccactcaaaccttcaccagaaggaaagtgctctggagaacctcaagattcagatgaaggatttcgaagtgagcgcagagccaatccaggattggctgtccaagaccgagaagatggtccatgaatccagcaacagactttacgatctgcccgctaaaaggcgcgaacagcaaaagctgcaaagcgttctcgaagaaatccactgttatgagccccagctgaatcgtctgaaggaaaaggcccagcagctctgggaaggtcaagccgctagcaaaagttttaggcaccgggtgtcccagctgtcgtctcagtacttggccctgagtaacctgacaaaagaaaaggtgagccggctcgacagaatcgtcgcagagcataatcagttcagtctgggaatcaaagagcttcaggattggatgacagacgcaatccatatgctcgactcttattgtcacccaacctccgacaagtccgtcttagacagccggacgctgaaattggaggccctcctcagcgtcaaacaagagaaggaaatccagatgaagatgattgttacccgtggagaaagcgtgctgcagaacacttctccagaaggaatccccactatacagcaacaattacagtctgttaaggatatgtgggctagtcttttgagtgctgggattagatgcaagtctcagctggaaggagcactgtcaaagtggaccagctaccaggacggtgtgaggcagttctcgggatggatggactccatggaagcaaatctgaacgaatccgagcggcagcacgctgagctccgcgataagacaaccatgctcggaaaagccaagctcctgaatgaagaggtcctgagctactcttctttgctggagaccatcgaggttaagggcgctggcatgacagaacactatgttactcaactggagctacaagatcttcaggagagatacagagctattcaagagcgtgccaaagaggcggtgaccaaatctgagaagctggtgaggctgcaccaggagtaccagagggatctgaaagcctttgaggtgtggttgggacaggagcaggaaaagctggatcagtattccgtcctcgagggggacgcacatactcatgagacaaccctgagggacctccaggaattgcaggtgcattgcgccgaaggccaggccctgcttaacagtgtcctacatacacgggaagatgtgatcccgtctgggatccctcaagccgaagacagggctctggagtccctgcgtcaggattggcaggcatatcagcaccgactgagcgagacccggacccagttcaacaatgtagtgaataaacttcggctgatggaacagaagttccagcaggtggatgaatggctgaagacggctgaagagaaaaaatggcatgaggaggtaactgcctatcgcgacgaggttgaagaagttggagccagggcccaggaaattcttgatgagagccacgtcaactctcgtatgggatgccaggccactcagcttacctccagataccaagccctcttactgcaagtcctggagcagatcaagttcctcgaagaggagatccaatccctggaggaatctgagagctcgctgtccagctattctgactggtacgggagcacacataagaattttaaaaacgtcgcgaccaagatcgacaaagtggatacggtgatgatggggaagaagctaaagaccctggaagtcctgctgaaggatatggagaagggacacagcctgctgaagagcgcgagggagaagggcgagagagcagtgaagtatctggaggagggagaagccgaaaggctccgaaaggagatccacgaccacatggagcagcttaaagagttaacttcaactgttaggaaggagcacatgactctcgagaaaggcttgcacttagctaaagaattctctgataaatgtaaagccctaactcaatggattgctgagtatcaagaaatcctgcatgtcccagaggagcccaaaatggaactttatgagaagaaagcacagctgtccaagtacaaaagcctgcaacagacagtcctgtcgcacgagccttccgtgaaaagcgtacgagagaagggggaggccctgttagagctagtccaggacgtcacgctcaaagacaagattgaccagctgcagtctgattatcaggatctgtgtagcatcggtaaggcaatgatggaggagatagctgggttcgaagatcgactaaacaacttgcagatgaaaggcgacacccttattggacaatgtgccgaccacctgcaggccaaactaaaacagaacgtccacgctcatctccaagggacgaaagattcatattcagccatttgtagcaccgcccagaggatgtaccaatcactagaacacgagctgcagaaacatgtaagtaggcaggacaccttgcaacagtgtcaggcctggctgtctgccgtacagcctgacctggagccgagccctcagccccctttgtcacgggcagaggctatcaaacaagtgaaacacttccgggctcttcaggaacaagccagaacatatctggacttgctttgcagcatgtgcgacctgtcgaacgcttcagtcaagaccacagctaaggacatccaacaaacagaacagacgattgaacagaaactggtccaggcacagaacttgacacaggggtgggaggagatcaagcatctcaagagcgaactgtggatttatttgcaggatgctgatcagcagctgcagaacatgaagcgccgtcactccgaattggagcttaatatcgcccagaacatggtgtctcaggtaaaggatttcgtgaaaaagctgcagagcaaacaagcaagtgtgaacaccataattgagaaagtgaacaaattgaccaagaaagaggagtctcctgagcacaaggagattaaccacctgaacgatcagtggctggacctgtgtcgacagtcaaacaacctgtgcctgcagagagaagaggacctgcagcgcacaagagactaccacgactgtatgaacgttgtggaagtgtttctggaaaagtttacaacggagtgggacaacttggcacggtccgacgccgaatcgacagccgtccatctcgaagcccttaagaaactcgcccttgcccttcaagagcgcaaatacgcaattgaggatctgaaggatcagaagcagaagatgatagaacaccttaatcttgacgacaaggagcttgtgaaggagcaaaccagccacctggagcagagatggttccagctcgaggaccttattaagagaaaaatccaagtgagcgtaaccaatctggaggagctgaacgtggttcaatctcgtttccaggagctgatggagtgggctgaggaacaacagcccaacattgccgaagctctgaaacagtcacctccgcctgatatggcccagaatctgctgatggatcacctagctatctgcagcgagctagaggcaaagcaaatgctgctgaagtccctgataaaggacgcagacagagtgatggccgacctggggctgaacgaacgccaggtgatacagaaggctctgtcagacgcccagagccacgtgaattgtttatccgacctggttggtcagaggcggaagtatcttaataaggcactgtctgaaaagactcagtttttgatggcggtttttcaggcaacatcacagatccagcagcacgagaggaagatcatgtttagggaacacatctgcctgttaccagatgatgtgtccaaacaggtcaaaacgtgtaagagtgcccaggcgtctttaaaaacataccaaaatgaagttacaggcctctgggcccaaggccgtgagctgatgaaagaggtgacagagcaggagaagtccgaagtgttgggcaagctgcaggagctacagtcagtctatgattcagtcttgcagaaatgctcacaccgcctgcaggaattagaaaagaacctggtcagtaggaagcacttcaaagaggactttgacaaagcttgccattggcttaagcaggcagatatcgtgaccttccctgagattaacctgatgaatgagtcatcagagctgcatacgcagttggcaaagtaccagaacattcttgaacagtctcctgagtacgagaacttgctcctgactctgcagaggacgggtcagacaatacttccttccctcaatgaagtcgatcattcatacctgtctgagaagcttaacgcactccctcgtcagttcaatgtgattgtggcactggctaaagataagttctataaggtccaggaagccatcttagccagaaaagagtatgcctctcttatcgagttaaccactcagtcgcttagcgagctggaggctcagttcctgcgaatgagcaaggttcccaccgaccttgccgtggaggaggccctctccttacaggacggctgcagggctatcctagacgaagtagccggattaggcgaagccgtcgatgaactgaaccaaaagaaggagggtttccgatcgaccggacagccatggcagcccgacaagatgctgcaccttgtaaccctctaccatcgattaaagaggcagactgaacaacgggtgtcactgctggaggatacgacttccgcttaccaagaacatgagaagatgtgccaacagcttgagagacagttgaagtccgtgaaggaggaacagagcaaagtcaacgaggaaacactgcccgcagaggagaaactcaagatgtaccattctctggctggaagtttgcaggactctggcatagtcttgaagcgcgtcactattcatctcgaggacctggctccacatctggacccgctagcatatgagaaggcccgtcatcagatccaatcttggcagggggaactgaagctactcacttcagccataggggagaccgttacagagtgcgagtcccggatggtgcagtcgattgatttccagacagagatgagtcgctcgctggactggctccggagagtgaaggccgaactcagtggcccagtctatctcgacttaaacttgcaggacatccaggaggaaatcaggaaaatccaaatccaccaagaggaggtgcagagctctctcagaataatgaacgctctgtctcataaagagaaggagaaatttacaaaggctaaggagctgatcagcgcggacctcgagcattcactggccgagctctcagaattagacggcgacatccaggaagccctgcggactcggcaagctaccttgacagagatttattcccagtgtcaacgatattaccaagttttccaggccgctaatgattggctggaggatgcccaagagctcctgcagctagctggaaacggtttggacgtcgaatcagcagaagaaaatctgaaatcccatatggagttcttctctactgaggatcagtttcatagtaacctggaagaactccattcactggtggctacattggacccactgatcaagccgaccggtaaggaagacctggaacagaaggtggcttcactggagctgcgctctcaacgcatgagcagagatagcggggctcaggttgacctgctgcagagatgcactgcacaatggcacgactaccagaaggctcgcgaagaggtgatcgaactcatgaatgacactgagaagaaattaagcgagttctccttgctgaagacttcttctagccacgaagcagaggagaagctaagtgagcataaagcccttgtaagcgtggtgaacagcttccacgagaaaatagtcgccctggaagaaaaagcctctcaactggagaagactggcaatgacgcatctaaggccaccctgtcacggtctatgaccaccgtatggcagaggtggactcggctgcgggctgtcgcacaagatcaggaaaagatcctggaggatgccgttgacgaatggaccggcttcaacaataaagtgaagaaggcaaccgaaatgattgatcagctacaggacaaactcccaggcagctctgcagagaaggcatcgaaagcggaattactcactctactcgagtatcacgatacgtttgtgcttgagcttgaacagcaacagtccgccctgggaatgctccggcagcagactctttcgatgctccaggatggcgcagctcccacgccaggcgaagagccgccactgatgcaagaaatcactgcaatgcaggatcgctgcctgaacatgcaagaaaaagtgaaaaccaacggaaaactggtcaaacaggagctgaaagaccgggagatggtggagacccagatcaatagcgtgaagtgctgggtgcaggaaacgaaagaatacctcggaaacccaaccatagaaatcgatgcccagcttgaggagttacagatacttctaacagaggcgacaaatcatcgtcagaacattgaaaaaatggctgaagagcaaaaggagaaatacctcggtctgtacacaatcctacctagcgaactttctctacagctggccgaagtggccttggacttgaaaatcagagaccaaatccaggataaaataaaagaggtagagcagtccaaggccaccagccaagagctttctaggcagattcagaaactggctaaggaccttacaaccatccttactaagctgaaggctaagactgataacgtggtacaggccaagacagaccagaaagtgctgggggaggagctggatgggtgcaattccaaactgatggagctcgacgccgctgttcaaaaatttttagagcagaacggccagctgggcaaaccacttgcaaaaaagatcggaaagctcacagaactccaccaacagaccatccggcaggcggagaaccggctcagtaaactgaatcaggccgcttcacacttggaggaatataatgaaatgctggaattaattcttaagtggatagaaaaagctaaggttctagcgcacggcaccatcgcttggaactcagcttcacaactgcgcgagcagtatatacttcaccaaactttgctcgaggaatctaaggaaatcgattctgagctcgaggcgatgacagaaaaactgcagtacctgacaagtgtgtattgcacagagaaaatgagtcagcaggtcgcagaactcgggcgagagacagaggaactgcggcagatgattaagattcggctgcagaatctccaggacgccgctaaagatatgaaaaagttcgaggccgaactgaaaaaattgcaggccgcattagagcaagctcaggctacactgacaagccctgaggtgggcaggttgtctctcaaagaacaactgagccaccggcagcacctactgtccgagatggagtccttgaagcccaaggttcaggccgtgcaactttgtcagagcgcactacgaatcccggaggacgtggttgccagtctgccactgtgccatgctgcgctcagactgcaggaagaggccagtcgcttgcagcacactgctatacaacagtgtaatatcatgcaggccgctgtggtacagtatgagcaatatgaacaggaaatgaaacatcttcagcagctcatagagggcgctcatagagaaatagaagacaaaccagtagcaacctcgaacatccaagagctgcaagcccagatctcacgccacgaagaattggcccaaaagattaagggttaccaggagcagattgcaagtcttaactccaaatgcaagatgctgactatgaaagccaaacacgcaactatgctgctgactgtgacagaggtagaggggttagccgagggcacagaagatctcgacggcgagctgttgcctacaccaagcgcccaccctagcgtcgtcatgatgaccgccggtagatgtcacactcttctatcacctgtgacagaggagtccggcgaggaggggaccaactctgaaatcagcagcccaccggcttgtagaagtcccagcccggtagccaatacagatgcctctgtgaaccaggacattgcatactatcaagctttatctgccgagaggttgcagactgacgcggcaaagatccatccaagcacatcagcctcacaagagttctatgagcctggactggagccaagcgccacagcaaagctgggagacctgcaacgttcatgggagaccctcaagaatgttatcagcgaaaagcaacgtacgctgtacgaggcgctcgaacgtcagcagaaataccaagattctctccagtccatcagcactaagatggaggcaattgaattaaagctgtccgaaagccccgaacctggacggagcccagagagccaaatggccgagcaccaggcacttatggatgagatcctcatgctgcaggacgaaattaatgagctgcagtctagtcttgctgaagagctagtctcagagtcatgtgaggctgaccccgcagaacagctggcattacagtctacccttacagtactcgcagagaggatgtctaccattcggatgaaggcctcaggtaaaaggcagctgctggaggagaaactgaacgatcagttggaggagcaacgacaggagcaagcactgcagcgctaccgatgtgaggccgacgagctagacagctggttgttgagcacaaaggccactttagacactgctctaagtccccctaaggaaccaatggacatggaagcgcaactcatggattgtcagaacatgttggtggagatcgagcaaaaggttgtggcattgtcagaactatccgtccacaatgaaaatctgctgctggagggcaaagcacacactaaggatgaagcggaacagctggcaggaaagttgaggagactgaaggggtctctgctggaactccagcgggctctgcatgacaagcaactcaacatgcaggggacagcacaggagaaggaggaatccgatgtagatttgaccgccacccagagccccggtgttcaggagtggctcgctcaggcacgaaccacttggactcagcagagacagagcagccttcagcagcaaaaagaactggaacaagagctcgccgagcaaaaatccctcctccgcagcgtggcatcccgaggggaggagattctgatacagcactcggccgcagaaactagtggtgacgcaggcgagaagcccgacgtcttatctcaggaattggggatggagggcgaaaagagtagcgccgaagatcagatgagaatgaagtgggagtccctgcatcaagagttttccacaaaacagaagttgcttcaaaacgtcctggaacaggagcaagagcaggttttgtattcgagacccaaccggctgctttccggcgttccgctgtataaaggtgacgtgcctactcaagacaaaagcgctgtgacatctctactggatgggctcaaccaagcctttgaggaggttagttctcaatctggcggtgctaagaggcaatccattcatcttgaacaaaagctatatgacggagttagcgcgaccagtacatggctcgacgacgttgaagagcgactatttgtcgctaccgcattgctgcctgaagagactgagacttgcctatttaaccaagagatccttgccaaagacataaaagagatgtctgaagaaatggacaaaaacaaaaacctgttcagccaggcgttccctgaaaatggtgacaacagggatgtgatcgaggacactcttggatgtcttctgggccgtctgagcctgctggattccgtcgtcaatcaaagatgtcatcagatgaaggagcggctgcagcaaatactgaactttcaaaatgacttgaaggtcttgttcaccagcctcgcagacaacaagtacatcatcttacaaaagctggccaacgttttcgaacagccagtagcggaacagatcgaagccattcagcaggccgaggatggtttgaaagagttcgatgccggtataatcgagctcaagcgtcgaggagacaagctccaggtggaacaaccctcaatgcaggaactcagtaagctgcaggatatgtacgacgaactgatgatgatcatcggaagtcggaggagcggcctgaatcagaacttaactctgaaatcccagtatgaacgggcactgcaagatcttgcagacctcctggagactgggcaggagaagatggctggggatcagaagattattgtgagcagcaaggaagaaatccaacaactactcgataagcataaggaatactttcaggggcttgaaagccatatgatcctgacagaaacacttttcaggaaaattatctcttttgcggtccagaaagaaactcagtttcacaccgagctcatggcgcaagcttcagccgtactgaaacgggctcacaagaggggtgttgagctggagtacatactggagacctggagtcacctcgatgaagaccagcaggaacttagccggcagctggaggtagttgagagcagcattccaagcgtaggcctggtggaggagaacgaggataggctgattgaccgaattaccctataccagcacctgaagagtagtctcaacgaataccagccaaagctttatcaggtgctggacgatggaaaacgactattgattagcatctcctgctctgatcttgaaagccagctcaaccagctcggagagtgctggttaagtaacacaaacaagatgtccaaggaacttcatcgacttgaaacaattctcaagcactggactcggtaccagagtgaaagcgcagatctgattcactggctgcagtccgctaaagaccgacttgaattttggacccagcagtcagtgacggtgcctcaagaactcgaaatggtacgggatcaccttaatgcctttttggaattcagcaaggaagtggacgcccaatcttccctgaagtcctcagtgctgagtacaggaaaccaattacttcggctcaaaaaagtggacacggccaccctgagaagtgagctatcccgaatcgatagccagtggaccgacttgttgaccaacatccctgcggtccaggagaagctgcatcagttgcaaatggataagctgccttcacggcacgctattagtgaggtgatgagttggatttctctgatggagaacgttatccaaaaggacgaggataacattaagaattccattggctacaaagccatccatgaatacttacagaagtataagggattcaaaatcgacattaactgcaagcaacttaccgttgattttgtgaaccagtcagtactacaaatctcaagccaggacgtggagtccaagcgaagtgacaaaactgatttcgcagaacaattaggcgcaatgaataagagttggcagatactgcaggggttggtgacggaaaaaattcagctactcgaagggctcttagagagctggtctgagtacgagaacaatgttcagtgcctgaagacatggtttgagacccaggagaaaagactcaagcaacaacatcgcatcggcgaccaagcttcggtgcagaatgctttgaaggactgccaggaccttgaggacctgatcaaggctaaggagaaggaggtcgaaaaaatcgaacaaaacggcctcgctctgattcaaaataagaaagaagacgtgagtagcatcgttatgtcaaccctgcgggaactcgggcaaacatgggccaacctggatcatatggtgggacaactgaagatcctgctcaaaagtgtgttagaccagtggtctagccataaggtggcatttgacaagataaatagttacctgatggaggctagatattctctgagccggtttcgtcttctaactggctctctcgaggctgtgcaggttcaagtggacaatctgcagaacctccaggacgacctcgagaaacaagagcgaagcttgcaaaagttcggaagcataaccaatcaactgcttaaagaatgtcacccccctgtgacagaaacactgacaaacacgctgaaagaagtaaatatgcgctggaacaatctgctagaagagattgccgagcagctgcaaagttcgaaagcactcctgcagctgtggcagcggtacaaggactacagtaaacaatgtgctagcaccgtgcagcaacaagaggatagaacaaatgagttgctcaaagcggctacaaacaaggatatcgctgatgatgaggtcgccacttggatccaggattgcaacgatctgcttaagggactagggactgtgaaagattcactgttcttcctccacgaactcggtgaacagctgaagcagcaggtggacgcttccgccgcaagtgcgatccaaagcgaccagctttccctcagtcagcacttgtgcgccctcgagcaagctctttgtaagcagcagaccagcctacaggctggggtgctggactacgaaacattcgctaaaagcctggaagcccttgaggcttggattgttgaggctgaggaaatcctgcagggccaggaccccagccatagtagcgatctatcaacaattcaggagcgtatggaggagctgaaagggcaaatgctgaagttctcaagcatggcacccgacctggacaggcttaacgagctggggtaccgcctgcccctgaatgataaggagataaaacggatgcaaaatttaaaccggcattggtcactgatttcttcgcagaccaccgagcgcttttccaaacttcagtctttcttgcttcagcaccagacatttcttgaaaaatgcgaaacatggatggagttcctggtgcaaaccgagcagaaactggccgttgagatcagcgggaattaccaacacctacttgagcagcagcgggctcacgaactctttcaggccgagatgttctcccgccagcaaatcttgcattcgataattattgatggtcagcggctgcttgagcagggccaggtggacgatcgcgatgaattcaatctgaagttgactcttttgagcaatcaatggcaaggagtgatccggcgagcacaacagaggcgtggcattatcgatagccagatccgacagtggcagagatatcgggagatggccgagaagctacggaagtggttggttgaagtgtcatacctccccatgtcaggactcggctccgtacccattccactccagcaggcacgcactttatttgatgaggtccagttcaaggagaaggttttcctccgtcagcagggatcttatatcttaactgtggaagcgggtaagcaattgttattgtctgccgattccggggctgaggcggctctgcaggcggagctggctgaaattcaggaaaagtggaaatcggcctcaatgcgactcgaggagcagaaaaagaagctggcattccttcttaaagattgggagaaatgcgagaagggcattgctgacagcctagaaaagctgagaacctttaaaaaaaaactgagccagtccctccccgatcaccacgaggaactgcacgcagagcagatgcggtgtaaggagctggagaacgcagtgggtagctggactgatgacctgacacagctgagcctgctgaaggacacactttctgcttatattagtgcagacgatatctctattctgaacgagcgggtggagctgctacagaggcagtgggaggagctgtgccatcaactgtcacttaggcggcagcaaattggagaaagattgaatgagtgggcggtattctctgaaaaaaacaaggaactctgcgagtggctgacccagatggaatctaaggtctcacagaacggcgacatcctaatagaggagatgattgagaagctgaaaaaagattatcaggaggaaatcgcaattgcccaggaaaataagattcagctccagcagatgggcgaaaggctagcgaaggcatcccatgagtctaaggcctccgaaattgagtacaagttgggcaaggttaatgatcggtggcagcacctgctggacctgatcgcagctcgcgtgaaaaaactcaaagaaacgctggttgcggtccagcagctagacaagaatatgtcttccctgcggacctggttggcccacattgaaagtgagcttgctaaacctatcgtttatgacagttgcaatagcgaggagattcaaagaaagttaaacgaacagcaggaactccagagagacattgaaaagcattcaaccggtgtggcctctgtgcttaacctgtgcgaagtattactgcatgactgcgatgcctgtgctactgacgcggaatgtgacagtatacaacaagcaacccgaaatctggatcgacgttggcgcaatatctgcgctatgtccatggagcggagactgaaaattgaggagacatggaggctgtggcagaagtttctcgatgactatagccggtttgaggactggctgaaatctagtgaacgcaccgcggcatttccaagcagtagtggggtcatttacaccgtggctaaggaagaacttaagaaatttgaggccttccagcgccaggtccacgagtgcctgacacagttagaactcatcaataagcagtacaggcgtcttgctcgcgaaaaccgaacagactccgcttgcagtctgaaacagatggttcacgagggcaaccagagatgggataatctgcagaagagagttacaagcattctcagaaggcttaagcatttcatcggacagcgagaagagttcgaaaccgcccgagactccatactggtttggcttaccgaaatggacttgcaacttacgaatattgagcacttcagtgagtgcgatgttcaagcgaaaattaaacagctgaaggccttccagcaggagatttccttgaatcataataagatcgagcagatcattgctcagggagagcagctgatcgagaaatccgagccactggatgctgcaatcatagaagaagagctggatgagctgaggcgttactgccaggaggtgtttgggagggtcgagaggtatcacaagaaacttattcggttgcctctgcctgatgacgagcatgatctgtccgatcgcgagttagagctggaagatagcgccgcacttagtgatcttcattggcatgacaggagtgccgattctctgctgtcacctcagccgagctccaacctctcactctctctggcccaacctctgagatcagaacgctcaggtcgagatacacccgctagcgttgacagcatcccattggaatgggatcacgattacgacctaagccgcgacctggagagtgccatgtctagggctctgccaagcgaggacgaagagggacaagacgataaagacttttacctgaggggcgcagtgggacttagcgacgtgatgattccagagtctccagaagcctacgtcaaactaactgagaatgccattaagaacacaagtggggatcatagtgccctggaaagccagattagacagcttggaaaggccctggatgattccagattccagatccagcaaaccgaaaatattatccgctctaagaccccaaccggacctgaacttgatacctcatataagggctatatgaaacttctgggcgagtgcagtagttccatcgattctgtgaaacgactggaacacaagttgaaggaggaggaggaaagccttccaggctttgtaaacctacatagcaccgaaacccagacagccggtgtgatcgatcgctgggaactccttcaggctcaggccttaagtaaggagcttcggatgaagcaaaacttgcaaaagtggcagcagtttaacagcgacctgaattccatttgggcctggttaggtgacaccgaagaggaactcgaacagcttcagcgcctcgaactctccacagatatccaaactatcgaactgcagatcaagaagctgaaggaactgcagaaagcagtggaccacagaaaagctattatactaagcatcaacctttgttcaccagaatttacacaggccgattccaaggagtctagagatcttcaggaccgattgtcccagatgaatggtcggtgggatcgagtctgctccctgctggaagagtggagaggtcttctgcaagacgcactgatgcagtgtcaaggatttcacgagatgtctcacggcttactgttgatgctggaaaacattgaccgcagaaaaaacgaaatcgtgccaattgactcaaacttggacgctgaaattctgcaggatcaccacaagcaactgatgcagatcaaacatgaactcctcgaaagtcaactgcgggtggccagcctgcaggatatgtcctgccagctcctggtgaacgcagaggggacagattgcttggaggctaaggagaaggtccatgtgataggtaacaggcttaaactgcttctgaaggaagtgtcaagacacatcaaggaactagagaagcttctggatgtgtcttccagtcagcaggacctgagctcctggagtagcgctgacgagctcgacacttccggctctgtcagcccaacttcgggtcgttcaacgccgaataggcagaaaacacctagaggtaaatgtagcctgtcccagcccggtccttctgtgtcatcgccacatagcaggagcacaaaaggtggcagcgactctagtctgtctgaacccggtcctggacgctccggtagaggattcctgtttcgagtgctacgagccgctttaccattgcagcttctgctcctgctgttgattggcctcgcttgtctggtgcccatgagcgaagaggactattcttgtgctctgtcaaacaacttcgcacgttcattccaccctatgctgcgatatacaaacggcccaccgccacttta

SEQ ID NO: 242071 - DNA, 2859 bp, Artificial Sequence
  Description of Artificial Sequence: Synthetic coding sequence
atggtggtcgctgaggatctgtcggcactcaggatggccgaagattcctgtgtcgacgccgacctccccgactgcaattgcgatgttaccagagtgaagaagctgaaagagacactggtcgctgtccagcagctggataagaacatgtcctccctgcgaacctggttagctcatatcgaatccgagctagctaaaccaatagtttatgactcctgtaactcagaggagatacagcggaagctgaatgagcagcaggaactgcaacgggacatagagaagcattctacaggggtggcatctgtgctgaacctgtgtgaagtgctgctgcatgactgcgacgcttgtgcgaccgatgctgagtgtgacagcatccagcaggcaacccgaaatctcgacaggcggtggcgcaatatttgcgctatgtcaatggaacggaggctcaagattgaagaaacctggcgactttggcagaagttcctggatgattactcgcggtttgaagattggctaaagagcagtgaaagaaccgctgccttcccctcctccagcggagttatatacactgtggccaaagaagagctgaagaaattcgaagcctttcaacgacaggtgcatgaatgtcttactcagctggagctgatcaacaaacaataccgccgactggctagagaaaatcgcacagattccgcctgtagtttgaagcagatggtacacgaaggcaatcagcgttgggacaatctgcagaaaagggtgacatcgatactcagacgcctgaaacattttatcgggcagagagaggaattcgagacagcaagagactcaattctggtgtggctgaccgagatggatctgcagctcactaatattgaacatttctcagagtgtgatgtgcaggcaaaaatcaagcaactcaaggcatttcagcaagagatcagcctaaatcataataagattgaacagattatagcgcagggcgaacagctgatcgagaaaagcgaaccgctagacgcggctatcatcgaagaggaactggatgaactgcggagatactgtcaagaggtttttgggagagttgagcgctatcacaagaagctgatcagactcccactcccagatgatgagcatgatctcagcgatagggagcttgagctcgaagactcggccgcactctcagatcttcattggcacgatcggagtgctgattccctcctaagcccccaaccctcttctaatctgtcgctgtccctggcccagccacttcgctccgaacgatctggacgagatacccccgctagtgtcgacagcattcccttggaatgggatcacgattatgacctgagccgtgatcttgaaagtgccatgagtcgcgctctaccatctgaggacgaggaaggccaggacgataaggatttctacctgaggggagctgtggggctatctggtgatcactccgcgttggagtcacagattcggcagctcggtaaggctctggatgatagccgattccagatccagcagacagagaatataatccggagcaagacaccaacgggtccagaactggatacctcctataagggttatatgaaattactgggtgagtgttcatcctcaatagattccgtaaaaagacttgagcataaattaaaggaggaggaggaatctctgccaggattcgtgaatctccacagcaccgaaacacaaaccgccggtgttatagatcgctgggagctgctccaggctcaggctctgagcaaggaactgagaatgaaacagaatctccagaaatggcagcagtttaacagtgatctgaacagtatctgggcatggttaggcgacaccgaggaagaactcgagcagcttcagcgccttgagttatctaccgatattcaaaccatagagctacagataaagaaattaaaagagctccagaaagccgttgatcaccgcaaggcaataatcttgtctattaacctttgctctccagaatttacccaagcggacagcaaagagtcacgagacttacaggatagactttctcagatgaacgggcgatgggacagagtgtgctctttgcttgaggagtggagaggcctattacaagacgcactaatgcagtgccagggtttccacgaaatgtcacacggtttgctgctcatgttggagaacatcgatcggcgtaaaaatgaaatcgtcccaattgacagcaacttggatgcagaaattctacaagatcatcacaaacagctcatgcagataaagcacgagttgctggagtcacagttgagggtagctagtttgcaagacatgtcttgtcaactactggtcaatgctgagggaacagactgcctcgaagcaaaagaaaaggtgcacgtgataggcaacagactgaaactgctgctgaaagaggtgtcccggcatatcaaagagttagagaaacttctggatgtaagttcctcccagcaggacttatcatcctggtcttcagcggatgaactcgatacctcaggctccgttagtcccacatccggcagaagcactcccaatcgacaaaaaacaccaaggggcaagtgctctctgagccagcctggtccctcagttagtagcccgcactcacgcagcacaaaaggtggcagcgactcttccttatcagaaccaggccctggtagaagcggtcgtggattcttgttccgggtattgcgcgctgcactccctctgcagctcctactcctgctcttaattggattggcctgccttgttccaatgagcgaagaggattacagctgcgctttatctaacaattttgccaggagcttccatccaatgcttagatacaccaacggacctccccctctgtag

SEQ ID NO: 242072 - DNA, 20474 bp, Artificial Sequence
  Description of Artificial Sequence: Synthetic coding sequence
atggcttcatctcccgagctgcctactgaagacgagcaaggcagctggggcatcgacgatctgcacattagtctacaggctgagcaagaagacacacagaaaaaagcttttacctgctggattaattcccaactggcacgccacacctccccgagcgtaatatcagatctcttcactgacatcaagaaaggccatgttctgcttgaccttctagaagtgttatcaggccagcagctccctcgtgacaagggttccaacacgttccaatgccgaattaacattgagcacgccctaactttcctaaggaaccggagcatcaaactgataaacatacatgtgacggatatcatcgacgggaatcctagcatcatcttaggtttaatctggactatcatcctccacttccacattgaaaaactggctcagactctctcttgcaactataaccagccgagcctggacgatgttagcgttgtggacagttctcccgcaagcagcccaccagccaagaaatgctctaaagtccaagccaggtggcaaatgagtgccagaaaggccctgcttctctgggcccaagaacaatgcgccacctacgaatccgtgaacgtgaccgacttcaagtctagctggcgcaatgggatggctttcctggcaattatccacgccctcaggcctgacctgattgacatgaagtctgtgaagcaccgttcaaacaaggacaacctccgcgaagcctttcgcatcgctgagcaggagcttaaaattcctagactgttagaaccggaagacgttgatgtggtggatcccgatgagaaaagcatcatgacgtatgttgctcagtttctacagtatagcaaagacgctccaggaacaggcgaagaagcccaggggaaagtcaaggatgccatgggatggctcacactgcaaaaagagaaactccagaagcttctgaaagactccgagaacgacacatacttcaaaaagtacaacagcctgttgtcattcatggagtcttttaacgaagaaaaaaagagctttctggacgtgctcagtattaaaagggacttagatgagttggataaggaccatctacaactgagagaggcatgggacggcctcgatcaccagataaacgcgtggaaaatcaagctaaattacgcattaccgcctccactgcatcagaccgaggcttggcttcaggaagttgaagaattgatggatgaagatcttagtgcttcacaggaccactcccaagcagtgaccttgatacaagagaagatgactctcttcaaaagtttgatggatcggtttgagcaccatagtaatatcctgttaacatttgagaacaaggacgaaaaccatcttccgttggttccgccaaacaaacttgaggagatgaagcgccgaattaacaatattcttgaaaaaaagtttattctgcttctcgagttccactactataaatgcttagtgctgggccttgtggatgaggtgaagagcaaactggacatctggaatataaaatatggatcgcgtgagtctgtggagcttttgcttgaagactggcacaagtttatcgaagaaaaggaatttttagctcgtctggacacatcattccagaagtgcggcgagatttacaaaaacctcgccggtgaatgtcaaaatatcaacaaacagtacatgatggtcaaatccgatgtgtgtatgtacagaaaaaatatatacaatgtgaaatcaactctgcagaaagtgctcgcctgctgggcgacttacgtggagaatctgaggcttctgagagcatgctttgaagagaccaaaaaggaggagatcaaggaggtgccgtttgaaaccctggcacagtggaacctggaacacgccacactcaacgaagcagggaatttcttagttgaggtctcaaacgacgtcgttggttcctctatatccaaagagctgagaaggttgaacaagaggtggaggaagctagtttctaaaactcagctggagatgaacctgccactgatgatcaaaaagcaggaccagcccactttcgacaattcaggcaatatattgtctaaagaggagaaggctacagtggaattctcaacagatatgagcgtggagctccctgagaattataaccagaacatcaaggctggggaaaaacatgagaaggagaatgaggaatttacaggccagctgaaggtggccaaagatgtggagaagctgattgggcaggtagagatctgggaagccgaggctaaaagcgttttggaccaagacgatgtcgatactagtatggaagagtccctgaagcacctcatagccaaaggaagtatgtttgatgagctgatggctcggagcgaggatatgttacagatggacatccaaaatatttcctcacaggagagcttccagcacgtcctgactacaggactgcaggctaagatacaagaggccaaggagaaggttcagattaatgtggttaaactcattgcagcactgaagaatctcaccgatgtgtcccctgatcttgacattaggctaaagatggaagaatcacagaaggaactggagtcctatatgatgcgcgctcaacagttgttgggccagcgggaaagccctggcgagctaataagcaagcacaaggaggccctcattatcagcaacacaaagagtctggctaagtacttgaaagccgtcgaggagctgaaaaataatgttacagaggatattaagatgtctttagaggagaagtccagagacgtctgtgcaaagtgggaaagtctgcaccacgagctctctctgtacgtacagcaactgaagattgacatagaaaagggaaagctttcggataacattttgaagctggagaagcagatcaataaggaaaaaaaattgattagacgcggacggaccaaaggactgatcaaggagcacgaggcttgcttctcagaggaaggctgcctatatcagctgaaccaccatatggaggtcctcagagagctctgtgaggagcttcccagtcaaaagagtcagcaggaagtaaaaagactgcttaaagactacgaacaaaagattgagcgcttgcttaagtgcgcttcagagattcacatgaccttacagcccacagccggtggaactagcaaaaatgaagggactatcacaacctcggagaaccgagggggagaccctcattccgaggccccttttgctaagtcagacaaccagccctctacagagaaggccatggagcctactatgaaatttagcctcgcttctgtgctgcgccctttgcaagaggagtccatcatggaaaaagattactcggctagcatcaactctctgttggaaaggtacgacacataccgcgatatactcgagcatcacttacaaaacaataagttccgcattacaagtgacttcagctccgaggaggatcggtctagtagctgcttgcaggccaagttgacggacctccaggttattaaaaacgaaaccgacgctagatggaaggaattcgaaatcatcagccttaagctggagaaccatgttaatgatatcaagaaaccatttgtaatcaaggagagagatacccttaaggaacgggagcgggaactgcagatgacgctcaacacacgtatggagtcgctggagaccgcactgcggttagtattgcctgtagagaaagcgtccctgctgctttgcgggagcgatctgcccctgcacaagatggctatccaggggtttcatcttattgatgctgatagaatttatcaacaccttcgcaacattcaggactccatcgctaagcagatagaaatctgcaaccggctggaagagcctggtaattttgtcctgaaggaacttcacccctttgatctccacgctatgcaaaatattatcctgaagtataaaacacagttcgagggcatgaaccaccgcgtccagaggtctgaggatactctcaaggcacttgaggattttctggcgagcctccgcacagccaaacttagtgctgagcccgtgacagacctgagcgcctctgacacccaggttgcccaggagaacacactgaccgtaaagaataaggaaggagaaatacacctgatgaaagataaagcaaagcacctagataaatgtctgaaaatgttagatatgtcattcaaagacgcagaaaggggagacgatacatcttgcgagaatctacttgacgccttctccatcaaacttagcgagacccatggctacggggttcaagaggagttcacagaagaaaataagctgctggaggcttgcatctttaaaaataatgaactgctgaagaacatacaggacgtgcaatcacagatcagcaaaatcggcttgaaggaccccactgtacctgccgttaagcaccgaaaaaagtctcttatccggctggataaagttctcgacgagtacgaagaggagaagcgtcacttacaggagatggctaactctctgcctcacttcaaagatgggcgagagaagaccgtgaatcagcaatgccagaacaccgtcgtactgtgggagaacacgaaggctttagtgaccgagtgcctcgaacagtgtggcagggtactggagctgctgaagcagtaccagaatttcaaatctattttgactacactgattcagaaggaggagtccgtcatctccctgcaggcctcatatatgggcaaagaaaatctgaagaagcggatcgccgagattgaaatcgttaaagaggagttcaacgagcatctcgaagtggtggataaaataaaccaagtctgcaaaaatctgcagttctatctcaacaagatgaaaaccttcgaggaacctccgttcgaaaaagaagcaaatattatcgttgatcggtggctggatatcaacgaaaaaactgaggactactatgaaaatctgggccgagctctggcgctgtgggataagctgttcaacctcaagaatgttatcgacgagtggacagagaaggcccttcaaaagatggaactccatcaacttaccgaagaggacagggagagactcaaagaagagcttcaagtccatgaacaaaaaacttctgagttctcacgcagggtcgctgagatccagttcctgttgcagagtagcgaaatacccttggaactgcaagtgatggagtctagcatcctaaataagatggagcatgtccagaaatgtctcaccggcgagagtaattgtcatgccctgtctggctcaaccgccgaactgagggaggaccttgatcaagcaaaaacccagatcgggatgaccgagagcctcttaaaagccctgagcccttccgactcattggaaattttcactaagctggaggagattcagcagcagatactgcagcaaaagcactccatgatcctgctagagaatcagatcggctgtttgaccccagagctgagtgaactgaaaaagcagtacgaatctgtgtcagacctgttcaacactaaaaaaagtgtgctgcaagatcactttagcaagcttctgaacgaccagtgtaaaaattttaacgactggtttagtaacatcaaggtcaacctgaaagagtgcttcgagtcgagcgaaacgaagaaatccgtggagcaaaaactacagaagctcagcgatttcctcacgcttgaagggcgaaactccaaaataaaacaggtggactccgtgcttaagcacgtcaaaaagcaccttccaaaggctcacgtaaaggaactgatcagttggttagtcggccaagaattcgagctcgagaagatggagtcaatttgccaggccagagctaaggagttggaagattccctgcagcaattattgcgcctgcaggatgaccaccgtaatcttcgcaagtggctgaccaaccaggaggaaaagtggaagggcatggaggaaccgggagagaagacagagctattctgtcaggcccttgccagaaaaagagagcagttcgaatcagttgcccagctcaacaatagtctcaaagaatatgggttcactgaagaagaggagatcattatggaggctacttgtctgatggacaggtatcagacccttcttagacaactaagcgaaatcgaggaggaagacaagctcctgcctaccgaggaccagagcttcaatgatctagctcatgatgtgatccactggataaaagaaatcaaagagtctttaatggtgctgaattccagtgaaggcaaaatgccactggaggaacgcatccagaaaattaaagaaattattctgcttaaacctgagggagatgcaagaattgaaacaatcatgaagcaggccgagtctagcgaggctccactggtgcaaaagacacttacagatatcagcaatcagtgggacaatactctgcatcttgcgtcaacatacttatcccatcaagaaaagcttctcctcgagggagaaaagtacctccaatcaaaagaggacctcaggcttatgctgatcgaattgaagaaaaagcaggaggctggctttgctctgcagcatgggcttcaggaaaaaaaagctcagcttaagatttataaaaagttcctgaaaaaggcacaggacctgacctccctcctcaaagaactaaagtctcagggcaactatctgctcgagtgcacaaagaatccctcctttagtgaggagccttggctcgaaatcaagcatctgcacgagtcactgctgcagcagctgcaggattccgtgcagaatctggatggccacgtgagggaacacgatagctatcaggtgtgcgtcactgatctgaataccaccttagacaacttttcaaaagaattcgtgagtttctcggacaaacctgtcgatcagatcgctgtcgaggaaaaattgcaaaaactacaggagcttgaaaaccgactcagcctgcaggatggaacactgaagaaaattctggccctcgccaagtcagtgaagcagaataccagctcagtggggcagaagattatcaaggacgatatcaaaagtctgcagtgtaagcagaaggacctcgagaaccgtctggctagtgccaaacaggagatggaatgttgcttaaatagtatcctgaaatcgaaaagatctactgagaaaaagggaaagtttactctgccaggtagagagaagcaggctacatctgacgttcaggagtctactcaggaatccgctgctgtggagaaacttgaggaagattgggaaattaataaaaacttcgttgagaacgtgatggcagtcagcaagaactgccatcacagtatgtatattttcgagtcgattgtgaagaacttcatcagcgacgagatgcaggattccgccgtcgagatggccatgagcaaacagctcagccttaacgctcaagagtcaatgaaaaacaccgaagacgagagaaaggtgaacgaactgcagaatcagccgctggagctggacactatgttacgtaacgagcagctggaggaaattgaaaaattatatacccagctcgaggccaagaaggcggcaattaagcccctggagcagaccgagtgcctaaataagacagaaactggggcattggtcctgcacaacatcggatactcggcccagcatctagacaacctgctgcaggcgctaataaccctcaagaagaataaggaatcccagtattgtgttttgcgcgacttccaggagtatttagctgcggtcgaatccagcatgaaggctctgctgaccgataaggagtcactgaaggtggggcctctagattcagtaacttatcttgacaaaattaaaaagtttatcgctagcatcgagaaggaaaaagactccctgggaaacttgaaaatcaagtgggaaaatttgagtaaccatgtaactgacatggacaaaaagctactggagtctcagattaaacaattggagcacggttgggagcaggtagagcagcagatacagaagaagtattcccagcaggtcgtggaatatgatgaatttaccactctgatgaataaagttcaggataccgagatcagccttcagcagcaacagcagcacctccaattgcgcctgaagtcaccggaagagagagcgggtaaccaaagcatgattgcgctcactaccgatctgcaggccaccaagcacgggttttcagtcctaaagggacaagccgagctgcagatgaaacgaatctggggagagaaagaaaaaaagaacctagaggatggaatcaacaatctgaaaaagcagtgggagactcttgagccactccacttggaggcagaaaatcaaatcaagaaatgtgatatcagaaacaaaatgaaggagaccatcctctgggccaagaacttgctgggagagctgaatccatccatcccattgctgccggatgacatactatctcaaatacgaaaatgcaaggtgacacacgatgggatactggctcgccaacagtcagtcgagtctctggccgaggaggtgaaggataaagtgccatccttgacaacatacgaggggagcgatctgaataacaccctcgaagaccttaggaatcagtaccaaatgctggtgctgaagtccacccaacggagtcagcagcttgagttcaaactggaagagaggtccaacttctttgcaatcatacggaagttccagttgatggtgcaggagagtgagacactgatcattcccagggttgaaaccgccgctacagaagccgagctcaagcaccatcacgtgactctggaagcttctcagaaagaattgcaggagatcgatagcgggatttctactcaccttcaggaactgacaaacatttatgaagagcttaatgtgtttgagcgccttttcctggaagaccagcttaagaatcttaagattcggaccaatagaatccagaggttcatccagaatacttgcaacgaggtcgagcacaaaattaagttctgtcggcaatttcacgagaagacgtctgcactgcaagaggaggccgacagtattcagaggaacgagctgcttctgaatcaggaggtcaacaagggggtaaaagaagagatttacaatctaaaggaccgattaaccgccattaaatgctgtattctgcaggttctgaagctaaagaaagtgtttgactacattggtctgaattgggactttagccagttagaccaattacagacgcaagtatttgagaaggaaaaggaacttgaggaaaaaatcaagcagctcgacacatttgaggaggagcatgggaagtaccaggccctgttaagcaaaatgcgcgctatcgacctgcagattaaaaagatgacggaggtggtactgaaagcaccggactccagtcctgaatcccgacgcctaaatgcgcagatcctctctcaaaggatcgagaaagccaagtgcctctgcgatgagattattaaaaagctgaatgagaacaagaccttcgatgacagcttcaaagaaaaggagatcctccagataaagctgaacgctgaagagaatgacaagctttacaaagtgctccagaacatggtgttggagctgtctccgaaggagttggacgagaagaactgccaggacaaactcgagaccagcctgcacgtgctcaaccaaatcaagagccagctgcagcagcctctcctcatcaatctcgagataaagcacatccagaatgaaaaggataattgtgaagcatttcaggagcaggtttgggctgaaatgtgcagtatcaaagccgtcacagctattgaaaagcagagggaagagaacagcagcgaggcatcagacgtcgagactaagctgcgtgaatttgaagacctacagatgcaattaaacacaagtatcgatctgcgtaccaacgtgctgaacgacgcctatgaaaacctgacaagatataaggaagccgtcactcgcgctgtagagtctatcacctcactcgaggccattattatcccctatcgggtcgacgttggaaatcctgaagaatctcttgagatgcctctgagaaaacaggaggagctggagagcacagtggctcatattcaggatctcactgagaagctgggcatgatttcttccccggaggccaagctgcagctgcagtacaccctgcaggaattggtgtccaagaattccgctatgaaggaagcgtttaaagctcaggaaaccgaagccgaacggtacctggaaaactataaatgctacagaaagatggaggaagatatatatactaatttatctaaaatggagaccgtcctgggacagtcaatgtcatctctccctctttcctacagggaggccctcgagcgcctagagcagtcaaaagctctagtcagtaacttgatctcaacaaaagaagagctgatgaaactgcgccaaattctgagactgctgaggttgagatgtactgagaacgacgggatatgtctcctgaagattgtctccgccctctgggagaaatggctctcactgctggaagccgcaaaggaatgggagatgtggtgcgaggagctgaagcaggagtggaaatttgtgagcgaagaaattgagagagaggctatcattctggacaacctccaagaggaacttcccgaaattagtaagaccaaggaagccgcaactaccgaagagttaagcgagctccttgactgcctgtgtcagtatggcgagaatgtagaaaagcagcagctgcttctgacattgctgcttcaacgtatcaggagtattcagaatgtgcccgagtcaagtggtgccgttgagacagtccccgctttccaggagatcacaagcatgaaagaaagatgcaataagctgctgcagaaggtgcagaaaaataaagaactagtccagacggaaatccaggagagacactccttcacgaaggagatcatagctttgaagaacttcttccagcagacaaccacatcgtttcagaatatggcctttcaggaccaccccgaaaaatcagagcagttcgaggaactccaaagcatcctgaaaaaaggaaaacttaccttcgagaacatcatggagaaactccgcatcaaatattcagagatgtacactattgtccccgctgagattgagagtcaggttgaagaatgccgaaaagcactcgaggatatagacgagaaaatttcaaatgaagtgttgaaatccagcccctcctatgctatgcgcaggaaaatcgaggagattaataacgggttacacaacgtagagaaaatgttgcagcagaagtccaagaatatcgagaaggcccaagaaattcagaagaagatgtgggacgagctggacctctggcattccaaactgaatgaactggattctgaggtacaggacattgtagagcaggaccctggccaggcacaagagtggatggataatcttatgattccatttcagcagtatcagcaggttagccagcgagccgaatgtcgaacatcacagctaaacaaggccactgtgaagatggaagagtacagcgaccttttgaaatctaccgaggcctggattgaaaatacgtcacacttactggcaaatcctgccgattatgatagcctgcgcactttaagtcaccatgcctccaccgtccagatggcgctggaagactccgagcagaaacataaccttttgcactcaatttttatggatttggaagacctgagcattatcttcgagacagacgagttaacacagtcgatccaggagctctcaaaccaagttaccgccttgcaacagaaaattatggagtcacttcctcagattcagaggatggccgacgatgttgtggctattgagagcgaggtgaaaagtatggagaaaagagtatctaaaattaagacaattctgctctcgaaggagatatttgacttcagccccgaggaacatcttaaacacggagaggtcatactggaaaacatcagaccaatgaaaaagacaatcgccgagatcgtcagctaccaggtcgaattgcgcttgcctcaaacaggaatgaaacctttaccagtgtttcaacgcacaaatcagctcctgcaggacattaaactgctggagaatgtgacgcaggaacagaatgagctattgaaagtcgtaatcaagcagacaaatgaatgggacgaagagatcgaaaatctgaaacagattcttaataattattctgcccagttcagtctggaacacatgtcgcccgaccaggccgacaagctccctcaattacagggcgagattgaacggatggaaaaacaaatcctgtccttgaaccaacgcaaagaggacctacttgttgatctgaaggccacagtgctgaacttgcaccagcatctgaagcaagagcaggagggagtagaacgtgatcggctccctgccgttacaagcgaggagggcggtgtggccgagagagacgcatccgaacggaagctgaatcggagagggtccatgagttatctggccgctgtcgaagaggaggttgaagagtcatcggtgaagagtgatcatgacaaagatatggaagaagacagagcaagtagctcatccgggacaattgtccaagaggcttatggaaagatcagtacgtccgataattccatggcccagattctgacaccggatagcctcaacactgagcaggggccagaatgctcactgcgccctaatcagacagaagagggaacaacccctccaatcgaggcggatacattggatagcagtgacgcccaaggaggactagaaccacgggtggagaaaactcgtccagagcccaccgaggtcctgcatgcttgcaaaacccaggtcgctgagctggagttgtggcttcagcaggcaaacgtggctgtcgagccagagacactgaacgccgatatgcagcaagtcttagagcagcagctagttgggtgtcaagcaatgctcacagagatcgagcacaaggttgcgtttctccttgagacttgcaaggatcaaggcctgggcgataacggggctacacagcatgaagccgaagccctgtctctgaaactaaagactgttaagtgcaatctcgaaaaagtgcagatgatgctacaagaaaaacattcagaggatcagcatcctacgatactgaagaagtcctccgaacctgagcaccaggaggcgctgcagccagtgaacctctccgaactagaaagcattgtcacagagcgtcctcagttctctagacaaaaggattttcagcagcaacaagtcctcgaactgaagcccatggaacagaaagattttattaaatttattgagttcaacgccaaaaagatgtggcctcaatactgtcagcatgacaacgacactacccaggaatctagcgctcgatatcccaccactgaggaactcaaaacttatactactcaattggaggacttgaggcaggaggcttcgaaccttcagacacaggaaaatatgacagaagaagcatatattaatctggacaagaaactctttgagctattcctaacactctcacagtgcctgtcatctgtggaggaaatgcttgagatgccacgtttgtatagggaggatgggtccggccaacaggtacactatgagacattggccctggaactgaaaaaactctatcttgcgctctccgataagaagggcgatctgctcaaggccatgacctggcccggagagaatactaacttgttattggagtgcttcgacaatttacaggtctgtttggaacatacacaggcagcggctgtgtgtcgctctaaatcacttaaggcaggtctggactataacaggtcctatcagaaggctgatgcctatactgtggagttggagaacgctgagagccgtgtggccaagcttcgcgacgaaggcgagaggttgcacttaccttatgcgttgctgcaggaggtctataagctggaggacgttttggactctatgtggggcatgctgcgagcccgttacacggaactgtctagtccatttgtgacggaaagccagcaggacgctttgctgcagggaatggtagagcttgtgaagataggcaaagaaaagttagcccatggtcatctgaaacagactaagtcaaaagtggcactgcaggcccagattgaaaaccacaaagtgttcttccagaagctcgtcgccgatatgctcctcattcaggcatattcagctaagatcctgccttctctgctgcagaatcgggaaaccttttgggctgaacaggtaacagaagtgaagatactggaggaaaagtcacggcaatgcggtatgaagctgcaaagcctcctgcagaaatgggaggagttcgatgagaactacgcctctctggaaaaggacctggagattctgatctcaaccctaccgagcgtgtctctggtggaggagaccgaggaacggcttgtagagcggattagtttctatcagcagattaaaagaaacatcggtggaaagcatgccaggctgtaccagaccttgaacgaggggaagcaactggtcgcttctgtgagttgccccgagttggagggccaaatcgccaaactggaagaacaatggttgagcctgaacaagaaaatcgatcatgagctgcacagactacaggccctcttgaagcatctcttgagatcagccttcctgggcgtctacaatagggactctgatcaactcactaaatggctggagagttcacagcacaccttaaactactggaaggagcagtctctcaatgtttctcaggacctggacactattaggtcaaatatcaataacttctttgagtttagcaaagaagtcgacgaaaagtcatccctcaaaactgctgtgatctccattggcaatcagttgctccacctgaaggagaccgacaccgccaccttgagagcctctctagcccagttcgaacagaagtggacgatgctgatcacccaacttccagacatacaggagaagcttcaccaactccagatggagaagttaccttcacggaaggctattacagagatgatcagctggatgaacaacgtggagcatcagacctctgatgaagactcagtgcactccccctcatcagctagccaggtcaaacatctcctccagaagcacaaggaattccggatggagatggattataagcagtggatagtagacttcgtgaatcaatctctcttgcagctgtccacatgtgatgtcgaatccaagcgttacgaacgtacagagttcgctgagcacctgggcgaaatgaatcgccaatggcacagggttcatggcatgttgaaccgtaaaatccagcacctcgagcagctgctcgagtcaattacagaatctgaaaataagatacagatccttaataattggctggaggcacaggaagaacgcctgaagacgcttcaaaagcctgagagcgtgatcagcgtgcaaaagcttttgctcgactgtcaagacatcgagaatcagctcgcgataaaaagtaaggctctggacgaacttaaacaaagctaccttacccttgaaagcggcgcagtgcctctcctcgaggatactgctagcagaatcgacgaactgttccagaaacggtcatcagttctaactcaggtgaaccagttaaagacatccatgcagagcgtgctacaggagtggaaaatctacgatcagctctatgatgaagtgaatatgatgacaatcagattttggtactgtatggaacactccaagcccgtagtcctctccctcgagaccttacggtgccaggtggaaaatcttcagtcccttcaagacgaggcagagagcagcgaaggatcttgggagaaactgcaggaagtcattgggaagctcaagggtctttgcccgagtgtggcagaaatcatcgaagagaaatgtcagaacacacacaagcgctggacgcaggtcaaccaagctatcgccgaccagttgcaaaaagcccaaagcttgctgcagctctggaaggcttattctaatgctcatggagaagccgctgccagattgaaacaacaagaggcgaaattccagcagctcgctaacatttccatgtcgggaaacaatctggcggaaatactgcctcccgctcttcaggacataaaggagttgcagcacgatgtgcaaaagacaaaggaagctttccttcagaatagctcagtcctggatcgcctcccccagcctgccgaaagctcaacgcatatgctcctccccggaccgctacactcgctgcagcgcgcagcgtacctggagaaaatgttgctggtgaaggctaatgagttcgaaaaccatgtgctggccctgactgcacagtctcccgacatcgagcacctgaacgaggtttccctcaaattgccgttgtcggatgtcgcagtgaagacactgcagaacatgaaccgccagtggatccgggcaacagccaccgctctagaaagatgcagcgagctgcagggcattggtctgaatgagaagttcctgtattgttgtgaaaaatggatccagctgttagagaagatcgaggaagccctgaaggtcgacgtggcaaactccctgcctgagctcttggaacagcagaagacatataaaatgcttgaagcagaggtgagcatcaaccagactattgcagacagctatgtgactcagtcactccagttgctcgatacaacagaaattgagaatcggccagaattcatcactgagttcagtaagctcaccgacaggtggcaaaatgccgtacagggagtgcgacagcgcaaaggcgatgtggatgggctcaatgcccacgtagcccgatgtggcggagcatctctaaaaaagcaggatctgcgatattccctgcacactgcgtgtggcgcagctctgctttgtaggtcgagtcatggggcaaacaaagagattcatttccagagaaggcggacaacctgtgccctcacattggaggccggagagaagctgttgctgaccacggacctaaaaaccaaggaatctgtaggtcgcaggatttcccagctgcaagattcttggaaagacatggaaccccagttagctgaaatgatcaaacaatttcagagcactgtagagacctgggatcagtgcgagaagaagataaaggaactcaaaagcaggctgcaggtgttgaaggcccagtccgaggatcctctaccagaactgcatgaggatctgcacaatgagaaggagctcattaaggttgctataaggaaacaagagatcgaggatcgcctgaacacctgggtggtatttaacgagaagaacaaggagctgtgcgcttggttggtccagatggagaataaagtccttcagaccgcagacatttcgatcgaggaaatgattgagaaactccaaaagcgaactgtcggcagagaggaagtgccggagagatgggaatgcgaaacgattgtcagcggtcacggcaccgaggaaagctgctttttgtcaatacggaagttccaccaggggagaggcctccatatcctgacttgtcagcttattccgcaggattgcatggaggagatcaacctgtttagtgaaaacaagctgcaacttaagcagatgggcgaccaacttattaaggcttctaacaagtctcgggcagcagagattgatgacaaattaaacaagatcaacgataggtggcaacatctgtttgacgtgattggcagcagcatggccgaccaaaccaattcaagatggatgtttttccagtggcctcgagggatccagagaactgtgacctggccatgggatcatctgtgcagctgcgccagcacagggcatactggccctttccacagttctgtgctgcgctgctttgagcagcatatagaattcggaatctaccggaggacatacaaggtgaacaaggagcttggcggagacaagaacggtcagaggtgtcctattatctatcctcacgggctggtgcagtgtattagacttggagaacccctgatccttaaacgcgtgaagaaactgaaagaaactttcgcttttatccagcaattggataaaaacatgtcaaatctaagaacttggttggcccgtatcgaaagcgaattgagtaaacccgtagtttacgacgtctgtgacgatcaggaaattcagaaacggctggctgaacagcaggatctgcagagggacatcgaacaacattcagcaggcgtggaatctgtgttcaatatctgtgacgtcctgctgcatgattctgacgcttgcgccaatgagaccgagtgcgattcgatccagcagacaaccagaagcttggacaggcgctggcgaaacatatgtgctatgtccatggaaaggcgaatgaaaattgaggagacctggcgcctgtggcagaagttcctggatgactactcgagattcgaggattggctgaagagtgccgagagaacagcggcatgcccaaactcgtcggaagttttatacacatctgcgaaagaagaactgaaacgcttcgagagacagattcacgagcgcctgacacaactggagctgatcaataagcagtatagaaggctggcgcgtgagaataggactgacactgcttcccggctcaagcagatggtccatgagggcaatcagcgctgggataacctccagcgcagggtcaccgctgtgctccggcgtctgcgccacttcacaaatcagagagaggagtttgaaggaactcgagagtcgattctcgtctggttgacagaaatggacttacagctgactaatgtcgaacatttctcagagtcggatgccgacgacaagatgcggcaactgaacgggttccagcaagagataacactcaacaccaacaagatagatcagctgattgtgttcggagagcaactgattcagaagagcgagcccttggatgctgttctgatcgaagatgaactggaagaactgcaccggtactgccaggaaggcctagaagacgaaaaagaagccagtgaaaacgaaacagacatggaggatcccagggaaatccaaaccgacagttggagaaagaggggtgaaagcgaggagccttcctccccccagagcctctgccatctggttgcccctggacatgagcgtagcggctgcgagacccccgtgtcagtggattctatacccctggaatgggatcataccggagacgtcgggggaagctcatcacacgaagaagacgaagaaggcccatattatagtgcgctctccggaaagtctattagcgacggccattcctggcatgtccccgacagcccatcctgtccagaacaccactacaaacagatggagggtgaccgtaatgtgccacctgtaccaccggctagcagcaccccatacaagcccccttacgttagcctgaattttactggaagcacggcgtacgtttgcgcttttgaccggtgggagatgattcaggctcaggagctgcacaacaagctcaaaatcaaacagaacctccagcaactgaatagcgacatatctgcaattacgacttggctcaagaaaaccgaagccgagctggagatgctgaaaatggccaaaccaccgtctgacatacaggagattgagctgcgagtgaaaaggctgcaggagatcctcaaagcattcgacacctacaaagcgcttgtggtgtcagtgaacgtgagctccaaagagtttcttcagactgaatcgcctgagtctaccgagctacagagtcgcctgaggcagctgagcctgctctgggaagccgctcagggagctgtcgactcttggcgcggaggactgcgtcagagcctgatgcaatgccaggatttccaccagctgagccagaacctcctgctgtggttagcctccgcaaagaaccggagacaaaaggcgcacgtaacagatccaaaggctgatccgagggcccttctggaatgtagacgcgagctcatgcagttggagaaggagttggtcgagagacagccccaggtcgatatgctccaggaaattagcaattccctcctgattaaggggcacggagaagactgtatcgaagctgaggagaaagttcacgtcattgagaagaaactgaaacagctgagggagcaagtcagtcaggatctgatggctctgcagggtactcagaatcctgcctcccctttgccctctttcgacgaagtggactccggcgatcagcctcccgcaaccagcgttcccgctccacgggctaaattcctgtaccccgctgtgcagtctagcgagaattataggcggcgaggcggagaccgcgagcagggtccacgtcaacatacagcaaccgctctccttcctctgaaaggcggacctggatcgcccaccccagcagccgcacctcctgcggcagccgcacccggattacctgctgcactgctgcgcagaaggctccagcttcattcggggcaacagttgtgccctgtgctgttgccccacgctgaggtgcatcagtgggccactccacacatcgaaggaattgccggacatagtgcaacccccccagctta

SEQ ID NO: 242073 - DNA, 20658 bp, Artificial Sequence
  Description of Artificial Sequence: Synthetic coding sequence
atggccagtagcccagaactgcctaccgaggacgagcagggatcctggggaattgatgatctgcacatttcgctgcaggcagagcaggaggatacccagaagaaagccttcacttgttggataaactcacaacttgcccgacatacttccccaagtgtaatctctgatctgttcaccgacataaagaaggggcatgttctcctggacctgctcgaggtgctgtcggggcaacagctcccccgagacaaaggaagcaatacctttcagtgtcggatcaacatcgagcatgccctcacatttctgcggaaccgatcaatcaagttaatcaacatccatgtgaccgacatcatcgatggcaatccctccattattctcggcctgatttggacaataatcctccactttcacatagaaaagctcgcacagacattgtcctgtaactataatcagccatctttggacgatgtgtccgtcgtcgacagttctccagcctcctcccccccagccaagaaatgttcaaaggtccaggcaaggtggcagatgagcgccagaaaggcccttctgctatgggcccaagagcagtgtgccacatacgagagcgttaacgtaactgacttcaaaagctcatggcgcaatgggatggcattcctggccatcatacatgccttgcggccagaccttattgacatgaaatctgttaagcataggagcaacaaggataacttgcgggaagcgttcagaattgccgagcaggagctcaagatcccacgcctcctggaacccgaggatgtcgatgtcgtggacccagatgaaaagagcattatgacgtacgtcgcccagtttttgcagtactccaaggacgcacccggtacaggcgaggaagcacagggcaaggtcaaggatgctatgggatggcttaccttacagaaggaaaagttgcagaaattgctcaaggactcggaaaacgacacatattttaagaaatacaatagcctgctgtcctttatggaatcttttaatgaggaaaaaaaatcattcctggatgtgctcagtatcaaacgcgatcttgacgagctggacaaggatcacttgcagttgcgggaggcatgggacggtctggatcaccaaattaacgcatggaaaattaagttgaattatgccctccccccacccctgcaccagacagaagcgtggctgcaagaggttgaggagctaatggatgaagatctatccgcatcccaggaccactcccaagccgtgacactcatccaagagaagatgactcttttcaagagcctgatggaccgattcgagcaccattcaaacattctattgacttttgaaaacaaagacgagaatcatctgcctctcgttccacctaacaaactggaggagatgaaacggagaattaataacattctcgagaagaaattcattctcctgctggagtttcattactataagtgtctagtgctgggtctcgtggacgaggtaaagagtaaactcgacatatggaacatcaaatatggaagtagggaatccgtggagctgttactggaggactggcacaaatttatcgaggagaaagagtttctggctcgcttagacacctcctttcagaagtgcggggaaatttataagaacttggcaggggaatgccagaatattaacaaacagtatatgatggttaagtcggatgtgtgcatgtataggaagaacatatacaacgtcaagagcactctgcagaaggtgctggcctgttgggccacgtacgtcgaaaatctgagacttctacgtgcgtgtttcgaagagactaagaaagaagaaatcaaggaggtgccatttgagactctggctcagtggaatctggagcacgccacacttaatgaggcagggaattttttagtggaggtgagtaatgacgtggtggggtcgtcgattagcaaagagttacgcaggctgaataagagatggagaaagctcgtgtccaaaacccaattggagatgaaccttccactgatgataaaaaagcaagaccagccaacattcgataactcagggaacattttgtcaaaagaagaaaaagccaccgtggagttcagcacagacatgtctgtggagctgcccgagaactacaaccagaacattaaagcaggtgaaaaacacgaaaaggagaacgaggaattcaccggacagctgaaggtggctaaggatgttgagaagcttataggccaggtcgagatttgggaagcggaggctaagtctgtgttggatcaggacgatgtcgacacctccatggaggagtcactgaaacatctcatcgcaaagggtagtatgtttgacgagttgatggccagatctgaggacatgttacagatggacatccagaatatctcctcccaagaatctttccagcacgtcttgactactggtctgcaagcgaaaatacaggaagctaaggagaaggtccaaattaatgtggtgaaattgatcgcggctttaaagaaccttaccgatgtctcacctgatctggacattcgactcaaaatggaggagagtcagaaggagttggagagctacatgatgagagcgcagcagttgctgggccaacgcgagagccccggagagctgattagcaaacacaaggaagcattgataattagtaacacaaagtctcttgcgaaatatcttaaggcagtcgaagaactgaaaaacaatgtcacagaggacataaagatgagcttagaagaaaagtccagggatgtatgcgcgaaatgggaatcattacatcacgagttgtctctctacgttcagcagctgaaaatagacatagaaaagggtaaactgtctgacaacatccttaagctggaaaagcaaattaataaagaaaagaagctaatccgcaggggaagaactaaggggttaataaaagaacacgaggcgtgcttcagtgaggaaggctgcttgtatcagttaaatcatcatatggaggtgctgcgagaactatgcgaggagctcccttcacagaaaagccaacaagaggtgaaaaggctcctgaaggattacgagcaaaaaatcgagcgtctgttgaagtgtgccagcgagatccacatgacactgcagcctactgccggtggcaccagcaagaatgagggaactatcacgaccagtgaaaaccgaggtggtgacccccattcagaagcccctttcgccaaaagcgataaccagccaagcaccgaaaaagcgatggagccaaccatgaaatttagtcttgcaagtgttcttagaccactgcaagaagagtccattatggagaaggattacagcgcatcgataaatagcctcctggaaagatacgatacctacagagatattcttgagcaccaccttcagaataacaaatttagaattacatctgatttttcctccgaagaagatcggtcaagctcttgtctgcaagctaaactgaccgatcttcaagtcatcaagaatgagacggatgccaggtggaaggaattcgagattataagcttaaagctggaaaaccacgttaacgatattaaaaaaccattcgttatcaaggagcgggacaccttaaaggaaagggaaagagaactccagatgaccctgaatactagaatggagagcctggagaccgcattgaggctcgttcttccagtagagaaggccagtttgctgctctgcggctccgatctgcccctccataaaatggctattcaggggttccacctaatcgatgccgatcggatctaccagcacctgcgcaatattcaggatagcatagcaaaacagatcgagatttgcaaccgccttgaggagccaggcaatttcgtgttgaaagagctgcatccgttcgacctgcatgccatgcagaacataatcctgaaatacaaaactcagttcgagggcatgaatcatagggtgcaaagatcagaagacactctgaaagctttggaagactttttggccagtcttagaactgcaaagctgtcagccgagccagtgacggatttgtctgctagcgacacccaggttgcgcaggagaatacacttaccgtgaagaacaaggaaggtgagatccatctgatgaaggataaagcgaagcacctggacaagtgcctgaagatgctggacatgtccttcaaagatgccgagagaggcgatgacactagttgtgagaacctgcttgacgccttcagcattaagctgtcagaaacacatggatatggggtgcaagaagagtttactgaggaaaacaaactcttagaggcctgcattttcaaaaataacgaactgctcaagaatatccaagacgtgcagtcacaaatcagcaaaattggacttaaggatccaaccgtgcccgctgtgaaacaccgcaaaaagtcactgattagattagataaggtcttggatgagtatgaggaggagaaacgacatcttcaggaaatggctaattccctcccccacttcaaggacggcagagagaaaactgttaaccagcaatgccaaaatacagtggtgctgtgggagaataccaaggccctggtgaccgaatgcttagagcagtgtgggcgagtgctggaactactcaagcagtatcagaactttaagagtattctaactactctgattcagaaagaggagtctgtaatctccctgcaagcaagttacatgggaaaagaaaatctaaagaagagaattgctgagattgaaatcgttaaggaggagtttaacgaacatttagaggtcgtggacaagattaatcaggtatgtaagaacctccagttctacttaaataaaatgaagacctttgaggaaccaccattcgaaaaggaggcaaacattatcgttgatcgatggctggatatcaacgaaaagacggaggactactatgagaatctcggacgggcactggcgttatgggataaactgttcaaccttaaaaacgtgatcgacgaatggaccgagaaagctttgcaaaaaatggaactgcatcagctgaccgaggaagatcgggaaaggctaaaggaagaattgcaagtgcatgaacaaaagacttctgagtttagccgaagggttgcagagattcagttcctgctgcagagttccgaaatccctttggagctgcaggttatggagagctccattctgaataaaatggagcacgttcagaagtgcttaactggagagtccaactgccatgccttgagcggtagcacagcagagttacgggaggatctggatcaagccaagactcagatcggaatgactgaatctctcttgaaggctttatcgccctctgacagtttagaaatctttaccaaactcgaagaaatacaacagcagattctccaacagaagcattctatgatcctgctggagaaccagattgggtgtctcactcctgaattatcagagttgaagaaacagtatgaatctgtgagcgatctgttcaatactaaaaaatccgtgctgcaggaccacttctccaaactactgaatgatcaatgcaagaatttcaacgactggtttagtaacatcaaagtcaacctcaaggaatgtttcgagtcatccgaaacaaaaaagtcggtggaacagaagttacagaaactctctgacttcctgactcttgaaggtaggaatagcaaaatcaaacaggtggattctgtgcttaagcatgtaaaaaagcacctccccaaggcccacgtaaaagaactcatctcatggctcgttggccaggagttcgagctcgagaagatggagtccatttgccaagctcgcgctaaagagctggaggacagcctgcaacagctcctgcgcttgcaggacgatcaccgaaacctgagaaaatggctgacgaaccaggaagaaaagtggaagggaatggaggagccaggagaaaagaccgagctgttctgccaagctttggctagaaagagggagcagtttgagagcgtggcacagctcaataacagccttaaggaatatggctttactgaggaagaagagatcattatggaagccacctgcctcatggaccggtaccagactctcctgaggcagctctccgagatcgaggaggaagataagctcttgcctacagaagatcagtcattcaatgaccttgcgcatgacgttattcactggataaaggaaattaaagaaagtttaatggtgctgaactcctcggaaggcaagatgccacttgaggagcggattcagaaaatcaaagagataattctgcttaagcccgaaggagatgcacgcatagagaccatcatgaaacaagccgaatcttccgaggcacccctggtccagaagacccttactgatatatcaaatcagtgggataatactctgcatcttgcgagcacttacctcagtcaccaggagaaattgctactggaaggcgaaaagtatttgcagtccaaagaagacttgcggctgatgctgattgagttgaaaaagaagcaggaggccggattcgctttgcagcacgggttacaggaaaaaaaggctcagttaaaaatttacaaaaaatttctgaaaaaggctcaggatctcacttccctcttgaaggagcttaagtctcagggtaattatctcctcgaatgtaccaagaacccatccttctctgaggaaccgtggctagagatcaaacacctccatgaatccctgctgcaacaactgcaggactccgtgcagaacctagatggacatgtgcgggagcacgactcttaccaggtctgtgtgacagacctgaacacgaccctggataacttttcaaaagagtttgtctcattcagcgataaacccgtcgaccagattgccgttgaagagaagctgcagaagctccaggagctcgaaaacaggctgagccttcaagacggcaccctcaagaagattttggccttggccaaatccgttaaacagaatacaagtagtgtgggacagaaaattattaaggacgatataaagtcactccagtgcaaacagaaggacctggaaaataggttagcctccgccaaacaggagatggagtgttgcctcaatagcattctgaagagcaagcgcagcacggaaaaaaaggggaaatttacgctccctgggagggaaaagcaagctacatcagacgtgcaagaaagcactcaggagtccgctgccgtcgagaagctggaggaggactgggagatcaacaaagacagcgcagtcgaaatggccatgagcaagcagctgtcacttaacgcacaagaaagcatgaagaacactgaagacgaacggaaagtgaacgagctacagaatcagccactagagctcgacacaatgcttcggaacgaacaacttgaagaaattgaaaaactgtacacacaactcgaagctaagaaagcagccataaaaccgttggagcagacagagtgtctgaacaagacggagactggggctctggtactgcataacatcgggtactcagcacaacatctagataaccttttgcaagccctcatcacactgaaaaagaataaggagagccaatactgcgtgctacgcgattttcaggaatatctcgcagctgtggaatcaagtatgaaagcactgctcactgacaaggagtctctaaaggtcggcccattagactccgttacatacttagataagattaagaagttcattgcttctattgagaaggagaaggattctttggggaatctgaaaattaaatgggagaacctcagtaatcatgtgacagacatggacaagaaactgttggagagccagatcaagcagttagagcatggatgggaacaggtcgagcaacagatccagaaaaagtactcacaacaggtggttgagtatgatgagtttacaacactcatgaataaggtgcaggatactgagatttctctgcagcagcaacagcaacatctgcagctgcgtcttaaatctcccgaggagcgggctgggaatcagagcatgatcgcccttaccacggatctccaggccacgaaacacggatttagtgtgcttaaaggccaggcagagcttcaaatgaaaaggatttggggtgaaaaagaaaaaaaaaacctcgaagacggcattaacaatctcaagaagcagtgggaaaccctggagccccttcacctggaggccgagaatcaaatcaagaagtgtgacattcggaataaaatgaaagaaaccatcctttgggccaagaacctgttgggggagttaaatcctagcatcccgctactgcctgacgacatcctctcccagatcagaaaatgtaaggtgacacatgacggaattctagccaggcagcaatctgttgagagcctggccgaggaagtgaaagacaaagtgccctctctgacaacgtatgagggttctgacctaaacaacaccttggaagaccttaggaatcagtatcagatgcttgttctcaagtccacacaacgctctcaacaactagagttcaaacttgaggaacggtccaacttctttgcaatcatccggaaattccagctgatggtgcaggagagcgagactctcatcatacctagggtcgaaaccgccgctactgaggcagaactcaagcaccatcatgtaaccctcgaggcgtcccagaaagaacttcaagaaatcgactctgggattagcacccatctgcaggagctgacgaatatctacgaggagttaaatgttttcgagcggctcttcctggaagaccagttgaagaatctgaaaattcggactaacaggattcagcgtttcattcagaacacgtgtaatgaagtggagcacaaaataaagttctgtaggcagttccacgaaaagacctcggccctgcaggaagaagccgacagtatacagagaaacgagttattgctgaaccaagaggtgaacaagggtgtgaaagaggagatctataacctgaaggatcggttgacagctatcaaatgctgcatcctacaggtacttaaattaaaaaaggtgtttgattacatcggtctgaattgggatttctcccaactggatcagctccagacacaagtgttcgaaaaagaaaaagagttagaagagaaaattaagcagctggatactttcgaggaagaacacggcaagtatcaggccctgctctctaaaatgcgagccatcgaccttcagatcaagaagatgaccgaagtggtgcttaaggccccagacagctcccccgagagccgcagacttaatgcacagattctgtctcaacggattgaaaaggccaagtgcctatgtgatgagatcattaaaaagctgaacgagaataaaaccttcgatgattcctttaaagagaaggaaatcctgcaaattaaactgaatgcagaggaaaacgacaaactgtacaaggttttgcagaatatggtacttgaactgtcacccaaggagctcgatgaaaagaattgccaagacaagctcgagacgtcattacatgtgctcaaccagattaagtctcagttacaacaaccgctcttgataaacttggagatcaaacatatccaaaacgagaaagacaattgtgaagctttccaagagcaggtatgggctgagatgtgcagcatcaaggcagtgactgctatcgagaagcagcgtgaggaaaacagctcagaggcttcggacgttgaaactaagctgagggagttcgaggatctccagatgcaacttaatacgagcatcgacctgcgtaccaatgtgctcaacgatgcttatgagaatctcaccagatacaaagaagctgtgacccgagcggtcgagagcattacgagtctggaggccataatcataccctacagggtcgatgtagggaatccagaggagtcactagagatgcctctgagaaaacaggaagagttagagtccacagtagcccacatacaggacctcaccgaaaaactgggtatgatttcatcaccagaagctaaattacagcttcagtatactctgcaggagctggtgtcaaagaatagcgctatgaaggaggcctttaaagcccaggaaacggaggccgaaaggtatttggagaactacaagtgttacaggaagatggaagaagacatctatactaacttgtccaaaatggaaactgtgttgggtcagtctatgtcgtccctgcccctttcttatcgagaggccctggagagactggaacagtcaaaggccctggtgtctaatcttatttctacaaaggaagaactaatgaagttacgacagattctcagactactgaggttgcggtgtaccgagaacgatggcatctgcctcctcaaaattgtctccgcgctttgggaaaagtggctgagcctactggaagccgctaaagaatgggagatgtggtgtgaggagcttaaacaggagtggaaatttgtgagcgaggaaattgaaagagaggcgattattcttgataacctacaggaagagctcccagagattagcaagaccaaagaggctgccactaccgaagagttgtcggaactcctggactgcctttgtcagtacggggagaatgtggagaaacagcagctgctcctgactcttctgctccagagaattcgtagcattcagaatgtgcccgaaagtagcggcgcagtggagaccgtgcccgctttccaggaaattacgagcatgaaggagagatgcaacaaactgctgcagaaggtgcagaagaataaagagctggtccagactgagattcaagagaggcattctttcacaaaggagattatcgccctgaaaaatttcttccaacagacgacaacgtcattccagaatatggcattccaggatcatccagaaaaaagtgagcagttcgaggagctgcagtcaattctgaagaaaggaaagctgacgtttgaaaacattatggaaaaactgaggattaagtacagcgagatgtacaccatcgttccggctgagatcgaatcccaggtagaggaatgtaggaaagcactagaagatatcgatgagaagatctcaaacgaggtgctcaagagctccccaagttacgctatgagacggaagatcgaagagattaacaacggactgcacaacgttgagaagatgctgcaacagaaatccaagaatatcgagaaggcccaggagattcagaagaagatgtgggatgaactggatctctggcactctaagctaaatgagttggattccgaggtacaggacatcgtcgagcaggaccctgggcaggcccaagagtggatggacaacttaatgatcccttttcaacagtaccaacaagtgagccagagggctgagtgtagaactagccagctaaacaaagcaaccgtgaaaatggaggaatactcggacctgctgaaaagtacagaggcctggatagaaaacacgagccacctattggccaaccccgctgactacgactccctgcggacgctctctcaccatgcaagcaccgttcagatggccttggaagacagtgaacagaagcacaacctactgcattccatatttatggacttggaagatctgagtatcattttcgagacagacgagttgacccagtccatccaagagctgtccaatcaagtgaccgctctccaacagaaaatcatggaatcgttacctcagattcagcggatggctgacgatgtggtcgcaattgaatcagaggtcaagtctatggaaaagagagtgagcaagattaaaactatacttctgagcaaagagatatttgacttcagcccagaagagcacttgaagcatggagaagtgattctggagaacatcagacctatgaagaaaacaatcgcagaaattgtgtcttaccaggttgaactgagactcccacagacgggcatgaagccattgccagtgttccagcgaaccaatcagcttttgcaagacatcaaactgttggaaaatgtcacccaggagcaaaacgagcttttgaaggtggtgatcaagcagaccaacgaatgggatgaagagattgaaaatttaaaacagatcttgaataactactctgcccagttctcattagaacacatgagtccagatcaggccgataaacttccccaattgcaaggcgaaattgagcggatggagaagcagattctgagtcttaaccaaaggaaggaagacctgctggtggatctcaaagccaccgtactgaacctacaccaacatctcaagcaggaacaagaaggggttgaacgcgacaggctcccagccgtgacatccgaggaaggaggcgtagcagagagggacgcatccgaacggaagctcaaccgaaggggttccatgtcttacctggcagcagtcgaggaagaggtcgaggagagtagtgtgaaaagcgataacggcgacgagaaagctgagccctcgccccagagctggtctagtctctggaaacacgacaaagatatggaggaagatagagcgtcatcatctagtggaactatcgtccaggaagcatatggcaagatctctacaagcgataactcgatggcccagatccttacccctgatagcctgaataccgaacaggggccagagtgcagtctgcgaccaaatcagaccgaggagggtaccacacccccaatcgaagccgatacccttgatagctccgatgctcaagggggactcgaaccaagagtcgaaaagaccaggcctgaaccgaccgaggtccttcacgcctgcaaaactcaggttgctgagctagaattatggctccagcaagccaatgtggctgtggaaccagagacactgaatgccgacatgcagcaggtgctagagcagcaactggtgggttgtcaggctatgctgacagaaattgagcacaaggttgcctttctacttgaaacatgtaaggaccagggacttggcgacaacggcgctacacaacacgaggccgaggctctctctctcaaactaaaaactgtcaagtgtaatcttgagaaggtgcagatgatgttacaagaaaaacattcagaggatcagcacccaaccattttaaagaagtcctccgaacccgaacaccaggaagcactgcagccagtgaacctatccgagcttgaatccattgtaaccgagcggcctcagttcagtcgtcaaaaagacttccaacagcagcaggtcctcgagttgaaacctatggagcaaaaagatttcatcaaattcatagagtttaacgcgaaaaaaatgtggcctcaatattgccaacacgacaacgatactacacaagagtcatctgcaagtaatcaggccagtagtccagagaatgacgtgccggacagtatcttgagcccacagggccagaacggagataagtggcagtatcttcatcatgagcttagctccaaaattaagcttcctctacctcagctggtcgaaccacaggtaagcaccaatatgggcatattgccctctgtcacaatgtataacttccgatatcccactactgaggaacttaagacttacaccacccagcttgaagacctgcggcaggaggcctcaaacctgcagacacaggaaaacatgacagaggaggcctatattaacctggataagaaactattcgaactctttttgacactgagccagtgtcttagctcggtggaagagatgctcgagatgccacgactgtacagggaggacggcagcggacagcaagtgcactacgaaaccctggctctcgagctgaaaaaactgtacctcgcgctctctgacaaaaaaggcgatcttctcaaggctatgacttggccaggtgagaacacgaatcttctgcttgagtgttttgacaacctgcaggtgtgtctggagcacacccaggccgctgcagtatgtaggagcaagtccctgaaggccggactcgactacaaccgttcttaccagaatgaaattaaacgactgtaccaccagctaataaagtccaaaacatcactccagcagtctttgaacgaaatttcagggcagagtgtcgcagaacagctccagaaggcagatgcctacacagtggaacttgagaacgccgagtctagggtggctaagctgagagacgaaggcgagaggctgcacttaccgtacgcactgctgcaggaggtgtataagctggaggacgtactggattccatgtggggaatgctcagagccaggtatactgagctgagttctccttttgttactgaatcccagcaggacgcactgttacagggcatggtcgagttagtgaagataggcaaggaaaagctcgcccatggtcatcttaagcaaacaaaatccaaggtcgctctgcaggcccagattgagaaccataaggtattttttcagaagttagttgcagacatgctgctgatccaagcctactcagcgaagatcctcccctctctacttcaaaaccgggagactttctgggcagagcaagtaacagaagtcaaaatcttggaagagaaatcaaggcaatgtgggatgaagctgcagagcttactgcagaaatgggaagaatttgacgaaaattacgcgagccttgaaaaagatctggaaattctgatcagcacattaccctctgtcagtctggttgaagagaccgaagagagactggtagaaagaattagcttctaccagcagatcaagcgtaatattggcggaaaacacgcaaggttgtatcagacacttaacgagggcaaacagctggtggcctctgtgtcttgcccggagttggaaggacagatagccaagttagaagagcagtggctgtcactgaacaagaagatcgaccacgaactgcatcgtcttcaggctctcctgaagcacttgctttcctacaaccgtgactcagatcagttgaccaagtggctggagagttcccagcacaccctgaactactggaaagaacagtctctgaatgtaagccaggacctggacaccattcgcagcaatattaacaacttttttgagtttagcaaggaggtagacgagaaaagttctttgaaaactgccgtgatatccattgggaaccagctgcttcatcttaaggagacggacaccgcgacactgcgtgcctcgctagcccagtttgagcaaaagtggactatgctcattacacagctccccgatattcaggaaaagttgcatcagctgcagatggaaaaactgccctcccgcaaggcaattacagaaatgatatcatggatgaataacgttgagcaccagacctccgacgaagatagtgttcatagtccatcgagcgcctctcaggtgaagcatctactgcaaaagcataaagaatttagaatggagatggattataagcaatggatcgtggactttgttaatcaaagcttgttacagttaagcacgtgcgatgtggagtccaagcggtatgaacggaccgagtttgcagagcatctgggcgagatgaacaggcagtggcatcgcgtgcacggtatgttaaaccggaagatccaacatttagaacagctgctggagagtatcactgagagcgaaaataagattcagatccttaacaactggttagaggcccaagaagaacggctcaagactttgcagaaacccgagtcggttattagcgtgcagaagctgctgttggactgccaggacatagagaatcagcttgccataaagtcaaaggcattagatgaattaaaacagtcatacctgaccctggaatcaggtgccgtgcccctcctcgaagacaccgcctcaagaatcgacgagttatttcaaaaaaggagcagcgtcctgacccaggtcaaccagctgaagacttcaatgcagtccgtgctccaggagtggaaaatttacgaccagttgtacgatgaagttaatatgatgacaatacgattctggtactgcatggagcacagcaaacccgtggtgttgtccctggagacactcagatgtcaggtggagaacctccagtccctgcaggatgaagccgagtctagcgaaggatcctgggaaaaactgcaagaggtgatcggtaagttgaagggattgtgtccatctgttgccgagattattgaggagaaatgtcagaatactcataaacggtggacccaagtgaatcaggcaattgcagatcaactccagaaagctcagagcttactccaactatggaaggcttactctaatgcccatggcgaggctgccgctcgacttaagcaacaagaagctaagtttcagcaactggctaacatctctatgtctggtaacaacctcgccgagattctgccacctgccctacaggacatcaaggaactacaacacgatgttcagaaaaccaaggaggctttcttgcagaacagttcagtactcgacagattgccacagcccgcagagtcatctacgcatatgctgttgccaggacctctccactctctgcagagggcggcttacctcgagaagatgctgctggttaaggcaaatgagttcgaattcgtgctgtcacagtttaaagacttcggtgtaaggctagagtcccttaaggggctcatcatgcacgaggaggaaaatctggacaggctgcatcagcaggagaaggaaaaccctgactctttcctgaaccatgtcctggccttgaccgcacagtcaccagacattgagcatttaaatgaggttagcctgaagttgcctctgtccgacgtggccgtgaaaacactgcagaacatgaacagacaatggatccgggcaacagctaccgctttggagcgttgcagcgaactccaggggattggacttaatgagaaattcctctactgctgcgaaaagtggattcagctccttgagaaaattgaggaggctttaaaagtggatgtggccaactccctgccggaactgctagagcaacagaagacttacaaaatgcttgaagcagaggtatccatcaatcagactattgccgactcttatgttacacagagccttcagctgctagataccacagaaattgaaaaccgccctgaatttataacggagttctccaagttgacggataggtggcaaaatgcagttcagggagttaggcagaggaagggggatgttgacggcctcgttcgtcagtggcaggatttcaccacctctgttgagaatctgttccgtttcttgaccgatacctcacacctgctgtccgctgtcaagggccaggagcgatttagtctttaccaaaccaggagccttatccatgagctaaagaacaaagagatccacttccagcgcagaaggaccacctgcgcactcaccctggaagcgggtgaaaagctcctcctgactacagacctgaaaaccaaggagagcgtgggccgaagaatctcacagctgcaagattcctggaaggacatggagccacagctcgcagagatgatcaaacagttccaaagcaccgtggaaacctgggatcagtgcgagaagaagattaaagagttgaaatcacgcttgcaagtgctgaaggcccaatcagaagaccctcttcccgagcttcatgaggacctccataatgagaaggagctaatcaaggagctggaacaaagcctggccagctggacacagaacctgaaggagctccagacgatgaaggccgatctgactcggcacgtcctggttgaggatgttatggtgctgaaggagcagatcgagcatttgcaccggcagtgggaagacctctgtcttagagtagcgatccgaaaacaggagatcgaagatcgccttaatacatgggtggtttttaatgagaaaaataaggaactgtgcgcctggttagtacagatggagaataaggtcttacagacagccgatatcagcatcgaagagatgattgagaagctgcagaaggactgtatggaggaaattaatctgttttccgaaaacaaattgcaactgaaacaaatgggggatcagctgataaaggcgagcaacaagtctcgagccgcagagattgatgataagctgaacaaaattaacgatcgctggcagcacctgttcgacgtcattggtagcagagtgaaaaagcttaaagagacgtttgcgttcatccagcagcttgacaaaaacatgtcgaacttacgcacgtggctcgcccgtatagagagcgaactctccaaacccgtggtgtacgacgtgtgcgatgatcaggagatccagaagaggttggccgaacagcaagacctgcagcgtgacatcgaacagcactcagccggagtggagtccgttttcaatatctgcgatgtcctgctccacgacagcgacgcttgcgccaacgaaactgagtgtgactctatccagcagaccaccagatccctggaccgcagatggagaaatatctgtgccatgagcatggagcgaagaatgaagatagaagaaacatggcgtctctggcagaagtttctggacgattactctagatttgaggattggctgaagagtgctgaaagaacagcagcctgtcccaattctagtgaggtgctttacacctccgccaaggaggagctcaaacggttcgaagctttccagcgacaaatccatgaacggctgactcaattagagctgattaacaaacaatacagacggctggcacgtgaaaaccggaccgacactgcctccagattgaagcagatggtccatgaggggaatcagcgctgggacaatctccagagacgtgtgaccgcggttttacggaggctacgacacttcacaaaccagcgggaagagtttgaaggcaccagagagagcatattggtatggcttacagagatggatttgcagttgactaacgtggagcatttctctgagtcggacgccgatgataagatgcggcagcttaatggatttcaacaggagataactcttaatacaaataagattgatcagcttatcgtttttggcgagcagctaatacagaagagcgagcctctggatgccgtcctgatcgaggacgaactcgaagaactgcaccggtattgtcaggaggtgtttggccgtgtttctaggtttcatcgtcgtttgacttcctgcaccccaggcctggaggacgagaaggaagcttctgaaaacgaaaccgacatggaggaccctagagagatacaaacagatagctggcggaagcggggtgaatctgaagagccgagcagccctcaatccctgtgtcatttggtggccccaggccacgagagatccggctgcgaaacacccgtgtccgtggatagcatacctctcgaatgggatcacacgggagacgttggcggttctagtagccacgaggaggacgaggaaggaccctattacagtgccctaagcggaaaatctatctcagacggacattcctggcatgtcccagattcacccagctgtcctgagcatcactacaagcagatggaaggtgacaggaacgtcccaccagtgccgcctgctagttccacaccctataaacccccttatggcaagttgctcctcccacctggcacagacggtggtaaagaggggccaagagttctcaacgggaacccacaacaggaggacggagggcttgctggcattacggaacagcagtcgggcgctttcgatagatgggagatgattcaggcccaggaactccataataaactgaaaattaagcagaaccttcagcagctgaattcagacatctcagcaattacaacatggttgaaaaaaaccgaagctgagctggagatgcttaagatggccaaacccccttctgacatccaggaaatcgaactaagggtgaaacgccttcaggagatccttaaggccttcgacacctataaagcactggtagtgagcgtgaacgtgtcctcaaaagagttcttgcagactgagagccccgagtcaaccgagctgcagagcaggttgcgccagttgtcactgttatgggaagctgctcagggggctgtagattcatggcggggaggattgaggcagagcctgatgcagtgtcaggacttccaccaattatctcaaaacttgctgctttggttagcctccgcaaaaaatcgcaggcagaaggcacatgtgaccgatccaaaggctgatcctagggcactgctggagtgccgcagagagttaatgcaactggagaaggaactggttgagaggcagccgcaagtagatatgctgcaggaaatatcaaactccctactgataaagggacacggcgaggattgcatcgaggccgaagaaaaggtgcacgtgatcgagaaaaaactcaaacaactgagagaacaggttagccaggatctaatggccttacaagggacacagaatcccgcttcacctctgccttctttcgacgaggtggatagcggcgatcagcctcccgctacttcagtccccgctccacgcgcaaagcagtttagggccgtgcggactaccgaaggggaagaggagacggagagtcgcgtgccaggcagcacccgtccccagcgctccttcttatcacgggtggttagggcagccctgccccttcagctgctgctgttgctcctcttgcttctcgcttgcctgctgccaagttccgaggaggactactcttgcacgcaagcaaataatttcgctagaagcttctatcctatgctgcggtatactaacggcccaccgccaacttag

SEQ ID NO: 242074 - DNA, 804 bp, Artificial Sequence
  Description of Artificial Sequence: Synthetic coding sequence
atggcctcatcgcctgaattacccaccgaggatgaacagggttcgtgggggattgatgacctccatatctctttgcaggctgaacaggaagatacacagaagaaggcctttacgtgctggataaattctcagttagcaagacacacatcgcccagtgtcatctcagacttgtttaccgacattaagaagggccatgtgctactcgacctccttgaggtcctatctggacagcagctgccccgagataaggggtcaaacacatttcagtgcaggatcaatatcgaacatgcactaacatttctgcgcaacagatccatcaagttgatcaacatccatgtgactgacatcattgatggaaacccaagcatcatcctgggtttgatctggactataatactccacttccatattgagaagctcgcccagactttgtcttgcaactataatcaaccttctctggatgatgtgtccgttgtcgatagttcgccagccagctcccctcctgccaagaaatgttctaaggtccaggccaggtggcaaatgtcagccaggaaggctctgctactctgggcccaggagcagtgcgcaacttatgaatctgtcaacgttactgatttcaagagcagttggaggaatggcatggcatttttagccattatacatgcactcagacccgatctaatcgatatgaagtcagtcaaacaccggtctaacaaggataacttacgcgaggccttccggatagccgagcaagagttaaagattcctagactgttagaacccgaagcctacaagaatttttag

SEQ ID NO: 242075 - DNA, 9813 bp, Artificial Sequence
  Description of Artificial Sequence: Synthetic coding sequence
atggagaagctgcgaatcaaatacagcgaaatgtatacaatcgtgcctgccgagattgaaagccaggtggaggagtgccgaaaggcgctggaggacatagacgaaaaaattagtaatgaagtcctgaaatcgagcccaagctacgccatgagaagaaaaattgaagagataaataatggcctgcacaatgtggaaaagatgctgcagcagaagtccaagaatatcgaaaaagcccaggagattcagaaaaagatgtgggacgagctcgatctgtggcacagcaaacttaacgaattggatagcgaggtccaggatatagttgaacaagatcctggtcaggctcaggaatggatggataacctcatgatcccgttccaacagtaccagcaggtgtctcaaagagctgagtgtaggacatcgcagctcaacaaggcaacagtcaaaatggaagagtacagcgatctgctgaagtcaactgaggcttggatcgagaacacgtcccacctgctggccaaccctgctgactacgattcactgaggaccctgtctcatcacgcgtccactgtacaagacagcaaatgttttagaagcggcccacgacccaacatctacgttagctactatgtcaccgttatacaaatggccttggaggactccgaacagaagcacaatcttctccatagtattttcatggatctcgaagacttatccattattttcgaaaccgacgagctcacacaatcaattcaagagctgagcaatcaggtgacagctctccagcaaaagataatggaatccctgccacagatccagagaatggcggacgatgtggtcgcaatcgaaagcgaggtgaagagcatggagaaaagagtgagcaagataaagaccattttgctttccaaagagattttcgacttctcacccgaggagcacttaaagcatggcgaagtgatcttagaaaacatccggccaatgaagaagacaatagcggaaatcgtatcctatcaggtggagctccggcttcctcagaccggtatgaagcccctccccgtctttcaacggacaaatcagcttttacaagatatcaagttgctcgaaaacgttacccaggaacaaaacgaactgctgaaagtggtcatcaagcagaccaatgaatgggatgaagaaattgaaaacttaaagcagatcctaaacaactactccgcacagttttccctcgaacatatgtcacccgaccaggcggacaaactgccacagctccagggcgagatcgagcggatggaaaagcaaatactgtccctcaatcaacgcaaggaagatctgcttgtggacctgaaagctaccgtactgaatctacaccagcatctcaaacaggagcaggaaggcgtggaacgggatcggctgcccgctgtcacgtccgaagaaggcggagtcgctgagcgggatgcatccgaaagaaagctgaacagaaggggaagcatgagctacctggccgcagtagaggaggaggtggaagagagtagcgttaagtcagacaatggcgacgaaaaggccgaaccatctccccagtcctggagcagcctctggaagcacgacaaagacatggaagaggacagggcgtccagctcctctggcacaatagtgcaggaggcctacggcaagatctctaccagtgataattccatggcacaaatactgactcctgatagccttaacaccgaacaggggccagaatgctccttaaggcctaaccagactgaagaaggcactacacccccaatcgaagccgacactcttgattcttccgatgctcaaggcggtctggagccaagagtggagaagacacgacccgaaccaaccgaggtattacatgcctgcaaaacacaggtcgccgagctggaattgtggctgcaacaagccaatgtggccgtcgaacccgaaactcttaacgcagatatgcaacaagtgctcgaacagcagctggtgggctgccaggccatgttaactgaaatcgaacacaaagtagcttttcttctagagacgtgtaaggatcagggactgggtgataatggggcaacccaacacgaggccgaagctttaagtctgaagttaaagaccgtgaaatgtaatttggaaaaagtccagatgatgcttcaagagaagcactctgaggaccagcatccaacgatcctcaaaaagtcaagcgaacctgagcaccaagaagctctacagccggttaacctctctgagcttgaaagcattgtaaccgaacgacctcagttcagccggcagaaggacttccagcagcagcaggttctggagctgaagccgatggagcagaaggattttatcaaattcatagagttcaacgccaaaaaaatgtggccacaatactgccagcatgataacgataccactcaggagtcctccgcaagtaatcaggcatcctcacccgagaacgatgtgcctgattccatcctcagtccccagggtcaaaatggtgacaagtggcagtacctccaccatgaattatcaagcaaaattaagctcccgttaccgcagcttgttgagcctcaggtctcaacaaatatggggatcctcccatccgtgacaatgtacaattttcgttatcctaccacagaggaactcaaaacctacactacccagctggaggacctcaggcaggaggcaagcaatctgcagactcaagagaatatgaccgaggaagcctatattaacctcgacaagaagcttttcgagctttttctgaccctgagtcagtgcctgagttccgtcgaagagatgctcgagatgcctcggctctaccgagaagacggctccggccaacaggtgcactatgaaacattggccctcgagcttaaaaagctttatctcgcactttcagacaaaaagggcgacctcctaaaagccatgacatggcctggggaaaacacaaacttgctgctcgagtgcttcgataatttgcaagtatgcctggaacatacacaggcggcagcggtgtgccgatctaagtcactgaaagctggtcttgattacaaccgcagctaccaaaatgaaatcaagagactgtaccatcaacttataaagagtaagacatctctgcaacagagccttaacgagatatctggtcagtctgtagcagaacaacttcagaaagccgacgcctataccgtagaacttgagaatgccgaatcccgtgtcgcgaagttgagagatgagggcgaacgccttcacctgccttatgctctgctgcaggaagtttacaagctggaggatgtacttgactccatgtggggcatgcttcgcgctcgatataccgagctcagctcccctttcgtcactgagagccagcaagacgccctgcttcagggcatggtggaactagttaaaattggcaaggagaagctcgctcacggtcacctgaaacagaccaaatcaaaagttgcgctacaggcacagatcgagaaccacaaggtattttttcagaagctcgtggctgacatgctgctgatccaggcctactccgccaaaatccttcctagcctactccaaaaccgcgagaccttttgggccgagcaggtcactgaggtgaagattcttgaggaaaagtctagacaatgcggaatgaagctgcagagtctgctgcagaaatgggaagaattcgatgagaattacgccagcctggagaaagacttggaaattctcatctctactctcccaagcgtgtctctggttgaagagacggaggagcgactggtggaaagaatcagtttttatcagcagatcaaaaggaatatcggtggcaaacatgcccgactgtaccagacacttaacgaaggaaaacaactcgttgcctccgtctcgtgtcctgagttggaaggccaaatcgcaaaacttgaggagcaatggcttagcttaaacaagaaaatcgaccatgaactgcacaggctccaagccctgctgaaacatctgctctcttataacagagactccgatcagcttaccaagtggctcgagagtagtcagcacacactgaattactggaaggaacaaagcctgaacgtatctcaggatttagatacaatacggtcaaatattaataacttctttgaatttagcaaggaggtagatgagaaaagctctctcaaaactgccgttatcagcatcggaaatcagctcctccatctgaaggaaactgataccgcaaccctgcgggcttctctggcccagtttgagcagaaatggactatgctcataacccaattgccggacatacaggaaaagctacatcagcttcagatggagaagctgcccagccgaaaggcaattaccgagatgatttcatggatgaacaatgtggaacaccagacaagcgatgaagactcagttcatagtccctcttcggctagtcaagtcaagcacttgctgcaaaaacacaaagaattcagaatggaaatggactacaagcagtggatcgtcgattttgttaatcaatcactcctgcagctgagcacatgtgacgttgagtcgaagcggtatgagagaacagagttcgccgaacatctgggtgagatgaacaggcagtggcatcgtgtgcacggcatgctcaatagaaaaatccagcatctggagcagctattggaatccatcactgagagtgagaacaaaattcagattctgaataattggctcgaggcacaagaggaacggttaaagaccctgcagaagccggaatcggttatcagcgtgcagaaactgctgctcgattgtcaggacattgaaaatcaattggcaataaaatctaaggccctcgacgagcttaagcagagctacctgactctcgagtctggtgccgttcccctcctcgaggatacagccagcagaatcgacgaactctttcaaaaacggtcaagtgtcctgacgcaagtaaatcagttaaagacaagcatgcagagcgtgctccaggaatggaagatctatgaccaactgtacgacgaggtgaacatgatgacaatacggttttggtattgcatggagcattcaaagcccgtcgtgctctccctggaaaccctgcgctgtcaggtggaaaatctgcagtcgctccaagatgaagccgagagttctgagggatcatgggagaagctgcaagaggtgatcggcaaactcaagggcttatgtccgtccgtggcggaaatcatcgaggagaaatgccagaatacacataagcgctggacccaggtaaatcaggcaattgctgaccagctccaaaaggcacagtctctcctgcagctgtggaaggcttacagtaatgcccatggcgaagccgcagccagactgaagcaacaggaggccaaattccagcaactcgcaaacatatctatgagtggaaacaatctagcggagatcctgcccccagcactgcaagatataaaagaactgcagcatgacgtccaaaaaaccaaagaagcctttctgcagaatagcagtgtgcttgacagactcccccagcccgcagagtcttccacccacatgctgctgcccggacctttacactcactgcagagagctgcataccttgagaagatgttgttagtgaaagcaaatgagttcgaattcgtgttgtcacagtttaaggacttcggcgtgcgcctggagtcacttaagggactgatcatgcacgaggaggagaaccttgatcgactgcatcagcaggagaaggagaaccctgatagcttcctgaatcatgtgctggctttaaccgcccagtcccccgatatcgaacacctgaacgaagtgagcttgaaactgccgttatccgatgtcgccgtgaaaactctgcagaatatgaatcggcagtggatccgcgcaactgccactgccttggaacgctgctctgaactgcagggaatagggctgaatgagaagttcctctactgttgcgaaaagtggatccagctgctagagaaaatagaggaggccctgaaggtcgatgtggccaacagcctgcctgagcttttggagcagcaaaagacatataaaatgctcgaagctgaggtcagcatcaaccagactatcgctgactcgtacgtgacacagtccctacagctgttagacacaacggaaattgagaacagaccggagtttataactgaattttcaaaattgaccgatcgatggcagaacgccgtgcagggcgtgcgccaacgaaaaggcgacgtggacggcctggtcaggcagtggcaagattttaccacaagcgtagaaaacctcttcagattcctgacagatacaagtcatctacttagtgcagtaaaaggtcaggaacggttcagtctataccagacaaggagtctgattcatgaactgaaaaacaaagagatccatttccagcgcaggagaacgacatgcgctctgacgctcgaagcaggcgagaaattgttgctgacaaccgacctgaaaacaaaagagtcggtagggcgtcgcatcagccaattgcaggattcatggaaagatatggagccccaactcgctgaaatgatcaagcagttccagtcaactgtcgaaacctgggatcagtgtgagaagaagataaaggaactgaaaagtagactccaggtattgaaggcacagtccgaggatccgttgcccgaactacacgaagatctgcataatgagaaagagctaatcaaagagttagaacagagtttggcctcatggactcaaaatctgaaagaacttcagaccatgaaagcagatcttacccgtcatgttttggtggaggatgttatggtgctgaaagagcagatagagcacttgcatcgacagtgggaggacttatgcttgcgcgtcgctattaggaaacaagaaatcgaggaccggctcaacacctgggtagttttcaacgaaaaaaataaagaactatgcgcctggctggtacagatggagaacaaggtcctccagaccgccgacatctcgattgaggagatgatcgagaaactgcagaaggattgtatggaagagataaacctattctctgaaaacaagctgcagttgaagcagatgggggatcaactcatcaaagccagcaacaaatctcgagcggctgagattgacgacaaactgaataagataaacgataggtggcaacatctgttcgatgtgatcggcagcagggtgaagaagctgaaggaaacattcgcattcatacaacagctggataagaatatgagtaatcttagaacttggctcgcgaggatagagagcgagctgagtaaacctgttgtttatgacgtttgtgatgaccaagagattcagaagcgactggcagagcagcaagatttgcaaagggacatcgaacaacactcagccggagtcgagagcgtgttcaatatttgcgacgtgttgttgcatgatagcgacgcatgcgccaacgaaactgagtgcgacagcatccaacaaacgacaagaagtctcgaccggcgttggcgtaacatttgcgcaatgtctatggagagacgcatgaagatcgaggaaacatggcggctgtggcaaaagttcctcgacgactattcccggtttgaagactggctcaaatctgctgagagaacagccgcatgccctaatagctcggaggtactttacacctcagccaaagaagagcttaaaaggttcgaggctttccagagacagattcacgagaggctcacccagcttgaactgattaataaacagtataggcgtctggccagggagaaccgcactgacaccgccagcagacttaagcagatggtgcacgagggcaaccagcgttgggataatctgcaacgaagggtgaccgccgtgctcagaaggttgaggcattttacgaatcagcgcgaggagtttgaaggtacccgagaatccatactagtgtggctcacagagatggatctgcagcttaccaacgtggagcatttcagtgaatctgatgccgatgataaaatgaggcaactcaatggatttcagcaggagattactctcaatacgaataaaattgaccagcttatcgtctttggagagcagcttattcagaagagtgagccacttgatgcagtgctcatcgaagatgagttggaggagctgcaccgctactgtcaggaggtgttcggacgcgtgtctcggtttcaccgcagactgaccagttgcacccctgggttagaagatgagaaggaagcttcagagaacgagacagacatggaggaccccagggaaatccagacggacagctggaggaagcgaggcgagagcgaggagcccagcagcccgcagagtttgtgtcatctggtggccccagggcacgagcggtccggttgtgaaacgcctgtgtctgtggattcaattccactcgaatgggaccacacgggggatgtaggcggatcaagcagccatgaggaagatgaggaaggtccgtactactctgctctgtcagggaagtctatatctgacgggcactcatggcacgtgcccgactcaccctcttgtcccgagcaccactataaacagatggagggagaccggaatgtgccccctgtgccacccgcatccagcacaccatataagcccccatatggaaagttgctgcttccaccgggaactgatggtggaaaggagggacccagagtcctcaacggtaatccacagcaggaagacggcggtttagctggcatcacggagcagcagtctggcgcatttgaccgctgggagatgatccaggcccaggagctccacaataagcttaaaatcaagcaaaatctgcagcagttaaactccgatatcagcgccataactacatggcttaaaaaaaccgaggccgaattggaaatgctgaaaatggcgaaacctccctccgacattcaggagatcgagctccgggttaagcgactgcaggagatcctgaaagcttttgatacttacaaagcactcgttgtatcagtaaatgtgagcagcaaagaatttcttcagacagaaagccccgagtccactgaactacaaagtcggctgaggcagttaagcctcctttgggaggcagcccagggcgctgtagacagctggagaggagggctacgtcagtcactgatgcagtgccaggatttccaccaattgagtcaaaatctcctactgtggctggcctctgcaaaaaacagaagacagaaggcccacgtgaccgaccccaaagctgatcccagggccttactggagtgccgccgtgaattaatgcaactcgagaaagaactggtcgagcggcagccgcaggtggacatgctccaggaaatttccaattcactgcttattaagggccatggtgaggactgcatcgaggccgaggaaaaggtgcatgtaatcgagaaaaagctcaagcaactgcgagagcaagtgagtcaggatctgatggccctgcagggtacccagaaccctgccagtccactccccagcttcgatgaggttgattctggggatcagcctccagcaacctctgtccctgcacccagggcaaaacagtttcgcgctgttcggacaaccgagggagaagaggagactgaatccagggtccccggatccacgaggccccagaggtcctttctgtctcgcgtcgttcgggcagctctccctttgcaactgctcctcttgctgctcttgctactggcctgtttactgccttccagcgaggaggattattcttgcactcaggccaataatttcgcaagatccttttaccctatgctccgatataccaatggaccaccacctacatag

SEQ ID NO: 242076 - DNA, 20724 bp, Artificial Sequence
  Description of Artificial Sequence: Synthetic coding sequence
atggctagctctcctgaactcccgaccgaagatgagcagggctcctggggaatcgacgatctgcatattagcctccaggcggagcaggaggacacccagaagaaggcctttacatgttggattaattcccagctggcacggcatacaagtccttccgttatctcagatctgtttacagacattaaaaaagggcacgtcctgctggatctcctcgaggtcctgtccggacaacagctaccaagggacaagggatccaatacattccagtgtaggatcaatatagaacatgctctgacattcctgcgtaataggtccattaaactgatcaatatccacgtgacagatattattgacggaaatccaagtatcatcctaggcctcatctggactataatactgcactttcatattgaaaagctggcccagaccctttcctgcaactataatcagcctagcctagacgacgtgagtgtagtggattcctcccccgcttcatcccctcctgcgaagaaatgttctaaagtacaggcccgttggcagatgagcgccaggaaagctttgctgctgtgggcacaggagcaatgcgcgacatacgaatcggtcaatgtgacagacttcaagtcttcgtggcggaacgggatggcattcctggcaatcatccacgcgctcagaccagacttgatcgatatgaagtctgtcaagcaccgatccaacaaggacaacctgcgagaggccttccgcatcgccgagcaggagctcaaaattccccgactcctggagcctgaagacgtcgatgtcgtggatcctgacgagaaatctattatgacctacgtggcccaatttttgcagtatagtaaggacgcccctggcacgggggaagaggcacaagggaaagttaaagacgccatgggttggctcacgctccagaaagagaagctccagaaactgctgaaggattccgagaacgacacatattttaaaaagtacaactctctgctgagctttatggagtcatttaatgaagagaaaaaatcttttctggacgtgctgagcataaagagagacctggacgagttagacaaagatcatttgcaactaagagaagcatgggacgggttggaccaccaaattaatgcttggaagatcaagctgaattacgctttgcccccacctctgcatcagaccgaggcgtggctgcaggaggtcgaggagttaatggatgaagatttgagcgccagccaggaccattcacaggctgtcaccctcattcaggagaagatgactctgttcaagtcccttatggaccgcttcgagcaccatagcaatattctattgactttcgagaataaggatgagaaccacctccctcttgttcctcccaacaagttggaagagatgaagcggcgaatcaacaatattctggagaaaaaattcattctgcttctcgagttccattattataaatgcctggtcctggggttggtggacgaagtcaagagcaagctggacatttggaatattaaatatggctcccgcgaaagcgtggaactgctcttggaggactggcacaagtttattgaagagaaggaattcctggcaagacttgacacatctttccagaaatgcggcgagatctacaaaaatttggccggagagtgtcagaatatcaacaaacagtacatgatggtgaagagcgacgtttgcatgtaccgcaagaacatatacaatgtcaagagcactttgcagaaggtgcttgcctgttgggctacctacgtcgaaaatctccgcctcctccgcgcttgttttgaggagacaaagaaagaggaaatcaaggaggtgcctttcgagacattggctcaatggaatcttgagcacgccacactcaatgaggccggtaacttcctggttgaggtaagcaacgatgtcgtaggaagctctatctcaaaggagcttcgcaggctaaataaacggtggcgcaaattggtaagtaaaacccagctggaaatgaacctgcctcttatgatcaaaaaacaggaccagcctactttcgataacagcggtaacattctgtccaaggaggaaaaagccaccgtagaattctctactgacatgagcgttgagttaccagagaactataaccagaacattaaggccggtgagaaacacgaaaaggagaatgaagagttcacaggacagctgaaagttgcgaaagacgtggaaaaactaattggacaagtagaaatatgggaagccgaagccaagagtgttctcgatcaggatgatgtcgatacgagcatggaggaatcgttgaagcaccttatcgctaagggttctatgttcgacgagttgatggccaggagtgaagacatgcttcagatggacattcaaaacatcagctctcaggagtcctttcaacatgtgctcaccacaggactgcaagcaaagattcaagaggccaaagaaaaggttcagatcaatgtggtcaagcttatcgcagcacttaagaacctgaccgatgtttcacctgatctggatatcaggctgaagatggaagaatctcagaaagagctggagtcatatatgatgcgtgctcagcaactgctaggccagcgggaatccccaggtgaactgatttctaaacataaagaggccctgatcatatcaaacacgaaaagcctggccaagtacctgaaggcagtggaagaactgaaaaacaacgttaccgaggatattaaaatgagcttggaggagaaaagtcgtgacgtttgtgccaagtgggaaagcctgcaccatgagctgtcactatatgtccaacaactaaaaattgatattgaaaaaggcaagctttctgacaatatcctgaaacttgagaagcagatcaataaagagaagaaacttataagacgcggacggacaaaagggttgatcaaagagcatgaggcatgtttctccgaggaaggttgcttataccagctgaatcaccacatggaggtgttgagagaattatgtgaggaactgcccagtcaaaagtcccagcaggaggtaaaaagactgctgaaggattacgagcaaaagatcgagaggctcctcaagtgcgcttcagaaatccatatgaccctacagccaactgccggaggaacttccaaaaacgaggggactatcacaacgtctgaaaatcgtggtggggacccacacagtgaagcaccattcgctaagtcagataaccaaccatctaccgagaaggctatggaacccacgatgaaattctcgctggccagtgtactccggcctctgcaggaagaaagcatcatggaaaaagactatagcgcatcaataaactcactgctggagaggtacgacacttaccgggacatcctggagcaccacttgcaaaataacaagtttcgtatcaccagtgatttctcctccgaggaggaccgatcttcttcttgtctgcaggcgaaactaacagatctccaggtgatcaagaatgaaactgacgcccgatggaaggaattcgaaatcattagcttaaaactggagaatcatgtgaatgatattaagaaaccctttgtcattaaggagagggatacacttaaggagagagaaagagagctgcagatgactctgaacactcgcatggagtcccttgagactgccttacggctggttctaccagtggagaaggcaagcttgctcttatgcggcagcgacctgcccctgcataagatggccattcaggggtttcacctgattgacgctgaccgcatctatcagcacctgcgaaacatccaggacagcatagccaaacaaatcgagatatgtaacaggctggaagaacccggaaacttcgtactgaaggaactccaccccttcgacctccatgctatgcaaaacatcatcctcaagtacaagactcagttcgagggcatgaatcatcgcgtccaaaggtcagaggacactctcaaagccttggaggatttcctggcctcccttcggacagcaaaactttccgcggaacccgttacggacctgagcgctagcgacacccaagtggctcaggagaatacactgacagtgaaaaacaaggaaggagagatccacttaatgaaagacaaagctaaacatctcgacaaatgcttgaagatgttagacatgagctttaaagacgccgaacggggtgacgataccagctgtgagaacttgctggacgcctttagcattaagttaagtgagacacacgggtatggagtccaggaggagtttacggaagaaaataagctgctggaagcctgtatattcaaaaataacgaacttctgaaaaacatccaggacgttcagagtcagatctctaagattggcttaaaggatccgaccgttcccgctgtcaaacatcgcaagaaaagcttgatccgcttggacaaggtgctagacgagtacgaggaggagaaaagacatctacaagagatggctaactccctgccacattttaaggatggccgagaaaaaaccgtgaatcagcaatgccaaaatacggtggtcttgtgggagaatacaaaggccctcgttacggagtgcctggaacagtgtgggagagtactggaactgctcaagcagtatcagaattttaaatcgatactaacaaccttaattcagaaagaagagtccgtaatctctttgcaggcctcctacatgggtaaagagaacctgaaaaaaagaattgccgagattgaaattgttaaggaggagttcaacgagcatttggaagttgtggacaagatcaatcaggtgtgcaagaatcttcaattctatctcaataagatgaagacattcgaagagccgccttttgagaaggaagcaaacataatcgtcgaccgctggctcgatatcaatgagaaaaccgaggactattacgagaacctggggagagccctagcactttgggacaagttatttaatctcaaaaatgtgattgacgaatggactgagaaggccctccagaagatggaacttcaccagctgaccgaagaggaccgagagcggctgaaggaagagttgcaggtgcacgagcaaaagacatccgaattctcacgaagagttgcggaaatccaatttctactccaaagcagcgagatccctctcgagctacaggttatggaatcctcgattctgaacaaaatggaacacgttcagaaatgccttaccggcgaatcaaactgtcatgccttatcaggttcgaccgccgagctgcgggaagacctggaccaggccaagactcagataggaatgactgagtcattattgaaggccctttcaccttctgacagtttagagatttttacaaaactggaggagatccagcagcagatcttgcagcaaaaacacagtatgattcttctcgaaaaccaaataggttgcctgacgccagaactgtcagaattaaaaaaacagtacgagagcgtgagcgatctgtttaacactaagaagtccgtcctgcaagatcacttctccaaactgctgaacgatcagtgtaagaattttaacgattggttttccaatatcaaggtaaacttgaaggaatgcttcgagtctagcgaaactaagaagagtgtcgagcagaagttgcagaaactatcagatttccttacactcgagggacgcaatagcaaaataaaacaggttgacagtgtgctcaaacacgtgaagaagcatctccccaaggcccacgtaaaggaacttatctcatggcttgttggacaggagtttgagctcgagaagatggaatccatctgccaggccagagccaaagagctggaggattctctgcagcagttgctgagactgcaagatgaccatagaaatcttaggaagtggctgaccaatcaggaagagaaatggaaaggaatggaagaacccggtgagaaaaccgagctgttctgccaggccctcgcgcgaaagcgcgagcagtttgagtccgtcgcccaattgaataattcactcaaggaatacggctttactgaggaagaagagatcatcatggaagccacatgccttatggacaggtaccagacactactccgtcagctttccgaaattgaggaggaagacaaactccttcccactgaagatcaaagctttaacgatttggctcatgacgtgattcactggatcaaagagatcaaagagtctttaatggtgctaaattcaagcgaggggaaaatgccactagaggaaagaatccagaagatcaaggaaatcatcctgttaaaaccggaaggtgacgcaaggattgaaaccatcatgaagcaggccgagtcctcagaggcaccattagtccagaaaactctgactgatatcagtaatcaatgggacaatacactccatttagcctccacatacctttctcaccaggagaagttactgctggagggggagaagtacctgcagagtaaggaggacctaagactgatgctgattgagctgaaaaagaagcaggaagcaggtttcgccctacagcacggcctccaggagaagaaagcacagctcaaaatctacaaaaaattcctgaaaaaagctcaagacctaactagtttgcttaaagaactgaagtctcagggtaactacctgcttgagtgcacaaagaatccgagtttctccgaagaaccatggctagaaattaaacacctgcatgagtctttattgcaacaacttcaagactcagttcagaacctggatggccacgttcgtgaacacgactcctatcaggtatgtgttaccgaccttaataccacactggataatttttctaaggagttcgtttctttttctgacaaacctgtcgaccagattgcagtagaagaaaaactccagaagttacaagagttggaaaacagactttccctgcaggatggcaccttgaagaagatcctggcgctcgctaaatcggtgaagcaaaatacaagctctgtgggtcagaagattattaaggacgatatcaagtctttgcagtgcaagcagaaagatttggagaaccgactggctagtgccaagcaagaaatggagtgttgcttgaacagcattctgaaatccaagcgctctacggagaagaagggaaagttcacactgcctggcagggaaaagcaagctaccagtgatgtgcaggagtcaacccaagagagcgccgctgtcgaaaaattagaggaagattgggagatcaacaaggactccgctgtcgagatggccatgtctaaacagctcagcttaaacgcgcaagagtccatgaagaatacagaggatgaaagaaaggtgaatgaactgcaaaaccagcctttagagcttgatacaatgctgcggaatgaacagctagaggaaattgaaaaactgtacacccagctggaggccaagaaggccgctatcaaaccattagaacagactgagtgtctcaataagactgagacaggcgcactggtgctgcataatatcggatactccgcacagcacctggataacttgctacaagcgctaattacattgaagaaaaataaagaaagtcaatactgcgtactccgtgactttcaggaatacttagcagcagtggagtcgtccatgaaagcacttctgacagacaaggaaagtctgaaagtgggcccacttgattccgtgacctatctggacaagatcaagaagtttattgccagcattgaaaaggagaaggactcgctgggcaacctcaagataaaatgggagaacctatccaatcacgtgacagacatggataagaagctcttagagtcgcagatcaaacagctcgaacacggttgggagcaggtggaacagcagattcagaaaaagtactcccaacaggtcgtggaatatgacgaatttacaaccctgatgaacaaagtgcaggacacggaaatcagcttacagcagcagcagcagcatctgcagctgcggctcaagagccctgaggagcgggctggaaatcagagcatgatagcactgaccacggatctgcaggctactaagcacggtttttccgtgctgaagggacaggccgagctgcagatgaaaagaatctggggcgaaaaagagaaaaagaacctggaggatggcattaacaacctgaagaagcaatgggagaccttagaacccttgcatttggaggcagaaaatcaaatcaaaaagtgcgatattcggaataagatgaaggagaccatattatgggctaagaacctgctgggggagttgaatccctcaatccccctccttcctgatgatatactcagtcagatcaggaaatgcaaagtgactcatgatggaatcttagctaggcagcagtccgtggagtccctggctgaggaagtgaaagataaagtgccatctctgactacctatgaggggagcgatctgaataacaccctggaagacctgaggaaccagtaccagatgctggtactgaagagtactcagcgaagccagcagttggaattcaagctggaggagaggtcgaactttttcgccattattaggaagttccagttaatggttcaggagtctgaaactcttataattcccagagtcgagaccgctgccaccgaagctgagctcaagcaccaccatgtgaccctggaggccagccagaaggagctccaggagatagactccgggatcagtacacacttgcaggagctcactaacatatacgaggagctcaatgtgtttgagaggctctttctcgaagatcagctgaagaatctcaaaatcagaacaaacaggatacaacggttcattcagaatacctgtaacgaagtggaacacaagataaaattttgcaggcaatttcacgagaagactagcgccctacaggaagaagctgactcaatccagagaaacgagttgctgttaaaccaagaagtgaacaagggcgtgaaagaagagatttacaatctgaaagatcgccttactgcaattaagtgttgcatcctccaagttttgaagctgaaaaaagtgtttgattacattggattgaactgggactttagtcagctcgaccagctgcagacacaggttttcgaaaaggaaaaggaattagaggaaaagatcaagcaactggatacttttgaggaagagcacgggaaatatcaagcccttctgtctaagatgcgtgctatagatctccagataaagaaaatgaccgaagttgtgctaaaggcccctgactctagccctgaaagccggaggctcaatgctcaaatactcagccagcgcattgagaaagccaaatgcctatgcgatgaaatcatcaaaaaacttaacgaaaacaagaccttcgatgattctttcaaggaaaaggagattttgcagattaagcttaacgctgaagagaacgacaaactgtacaaagtgctgcagaatatggtactagaacttagccccaaggagctcgatgaaaagaattgtcaggataaactcgagacttctcttcatgtgttgaatcagatcaagagtcagttgcagcagccactgctaatcaacttggagatcaagcatatccagaatgaaaaggacaactgcgaggctttccaggaacaggtttgggctgaaatgtgttctattaaggccgttaccgctatcgaaaaacagagggaagaaaatagttccgaggctagcgacgtagagactaaactccgagagttcgaggatctccagatgcaattaaatacttcaatcgatcttagaaccaacgtgctgaacgatgcctacgaaaatttgacacggtacaaggaggccgtgacacgagccgtggagtccatcactagtcttgaagctatcatcatcccataccgggttgacgtgggtaaccccgaggaatccctggagatgcccttgaggaagcaggaggagctggagagcacagttgcccatatacaggacttgaccgagaagcttggaatgatttccagtcccgaagccaagctgcagctgcaatacaccctgcaggagcttgtttccaagaacagtgccatgaaagaagcatttaaagcgcaggagactgaggccgaacgctacctagagaactacaagtgttatcgtaagatggaggaggacatctacaccaacctgagcaagatggaaaccgttttgggacagtccatgtcttcactgcctctctcctatcgggaagccttagagcgcctggagcagtctaaagcccttgtcagcaacttgatcagcaccaaggaggaactgatgaagctcagacagatcctcagactgctgagactccgttgtacggagaacgacggcatatgtttgctgaaaattgttagcgccctgtgggaaaagtggctgagtctgcttgaagctgccaaagaatgggaaatgtggtgcgaggagcttaaacaggaatggaagtttgtgtccgaggagattgagagggaggctattatcctcgacaatctccaagaggaactcccggagatctctaagaccaaagaagcagctactactgaagagctgagcgagcttctggactgtctgtgccaatatggcgaaaacgtcgaaaagcagcagctcttgcttacactcctgctgcaacgcataaggtctattcagaatgtgccagaatcatccggcgcagtagagactgtccccgctttccaagaaataactagcatgaaagagagatgcaacaaactgctgcagaaggtgcagaaaaacaaagaactagtccagaccgagatccaagaaagacactcttttacaaaggagatcatcgccttgaaaaacttttttcagcagactacgacctcatttcaaaacatggcttttcaggaccacccagagaagtcggagcaatttgaggagctccaaagcatcctgaaaaaagggaagcttacttttgaaaacatcatggaaaagctgcggattaagtactccgaaatgtacacaatcgtgcctgctgagatcgaatcccaggtggaggaatgtagaaaagccctcgaagacatcgacgagaaaatcagcaatgaagttttgaagagctctccttcctatgcaatgagaagaaaaattgaagagattaataacggactacataacgtcgagaaaatgctgcagcagaagtcaaaaaatattgagaaagctcaggagatacagaagaaaatgtgggatgaactagatctgtggcattcgaaattgaatgaactggactccgaggtgcaagacattgtggagcaggatccaggacaagctcaggaatggatggacaatctcatgatcccttttcagcagtaccaacaggtcagtcagagggcagagtgtaggacctcgcagttgaataaggccacggtaaagatggaagaatatagcgaccttctaaaatcaaccgaagcctggatcgagaacacttcccacctgctcgcaaatcccgctgactacgattccctgcggacattatcccaccatgcctccacagttcagatggctttggaggatagcgagcagaagcacaacctcctgcactctatctttatggatcttgaggacctttctatcatctttgagacggatgagctgacacagagcatccaggaactttcaaatcaggtaactgccctgcaacagaaaattatggagtctttgccacagattcagaggatggctgacgatgtggttgccattgagtctgaggtgaagagcatggagaaacgagtcagcaaaatcaagaccatccttctgagcaaggaaatattcgattttagtcccgaagaacacctcaaacacggggaagtgattctggagaatattcggcctatgaagaaaactatagccgagattgtttcctaccaggtagaactgagactgccccagacaggtatgaagccgctgcctgtgtttcagcgaacaaatcagctgctgcaggatattaaactgttggaaaacgtaacgcaggagcagaatgagttgctgaaggtggtgataaaacagacaaatgagtgggatgaagaaattgagaatcttaagcagatcctgaacaattatagtgcacagttttcccttgagcacatgagtcccgaccaggcagataaattgccgcaactccagggcgagatagagcggatggagaaacagatcctgtccctgaaccagcggaaagaggatctcttagtggatctgaaagccacggttcttaatttgcatcagcacctgaagcaggagcaagaaggcgtggagagggacagattaccggctgtcacaagcgaggaaggcggagtcgccgaacgcgacgcctccgaacgaaaactgaaccgcaggggttcaatgagctacttagctgccgtagaagaggaagtggaagaatcctccgtcaaatctgacaacggtgatgagaaagccgagccttccccacaaagctggtccagcctgtggaagcatgacaaagacatggaggaggaccgcgctagttcctcctcaggaacaattgttcaggaagcatacgggaagatttccacctctgataacagtatggcccagatattgacacctgacagccttaacacagaacagggacccgaatgctctttacgtcctaaccagacagaggaggggaccacgcctcctatcgaggccgatactctcgactcttcagatgcacagggcggacttgagcctcgtgtggagaagacccgcccagaacccactgaagtacttcatgcatgcaaaactcaggttgcagaactggagttgtggcttcagcaggcgaatgttgcagtcgaacccgaaactctcaacgccgacatgcagcaggtgctagaacaacaactggtgggatgtcaggcaatgttaaccgagatagaacataaggttgcgttcctgctggaaacatgcaaagaccagggactgggagataacggcgcaacacaacacgaagccgaagctctttctcttaagctgaagactgtcaagtgtaatttagagaaagtgcagatgatgctgcaggagaagcactcagaggatcagcatcccacaattctgaagaaaagtagcgaacccgaacaccaggaggctctgcagcccgtaaatttgagcgagctggaaagtatagtgactgagcgtccccagttcagtaggcagaaagacttccagcaacagcaggtattggaactgaagcccatggaacagaaggatttcataaagttcatcgagtttaacgccaaaaagatgtggccccagtactgtcagcacgacaacgataccacccaggagagcagcgcatccaatcaagcttcgagtcctgagaacgacgtaccggactctatcttaagcccgcagggtcagaatggggacaagtggcaatatctccaccacgagctgtccagcaagatcaagctgcctcttccccagctcgtcgagcctcaggttagcaccaacatgggcattctgccttcagtgactatgtacaatttccgatatcctaccaccgaggagctgaagacttacactactcagctcgaggacctcagacaggaggccagtaacctgcaaactcaggaaaacatgactgaggaagcttatatcaatttagacaaaaagctcttcgaactttttttaacactgtcccagtgtctttcgtccgttgaggagatgttggagatgccacgcctgtacagggaggatggttcaggccagcaagtgcattatgagaccctggccctagaactaaagaaactctacctcgccttgagcgataaaaagggcgacctgttgaaggccatgacttggcccggtgagaacacaaacttgctcctggagtgctttgacaatctgcaggtctgtttggagcacacacaggccgctgccgtttgccgcagcaagtcactgaaggcaggcctggactacaatagaagctaccaaaatgaaataaagcggctgtaccaccagttgatcaaatccaaaaccagcctccaacagtccctgaacgaaataagcggtcagagtgtggccgaacaactgcagaaagcagatgcgtacaccgtagaattggaaaacgcagaatctagggttgccaagcttagggacgaaggtgaacgcctacacctgccttacgctttgctccaagaagtctataagctcgaggacgtcctcgattcaatgtgggggatgctcagggcccgatatacagagttgtcatctccattcgtcacagagtcccagcaagacgcactgctgcaggggatggtcgaactggtaaaaatcggaaaggaaaagctggcacacggccatttaaaacagaccaagtctaaggtcgctctacaagcacagatcgaaaaccacaaagtcttctttcagaagcttgtggcagatatgttactgatccaggcgtacagtgctaagatcctcccatctttgctccaaaaccgggagacgttttgggccgagcaggtgacagaggtgaaaatccttgaagagaagagccgacagtgcgggatgaaattgcaatcccttctgcagaaatgggaggaattcgacgaaaactatgccagcttagaaaaagacttggagattctgatctcgactttgccgtctgtttctttggtggaagaaaccgaggagcgtttagtggagaggatctcattctatcaacagattaagcgcaacataggcggaaagcacgccagactgtatcagaccctcaatgagggcaagcagctggtcgcttcggtgagctgtcctgagctggaaggccagattgctaaactagaggagcagtggctgtccctcaataaaaaaatcgatcacgaactgcaccggctacaggccttgctcaaacatctgcttagctacaatcgggactctgatcagctcacaaagtggctcgagtcttcgcaacacacactgaactactggaaggagcagtcactgaacgtctctcaggacctggacacaattcggagcaatatcaataacttttttgagttttcaaaagaggtagatgaaaagagctccctaaagaccgcagtgatctcgattggaaaccagctgctgcatttgaaggagactgatacggctactttacgtgcttccttggcccagtttgaacagaaatggaccatgctaattacccagctgccagatatccaggagaaactccaccagctccagatggaaaagcttccaagtcggaaggccataacagagatgattagctggatgaacaatgtagagcaccagaccagtgatgaggactccgtgcactcacccagctccgcatcccaggtcaaacatttgctgcagaaacataaagaattcaggatggaaatggactacaagcaatggatcgtggactttgttaaccagtccctgctgcagctctctacttgcgatgtggagtcaaagcgttacgaacgaactgaattcgcggagcatttgggcgaaatgaataggcagtggcacagggtccatgggatgctcaaccggaagatacagcacctcgagcaacttctggagagtattaccgagagcgagaacaagattcagattctgaacaactggcttgaggctcaggaggagaggctcaaaacactgcagaagcccgaatccgtgatttccgtgcaaaaactcctgctggattgtcaggacattgagaaccagctggcaatcaagtctaaggcactggacgagttgaagcagagctatctcacccttgagtccggcgctgtaccactccttgaagatacagcctcaaggattgacgaattgttccagaagagatcgtccgttctgacccaggttaaccagctaaagaccagcatgcagagtgtattacaagagtggaagatatacgaccagctctacgatgaggtgaacatgatgactatacgcttctggtactgcatggagcacagcaagccagttgtgttatcgctcgaaacgttgcgctgtcaagtcgagaatctgcagtctcttcaggacgaggccgagtctagcgaaggctcatgggagaagctgcaggaagtgattggaaagctgaaaggactgtgccccagcgttgcagaaatcatcgaagagaagtgccagaacacacataaacggtggacacaggtcaaccaggccatagccgatcagcttcagaaggcacagtcgctcctacaactgtggaaggcgtatagtaacgctcatggtgaagcagcagccaggctgaagcagcaagaagccaaattccaacagttggcgaacattagtatgtccggaaacaacttggcagagattctccccccagcgctgcaggacatcaaagagctgcagcacgacgttcagaaaacgaaagaggccttcctgcagaattctagtgtactcgaccgactcccccagcccgcagagagttcaacgcacatgctgttaccaggacctctccattcccttcagcgcgctgcgtatctggagaagatgctgctcgtgaaagcaaatgaattcgaatttgtgctgagccagttcaaggactttggcgtgagattggagtcacttaagggactgatcatgcacgaagaagaaaacctcgatcgccttcatcaacaggaaaaggagaatcccgactctttcctcaatcatgtgttagccctgacggcgcagagtcctgacatcgagcacctgaacgaggtctccctcaagctgcctctgtccgacgtcgcggtgaagactctccagaacatgaataggcaatggatccgggcaacggccaccgcactggagcgctgctcagagttgcagggcatcggattgaacgagaaattcctgtactgctgcgagaagtggatacagctactcgagaaaattgaggaggcactcaaagtggatgtggccaattcgctgcccgagctgctggagcagcaaaagacgtataagatgctggaggctgaagtaagtattaatcagacaatcgccgattcctacgtgactcagagcttgcagctgttagataccaccgagattgagaatcgcccagagtttatcaccgaatttagcaagctgacagatcgttggcagaacgcagtgcagggggtacgtcagcggaaaggggatgtggacggactcgtgcgtcagtggcaagacttcacaacctccgtggagaatttgtttaggttccttaccgatactagccacttgctgagtgccgtgaagggccaagaacggttctctctataccaaactaggagcctgattcacgaacttaagaacaaggaaatccactttcaacgaaggcggacaacctgcgcccttactctggaagccggagagaagctgttgctgaccacagacctgaagaccaaagagtcagtaggaagaagaatcagtcagctacaggattcttggaaggacatggaacctcagttggctgagatgatcaaacaatttcagtccaccgtggagacatgggaccaatgcgagaagaaaatcaaggagctgaagtctcgcctgcaggtcttaaaggcccagtcagaagatcccctacctgaactgcacgaggatctccacaatgagaaggaactgatcaaagagctggagcagtctctggcgtcttggacgcagaacttaaaggagctgcaaactatgaaagcagaccttacaaggcacgtgttagtggaagatgtaatggtgctgaaagagcagattgagcacctgcacagacaatgggaagatctttgcctaagggtcgccattaggaagcaggagattgaggacaggctgaacacgtgggtggtttttaacgagaagaataaggaactgtgtgcatggctggtacagatggagaataaggttctccagaccgccgacatttccatcgaagagatgatcgaaaagttacagaaggactgcatggaggagatcaatttattttcagagaataagctgcagctgaagcagatgggtgatcagctgatcaaggccagcaataaatcccgtgcagccgaaattgacgacaaactgaacaagataaatgatagatggcagcatctgttcgacgtgatcgggtcaagggtgaagaaactgaaggaaacattcgcctttattcaacaacttgataagaatatgtccaatttgagaacctggctcgcacggatcgagtccgagctgtcaaaaccggtggtctacgacgtttgcgatgaccaggagatccagaagcggcttgccgagcagcaggatttacagagagatatcgaacagcacagcgcgggtgtggagtctgtattcaatatctgcgacgttctcctgcacgactcggacgcctgcgccaacgagacagagtgtgactctattcagcagactacccggtccttagatagacgctggcgaaacatttgtgccatgagcatggagcgcagaatgaagatcgaggagacttggcgtttatggcagaagtttctggacgattattctcgctttgaagattggctgaaaagtgccgaaagaaccgccgcatgcccaaactcctctgaagttctgtacacctctgcaaaggaagagctgaaacgttttgaggcctttcagcgccagattcacgagcgcctgacccaattggagctgattaacaagcagtatcggagactcgctcgcgaaaacagaactgacactgcatcacggctgaagcaaatggtgcacgaggggaaccaaagatgggacaacctgcagaggagggtcacagccgtcttgcgcaggttgcggcatttcacaaatcagcgcgaggaatttgaaggcacgcgcgaaagtatactagtgtggcttaccgaaatggatttacagctcacaaacgttgagcacttctcagagtctgacgctgacgataaaatgagacaacttaatggcttccagcaggaaatcacactgaataccaacaaaattgatcagcttatcgtgtttggggaacaattgattcagaagagcgagccacttgatgctgtgctgattgaggatgagcttgaggagctgcatcggtactgccaagaggtgttcggtagagtctcccggttccatagacgcttgacaagttgtactcccggactggaagacgagaaggaggccagtgaaaacgaaacagatatggaggatccaagagagattcagacagatagctggcggaagcgaggggaaagcgaggagcccagcagcccacagtctttgtgtcatttagtcgcccctgggcacgagaggagcggctgcgaaacaccagtttctgtggactctatcccactggagtgggaccacacaggggatgtgggaggaagctcaagccatgaagaggatgaggagggaccttattattcagcgctctccgacgtggagatcccagaaaaccccgaagcctatctgaaaatgaccaccaaaactctcaaagcttctagtggaaagagcatctctgacggtcattcttggcacgttccggacagtcccagctgtcctgagcaccactacaagcagatggagggagaccgcaatgtaccacctgtcccacctgcttcctccacaccttacaagccaccttacgggaagctgctgcttcctcccggaaccgatggcggaaaggaggggcctcgggtactcaacgggaaccctcaacaagaggacggcggattagcaggaatcacggagcaacagtccggtgccttcgaccgctgggaaatgatccaggctcaggaactacataataagctcaagatcaagcaaaatctccagcagctcaattctgatatctctgctatcaccacatggctcaagaaaactgaggccgagctagagatgctgaaaatggcaaaaccacctagcgacattcaggaaatcgagttgcgtgttaagcgactgcaggaaatcctcaaggcttttgacacctacaaggccctggttgtctctgtgaacgtgagttctaaggaatttttgcaaactgagtctccagaaagtaccgagttgcagagcaggctgcgacaattaagtttactttgggaggcagctcagggggctgttgattcgtggcggggaggcctgaggcagagcctgatgcagtgtcaggatttccaccaactttcacagaatctgctcctctggctcgcatccgctaaaaacagaagacagaaagcccacgtgaccgacccaaaggctgaccctagagccctgctggagtgtcgcagggaactgatgcagctggagaaggagctggtagagcggcaaccgcaagtggatatgcttcaggagatctcaaatagcttactgattaagggacacggcgaggattgcattgaggcagaagagaaggtgcacgtcattgaaaagaagctgaagcagctccgcgaacaggtcagtcaagacttgatggcattacagggcactcagaatccagccagtcctcttccttcgttcgacgaggttgatagtggggaccagccccctgccacgtctgtcccagccccaagggccaagttcagggccgtccgcacgacggagggggaggaagaaacagaatctagggtgccagggtctacccgtccacaacggagttttctgagcagggtggtgcgagcagctctgccacttcagctgctcctgttgctcctgctgcttcttgcatgcttgcttcccagttctgaggaggattacagctgtacccaggccaataattttgcccgaagcttttaccctatgctacgatataccaatggaccccctccaacctaa

SEQ ID NO: 242077 - DNA, 9812 bp, Artificial Sequence
  Description of Artificial Sequence: Synthetic coding sequence
atggagaaactgaggattaagtactcagagatgtataccattgttcctgctgagatcgaaagtcaggttgaagaatgtcgcaaagccttagaagacattgacgagaaaatttctaatgaggtgttaaagtcatctccgagttacgcaatgaggaggaagatagaggagattaacaacggactccataatgtggaaaaaatgctccaacagaagagcaagaacattgagaaagcccaggagatacaaaagaagatgtgggatgagctggatctgtggcactctaagctgaatgaactggactctgaggtgcaggacattgtggaacaggatccaggtcaggcccaagaatggatggacaacttgatgatcccttttcagcagtaccagcaagtttcacagagagctgagtgccgcacaagccaattaaataaggccacggtcaagatggaggaatacagcgacctcctcaagagtactgaagcatggatcgaaaatacctctcacctgttggccaaccccgctgactatgatagcctgcgcacactcagtcatcacgcctccaccgtccaggactccaaatgttttcggagcggcccaagacctaacatatacgtgtcctattatgtaaccgtcatccagatggctctggaagacagtgaacaaaaacacaatcttctccattctatttttatggatttggaagacctgtcgatcatctttgagacagacgagctgacacaatctatacaggagctctcaaaccaggtaactgctcttcaacaaaagatcatggagagcctgcctcaaatccagaggatggccgatgatgtggtcgcgattgagagcgaggtgaagagtatggagaaaagggtgtccaagattaagaccatcctgttgtctaaggagatcttcgatttctccccagaagagcacctgaagcatggggaagttatactcgaaaatataaggcctatgaaaaaaaccattgctgagatcgtaagctaccaggtggagttacggctaccacagactgggatgaaaccactgcctgtttttcagagaaccaaccaactgctacaggatatcaagttattggagaatgtgacccaagaacaaaacgagcttttgaaggtagttatcaagcagactaatgagtgggacgaggagatcgagaatctgaagcagattctgaataattactcggctcaattctcccttgagcacatgtcccctgatcaagccgataagctcccacagctccaaggcgagatcgagaggatggaaaagcagatcctgtctttaaaccagaggaaagaggatcttttggtagacctgaaggccactgtcttaaacctccatcaacacctcaagcaggaacaggagggagtggagcgggacaggctgcccgctgtgaccagtgaggagggtggagtcgccgaacgagacgcttctgaacgaaaactgaacagacggggatccatgtcatacctcgccgcagttgaagaggaggtcgaggagtcctctgtgaagtccgacaacggagacgagaaggcagaaccttccccgcaaagctggtctagcttgtggaaacacgataaagacatggaggaggaccgcgcaagctcttcttcagggaccattgtccaggaggcttacggcaagatttccacttctgataatagcatggcccagattctgaccccagatagcctgaatacggagcagggccctgagtgctcgcttcgacctaatcagaccgaggagggtaccacgcccccaattgaggccgatactttggatagctcagacgctcagggcggattggagcctagggttgaaaagacgagaccagaacccacagaagtcctgcatgcatgcaaaacacaagtggcggagttggaattgtggctgcaacaggcaaatgtcgccgtggaacccgagacactaaatgccgatatgcagcaagtgctggagcagcagttggtgggatgccaggcaatgctgacagaaatagaacacaaggtggcattcctcctcgagacatgtaaggatcagggcctcggcgacaacggtgcaacccagcatgaggcggaggccttgtctctaaaactgaaaaccgtgaagtgtaacctggagaaagtgcagatgatgctgcaggagaagcattccgaggaccagcatccaactattctgaagaagagttctgaacctgagcatcaggaagctctccaaccagtgaacctgtctgagctggaatctatcgtgaccgagcggccacagttttctcggcagaaggacttccagcagcagcaggtgctagaattgaagccgatggaacagaaggatttcattaagttcatcgaattcaatgccaaaaagatgtggcctcagtactgccagcatgataacgacaccacccaggaatcatctgcgagtaaccaggcctctagccctgagaacgacgtacccgattcaatcctgtctcctcaaggacagaatggcgacaaatggcagtatctccaccacgaactgagttctaaaattaagctccctttaccccagctggtagagccacaggtctcgacaaacatgggcatcctgccgtctgttactatgtacaacttcagatacccaacaacagaggagctgaagacttacacaacgcagttagaagacctgagacaggaggctagcaatctacagacacaggagaatatgacagaggaggcttatatcaaccttgacaagaagttgttcgagctgttcctcacactgtctcagtgcctgtctagtgtggaggaaatgttggagatgccaagactttaccgggaggatggatctggacagcaagttcactacgaaacgcttgccttggaactgaagaagctttaccttgcacttagcgacaaaaagggagatctgctgaaagctatgacgtggcctggggagaatactaacctgctgcttgagtgcttcgataacctgcaggtttgcttggaacatacacaggctgctgctgtgtgcaggtctaaatccctgaaagccggtctggactataatcggagttatcaaaatgagattaagaggctttatcaccagcttatcaagagcaagaccagcttacagcagagtctcaacgagatctccggccagtccgtggcggaacaactccagaaagccgatgcttacacggtcgagttggagaacgccgaaagtagggtggctaagttgagagatgaaggggagaggctgcacctgccttacgccctcttgcaagaggtgtataaactagaagacgtacttgattctatgtggggtatgctgagagcccgttacacagagctgtctagcccattcgtgaccgagtcccagcaagacgcactgctgcaggggatggttgaactggtcaaaatcgggaaagaaaaactggcgcacgggcatttgaaacaaacaaaatccaaggtggcactgcaggcccagattgagaaccataaggtgtttttccagaagttggtcgctgacatgttgcttattcaggcttattctgctaaaatactcccctctttacttcagaaccgcgaaacattctgggcggagcaagtgacagaggtgaaaatcctggaggagaagagccggcagtgcggtatgaaactgcagagtcttctccaaaaatgggaggaattcgacgaaaactatgcatccttagagaaagatttagaaattctgatctcaaccctgccgagtgtatcactcgtggaggaaactgaggagagactggtggagcgtatctcattctaccagcaaatcaaaagaaacatcgggggtaaacatgcgagactgtatcagaccctgaacgaaggtaagcagttagtggcgtcagtcagctgccccgaactcgaaggccaaattgccaaactcgaagagcagtggctgtcactgaacaagaaaatcgaccatgagttgcatcgccttcaggctctcctgaagcacctgctgtcctataaccgcgacagcgaccagcttaccaagtggctggagagtagccaacatactctgaactattggaaggagcaatctctgaatgtgagccaggacctggacacaattaggagcaacattaacaattttttcgagttcagcaaagaggtggacgagaaatcatctctcaaaacggcggtgatctctataggtaatcagctcttacacttaaaggagacggacacagctactctgcgggcaagcctggctcagtttgagcaaaaatggacaatgctcattacccaactgcctgacatccaggagaagcttcaccaattacagatggagaaactcccttctcgtaaggccattacagagatgatctcctggatgaacaacgtggagcaccagacttccgacgaagactcagtgcactccccgtcctccgctagtcaggtgaaacatctgttgcagaagcataaggagttccgtatggaaatggattacaaacagtggattgtcgactttgtgaaccagagcttgctccagctgtcaacttgcgatgtcgagtctaagaggtacgagcggacagagtttgcagagcaccttggagagatgaatcgccagtggcacagagtgcacggaatgctcaaccgaaagatccagcacctcgaacagctccttgagagcattaccgagagcgagaacaaaatccagattttaaacaactggcttgaggcccaggaagagaggctgaaaaccctgcaaaaacccgagtccgtgatctccgtccagaaactcctgctagactgccaggacatcgaaaaccagctcgcaatcaagtccaaggccttggacgagctaaaacagagctatcttacactggaatccggcgctgttcccctcctcgaggatacggccagccggatcgacgagctcttccagaagcgaagctccgtcctgacccaggtcaatcagctgaagacgtcaatgcaatctgtgttgcaagaatggaagatttatgaccagctgtacgatgaagtcaatatgatgacaatcagattttggtactgcatggagcacagtaaaccggtcgttctgagcctggagaccctgagatgccaggtggagaacctgcaaagtctccaggatgaagccgagagctccgagggctcgtgggagaaactgcaagaggtcattggtaagttgaaaggtctctgtccctccgtagccgaaatcatcgaggagaaatgccagaacacacacaaacgttggacgcaggtgaaccaggccatcgccgaccagcttcaaaaggcacagtctttactgcaactgtggaaagcctacagcaacgctcacggagaggccgcagctagactgaaacaacaggaggctaagttccagcagcttgcaaacatttccatgtctggcaataatctggctgaaatccttccacccgctttgcaggacatcaaagaactgcagcacgacgtccaaaagactaaagaggcattcttgcagaacagctccgttctggacagactgccacagcctgctgagagctctacccacatgctgctccccggtcctctgcactctctccaaagagccgcataccttgaaaaaatgcttctagttaaggcaaatgaattcgagttcgttctttcacaattcaaagatttcggggtgcgattggaaagcctgaagggtctgattatgcatgaggaggagaatctggaccgcctccaccagcaagagaaggaaaatcctgattcgtttctgaatcatgtactcgcactgaccgctcagtccccggacatagagcaccttaacgaagtgagcttaaagttgccacttagcgacgtagccgtcaagacccttcagaacatgaatagacagtggatccgagcgacagccactgcgttggagcggtgtagcgagctgcagggaataggactgaacgagaaattcctctactgttgtgaaaaatggatccagctgttggagaaaatagaagaggccctgaaggtcgacgtcgccaatagcctgcctgagctgctggagcaacaaaagacgtataaaatgcttgaggccgaagtgtctattaatcagaccatcgccgactcctatgtcactcagagtttgcagttgcttgacaccacagagatcgagaacagacccgagtttatcactgaattcagcaagttgactgacaggtggcagaatgccgtacagggtgtgcggcaaaggaaaggcgatgttgatggactggtgaggcaatggcaagattttacaactagcgttgaaaatctgtttaggtttttaactgacacctcgcacctgctttcagccgtgaaaggacaggagagatttagtctttaccaaactcgctccttgatccacgagctgaaaaataaggagatacactttcaacgaaggcgcacgacctgtgcactgacactggaggcaggcgaaaaactgctactcactacggatctgaagacgaaggagagtgtcggtcgccgaatcagccagctccaggattcctggaaggatatggaaccccagctggccgaaatgattaagcaattccagagcactgtggaaacctgggatcagtgcgaaaagaagattaaagagctaaagtcacgcctgcaggtacttaaggcccagagcgaagatcctctgcctgagctacacgaggaccttcacaatgaaaaggagctgataaaggagttagagcagtcccttgcctcttggacacagaatctgaaagagctgcagactatgaaggcggacctcacccgccacgtgcttgttgaagacgtgatggtgctgaaagagcagatcgagcacctacaccgccaatgggaggatttgtgtctcagggtagctatccgaaagcaagagatcgaggatcgcctaaacacctgggttgtttttaacgaaaaaaataaagagttatgtgcctggctggtccaaatggaaaacaaagtcctccagacagccgatatctctatcgaggagatgattgagaaactccaaaaagactgcatggaagaaattaacctattctcagagaataaattacagctgaagcagatgggcgaccagctcattaaggccagcaacaaaagccgtgccgcagaaatcgatgataaactgaacaagatcaacgatagatggcagcacctgttcgatgtgatcggatccagggtgaaaaagttaaaagagacctttgccttcattcaacagttagataaaaacatgagcaacctgaggacctggctcgccaggattgagtccgagttgtctaagccagtggtctatgatgtgtgtgatgaccaggagattcagaagcggctggcagagcagcaggacctgcagagggatattgagcagcatagtgccggagtcgagtccgtgttcaatatatgtgacgttttgctccacgactctgacgcttgcgccaacgagaccgagtgtgactccatccaacagactacccgcagcttagaccgcaggtggagaaatatttgtgctatgtctatggagcgccgaatgaagatagaggagacctggcggctctggcaaaagtttctggacgattacagtcggtttgaggactggctgaagtccgccgaaaggacagctgcatgtcctaattcctctgaggtgctttacacatccgccaaggaagaactcaaacggttcgaagcctttcagcgacagattcatgaacggctgactcagttggagctcattaataagcagtaccgcagactggccagagaaaatcgtacagacactgcctcacgcctgaaacagatggttcacgaaggcaaccagcgatgggacaacctgcagcggagagtgaccgctgtgctgagaagattgcgccactttactaatcagcgagaggagtttgaggggacgcgggagagcatcctggtatggctcactgaaatggatctgcaactgaccaacgttgagcattttagcgagtccgatgccgatgacaagatgagacaactgaatggatttcaacaggaaataaccttaaacacgaataagattgatcaactcatcgtattcggagagcaactcattcagaaatccgaaccgctcgatgctgtgctcattgaggacgagctggaggaactccatcgttattgtcaggaggtctttgggagagtcagcagatttcataggagattgacttcatgcacacctgggctggaggacgagaaagaggcgtctgagaacgaaactgatatggaagatcccagggaaatccagacagactcctggcgcaagcggggtgaatctgaggaaccttcatctccacaatctctttgccaccttgttgcgcctggacacgagcggtccggctgtgagaccccagtgagcgtagacagcattcccctggagtgggatcacaccggtgacgtcgggggatctagcagccatgaggaggatgaagagggtccttattacagcgctttgagtggcaaaagcattagtgatgggcacagttggcatgtgcccgattcaccctcatgcccagagcaccattacaaacaaatggagggtgaccgcaatgtgcctccggtgccccctgcctcctctaccccttataaaccaccttatggcaagctgctcctgcccccaggcacggacggcggaaaggaggggcctagagtcctcaacggcaaccctcagcaagaggatggagggctcgccggtataaccgagcagcagtcgggggcattcgatcgctgggagatgattcaggcccaggagctgcataacaaactcaagatcaaacagaatttgcaacagctgaatagcgatatcagtgcaattactacttggctaaaaaaaactgaagctgagttggagatgctgaagatggccaaacccccaagcgacattcaagaaatcgaactgcgggtgaaaagactacaggaaatcctcaaggctttcgacacctacaaggcacttgtggtttctgtcaatgtaagtagtaaagaattcctccagaccgagtctcccgaatctacagaactccagtccagactcaggcaactgtcgttgctatgggaggccgctcaaggtgcagtcgacagttggcgcggtggcctgaggcaatccctcatgcaatgccaggacttccatcagctgagccagaacttactcttgtggctcgccagtgccaaaaataggcgccagaaagcgcacgtaacggatcctaaagctgatcctcgggcactcctcgaatgccgtagggaactgatgcagctcgaaaaagagcttgtcgagcgccaaccccaagtggacatgctccaggagattagtaatagtctgctgattaaagggcacggcgaagactgcatagaagccgaggaaaaggttcatgtgattgaaaaaaagctcaagcagctgcgtgagcaggtgagtcaggatctcatggcgctgcaggggacccagaatcctgcctccccacttccttctttcgacgaagtcgacagcggagatcagccccctgccacgtccgtgccagctccccgtgcaaaacaatttcgggcagtgagaaccacagagggcgaggaggagacagaatctagggtgcctgggtctacacgaccacagagaagctttctcagccgggtcgtgagggccgctttaccattgcagttgcttctgcttctccttttgctgctcgcctgcctgctgccttccagcgaggaggactattcatgcacacaggccaataacttcgctcggagcttttatcccatgcttagatatactaatgggcctcctcctacgta

SEQ ID NO: 242078 - DNA, 1290 bp, Artificial Sequence
  Description of Artificial Sequence: Synthetic coding sequence
atggaaggtgataggaacgttccaccagtgccaccggcatcttctaccccttataagcccccatacgggaagctactgctccctcccggtaccgacggcggtaaggagggaccacgcgttctaaacggcaaccctcagcaagaggacggcggattggcagggatcactgaacaacagtctggagccttcgacagatgggagatgattcaggctcaggaactgcacaataaactaaagatcaagcagaacctccagcagctgaacagcgacatcagtgctattacgacctggcttaagaagaccgaggctgaactggagatgctgaaaatggccaaaccaccttctgatatccaagagatagaactgagggtgaagcgcttacaggagatcttaaaggcttttgacacctacaaagctctcgtggtgtccgtgaatgttagtagtaaggagttcctgcaaactgaatcacccgagtctacagaactgcagagcaggcttcggcaacttagcctcctgtgggaagcggctcagggcgctgtggatagctggaggggcggtctccggcagagtctgatgcagtgtcaaggatctaagacacgacctcgcagcgacgtgctgttttttaaggatttccatcagctctcccagaacttgctgttatggctcgcgtccgctaaaaacagaagacagaaggcccacgtgactgatcctaaggcggatccgagagctttactggaatgccggagagaattgatgcaacttgaaaaagaactggttgagcggcaacctcaagtggacatgttacaggagattagcaacagcttattgataaaggggcatggggaggactgcattgaggctgaagagaaggtccatgtcattgaaaagaaactgaaacaactgagggaacaggtgagccaagatctaatggccctacagggcactcagaaccccgcttcccccctgccctccttcgatgaagtggacagcggggatcagcctccagctacttccgtgcctgctccaagggcgaaattcagggccgtgcgtacgactgagggggaggaggaaactgagtccagggtgcccggaagcactcgccctcaacgaagttttctctcgagagtagttagagcggctctccctctacaactcctcctgttattactgttactgctcgcttgcctgcttccaagctccgaggaggattattcgtgtacgcaggctaacaattttgccaggagcttttacccgatgctgcggtatactaacggcccacctccaacctag

SEQ ID NO: 242079 - DNA, 1671 bp, Artificial Sequence
  Description of Artificial Sequence: Synthetic coding sequence
atggaagatcctcgagagattcaaaccgattcctggaggaaaagaggagaaagcgaggaaccatctagtccacaatctctgtgtcatctggttgctccaggacatgagcggagtgggtgcgaaacacccgttagcgtcgactccatcccactagaatgggaccataccggggatgttggtggaagttccagccatgaggaagacgaggaggggccatattacagcgcactgagcgatgttgaaattccagaaaatcctgaagcctacctgaaaatgaccactaaaacactgaaggcatcaagtggcaaaagtatctctgatggacactcgtggcacgtgcccgattccccttcttgccctgagcaccactacaagcaaatggagggcgacaggaatgtacctcccgtgcctcctgcaagcagtaccccttacaagccaccctatgggaaattgcttttgccccctggtacagatggcggtaaagaggggccaagagtactgaacggcaacccccagcaagaggatgggggattagcaggtatcaccgaacagcagagtggggcatttgaccgatgggaaatgattcaggcgcaggagctacacaacaagctgaagatcaaacagaaccttcagcagctgaactctgatattagcgccattaccacatggcttaaaaagactgaggctgaacttgaaatgctgaagatggcaaagcctccctcagacatccaggaaattgagttacgagtcaagaggcttcaggagatcctcaaagccttcgacacatataaagcgttagtggtgtccgtgaacgtgagctctaaagaattcctgcagaccgaatctcctgagagcaccgagctacagtcacggctccgacagctgtctttactgtgggaagcggctcagggcgctgtggatagctggcggggaggcttaaggcagagtcttatgcagtgtcaaggtagtaaaacaagacccaggtctgatgtattatttttcaaggactttcatcagctgtctcagaacctactgctgtggctggccagcgctaagaaccgccgacagaaggcccatgtgacggaccccaaggctgatcccagggcccttctggagtgtcggcgagagctcatgcagctggagaaggagctggtcgaaaggcagccacaagtggacatgctgcaggaaatcagtaacagcctgctgattaagggacacggtgaggactgtatcgaagccgaagaaaaagttcacgtgattgaaaaaaaactgaagcagttaagagaacaggtctcacaggatctgatggctctccaggggacgcagaatcctgcctcccctcttccgtcattcgatgaagtcgattctggcgaccagccccctgccacgtctgttccagcccctcgcgctaagcagttcagagcggtcaggactaccgagggcgaagaggagactgagtcccgggtgccaggctccacgaggccacagcggagcttcttgtctagagtcgtacgcgctgcgcttcctctacagttgttgctgctgctgctgctgcttctcgcctgtttgctgccatcaagtgaggaagactactcctgcacccaagctaataatttcgccagatctttctatccaatgttgcgttataccaatggcccacctcccacctag

SEQ ID NO: 242080 - DNA, 2007 bp, Artificial Sequence
  Description of Artificial Sequence: Synthetic coding sequence
atggtccacgagggaaatcagcgctgggacaatctgcaacggagagtcaccgcagtcctgcggcgactgcgccattttactaaccagcgcgaggaattcgaggggacaagggagagtatccttgtgtggctgacagagatggatctacaattaaccaacgtggagcacttctctgaaagtgacgcagacgataagatgagacaactcaacggctttcagcaggaaattacgctgaacaccaacaagattgaccagctgatcgtatttggagagcagttaatccagaagagcgagcctttggatgcagtgctgatcgaggatgagctcgaggaactgcatagatattgtcaggaagtctttgggagggtttccagatttcatcgacggctgacaagttgtactcctggtctggaggatgagaaagaagcttctgagaatgaaactgatatggaggatccacgtgaaatccagactgactcatggaggaagcgcggagagtccgaagagccaagctcaccccagtcactgtgccatcttgtagcacctgggcacgaaagaagcgggtgcgaaactcccgtctccgttgactcaatcccactggagtgggatcatactggggatgttgggggaagctcaagtcacgaagaggatgaggagggaccctattatagtgcccttagcggaaagtccattagcgatgggcactcatggcacgtgcccgattctccctcttgccctgagcaccactacaaacagatggagggggataggaatgtccctcctgttcccccagcctcaagcactccatacaagcccccatacggaaagctactattgccgcctggaacagatggtgggaaggaagggcctagggttctgaacggaaatccgcagcaggaggatggtggccttgcaggaattaccgagcagcagagcggggcattcgacagatgggagatgatccaggcacaggaactgcacaataaactgaagatcaagcagaacctgcaacaactgaactcggacatcagtgcaattaccacctggctgaaaaagacagaagcggagctggaaatgcttaagatggcaaagccaccttccgatatacaggaaatcgagctgagagtcaagcgtctccaggagatccttaaagctttcgatacctataaggcgttggtggtcagtgtgaacgtcagttctaaggagtttttacagacagaaagccctgaatcaacagaactccagtccaggctgcgtcaattgagtctgttgtgggaggccgcacagggggcagtagactcctggagaggaggcctgcggcagtctttgatgcaatgtcaggatttccaccaactgtcgcagaacctactactgtggctggccagcgctaaaaaccgcagacagaaggcccatgtgaccgatcccaaagcagacccacgcgctttgctagaatgccggagagagctgatgcagttggaaaaggagctcgtggaacgacagccacaggtcgacatgctgcaggagattagtaattccttgcttatcaaagggcacggggaggactgcatcgaggcagaagaaaaggtgcacgtaatcgagaaaaaactgaaacagttgcgtgagcaagtgtctcaggacctgatggctttgcagggaacgcaaaatcccgcatcaccactcccaagtttcgacgaagtcgactcgggcgatcagcctcctgctacgtccgtgcccgctccacgcgcaaagcagttcagggccgtgcgaaccactgagggggaggaagagacagagtccagggtgccgggtagcacccggcctcagcgttccttcctgtcccgcgtagtcagagccgcactgcccctccagctgttactgctactcctactcctcctggcttgtttgctgccaagtagtgaggaagattattcctgcactcaagcaaacaattttgcccgaagcttctacccgatgttgcggtatactaacgggcctccacccacttag

SEQ ID NO: 242081 - DNA, 10626 bp, Artificial Sequence
  Description of Artificial Sequence: Synthetic coding sequence
atggaagaagacatttacactaacctttccaagatggagactgtcttaggccagagcatgtcctccctaccactttcctatcgcgaggcgttagaacggctggagcagagtaaagcgcttgtaagcaatctgatcagtactaaagaagaactgatgaagttgaggcagattctgcggcttctgcgattgagatgtactgagaatgatggcatctgccttttgaaaattgtgagcgcactctgggagaagtggctatccctcctcgaagcagcaaaggagtgggaaatgtggtgcgaggagctcaaacaagagtggaagtttgtgagcgaagaaattgagagagaggcaatcatcttggataatctgcaggaagagctgcctgaaatatcaaagactaaggaggctgcgaccaccgaggagcttagtgagcttctcgactgcttgtgccagtacggcgaaaacgtggaaaagcaacagctgctactgacgctccttctgcagcggataaggtccattcagaatgtgcctgagtcctccggagccgtcgaaactgtaccagccttccaagagattacatctatgaaggagagatgcaataaactgctacaaaaggtccagaagaataaggagctggtccagaccgaaatccaggagaggcattctttcactaaagaaattatagctctgaagaacttctttcagcaaaccacaacctcgttccagaatatggccttccaggaccaccccgaaaagagcgagcaatttgaagaactgcaatcgatcctgaagaagggaaaactgacgttcgagaacatcatggagaagctacgaatcaagtacagcgaaatgtacacaatagtgcctgccgagatagaaagccaggtcgaagagtgccggaaagctctggaggatatcgatgagaagatttccaacgaggttctgaaatcgagtccatcttatgcgatgcgccgtaagattgaagaaataaataatggcttgcacaatgtcgagaagatgctccaacagaagtctaagaacatcgaaaaagcacaggagatccagaagaagatgtgggatgagcttgatctgtggcactctaagctcaacgagctcgatagtgaggtgcaggacattgtggagcaagatccgggacaggctcaggagtggatggataaccttatgatcccattccagcagtaccaacaagttagtcaacgagctgagtgtcggaccagtcagctgaacaaggcaacagtgaagatggaggagtattcagatttgcttaaaagtacagaggcgtggatcgaaaataccagtcatctgctcgctaacccagctgactacgactccctccggaccttgtcccatcacgctagtactgttcagatggccctggaggacagcgagcagaagcacaacctgctgcactccatattcatggatctcgaggacctctccatcatcttcgaaaccgacgagcttacccagtccattcaggagctgtctaaccaagtcacggcactgcagcagaaaataatggaatcactgccacagatccagcggatggcagacgatgtcgtcgctatcgagtccgaggtgaagtccatggaaaaacgcgtgtctaagattaagacgatcctactgagcaaggaaatttttgactttagcccggaggaacacctgaagcatggtgaggtgatattagaaaatatcaggcccatgaagaaaaccatcgccgaaatagtctcttatcaagttgagcttagactgccacaaacaggcatgaagccactcccagtttttcagcggaccaaccagctgttgcaggacatcaagctcctcgaaaatgtgacccaagagcagaatgagcttctaaaggtagtgatcaaacagactaacgaatgggatgaggaaatcgagaatcttaagcagatactgaacaattatagcgctcagttcagcctggaacacatgtcccctgaccaagcagacaaattgccacaactgcagggagagatcgaacgcatggaaaagcaaattctttctctcaatcaacggaaggaggacctgctggtagacctgaaggcaacagtgcttaatcttcaccaacatctgaagcaggaacaagaaggcgtcgagagagatcgtcttccagcagttaccagtgaagagggaggcgtggcagaaagagatgcatcagagcgaaagttaaatcgtcgcggttcgatgagctaccttgccgctgtggaagaagaagtggaagaatcaagtgtgaagagcgataatggcgacgaaaaggctgagccatccccacagtcttggtctagcctatggaagcatgataaggatatggaggaagaccgcgcttcaagcagttccggtaccatcgtgcaggaggcttatggcaagatcagcacctctgacaactccatggcccagattctgacaccggacagtttgaacactgagcaaggacctgagtgtagcttgcgaccaaatcaaactgaggagggcactactcccccaatcgaggctgatactttggatagtagcgatgctcagggcggactggagcctagggtggagaagacacgcccagagcccaccgaggtactgcatgcctgtaaaactcaagtcgctgagctcgagttgtggctacagcaggccaatgttgccgtggagccagaaacgctgaacgccgacatgcagcaggtcctcgagcagcagctagttggctgccaggctatgcttacagagatcgagcataaagtcgcctttctgctagagacctgcaaggaccagggcctgggcgataatggagcgacacagcacgaagctgaagcactgtccttgaagctgaagacagtgaagtgcaatctcgagaaagtacaaatgatgctccaagaaaaacactcagaagaccagcatccgacaatattaaagaagagtagcgaacccgagcaccaggaagccctgcagcctgtgaaccttagtgagctggagtctatcgttactgagcgacctcagttttcccgacaaaaggacttccagcagcagcaggtcctcgagctgaaacccatggagcagaaggatttcatcaaatttatagaattcaacgcaaaaaaaatgtggccacagtactgccagcacgacaacgacacgacacaggagtccagcgccagcaatcaggcatcatcacccgagaatgacgtgcccgactccattttatcgccccagggtcagaatggtgataaatggcagtaccttcatcatgagttaagtagcaagataaagctgccactgccacagctggtggagccccaggtgtcaacaaatatgggtatcctccccagtgttacgatgtacaattttcggtaccctacaactgaggagctgaaaacgtataccactcagctggaagacctccggcaagaggcttctaatctccaaacccaggaaaacatgacggaagaggcatacatcaacctggataaaaagctgttcgagctgttcctcacattgtctcagtgtctgtctagcgtcgaagaaatgctagaaatgccccgactataccgcgaggatgggtcagggcagcaggttcattacgagacgttggcacttgagttaaaaaaattgtatctggccctctcagataaaaagggggacttgctcaaagcaatgacctggccaggggagaataccaacttgctcttggaatgcttcgataatcttcaggtctgtctggaacatacacaggccgcagcagtgtgccggagcaaatcactcaaagccggactggattataacagatcctatcaaaacgaaatcaagaggctttaccatcagcttatcaaatccaagacctcgctccagcagtccttaaatgagataagcggccagtctgtcgcagaacagctgcagaaggctgatgcctacactgtagagttggagaatgccgagagtagggtggccaagctacgggacgagggtgaaaggcttcatcttccatacgccctgctgcaggaggtatataaactggaagacgtcctcgactccatgtggggaatgctcagagccaggtacaccgagctatctagtccttttgtgacagagagccagcaggatgcgttgcttcagggaatggtggaattggtcaaaatcggaaaagagaagctggctcacgggcacttgaagcagacaaaaagtaaggtcgctcttcaggcccagattgaaaatcataaagtgttcttccagaaactggtggcagacatgctattaatccaagcctactcagccaaaatcctgcctagcttactccagaatagagagacattttgggcggagcaggtcacagaggttaaaattctggaggaaaagagccggcaatgtgggatgaagctccaatctctgttgcagaagtgggaagaattcgacgaaaactacgcctccctcgaaaaagacctcgagattctcatctccactctcccgtctgtcagcctggtagaggagacagaggaacgattggtagagcgcattagtttctatcagcaaataaagcgtaatattggcggaaagcatgcacgcctgtaccagacactgaatgaaggaaaacagttagtagccagcgtcagctgccctgagcttgaagggcaaatagccaagctggaagaacagtggctttctcttaataaaaagattgaccacgagttgcaccgcctccaggctctcttgaaacacttactttcttataatagggattctgatcagttaaccaaatggctagagagcagccagcacaccctaaattattggaaagaacagagcctcaatgtttcccaggatcttgataccatccgctccaatattaacaacttcttcgaatttagcaaagaggtggatgaaaagagtagccttaaaaccgcggtgatcagcatcgggaaccagctgctccatctcaaggagaccgacactgccactctgcgtgcgagcctggcacagttcgagcagaaatggaccatgttaatcacgcagctgccagacatccaagaaaaattgcaccagcttcagatggagaagctgccatcacgaaaagccatcaccgagatgatcagctggatgaacaacgtcgaacatcagacatccgacgaagattcagtgcattctccatccagcgcctctcaagtcaagcacttgctgcaaaagcataaggaattccgcatggagatggactacaagcagtggatagtcgattttgttaatcagagtctcctccagttgtctacttgtgatgtggaaagtaagcggtacgagcgaaccgagttcgccgagcatctgggcgagatgaaccgacagtggcaccgggtgcacggaatgctaaatagaaagattcaacaccttgaacagttgcttgaatctatcactgagagcgagaacaaaatccagattttgaacaactggcttgaggcacaggaagaaaggctaaagacacttcagaaaccagagtctgttataagcgtccagaaattgctgctcgactgtcaagacattgaaaatcagctcgccatcaaatcgaaggccctggacgaactgaagcagtcttatctgaccctggaatccggggctgtgcctctgctggaggatacagcaagcaggatcgatgaactgtttcagaagcggtctagtgtgctgacccaggtgaaccagcttaaaacctcaatgcaaagtgtgctacaagagtggaagatctacgaccaactgtatgacgaggtcaacatgatgacgatacgcttctggtactgtatggagcactccaaaccagttgtgctctcacttgagacgctccggtgtcaggtggagaacctccaaagcctgcaggacgaggccgaaagtagcgaggggtcatgggagaaactccaggaagtgatcgggaaattgaaaggcttgtgtccctctgtcgctgaaatcatcgaggagaagtgtcagaatacccacaagcggtggacgcaagtgaatcaggccattgccgaccaacttcagaaggcacagtcactgcttcagctttggaaagcgtattccaacgcccacggggaggcggcagccagactaaagcagcaggaagctaaattccagcagctggcaaatatcagcatgtcagggaacaacctggccgagattctgcctccggctctgcaagatattaaagaacttcagcatgatgtgcaaaaaaccaaggaggctttcctgcagaactcctccgtgctggaccgcctcccgcagcctgccgagagctctactcacatgttactgccaggacctctgcactccctgcaaagagcagcatatcttgagaagatgctcttggtaaaagccaatgagtttgaatttgtgctatcccagttcaaagactttggggtgcggctcgagtctttgaaagggctgattatgcacgaggaggaaaacctcgacagactccaccagcaggagaaagagaaccctgactcttttttgaatcacgttctggccctcaccgcacagtcccctgacatcgagcatcttaatgaggtgagcctcaaactgcctctgagcgatgtagcggtaaaaaccctgcagaatatgaatcgacagtggataagagccacagccaccgccctggaaaggtgcagcgagctccagggtatcggtctgaatgagaaattcttgtactgctgtgaaaagtggatccagttgttagagaagattgaagaagccctaaaagttgatgtggctaactctcttccagaactgctggagcagcagaagacgtataagatgctcgaggctgaagtgtccataaaccagaccattgcagactcctatgtcacccagtcattacagctcctggacacaacggagatcgaaaaccgccctgaatttataacggagttttctaaactgactgaccggtggcaaaatgccgtccagggcgtcagacagcgaaaaggtgacgttgacgggctcgtgaggcaatggcaggacttcaccacaagcgtcgagaacctgttcagattcttgacagacacatcacatctgctctctgctgtcaaaggccaggagagattttccctgtaccagactcgctctctcatccacgagttgaagaacaaggaaattcattttcaaaggaggcgaacaacttgcgcattaacactggaggctggggagaaactgctcctgaccacggacttaaagacaaaggaatccgtgggacgcaggatttcgcaacttcaagacagctggaaggatatggaaccacagctggccgaaatgataaagcaattccagtctaccgtggagacgtgggaccagtgcgagaaaaagattaaggaactcaaaagcagactccaagtgctcaaggctcagtcggaggatccgcttccagagttacacgaagacctgcataatgagaaagagttaattaaggagttggagcagtctctcgcaagttggacacagaacttgaaagagctgcaaactatgaaggccgatttgacccgacacgtcctggtcgaagacgtgatggtgctgaaggaacaaatcgagcatctccaccgccagtgggaggatctctgcttacgggtggctataaggaagcaagagatcgaggaccgtctgaacacttgggtcgtgttcaacgagaagaacaaggagctctgcgcctggctcgtgcaaatggagaacaaagtcctgcagacagccgatattagtatcgaagagatgattgaaaagttgcagaaggattgcatggaggagatcaatctgtttagcgaaaacaagctgcaactaaagcagatgggggaccagttaatcaaagcgagcaacaaaagccgagccgctgaaatcgatgacaagctgaataagatcaacgaccgatggcaacatcttttcgacgtgatcggcagtcgtgtcaagaagctgaaagagacttttgcattcattcagcagctggacaagaacatgtcaaatttgaggacatggctcgctcggattgaatcggaactgtccaaacccgtggtgtatgacgtttgtgatgaccaggagatacagaagagactcgctgaacaacaggacctgcagagggacatcgagcaacatagtgcaggtgtagaatccgttttcaatatctgcgacgtgctgttacacgattccgacgcatgtgccaacgaaacggagtgcgattccattcaacaaaccaccagaagcctggaccgcagatggaggaacatttgtgccatgtccatggagagacggatgaagattgaggagacatggcgcctttggcaaaaattcctggatgattatagccgtttcgaggactggcttaaatccgccgagcggacagccgcatgtccgaactcatcagaggtattatacacgtcagccaaggaagagctgaagcggttcgaggcttttcaacggcagatacacgaacgcctgacgcagttggagctcatcaacaagcaatatcgcaggctggctagagaaaacaggacagacacggcctcgcgcctcaaacagatggtccatgagggaaatcagagatgggacaatctccaaagaagagtgacggcggtgctgcggcgacttcggcactttaccaatcaacgcgaagaatttgaagggactagagagtcaatcctcgtatggcttaccgagatggatttgcagctgacaaacgtcgagcacttcagcgagtcagacgctgatgacaaaatgagacagctgaacggcttccagcaagagatcacactgaacaccaacaagatcgatcagctcatcgtgtttggagagcagctgatacagaagtccgagccgctggatgccgtgctgatagaggatgagctggaggagctacaccgctactgtcaggaggtatttgggagagtaagcaggttccataggcgcctgacttcctgtacacccggactggaagatgagaaagaggcctcagagaatgaaaccgatatggaggatccgagagaaatccagacagactcctggagaaagcggggagagagtgaggaaccctcttctcctcaatccctttgccacctcgtggcccctggtcacgaacggtccggatgtgaaacgcctgttagtgtggatagcattccccttgagtgggatcacacgggggacgtgggtggatcaagctctcacgaggaggacgaagaaggtccctattactccgcactctcggacgtggagattccagagaacccggaagcttacctgaagatgacaaccaaaacgttaaaggcaagtagtggcaagtcaatcagcgatgggcattcatggcatgtgccggactccccaagctgtcctgaacatcattacaaacagatggaaggcgataggaatgtcccacctgtcccgcctgcttcctcgacaccctacaagcccccttatggaaagctcctcctgccccctggaaccgacggaggaaaggaagggcctcgtgtgttgaacgggaacccccagcaggaggacggaggacttgccggtattacagagcagcaatctggcgcattcgaccgctgggagatgattcaggctcaggaactgcataacaagctgaagataaagcagaatttacaacagctgaactcagatatcagcgcgattacaacatggctgaaaaaaactgaagcggaactggagatgctgaagatggctaaacccccatctgacatacaggagatagaattgcgcgtaaaacgcctgcaggagattttaaaggcatttgatacttataaagctctggtggtctccgtcaacgtttcatcaaaagagtttctgcagaccgagagccctgaatcaacagaactccagagtagattaaggcaactctcactgctatgggaggccgcacaaggtgccgtggatagttggaggggtggactgcgacagagcctgatgcagtgccaggactttcatcaactgtcccagaacttactgctgtggctggcatccgctaagaataggagacagaaggcacatgtgaccgacccaaaggccgatccaagagccctgctcgagtgtcggagggagctgatgcagctcgagaaggagctggtggaaagacaaccccaggttgacatgcttcaagagattagtaactctctactgataaagggccacggagaagactgcatcgaggcggaagagaaggtgcacgtgatcgagaaaaaattgaaacagctgagagagcaggttagccaggatttgatggcattacaggggacacaaaaccctgcaagcccattgccctcctttgacgaggtcgactccggcgaccaacctcccgctacatctgttcccgcaccgagggccaagttcagggccgttcggacgaccgagggcgaggaggagacagagtccagagtgcccggatccacccgtcctcagcgttcctttcttagccgcgtggtgcgcgcagcgctgccgctgcagctcctgctgctgctgctcctgttacttgcatgcctgctaccgtcctctgaggaagattattcgtgtacccaggcaaacaacttcgccaggagtttttatccaatgttaaggtacaccaacggtccaccccctacataa

SEQ ID NO: 242082 - DNA, 2292 bp, Artificial Sequence
  Description of Artificial Sequence: Synthetic coding sequence
atgagtatggagaggaggatgaaaattgaggagacctggagattgtggcagaaattcctcgacgactatagccgcttcgaagactggctgaaatctgccgagcgcacagcagcttgtccaaactcatccgaagttctgtatacctcagccaaggaagaactgaaaaggtttgaggcatttcagcgccaaatccacgagagactcactcagcttgagctcataaataagcagtatcggcgattagcgagggaaaaccgcactgacaccgcctcacggctcaaacagatggtgcacgaaggcaaccagcgctgggataacctccagcggagggttaccgctgttttgagacggctgcggcactttaccaatcagagagaagagttcgagggcacacgcgagagtattctggtgtggctgacagagatggatctccagctgactaatgtagagcacttttccgaatcagacgctgatgataagatgcgacagttaaatggattccagcaggagataactcttaacaccaacaagatcgaccagttaatagtgttcggggagcaactgatacagaaaagcgaacctctggatgctgtgttgattgaggatgaactagaagaactgcacaggtactgccaggaggtgtttggtagggtgtcccggtttcacagacgccttacctcttgcaccccaggactcgaggatgaaaaggaggcttctgagaacgagacagatatggaggatcccagggagatccaaactgatagttggcggaaaagaggcgagtccgaggagcctagcagtcctcaaagtctgtgccatctggtggcccctggccatgagcgtagtggatgcgagacaccagtgagcgttgacagcattcctttggagtgggatcatacaggggacgtcggaggatcttcttctcatgaagaggatgaagaagggccatactattctgccctgagtgggaagagcatttcggacggccacagctggcacgtgcctgacagtccatcttgccctgagcatcactacaaacagatggagggagaccggaatgttccccctgtcccaccggcttcctctaccccttataaacccccttacggcaagctactattgccccctggcacggacgggggaaaagaagggcctagggttcttaacggtaatcctcagcaggaggatggaggtctggcaggcatcacagaacaacagagcggcgcattcgacagatgggaaatgatccaagcccaggaattgcataacaaactcaagatcaaacagaacttgcaacagttgaattcagatatatcagctattaccacttggctcaagaaaacagaagcagaactcgaaatgctgaagatggccaagccaccgagcgatatccaggagatcgagcttcgagttaagcggttgcaggagatcctgaaagccttcgacacatacaaggctttagtcgtgagcgtcaacgtcagcagtaaagaattcctgcaaactgagagcccagaatcgacagagctgcagagtagactgcgtcaactgtccctgctctgggaggcagcacagggagctgtggactcatggcggggtgggctgagacaatcacttatgcagtgccaggactttcaccagttatcccagaaccttctgttatggctggcttcggcaaaaaacaggaggcagaaggcacacgtcaccgaccccaaggccgaccctcgcgcactcctggaatgtcgtcgagaattgatgcagctggaaaaggaactggtggaacgtcagccacaggtcgatatgctgcaggagatcagcaattcactcctgatcaagggccacggagaggactgtattgaagccgaggaaaaagtgcacgtcatcgagaaaaaactgaaacaactccgcgagcaggtgtcacaagacctaatggcccttcagggtacgcagaaccccgctagtcctcttccctcattcgacgaggtcgattccggggaccagcccccagccacatccgtccctgccccaagagcaaagcagtttagggccgtgcggacaactgaaggcgaggaagagactgagtccagagtgccaggcagtacgaggccccagcggagctttctcagcagagttgttagggcagcgctaccactacaactactgcttctcttgttactcctgctggcctgtctcttgccgagctccgaggaggattactcgtgtacacaggccaacaatttcgctcgcagtttctatcctatgctccgttatacgaacggtccaccccctacatag

SEQ ID NO: 242083 - DNA, 7250 bp, Artificial Sequence
  Description of Artificial Sequence: Synthetic coding sequence
atggagcagttccccaaagagaccgtagttgaaagctcaggcccaaaggtgctggagacagctgaggagattcaagaaagaaggcaagaggttctgactaggtaccagtccttcaaagagcgagtggccgaaagagggcaaaagttggaagacagctaccacctgcaggtatttaagcgagacgcagatgatctcgggaaatggattatggaaaaggttaatatcctgaccgacaagtcttacgaggaccccaccaatatccaagggaagtaccagaagcaccagtctctcgaagcagaagtgcagactaagtccaggcttatgtccgagctggaaaaaacccgagaagaacgctttaccatgggacattcagctcacgaggagaccaaggcacatatcgaggaactccgtcatctctgggatctgctgctggagcttactcttgaaaaaggtgaccagctcctcagggccctgaagtttcagcaatacgtgcaggaatgtgccgacatccttgaatggatcggagacaaggaagctattgcaaccagtgtggagctgggcgaggattgggaaagaacggaggtgttgcacaaaaaatttgaggattttcaggtggaactggtggctaaggagggtagagtagtggaggtgaatcagtacgccaacgaatgcgccgaggaaaatcatcctgatcttcccctaatccagtctaaacagaacgaagtgaacgccgcatgggaacggcttcgcggactggccctgcagagacagaaggctctgtccaacgccgctaacttgcagcggtttaagagagatgtcacggaagcaattcagtggatcaaagagaaggaacctgtgttgacatctgaagattatgggaaggacctggtggcatccgagggtctgttccactctcataaagggctagagaggaacctggccgtgatgagcgacaaggtgaaggagctctgcgcgaaagccgagaaactgactctgtctcaccccagcgacgcccctcagatacaagaaatgaaggaagatttggtgtcctcatgggaacacattagggctttagccacctcgcggtacgaaaagctccaagcaacctactggtatcaccggttctcttccgatttcgacgaactgagtggatggatgaacgaaaaaactgctgcaataaacgcagacgagctccctacagacgtggccggaggtgaagtcctgctggatagacaccagcagcataaacatgagattgatagctacgatgatagattccaaagcgctgatgagacaggacaagacctcgtcaatgcaaaccacgaggccagcgatgaggtacgggagaagatggagatactcgacaacaattggaccgcgctgctcgaattatgggatgagaggcacagacagtacgagcaatgccttgacttccatctgttttatagggactccgaacaagtggactcgtggatgtcaagacaggaagccttcctcgagaacgaggatcttggaaactccctgggctctgctgaggctctgctgcaaaaacatgaggacttcgaggaggcattcacggcgcaagaagagaagattatcaccgtggacaaaacggctacaaaactaataggcgacgaccactatgattccgaaaacatcaaagctattagggacgggctgttggctcgcagagatgctcttagggaaaaggccgctacccgaaggaggctgctgaaagaaagcctgctgctccagaaactgtacgaagattcagacgatctcaagaactggatcaataagaaaaagaagctggccgatgacgaggactataaggacatccagaatctgaagtcccgcgtccagaaacaacaggtattcgagaaggaactagcggtcaataagactcagttagagaatatacagaaaacaggccaggaaatgatcgaagggggtcactacgcctcggacaatgtgactaccagactaagcgaggtggcaagcttgtgggaagagttactggaagccaccaaacagaagggaactcaacttcatgaggccaatcagcagcttcagtttgaaaacaatgccgaggacctgcagcgatggctggaggacgtggaatggcaggtgactagcgaagactatggcaagggcctggcagaggtacagaatcggctgcggaagcacggactcctggaaagcgctgtggctgctaggcaggatcaggtggacatcctaaccgatcttgccgcttacttcgaagagatcgggcacccagattctaaggacatcagggccaggcaagaatccctcgtctgtagatttgaggctctgaaagaacctcttgctacccgcaaaaagaaactcctggacctactgcacttacaactcatttgccgcgacacagaagacgaggaagcttggatccaagagaccgaacctagcgctacttctacttacctcgggaaggatctgatcgcaagtaagaaattattgaatcggcatcgagtgatactggagaatatagctagtcatgagcctcgcatccaggagatcacagaacgagggaacaagatggtggaagaaggacacttcgcagctgaggatgtggccagcagagtgaaaagcctgaatcagaatatggagtccctccgagctcgcgcagccaggaggcagaacgacttggaggccaatgtgcagttccagcaatatttagcagacttgcatgaagcagagacctggataagagagaaagaaccaatcgttgataataccaactacggggcagatgaggaagctgccggtgctttgctaaagaagcatgaggcctttttacttgatctcaattccttcggggattccatgaaagcactgcggaatcaggccaacgcatgtcagcagcaacaggcggcacccgtggagggcgtggcaggcgaacagcgcgtcatggctctgtacgactttcaggcgaggagccccagggaggtcaccatgaagaaaggggatgtgctcacccttttgagcagcataaacaaagattggtggaaggttgaggctgcggaccatcaggggatcgtgcctgctgtatatgttaggcgactggcgcacgacgaattccctatgcttcctcagagacgccgtgaggagcctggtaatatcacacagcgccaagaacagatagaaaaccagtatcgctctttgctcgatagagcggaagagcgaaggaggcgactgctgcagcgatacaatgagttcttactggcgtacgaagcaggtgatatgctcgagtggatacaagaaaaaaaggcggagaatactggggtggagctggacgatgtgtgggaattacagaaaaaatttgacgaattccaaaaggacttgaatacaaatgaacctcgactgcgcgatatcaataaagtggccgacgacttgctttttgaaggcctgctgaccccggaaggagcacaaattcgtcaagagttgaatagccgctggggcagtctgcagaggctcgccgacgaacagcgccaattgctcgggtcagcccacgctgtagaggttttccaccgcgaagctgacgatacaaaagaacagatcgagaaaaaatgccaggccctgagcgccgctgatccaggaagtgatttgttttcggtccaagcgctccagcgtcggcatgaaggcttcgagcgggatctggtgcctttgggagataaagtgaccatccttggggaaaccgccgagcgcctgtctgaatcccatccagacgccactgaggatttgcagcgtcagaagatggagctcaatgaggcgtgggaggatcttcaaggccgaaccaaggacaggaaagaatctctgaacgaagcccagaagttttatctgttcctcagcaaagcacgcgacctgcaaaactggattagctccataggaggtatggtctcctctcaggagctggctgaagacctgactggaattgagattcttctggagagacaccaggaacatcgcgcagacatggaggccgaggcccctacctttcaagccctcgaggatttcagcgctgagctgatcgattcaggtcaccacgcatcccccgaaatcgaaaaaaaactgcaggctgtgaaattagaacgcgacgacctggaaaaagcgtgggaaaaacggaaaaagatcctggatcaatgtctcgagttacagatgtttcaagggaactgtgaccaagtggagtcttggatggtcgcaagagaaaatagtctgcgctccgacgataaaagttcgctagatagcctggaggctttgatgaagaaaagggacgatctggacaaagcgattaccgcccaggagggaaagattaccgacctggaacatttcgccgagtctctaattgccgacgaacattacgctaaagaggagatcgcgacccgactgcagcgcgtgttggaccgatggaaggcccttaaggcacagctgatcgacgagcgcaccaagctgggcgactacgcaaatctgaaacagttctatcgcgaccttgaagaattggaagagtggatctcagagatgctccccaccgcgtgtgacgagtcttataaagatgctacaaatatacaacgaaagtatctgaaacatcagactttcgcacacgaggtggatggccgatccgagcaggtgcacggggtgatcaatcttggcaattcactgatcgagtgttccgcatgcgatgggaatgaagaggccatgaaagaacagctagagcagctcaaagaacactgggatcatctgttagagcgcacgaacgacaaaggcaaaaaactgaacgaggcttccaggcagcagcgctttaatactagcattagagatttcgaattttggctcagcgaggccgagactctgctggctatgaaggatcaggccagggacctagcatcggctggaaacctgctgaaaaaacaccagctacttgaaagggaaatgcttgcccgagaagacgcactaaaagatctgaacacccttgcagaggatttgttgagctcgggaacatttaatgtcgaccaaatagtgaagaaaaaggataatgtgaataaaaggttcctgaacgtgcaagagctggccgcagcacaccatgagaagctcaaggaagcttacgccctgtttcagttcttccaggatctggatgacgaggagtcttggatcgaggagaagctcatcagggttagcagtcaggactacgggagggatctgcagggagtacagaatttgctgaagaaacacaagcgcctggaaggagaattggtggcacacgagcccgcaattcaaaatgtgctggacatggcagagaaactaaaggacaaggccgctgtgggtcaggaagaaatccagctgaggttagcccagttcgttgaacattgggagaagttgaaggagctcgctaaggccaggggactgaagcttgaggaatcattggagtacctccagtttatgcagaacgccgaggaggaggaagcctggatcaacgaaaaaaacgctttggccgtgaggggggattgcggcgatacactggccgcaacccagtccctgctgatgaagcacgaggcactggagaacgacttcgccgtgcacgaaactagggtgcaaaacgtgtgcgcgcaaggggaggacatcctgaataaagaggaaagtcagaataaggagatttcctcaaaaatagaggctctgaacgagaaaaccccatcccttgccaaggcgatcgccgcatggaagttacaactggaggatgactatgcgttccaggagtttaactggaaggcggacgtggtagaagcatggatcgcagacaaggaaacttcattgaagaccaatggcaacggggcagatctgggcgactttctgaccctgctggctaagcaagatactcttgatgccagcttgcaaagctttcagcaggaaaggctaccagaaattaccgatctcaaggataagcttatatccgcgcaacacaatcagtcaaaggccatcgaagagcggtacgccgctttgctgaaaaggtgggagcagctgttggaggcctcggccgttcaccgccagaaactcctcgagaagcagctgcctctgcagaaagctgaagatttattcgtggagttcgcgcataaggcgtcagcccttaacaattggtgtgaaaagatggaagaaaacctgtcagagccggtccactgtgtcagtctgaatgaaattcgccagctacagaaggatcacgaggattttctcgcctctctggcaagggctcaggcagatttcaagtgtctgctagaattagatcagcagattaaagctctcggcgtgcccagtagtccttatacatggctgaccgtggaggttctggagcgaacatggaagcaccttagcgatatcatcgaagagagggagcaggaattgcagaaggaggaggcccgacaagttaaaaactttgaaatgtgccaggaattcgaacagaacgccagcacattcctgcaatggatactggagacaagggcatacttcctggacggctcgctgctgaaggagaccggtactcttgaaagccagctcgaagccaataaaaggaagcagaaggaaatccaggccatgaaaagacagctgactaaaatcgtagacctgggagacaatcttgaggacgccttgatcctggatattaagtactccaccatcggcctggcccaacagtgggaccaattgtaccagcttggtctgcggatgcaacacaacctcgagcagcagatccaggcaaaggacataaagggcgtgtctgaggagaccctcaaggagtttagcactatttataaacactttgacgaaaaccttaccggccgtctcactcacaaggagttccggtcttgcctcagggggctgaactactacctcccaatggttgaggaggatgaacatgaacctaaattcgagaagttcctggacgctgtcgaccccggaagaaagggctatgtcagcctagaggattatactgcgtttctgattgacaaggaaagcgaaaatatcaagagctctgacgaaatagagaacgccttccaggccctcgctgagggtaaatcctatataactaaggaagatatgaagcaggccctaacaccagagcaggtgtctttctgcgcaacacacatgcagcagtatatggacccgaggggcaggtctcatctctccgggtacgactacgttgggtttaccaattcctacttcggaaacta

SEQ ID NO: 242084 - DNA, 7259 bp, Artificial Sequence
  Description of Artificial Sequence: Synthetic coding sequence
atggagcaatttcccaaagaaactgttgtcgaatcaagcggccctaaggtccttgagactgccgaggaaatccaagagagaaggcaggaggtgctcacaagatatcaaagctttaaagaaagagtcgctgagaggggtcagaagcttgaggactcctaccacttgcaagtcttcaaacgggacgcagacgacctggggaaatggatcatggaaaaagtcaacattctgaccgacaagtcctacgaggatcctaccaatatccaggggaagtatcaaaaacatcagagcctggaggccgaggtacaaaccaagagtcggcttatgtcagaactggaaaagacgcgggaggaaagattcacaatgggacattctgctcacgaggagacaaaggctcacatcgaagagctgcgccatctttgggacttgcttttggagctcaccctggaaaagggcgatcaacttttgcgcgctctcaagtttcagcagtacgtccaggaatgcgccgatatattagaatggatcggagataaagaagccatcgctacatccgtcgagttgggcgaggattgggagaggactgaggtcctccacaagaagttcgaggacttccaggtggaacttgtggccaaagaaggaagggtggtggaagtcaaccagtacgccaatgagtgcgccgaagagaatcatcctgacttgcctctaatccagtccaagcagaatgaggtcaacgcagcatgggaaagactacgcggtctggctttgcagcgccagaaggccttaagtaacgccgcaaacctacagcggttcaaaagagacgtcactgaagcaatacagtggatcaaggaaaaagaacctgtgttaacaagcgaggattacggcaaggaccttgtggcctctgaggggcttttccactcccacaaaggattggagcggaacctggcagttatgagcgataaagtcaaggaactatgcgccaaagccgaaaagctgacactgtcccatcccagtgatgcccctcagattcaggagatgaaggaggacctggtgtcttcatgggagcacattcgagccctggccacgagtcggtacgagaagttacaagccacttattggtaccacagattttccagcgactttgatgagttatctgggtggatgaatgagaagaccgctgcaatcaatgctgatgaactgccgaccgatgtggctggcggagaagtgttattggaccgccaccagcagcacaagcacgaaattgattcatacgatgaccggttccagtccgccgatgagactggccaggatttagtgaatgctaaccatgaagcttccgatgaagtacgagagaagatggagattctagacaacaactggactgccctcctcgagctgtgggatgagaggcacagacagtatgagcagtgtcttgattttcacctcttctatagagattctgagcaggtggattcctggatgtcccgccaggaagcctttcttgagaatgaggaccttgggaactctctagggtcagccgaggccctgcttcaaaaacacgaggactttgaggaggctttcacagcccaggaagagaagataatcacagtcgacaaaacagcgacaaaactgatcggggacgaccactatgattcggaaaatattaaagccataagagatggcttacttgctcggagggacgctctgagagaaaaagcggctaccagacgcagactgctgaaagagagtctcctactccagaagctgtacgaggattccgatgacttaaaaaattggattaacaagaaaaagaagctagctgatgatgaggactataaagatattcaaaacctaaagtctagagtccagaagcagcaggtttttgagaaggaactggcagtcaacaaaactcagctggaaaatatccagaagacaggtcaggagatgatcgagggcggtcactatgcatccgacaacgtgacgaccaggctgtccgaggtggcctctctgtgggaggagttactagaggccactaagcagaaggggactcagctgcatgaagccaatcagcagttacaattcgagaataatgcagaagatctgcagcgctggctggaagacgtggagtggcaagtcaccagcgaagattatgggaaggggctcgcagaggtgcagaatcggctgcggaaacatggactcctcgaatccgccgtagcagccaggcaggaccaagtggatattttgaccgacttagccgcatactttgaggagataggtcatcctgactcaaaagatattagagcacgtcaggagtccttggtgtgccgcttcgaagcacttaaagagccactcgccacgcgtaagaagaagttgcttgacctgcttcatctgcaattgatatgtcgagataccgaggatgaagaggcgtggatccaggagaccgaaccctccgcgacgtccacgtacctcgggaaagacctgatcgccagcaagaagctgctgaaccggcatagggtgatacttgagaacatcgcgagccatgagcctcggatacaggagatcaccgaacgcggtaacaaaatggttgaagaaggtcacttcgcagccgaagatgttgcaagccgggtgaagagtcttaaccagaatatggagtcactgagggctcgggctgccagaaggcaaaatgatctggaagcaaacgtacaatttcaacaatatttggctgaccttcacgaagctgagacatggattagggaaaaggagccaatcgtggataacaccaattacggtgcagatgaggaagcagctggcgctctgctgaaaaaacatgaagccttcttactggatctgaatagtttcggagattccatgaaggccctgagaaaccaggctaatgcctgccagcagcagcaggcagctccagttgagggcgtcgcgggagagcaaagagtgatggccctgtacgatttccaggccagatccccgagagaggtcacaatgaaaaaaggcgacgtgcttactctgttgtcaagcattaacaaagattggtggaaggtggaggctgcagatcaccaaggtattgtgcccgctgtctacgtccggaggcttgcccacgacgaatttccgatgctgccccaacgccgacgggaggagccgggaaacatcacacaacgtcaggagcagatcgagaatcaatataggagcctgctcgatcgtgccgaagaacggaggcggagactgttgcagcgctacaatgaatttcttctcgcatacgaggccggagatatgctggaatggatacaggagaagaaagctgaaaacaccggggttgagcttgatgacgtttgggagctgcagaagaagttcgacgagttccagaaagaccttaacactaatgaacctagattaagagacattaacaaagtagccgacgacctgctgtttgaagggctgctgaccccagagggagctcagatccgccaggaattgaactccaggtgggggtcacttcagcggctggccgatgaacagcgccaattgctagggagcgcccatgctgtggaggtattccatagggaggctgacgacaccaaggagcagattgagaaaaagtgtcaagcattgtctgctgcggaccccggaagcgatctcttcagtgtacaggccctgcagagaagacatgagggattcgaacgggatttagtcccattaggggacaaagtgacgattctcggcgagaccgctgagaggctctccgaaagtcatcctgatgcgacggaggatctgcagagacagaaaatggagctgaacgaggcctgggaggatctgcaaggacgcaccaaggaccgaaaggagagcctaaacgaggcacagaagttctacctatttcttagcaaggccagggatttacaaaattggatatcatctattgggggtatggtgagttcgcaagaactcgccgaagatttgaccggaattgaaattttgctggagcggcatcaagagcatagggccgacatggaggctgaagcacctacttttcaagctcttgaggatttcagcgctgagctgatcgatagtggccaccacgcttccccggagattgagaagaaactgcaggcggtcaaattagaacgcgacgatcttgagaaagcctgggagaagcggaaaaaaatcctggatcagtgcctggaactgcagatgttccaagggaactgcgaccaagtggaaagctggatggtggctcgcgaaaattcacttcgatctgatgacaaaagcagcctggacagtctcgaagctcttatgaaaaaacgagatgacctggataaggccataaccgcccaggaaggaaaaataactgacttggaacatttcgctgagtcactcatagctgatgagcattatgcaaaagaggaaatagcgaccaggctgcagcgggtgctggaccgttggaaggcactcaaagctcagctgatcgatgaaagaaccaagctgggggattatgccaacctgaagcagttttacagggatctcgaagagctggaagaatggatttctgagatgctccccactgcctgcgatgaatcgtataaagatgccacgaacatacagcgaaagtatctgaagcatcagacatttgcacacgaggtggatggcagatcagagcaggtccatggcgtcattaatctgggcaattctttgattgaatgcagtgcgtgcgacggcaatgaggaggcgatgaaggaacagcttgagcagctaaaggagcactgggaccacctgttggagcgtacaaacgacaaggggaagaagcttaatgaggcctcaagacaacagagatttaatacaagtatcagggactttgaattttggctgtccgaggctgagacacttttggctatgaaagaccaggcccgagacctggcttcagccggaaacctcctgaagaagcaccaactgctggagcgagagatgttggctcgggaggatgcactcaaggatctaaataccctcgcagaggacttgctctcatctggcacatttaacgtggatcaaatcgttaaaaagaaggacaatgtcaataagagattcctgaatgtgcaagaattagcggctgcacatcacgagaagctgaaagaggcctatgccctttttcagttcttccaggatctggacgacgaagaaagttggatcgaagagaagctcattcgggtgagcagccaggactatggcagagacctccagggagtgcagaaccttttgaagaagcacaagcgattagaaggagaactggtagctcatgaaccagcgatccaaaacgtcttagatatggcagagaagcttaaggataaggccgcagtgggacaggaagagatccagttaaggctggctcaattcgtggaacattgggagaaactgaaggagctcgctaaggcgagggggttgaaactggaggaatctctagagtatctgcaatttatgcagaatgctgaagaggaggaggcctggatcaacgagaagaacgccctggccgtgcgcggtgactgtggggataccctggccgcaacccagtccttacttatgaaacacgaagccctagaaaatgacttcgccgtacatgagaccagggtgcagaacgtgtgcgcacagggcgaggacattctgaataaagtcttgcaagaagaaagccagaataaagagattagctctaaaattgaggccctgaacgagaaaaccccctcactggcgaaagccatcgctgcgtggaagcttcaactcgaggacgactacgcattccaggaatttaactggaaggctgacgttgtggaggcctggattgccgacaaagagacatctctgaagaccaacggaaacggcgcagacctgggtgattttttgaccttgttggccaaacaagacacacttgatgcaagtctgcagtccttccagcaggagcggctccccgagattaccgacctgaaggacaagctgatcagcgctcagcataaccagtccaaagctattgaagaacgatatgctgccctgcttaagcggtgggaacagctgctagaagcttccgcagttcaccgccaaaaactgctggagaaacaactgcctttgcaaaaagccgaggacctgttcgttgaatttgctcataaagcctcagctttgaacaactggtgcgagaagatggaggaaaatttgagcgagccagtgcattgtgtttcgctgaacgagattcgccagctccagaaagaccacgaggacttcctggcaagtctcgcacgtgcacaggccgattttaagtgcctcctggaactggatcagcagatcaaagccttaggggtgccttcctctccatacacctggcttacagtggaggtgcttgaacgcacctggaagcatctaagcgatataatcgaggagcgtgagcaggaactccagaaggaagaagcgaggcaggttaaaaatttcgaaatgtgccaagagttcgagcagaatgctagcacttttctacagtggattcttgagacccgggcatactttctcgatggcagtcttcttaaagaaaccggcactctggagagccagctggaggctaataagcgcaagcaaaaggaaatccaggcgatgaaaaggcaactgacgaagatcgtggatctgggtgacaatcttgaagatgcccttattctcgatattaagtattcgaccataggcctcgcccagcagtgggaccagctataccagctggggcttagaatgcagcataacctggaacagcagatccaggctaaagacataaaaggcgtcagcgaggaaactctgaaagaattttctactatctacaagcactttgatgagaacctgactggccgtctgacgcataaagagtttcgctcttgcctgagaggccttaactattacctccctatggtggaggaggacgaacatgagccgaagttcgaaaagtttctcgatgctgtggaccccggtagaaagggttatgtatcactggaggactatacggcgttccttatcgataaggagtccgaaaacataaaaagttcagatgagatcgagaatgcgttccaggcgctcgcagaaggaaaatcctatattaccaaagaggatatgaaacaggctctgacccctgagcaggtaagtttctgtgctacgcatatgcagcagtacatggaccccagaggcagatcccacctgagcgggtatgactacgtgggattcaccaatagctatttcggaaatta

SEQ ID NO: 242085 - DNA, 7433 bp, Artificial Sequence
  Description of Artificial Sequence: Synthetic coding sequence
atggacccgtcaggagtgaaggtcctggagacagctgaagatattcaggagcgacgacaacaggtgctggaccgttaccatagatttaaagagttgtccaccctgaggcggcagaagctagaggactcttaccgttttcaatttttccaacgcgatgccgaggagttggagaaatggatccaagaaaagctccaaatcgcctcagacgagaactacaaggaccccaccaatctgcaagggaagctgcagaaacaccaggccttcgaggctgaagtgcaggccaattcaggcgctattgttaagctggatgagacaggaaacttgatgatctccgaaggccactttgcaagcgagaccattcgcacccggctgatggagctgcaccgacaatgggagctcctgctcgaaaagatgcgggagaaagggattaaactgctccaggcgcagaaactggtccagtacctgcgcgagtgtgaggacgtaatggattggattaacgataaggaagctattgttaccagcgaggagttggggcaggatctagagcacgtggaggtactccaaaagaaattcgaggagttccagaccgatatggcagcacatgaagaacgcgtcaacgaagtcaaccagtttgccgctaagctgatccaggagcagcaccccgaggaagagcttataaagactaaacaggatgaagtgaacgccgcttggcagcgacttaaaggattagctcttcaacggcaggggaaattgttcggtgccgctgaggtacagagatttaatcgggatgtagatgagaccatatcttggataaaggagaaggaacagctgatggccagcgatgatttcggacgggatctggcctctgtccaagctcttttaaggaagcacgagggactcgagagagacctggccgctttggaggataaggtcaaggcactgtgcgccgaagcagaccgcctccagcagtcccatcctctaagcgccacccaaattcaggtcaagcgagaagaactgataaccaattgggaacagatccgaacgctggccgcagagcgccatgcccgactcaacgactcttataggttgcaacggtttctggcggatttccgagacctcacaagttgggtgacagaaatgaaggccctgatcaacgccgatgagctagcctctgacgtggcaggcgcagaggccttgcttgaccgccatcaggaacataagggagagattgacgcccatgaagactctttcaaatcagctgacgagtctggccaggctctattagccgcaggtcactacgcaagtgacgaagtgcgtgaaaagttaacggtgctgtccgaggagcgggctgcgctactggagttgtgggagctccgcaggcagcaatatgagcagtgcatggacttgcagctattctaccgggacaccgaacaggttgacaattggatgtcgaagcaggaagccttcctgcttaatgaagatctcggcgactccctggattctgtggaagcccttctgaaaaaacatgaggattttgagaaaagtctcagcgcccaagaagagaagatcacagccctcgacgagttcgctacaaagctcatccaaaataatcactacgctatggaggatgtcgccacaagacgcgacgcccttctgtctcggaggaacgctctgcatgagagagccatgaggagaagagcccagctcgccgattctttccatctccagcaattttttagagacagcgatgaactgaaatcatgggtgaatgagaagatgaagactgccaccgacgaggcatacaaggacccatctaatctccagggaaaagttcagaagcatcaggccttcgaggccgagctgtcagccaaccagtcccgcatcgacgccttggagaaagcgggtcagaaactcattgacgtcaaccactacgccaaggatgaagtggccgctaggatgaacgaggtcatctccctctggaagaaactgctggaggctacggagttaaaaggaatcaaactcagagaggccaatcaacagcagcaattcaacagaaatgtcgaagacattgaattgtggttatacgaggtcgaaggccacctggctagcgatgactacggaaaagaccttacgaatgtccagaatctccagaaaaagcatgctttgctggaggccgatgttgccgctcatcaggaccggatcgacggcataaccatacaggccaggcaatttcaggatgctggacacttcgatgctgagaatatcaagaagaagcaggaggctcttgtagctagatatgaggcactcaaagagcctatggtggcaagaaagcaaaaactcgctgattctttgcgactgcaacagttgtttcgggacgtcgaagacgaggaaacatggatacgagagaaagaacccattgccgcttccacaaacagaggcaaggaccttattggtgtgcaaaacttactcaagaaacaccaagcactgcaggcagaaattgccggacacgagcccagaatcaaggctgtgacccagaagggcaacgctatggtcgaagaagggcacttcgctgccgaggatgtgaaggcaaaacttcacgaactgaaccagaagtgggaagctctcaaagctaaagctagtcagcgccgtcaggacctagaagacagcctccaagcacagcagtacttcgctgatgccaacgaagccgagtcctggatgagagaaaaggaaccgatcgtggggagcacggattacggcaaggacgaagactccgcggaggcgcttctcaaaaagcacgaggccctgatgtcagacctgtcagcatacgggagctcaatacaggccctgcgagagcaggctcaaagctgccgacagcaggtggcccctaccgatgatgagactggcaaagagctggtgctggcattatatgattaccaggagaagtccccacgagaggtaactatgaagaagggggacattttaacccttctcaactccaccaacaaggattggtggaaggtcgaagtgaacgaccgacagggcttcgtgccggctgcttatgtcaagaagctcgatcctgcccagagcgcaagtcgcgagaacctgcttgaggagcagggatcaatagcattaagacaggaacagattgacaatcagacgagaattaccaaagaggccggttctgtatccctcagaatgaagcaagtggaagagctttaccatagtctgctcgaacttggagagaagaggaagggcatgctggaaaaatcttgtaagaagtttatgcttttccgtgaggcaaatgagttacagcagtggattaacgaaaaggaggccgctctcactagcgaggaagtcggtgcagacctggaacaagtcgaagtcctgcagaaaaagtttgacgacttccagaaggacctcaaggctaacgagagccgcctgaaagatataaataaggtcgcagaggatctggagtctgagggtctaatggccgaggaggtccaggcagttcagcagcaagaggtctatgggatgatgcctagggatgaaactgatagtaaaacggcaagcccttggaagtcggccaggctgatggtgcatactgtcgccactttcaattctattaaggagctcaacgaacgctggagatcccttcaacagttggccgaggaacgcagtcagctactggggagtgcccatgaggtacaacgcttccaccgggatgctgacgaaacaaaggagtggatcgaagaaaaaaatcaggcactgaatactgataattatggacacgatctggcttctgtgcaagccttgcagcgaaagcacgagggattcgagagggacctggctgccctgggagacaaagttaattctctcggtgaaacagcggaaagactgattcagtcgcacccggagagcgcagaggacctgcaggagaagtgtaccgaactcaaccaggcttggtcatcactaggaaagcgagctgaccagaggaaggctaaattgggggactcccatgacctgcagcgctttctaagcgattttagggacctgatgagctggattaatggtatacgtgggttggtatcttcagacgaactggccaaagacgtcacgggagccgaagcccttctcgagcgccaccaggagcaccggacagagatcgatgctcgggctggcacttttcaggcatttgagcaattcggacaacagttgctagcccacggccattacgcatcacctgagatcaagcagaagctggacatactcgatcaagagcgagccgacctggaaaaggcgtgggtgcagaggagaatgatgctggaccagtgtcttgagttgcaattattccatcgcgattgcgagcaggccgagaactggatggctgccagagaagcttttttgaacacggaagacaaaggagattcattagacagcgtggaagcgctcattaagaagcatgaggatttcgacaaggcaattaatgttcaggaggagaaaatcgccgcactccaagccttcgcagatcaactgatagcggctggccattatgccaaaggagatattagcagtcgcaggaacgaggtgctggataggtggagaagactgaaggcccagatgattgagaaaagaagtaaactcggcgagtcacagacccttcagcaattctcgagagatgtcgacgaaattgaggcctggatctccgaaaagctgcagaccgcctctgacgaaagctacaaggaccccacgaatatccaggtttcccttatgctcagcaagcaccagaaacatcaagcatttgaagcagagctccacgcaaatgccgacaggatccgtggcgtgatcgacatgggcaattccctgattgagagaggtgcctgcgcaggctccgaggacgccgtcaaggcgcgtctggccgctcttgcagaccagtggcagtttttagttcagaagtctgcagagaagtcacagaagctcaaggaagctaacaaacaacagaacttcaacaccggaataaaggattttgatttttggctgtccgaagtggaagctttgcttgcaagtgaggactatggtaaagatctagccagcgtcaacaacctgttaaagaaacaccagctgctggaagccgacatctccgcccatgaagatagacttaaagacctgaactctcaggctgactctctgatgactagttctgcctttgacacctcccaggtgaaggacaagagagatacaatcaatggacggtttcagaaaataaaaagtatggctgcatcgagaagagctaagctaaatgagtcccacagacttcatcagttttttagagatatggacgatgaggagtcatggatcaaggagaagaagctgctggtggggtctgaagactacggccgtgatttgactggggtccagaatttgaggaaaaagcataagcgcctagaagcggaactcgccgctcacgaacctgctatccagggggtgctcgatactggcaagaagctgagcgacgacaatacgataggaaaggaagagattcagcagagactggcccagttcgtggagcactggaaagagctgaagcagctggccgctgcccgtggccaacggctcgaggaaagtcttgaataccagcagttcgtcgctaacgttgaggaggaggaggcttggattaacgagaagatgactctcgtggccagcgaggactatggggacaccctcgccgcaatacaaggactgctgaaaaagcacgaagcatttgagacggacttcacggtgcacaaggaccgggttaatgacgtttgcactaatgggcaggacctgattaaaaagaacaaccatcacgaggaaaacatcagctcaaagatgaagggcctgaatggcaaggtcagcgatctcgagaaagcagccgctcagagaaaggcgaaactcgatgaaaacagtgcatttctccaattcaactggaaagctgatgtcgtggagtcctggattggagaaaaggaaaattctctgaagactgacgattatggcagagaccttagtagtgtccagacactgctgacgaaacaggagaccttcgacgctggtctccaggcattccagcaggagggcatcgccaatattactgccctcaaggatcagcttcttgccgcaaaacatgtgcagagtaaggccatcgaggcgcgtcatgcttccttaatgaagagatggagccagttgctggcgaactcagctgctagaaagaaaaaattactagaagcacaaagtcatttccggaaagtagaggatctatttctgaccttcgcaaagaaagccagtgcctttaactcatggtttgagaatgcagaggaggatctgaccgacccggtacggtgcaattctctagaggagattaaagctcttagggaagcccacgacgcatttcgttcgtcactgagctccgctcaggccgacttcaaccagctcgccgagctcgacaggcagattaagagctttcgcgtcgcttcaaatccctacacttggttcaccatggaagctctcgaggagacctggaggaaccttcaaaagattattaaggaaagagagctggagctacagaaagaacagagacgccaggaagagaacgacaaactcagacaggaatttgcccaacatgctaatgccttccaccaatggattcaagagactaggtgccagccagcgggagcctcctgtatggttgaggagtccgggaccctggaaagccagttggaagcaacaaagcgcaaacatcaagaaattcgtgcaatgcgatcacaactgaagaagatcgaagacctcggggcagccatggaagaggccctaatattagacaataagtacacggagcatagcacagtgggcctggctcagcaatgggatcagttggaccagctgggcatgcgcatgcagcataacctggaacagcagatccaggccaggaatacaacaggcgtgaccgaagaagcgttgaaggaattcagcatgatgtttaaacatttcgacaaagataaatctggaaggctcaatcaccaagaattcaagagttgtctcagaagtctgggctacgacctgccaatggttgaggagggcgaacccgatcccgagttcgaggccattctcgataccgttgatccaaaccgcgacggacatgtgtccctacaggaatatatggcttttatgatctcccgtgagacggagaacgtgaagtcctcggaggaaattgaatcagcgtttagagccctcagctcagagggcaagccgtacgtcactaaagaagagctatatcagaatctgactcgcgagcaggcagattattgcgtgagccatatgaaaccatacgtcgacgggaaaggtcgggaactacctactgccttcgactacgtagagttcactagaagcctcttcgttaatta

SEQ ID NO: 242086 - DNA, 7358 bp, Artificial Sequence
  Description of Artificial Sequence: Synthetic coding sequence
atggatcctagcggggtgaaggtcctggaaacagcagaggatatccaggaaagacgccagcaggtgctggatcgctatcacagatttaaagaacttagcaccctgaggaggcagaagctggaagattcatacagattccaatttttccaaagagacgcagaggagttggagaagtggatccaggaaaagttgcaaattgccagcgatgaaaactataaggaccccaccaatcttcagggaaagttacagaaacaccaagccttcgaggcagaggtgcaggcgaactccggcgctatcgtgaagctggacgagaccggaaacttgatgatatcagaggggcactttgcctcggaaactatccgaacaagactgatggaactgcatcgccagtgggagctactgctggaaaaaatgcgtgaaaaaggcatcaagctcctgcaggctcaaaaattggtccagtacttgagagagtgcgaggacgtcatggactggataaatgataaagaggcaatagtgacctccgaagagctgggacaggaccttgaacacgttgaggtgttgcagaagaaatttgaggaatttcagacggacatggctgcacatgaagaaagagtgaatgaggtgaaccaattcgccgctaagctgatacaggagcaacacccagaggaagagttaatcaagaccaagcaagacgaggtcaacgccgcttggcagcggctgaaggggctagccctgcagcgccaggggaagctgttcggcgctgccgaagtgcaacgtttcaatcgtgacgtggatgagacaatttcctggatcaaggaaaaggagcagctgatggctagcgatgattttggtagagatttagctagcgtgcaggccctcctgagaaagcacgaaggactggagcgtgatctggccgctctggaggataaggtaaaagccctctgcgccgaagcagatcgtctacagcagtctcaccctctgtctgccacccagatccaggtgaaacgggaggagctcatcaccaattgggaacagatccgtactctggctgccgaacgccacgcaaggctgaacgactcttacagactgcagcggttcctggctgattttcgcgacctgactagctgggtcacagagatgaaggcactgatcaacgccgatgaactcgcaagcgacgtagccggagctgaagccctgcttgaccggcaccaagaacacaagggtgagatagacgcccacgaggattccttcaagtccgccgacgaatcagggcaggcgttactggcagcgggacactatgcatctgacgaagtacgtgaaaagctgacagttttaagtgaagagagggccgcattgctggagttgtgggaactgcggcgtcagcaatatgagcaatgcatggatctgcagctgttttatcgggacacggaacaggtcgataactggatgtctaagcaggaggcatttcttctgaacgaggacctcggggattccctagattctgttgaagccctgctcaagaaacatgaggactttgagaaatccttgtctgctcaggaggagaagatcacggctttggacgagtttgccacaaagctgattcagaacaaccactatgcgatggaggacgtggccacccgtcgagacgccctcctatctcgaagaaacgcactccacgaacgcgcaatgcggaggagggctcagctcgctgactcattccacttgcagcagtttttccgggatagcgacgagttgaagtcttgggtcaacgagaagatgaaaacggctacggacgaagcctataaagaccctagcaaccttcagggcaaggttcagaagcaccaggcctttgaggccgaactgtctgccaatcaaagtagaattgacgcacttgaaaaggccggacaaaagttgattgatgtgaaccactacgcaaaagacgaggtggccgcacgtatgaacgaggtgatttcactttggaagaagctccttgaggcaacggagctgaagggaattaaactgagggaagctaaccagcagcagcagtttaatcgcaatgtggaggatatagaactgtggctctatgaagtggaggggcacctagccagtgacgattatggaaaggacttaacgaacgttcagaatctccagaaaaaacatgccctcctggaggcagatgtggctgcccaccaggacagaattgacgggattactatccaagccagacagttccaagacgccggacactttgacgctgaaaatattaaaaagaagcaggaggctctagtagcgagatacgaagcccttaaggaacctatggtagcgaggaagcagaagctggccgatagtcttcgcctacagcagttatttagagatgtggaagatgaggaaacctggattcgggaaaaagaacccatcgccgcaagcactaacaggggcaaagacctcatcggagttcagaacctgctgaagaagcaccaggccttgcaggccgagatcgcgggacatgagccaagaattaaagccgttacccagaaaggcaatgcgatggtagaagaagggcactttgccgctgaggacgtcaaggcgaagctccatgagctaaaccagaagtgggaggctctgaaagccaaagcaagccagaggaggcaggatttggaagatagcctgcaggcccagcagtattttgcagacgcgaacgaagcagaaagctggatgagagagaaggaaccaatagtgggctcgacggactatggtaaggacgaagactcagccgaagcgctgctgaaaaaacacgaagccctgatgtccgacctgtcagcttacggctccagcatccaggcactgcgggaacaggcgcagagttgtcgccaacaagtggcaccaaccgacgacgaaacgggtaaggagctcgtactcgctttgtacgactaccaagaaaaaagtcccagggaagtgaccatgaaaaaaggggatattctcacccttctgaatagcaccaacaaagattggtggaaggtggaggtcaacgatcgccagggtttcgtaccggctgcctatgtcaaaaaactggatccagcccagagcgcatcccgagaaaacctccttgaggaacagggctctatcgctctgcgccaggagcagattgacaatcagtaccatagtcttttggaactgggggagaagcggaaggggatgctggaaaagtcctgtaagaaattcatgctgtttcgagaggctaatgaactacaacagtggattaatgaaaaagaggcagcactgacgagcgaggaggtgggggcagatctcgagcaggtggaagttcttcaaaagaaattcgacgacttccagaaagacctaaaggcgaacgagagccgcctgaaggacattaacaaggtcgccgaagatctagagtctgaaggcctgatggctgaggaagttcaagccgtgcaacaacaagaggtgtacggaatgatgccacgcgacgagacagatagcaaaactgccagcccttggaagtctgcgaggctcatggtgcatactgtcgccactttcaattctattaaagaactgaatgaaaggtggaggtctcttcagcagctggccgaggagagaagtcagctcttggggtccgcacatgaggtgcagagatttcatcgcgacgccgatgaaaccaaagaatggatcgaagagaagaaccaggccttaaacacagacaattatgggcatgacctggcaagtgtacaggccttgcagcggaagcacgaaggattcgaacgggatctggcagccttaggcgataaggtgaacagcctaggcgagacggccgaacgattaatccagagtcaccccgagtccgctgaagacctccaggaaaaatgcaccgagttaaatcaggcatggtcatccctcggcaaacgcgctgatcagaggaaagctaagttaggcgatagtcacgacctgcagaggttcctctcagattttcgggacctgatgtcttggataaacggtatcagaggtctcgtctcttccgatgagttggctaaggatgtaaccggtgccgaggcactgctcgaaaggcaccaggagcacaggactgagatcgacgctcgagctgggaccttccaggctttcgagcaattcggacagcagctcctcgcgcacggccactacgcgtctcccgagattaagcagaaactggacatcctggaccaggagcgggctgatttggagaaagcctgggttcagagacgaatgatgcttgatcagtgccttgaactgcagctctttcatcgagactgcgagcaggctgaaaactggatggctgcgcgagaggcattcttgaacacagaggataaaggcgattctcttgatagcgtggaggcactcatcaaaaaacacgaggacttcgacaaggcgatcaatgttcaggaggaaaagatcgcagcactgcaggctttcgctgatcagcttatcgccgctggacattacgccaagggcgacatctcctcccgcagaaacgaggtgctggacaggtggagaagactgaaggctcagatgatcgagaaaagaagtaagcttggagagagccagactcttcagcagttcagtcgagatgtagatgagatcgaggcttggatctccgaaaagctccagaccgctagcgatgagagctataaggaccctaccaacatccagtccaaacaccagaagcaccaggcctttgaagctgagctgcacgctaatgctgatcggatccgtggagtaatagacatggggaattcgcttatagaaagaggagcttgtgctggctctgaagatgccgtgaaagctcgtctcgccgcactggcggaccagtggcagtttttggtgcaaaagagcgcagaaaaaagtcaaaagctgaaggaggctaacaagcagcagaacttcaacaccggcatcaaggactttgatttctggttgagcgaagttgaagccctgctggcttctgaggattacggtaaggacctcgcaagtgtgaataatctccttaagaaacaccagcttcttgaagctgatatctccgctcacgaggaccgactcaaagacctgaactcccaagccgactctctgatgacatcatcagccttcgacaccagtcaggtgaaggataagagggataccataaacggaagattccagaagattaagagcatggccgcatctagaagagctaagctcaacgaatcacaccgccttcatcagttttttcgggatatggatgacgaggagagctggattaaagaaaagaagctgctggtcgggtcagaagattatgggcgtgatcttaccggagtgcagaatctcagaaagaagcacaaacgactcgaggctgagcttgctgctcatgagcctgccattcaaggcgtgctggacacgggtaagaagttaagcgacgataacacaatcggaaaagaagaaatacagcagcgcctggcgcagtttgtggagcattggaaagagctgaaacagctcgctgccgcacgcggacagaggctggaggaaagccttgaataccagcagttcgtggccaacgttgaagaagaagaggcctggataaacgagaaaatgacactggttgcaagcgaagattatggcgatacgctggccgcaatccaaggcctcttaaagaagcatgaggccttcgaaaccgatttcacggtccacaaagatagagtcaatgatgtttgtaccaatggtcaagacctcattaaaaaaaacaaccaccacgaagaaaatatttcttctaagatgaagggcctaaatggtaaagttagtgatctcgaaaaggcagcagctcaacgcaaagcaaagctggacgagaatagcgcctttctgcagtttaactggaaagctgatgtcgtcgaaagctggatcggggagaaggagaatagtcttaaaaccgatgattatgggagggatctgagctctgtccaaaccctgctaacaaagcaagagacattcgacgcgggactgcaggccttccaacaggaaggcattgcaaatataacagccctgaaagaccagttactggcagccaaacacgtacagagcaaggcgatcgaagctcggcacgctagcctgatgaagcgctggagtcaactgctggccaactctgcggctcgcaagaagaaattattggaggcccagtctcactttaggaaagtggaagatttattcctcacctttgcaaaaaaggctagcgcattcaatagctggttcgaaaacgctgaggaggacctaaccgatccggtgagatgcaacagccttgaggagatcaaagctctcagggaagcccacgacgcattccgcagctctctgagtagtgcacaggcagatttcaatcagttagccgagctggacagacaaatcaagagttttagagttgcatctaacccctatacttggtttactatggaagctctagaggagacatggcgcaatcttcagaagattattaaagaaagagagctcgagctgcagaaggaacagcgaaggcaggaggaaaatgacaaactccgtcaggagttcgcccaacacgctaatgcatttcatcagtggattcaggaaacccgatgccaacccgcaggcgcatcttgcatggtggaagagtcaggaaccctagagtctcagcttgaggccactaagcgaaaacaccaagaaatccgagcaatgcggagtcagttaaagaaaattgaggaccttggggcagccatggaggaagccctgattttggataacaaatacaccgaacactctacagtcgggctcgctcaacagtgggatcagttggaccagctaggaatgcgtatgcagcataatctcgaacagcagattcaggctcggaataccactggcgtgaccgaggaagctttgaaggagttcagcatgatgtttaaacattttgacaaagacaagagcggtagactgaatcatcaggagtttaaaagttgtctacgctctttggggtacgaccttcccatggtggaggaaggcgaacccgacccagagttcgaggctatcctcgatacggtcgatcctaacagagacggccacgtgtccttacaggaatacatggcctttatgatttccagagagactgaaaatgtcaagtcatctgaggagatcgagagtgcttttagggcactctccagcgaaggtaagccatatgtcacgaaggaggagctgtatcagaatttaactagggaacaagcagattattgtgtgtcccatatgaagccatacgtggatggtaaaggtcgtgagctgcccaccgcatttgattacgtggaattcacccggagcttgtttgtgaatta

SEQ ID NO: 242087 - DNA, 1485 bp, Artificial Sequence
  Description of Artificial Sequence: Synthetic coding sequence
atggccgcaagcaggcgagccaagctgaatgaatctcataggctgcaccaattctttcgcgatatggacgatgaagaatcttggattaaagaaaagaagctgctggttgggtctgaggattacggcagagacctcactggcgtgcagaacctgaggaaaaagcacaagagactggaggccgagctggccgctcacgagcctgctattcaaggggtcctcgatacgggaaagaagctctcagatgacaacaccatagggaaagaggaaattcaacagcggctggcacaattcgtggaacactggaaggaactgaagcagcttgccgctgctcggggtcagagactagaggaaagcctagagtaccagcagtttgttgcaaatgtggaagaagaagaggcgtggatcaatgagaagatgaccttggtggcctccgaggattatggagacacactagcagccattcagggacttctgaaaaagcacgaagccttcgaaacagactttaccgtgcataaagatagggtgaatgacgtatgtacaaacgggcaggatttgatcaagaagaataatcaccatgaagagaatatctcaagcaagatgaagggcctgaacgggaaggtctccgacctggaaaaagcagcggcacagcgcaaggccaagctggacgaaaatagcgccttcctgcaatttaattggaaggctgatgtggtggagtcatggattggtgagaaggaaaatagtctgaaaaccgacgactacggacgcgacctgagctctgtacagactctcttgaccaaacaggaaactttcgatgctgggttgcaagccttccagcaggagggcattgccaacatcactgcactgaaagaccagctgttggccgcaaaacatgtccagagtaaggcaatcgaggctagacatgcttccctgatgaaacgctggtcccagctgttagcaaacagcgcagcaaggaagaagaagctgttggaagcacagtcccattttcgcaaagtagaggatctgtttttaacattcgctaagaaagcctccgccttcaattcctggtttgagaatgcggaagaagatctcaccgacccagtgcgctgcaactccctcgaggagattaaagccttacgagaagcccatgatgcctttcgaagcagcctcagcagtgcccaggctgattttaaccagctggccgagttggatagacagatcaaaagcttcagggtagcatccaacccatatacttggttcaccatggaggcactggaggaaacatggagaaacctgcagaagatcataaaagaaagggagctcgaactccagaaggagcaacgtagacaggaagagaacgacaagcttcgtcaggaattcgcacagcacgctaacgcgtttcaccagtggattcaggaaacccgctgtcagcggaaagatggtcagctgcagggcggaagagttggggacccacgtattccagcctag

SEQ ID NO: 242088 - DNA, 7418 bp, Artificial Sequence
  Description of Artificial Sequence: Synthetic coding sequence
atggacccatccggcgtaaaggtgttggagaccgccgaggatatacaggagcgcaggcagcaggtgctggataggtatcataggttcaaggaactatctaccctgaggcgtcagaaactggaggactcctatcgatttcagttcttccagagggatgccgaagagcttgaaaagtggattcaggagaagttgcagatcgcctccgatgaaaactacaaggaccccaccaatctgcagggaaagctgcaaaaacaccaagctttcgaggcagaagtccaggctaactccggagctatcgtgaaactggacgagaccggcaatttaatgattagtgagggccactttgctagcgaaactatccgcacgaggctcatggagctccatagacagtgggagctgcttctggagaaaatgcgagagaaggggataaagttgctgcaagctcagaagcttgtccaatacctgagggaatgtgaagacgtcatggattggattaacgataaggaagccatagtaaccagcgaggaactaggtcaggatctggagcacgtggaggtcctgcaaaagaagtttgaggagtttcagaccgacatggctgcccacgaagagcgcgtgaatgaagttaatcaattcgccgcaaagctgatccaggagcagcacccagaggaggagctcataaagacaaaacaggacgaggtcaacgcggcatggcagcggctgaaaggcctggccctccagcggcaggggaagctgtttggagcggcagaagtgcaacgtttcaatcgggatgtggatgaaacgatttcttggatcaaggagaaggagcaactcatggctagcgatgatttcggtcgcgatctggcctccgtccaggctctattaaggaaacacgagggtctggaaagagacctggccgctttggaggataaagtgaaagcactctgcgccgaggcagatagactgcagcagtcacatcccctgtctgccacccagattcaggttaaaagggaggaactgattactaattgggagcagatcaggacactggctgcagaaagacacgcaagattgaatgattcataccgcctgcagcgcttcctggctgatttccgcgatctgaccagttgggtgaccgaaatgaaagcgctgatcaatgccgacgagctcgcttccgacgtagccggagcggaggcccttctggataggcaccaggagcacaaaggagaaatcgacgctcacgaggattctttcaagagcgccgacgaaagtgggcaggctcttctcgccgctggacattacgcaagcgatgaggtgagagagaaactgaccgtgcttagcgaagagagggctgcgctcctggagttgtgggagttgaggcgacagcagtacgagcagtgcatggacctccagcttttctaccgggataccgagcaggtagacaactggatgagcaaacaggaggcctttttgctcaatgaagacctcggagatagccttgacagcgtcgaggctttgttgaagaaacacgaggacttcgagaagagcctgagcgctcaggaagaaaaaataactgccctagacgagtttgcaaccaaattgatacagaataaccactatgctatggaagacgttgccaccagacgggatgctctgctcagccggagaaacgctttgcacgagcgggctatgcggagacgcgcacaactcgctgatagcttccacctgcagcaattcttcagagacagtgatgagctgaaaagctgggtcaatgagaagatgaagactgctacagacgaagcctacaaggaccctagtaaccttcaggggaaagtccagaagcaccaggctttcgaagcagagttaagcgctaaccaatcgaggatagatgcacttgagaaggcaggacaaaagctgatcgacgttaaccactacgccaaggacgaggtcgcagccagaatgaatgaggtgatctcactctggaagaaactcctcgaggctaccgaattgaaaggtatcaaactgcgagaagctaaccagcaacagcagttcaataggaatgtcgaggatatcgaactctggctgtacgaagtggaagggcatttggcctctgacgactacggaaaagacttaaccaatgtgcaaaacctgcaaaagaagcatgccctcctggaagctgatgttgcggctcaccaggacagaatcgacggaataacaattcaagccagacaattccaggacgccggacactttgacgccgagaatataaagaagaaacaggaggccctggtggccaggtacgaagcactgaaagagccaatggttgccaggaagcagaagctagcagacagcttgcgattacagcagctgttccgcgacgtcgaggatgaggagacttggataagagagaaggaacctattgctgcaagcacaaacagggggaaggacctgattggagtccagaatctgctcaagaaacatcaagccctgcaagctgagatcgcgggtcacgagccccgaatcaaggccgtgactcagaaggggaatgctatggttgaggaaggccactttgctgcagaggatgtgaaagccaagttgcatgagcttaatcaaaagtgggaagcactcaaggccaaagccagccagcgcaggcaagacctggaggacagcttgcaggcacaacagtactttgccgacgccaacgaagctgaaagctggatgagagagaaggaacctattgtaggttcgactgattatggaaaagacgaggattccgcagaggccctgctaaagaaacacgaagcgctgatgagtgacctgagcgcctacgggagctcgatccaggctctccgagagcaggcccagtcttgtcgtcagcaggtggccccaaccgatgacgagaccggcaaagagctggtgttagccctttacgactaccaagaaaagagtccccgtgaagtgactatgaaaaaaggagacattctgaccctcttgaacagcacaaacaaagactggtggaaggtggaagtgaatgataggcaagggtttgtgcctgctgcatatgtgaagaagctcgaccccgctcaatccgcatctcgggaaaacctgttagaggagcagggttcgatcgcgctccggcaggagcagatcgacaaccagacccggattaccaaggaagccggttcagtaagtctgagaatgaaacaggtcgaagagctttaccatagcttgctcgaactcggcgaaaagagaaaaggcatgcttgagaagagctgtaagaaattcatgctcttccgagaggccaatgaattacaacagtggatcaacgagaaagaagccgctctgacatccgaggaggtgggggctgacttggaacaagtggaggtgcttcagaagaaatttgacgacttccagaaggatctcaaagctaacgagtctcggctgaaggacataaataaggtcgccgaagatcttgagtcggaggggttaatggccgaggaagtgcaagcagtgcagcagcaggaggtgtatggaatgatgcccagggatgaaactgatagtaaaacggctagtccatggaagtctgccaggttgatggtgcatactgtggccacatttaactccatcaaggagctgaacgagcggtggagaagcttgcaacagctcgccgaggagaggagtcagctgctgggcagtgcccacgaggtccaacgcttccaccgcgacgccgatgagaccaaggagtggatagaggaaaagaatcaagcgcttaacaccgataactacgggcacgacctggcgtcagttcaggccctgcaacgaaagcacgagggatttgaacgggaccttgctgccctgggcgacaaggtgaactccctgggagagactgctgagaggctgatccagtcccatccagaaagtgcagaggatctgcaggagaaatgcaccgagctgaaccaggcatggtcatctctagggaaacgggctgatcagaggaaggcaaaactgggagattcgcacgatctgcagagatttctttccgatttcagagacttgatgagttggataaacggaatacgtggactggtgtcatccgacgaactggctaaagatgtaaccggcgcagaggccctgttggaaaggcaccaggagcatcggaccgagattgatgcacgggcagggacttttcaggcgtttgaacagttcggacagcagctgctcgcacacggacattacgcaagtccagagatcaaacagaagctcgacatcctggatcaggagcgggctgacctggagaaagcctgggtgcagcggcgtatgatgctggaccaatgcttggaactgcagcttttccaccgagattgtgaacaggccgaaaattggatggccgcacgtgaagcctttctcaacacagaggacaagggagattctctcgatagcgttgaagccctaatcaagaagcacgaggatttcgataaggctattaatgtacaggaagaaaagatcgccgcacttcaggccttcgcggaccagctgatcgcggctgggcactacgccaagggcgacattagctcccgaagaaacgaggtgttggatcgttggaggcggctaaaggcccaaatgatagagaagaggtccaagctgggagagagccagacattgcaacagttttcccgcgacgtggacgagattgaggcgtggatctccgagaaactgcagacggcctccgatgagagttacaaggatcccaccaatattcaaagcaagcaccagaaacatcaggcatttgaagccgaactccacgccaacgcagaccggatccgcggagttatcgatatgggtaactccctgatcgagcgcggtgcatgcgccggtagcgaggacgccgtaaaggccagacttgccgctctagccgaccagtggcaattcctggtccagaaaagtgcggagaagagccagaaactgaaggaggccaacaaacagcagaattttaataccggcattaaagacttcgacttctggctgtccgaagtggaggcgcttctggccagcgaagactatgggaaagacctagcttcagttaataatttgctgaaaaagcaccaactgcttgaggctgacatttcagcacatgaggaccgtcttaaagaccttaactcccaagccgacagccttatgacatctagtgccttcgacacttctcaagtgaaagacaaaagggacaccattaatggtcgcttccagaagattaagtctatggcagcaagccgccgagccaagctgaatgaatctcaccgcctccatcagttctttcgggacatggacgatgaagagtcatggatcaaggagaaaaagctcctagttggaagtgaggactacggaagggacctgacaggggtgcagaatctcaggaaaaaacataagaggctcgaagcagaactcgccgcacacgaacctgcgattcagggtgtgctcgacactggcaagaagttgagcgacgataacacaatcgggaaagaagaaatccaacagagactagcacagtttgtcgagcactggaaagaactgaagcagctcgccgcagcccgaggccagaggctcgaggaatcactagaataccaacaattcgtggccaatgtcgaggaggaggaagcatggattaacgaaaaaatgacgttggtggcatccgaggactatggtgataccctggccgctatacagggcttgcttaagaagcatgaggccttcgagaccgacttcactgtccataaagacagggttaatgacgtgtgtaccaacgggcaggaccttatcaaaaaaaacaatcaccatgaggaaaatatcagcagcaagatgaaaggtctcaatggcaaagtgagtgacttagagaaagccgctgcgcagcggaaggccaaattggatgaaaacagcgcatttcttcagtttaattggaaagccgatgtggtggaatcctggatcggcgagaaggaaaatagccttaaaacggatgattatggtcgggatttgtcctcagtccagacactccttaccaaacaagagacatttgatgcgggtcttcaggctttccagcaggaaggcattgctaatattacggccctgaaagatcaattactggctgcgaagcacgtgcagtcaaaggctatcgaggcacgccacgctagcctcatgaaacgctggtcacagttactcgcgaactcagctgcacgaaagaaaaaattacttgaagcgcagtcccattttcgcaaggtggaagaccttttcctgacatttgcgaaaaaggccagcgcttttaattcctggtttgagaacgcggaggaagatctgaccgatcccgttcggtgcaacagcctggaagagattaaggctctcagagaggcccacgacgcctttagatccagcctgagtagcgcacaagccgactttaaccagctggccgaacttgatagacaaattaagagcttcagagtagcttctaacccatacacttggttcaccatggaagccctggaggagacgtggcggaacctgcagaaaatcatcaaagagcgggaacttgaactgcagaaggaacagcgcagacaggaagagaatgataagttaaggcaggagtttgcgcagcatgcaaatgcattccaccagtggatacaggaaacgagaacctaccttcttgacggatcctgtatggtggaagaaagtggaaccctggaatcccaacttgaggcaacgaaaagaaagcaccaggaaattcgggctatgagatcacagctgaaaaagatcgaagatcttggcgctgccatggaggaggccctcatcttggacaataagtacacagagcactccacagtcggacttgcgcagcaatgggaccagctggatcagctggggatgaggatgcagcacaacctggagcagcagatccaggcccgaaatactacaggagtgacagaggaagctctcaaagaattctcaatgatgttcaaacactttgacaaggataagagcggaagactgaatcaccaggaattcaaatcatgcctgcggtccctgggctacgatctcccgatggtggaggaaggtgaaccagatcctgagttcgaagctatcctggatactgttgatcccaacagggatgggcatgtctcactgcaggagtacatggcatttatgatatcccgggagaccgaaaacgtaaagagtagcgaggagattgagtcggcgtttagagccctgtcttcggagggtaaaccctacgtgacaaaggaggaattgtaccaaaacctcacccgggagcaagcagactattgtgtgtcacacatgaaaccgtacgttgacggcaaaggacgtgaacttccaacagctttcgactatgtcgagtttacccgctcactgttcgtgaacta

SEQ ID NO: 242089 - DNA, 7433 bp, Artificial Sequence
  Description of Artificial Sequence: Synthetic coding sequence
atggatccctccggcgtgaaagtcttggagaccgcagaggacatccaggaaagaagacagcaagtacttgaccgctatcataggttcaaggagctcagtactcttaggcgccagaagctggaagacagttatcggtttcagttctttcagagggacgctgaagagctcgagaaatggatccaggaaaagctgcagatcgcttctgatgaaaactataaggatcccacaaatctccaaggaaagttgcagaagcaccaggcctttgaagctgaagtgcaggctaattcaggcgctattgtcaagctggacgaaaccgggaacttgatgatctccgaaggacatttcgcatctgagactatacgaacgagactgatggagttgcacaggcaatgggagctgctgctcgagaagatgcgagagaaaggtattaaattgcttcaggctcaaaagctggtccagtatctgagggaatgcgaagacgtgatggattggattaatgacaaagaagcgatagtgacctcagaagagctgggccaggacttggagcacgtagaggtactccaaaaaaaattcgaagaattccagacagatatggctgcccacgaagagagagtgaatgaagtgaatcaatttgccgcaaagcttatccaggagcagcaccccgaagaggagctgattaaaaccaagcaagacgaagtgaatgctgcctggcaaagactgaagggcctcgcccttcagcggcagggcaagctgttcggggctgccgaagtgcagcgctttaaccgggatgtggacgaaactatcagttggataaaagagaaggaacagctcatggctagcgatgattttggcagggatctggcctctgtgcaggctttgctgcgaaaacatgaaggattagaacgcgatctggctgcactcgaggataaggtaaaggcattgtgtgctgaagctgaccggcttcaacaatcacacccgcttagtgcgacacagatccaggtcaaaagagaggagctgattacaaattgggaacagatccgcacactagcggcagaacgccatgcacggctcaatgactcttaccgcctgcaacgcttcctggccgatttccgggacctgacctcatgggtcaccgagatgaaggcccttattaacgccgatgaactggcatccgacgtggcaggtgccgaagcattgctggatcgacatcaggaacacaagggggagatcgacgcacatgaggacagtttcaagagcgccgacgagagtgggcaggcgcttctcgccgcaggacactacgccagtgacgaggtccgagagaaactgaccgtcctctccgaagagcgggctgctctattggagttgtgggagctgcgacgccagcaatacgagcaatgcatggatctgcagcttttctaccgggatacagagcaggttgacaactggatgtccaagcaggaggccttccttctcaatgaggatctgggcgattctcttgattccgtggaagcactgctcaaaaaacacgaggattttgaaaaatcactgtcagctcaggaggagaagataaccgcgctggatgaattcgctaccaaattaatacagaacaatcattacgcaatggaggatgtagccacacgcagagacgcgctgttaagccggagaaatgctctccacgaacgcgcaatgcggaggcgagctcagctggctgactcttttcatctgcagcagttttttcgcgacagtgacgagctcaagagttgggtcaacgaaaagatgaaaaccgcaacagacgaagcgtacaaagaccctagcaacttacagggcaaggtgcagaaacaccaggccttcgaagctgagctgagtgctaaccagtcccgcatagacgcactggaaaaggccggacagaaactgattgacgtaaatcactacgctaaggatgaagtagccgctcgcatgaatgaagtaatctctctctggaagaagctgctggaggccaccgagctgaaaggcatcaagttgagggaagctaaccaacaacagcagtttaatcgtaatgtggaagatatcgagctgtggttgtacgaggtggaagggcaccttgcatctgatgactacggcaaggatctgactaatgtccagaacctgcagaagaagcacgccctgctggaagccgacgtcgccgctcaccaggatcgcattgacggcatcactattcaagccaggcagtttcaagatgccggtcacttcgatgccgagaatattaagaagaagcaggaggctctggtggccagatacgaggctctgaaggaaccaatggttgccagaaaacaaaagctggccgactctctccgcctacagcagcttttccgagatgtggaggacgaagagacatggattcgggagaaagagcctatcgcagcctccactaatagagggaaggaccttataggtgtgcagaacttgctgaaaaaacaccaggctctccaggctgaaatcgcaggtcatgaaccaaggataaaagcagtgacccagaagggcaacgccatggtggaggagggacactttgccgctgaagatgtgaaagcaaaactccacgagctcaatcagaaatgggaagctttgaaggccaaggcatcccagcgaaggcaggatttagaggactctctccaagcccagcagtatttcgctgacgcaaatgaggccgaaagttggatgagggagaaagaaccaatcgtagggtctaccgactatggcaaagacgaggatagtgccgaagctctactgaagaaacacgaagctctgatgtcagacttgtcagcctacggttccagcatccaggcgctgcgtgagcaggcccagtcgtgccgccagcaggtcgctcccacagatgatgagacaggaaaagaactggtccttgctttgtacgattaccaggaaaagagcccgcgtgaggtgacaatgaaaaagggtgatattctgacactgctgaactccactaataaagattggtggaaagtcgaagttaacgacaggcaaggcttcgtgcccgctgcctacgttaagaagctagatcctgcacaaagcgcctctcgagagaatctacttgaggagcagggtagtattgccctgcggcaggagcagatagacaatcagacaaggatcacaaaggaagccggttccgtgagtttacggatgaagcaggttgaggagctttaccactccctcctcgagttgggcgagaaaagaaagggaatgctcgagaagagttgtaagaaatttatgctatttcgtgaagcgaatgaactccaacagtggataaatgagaaggaagcggctctcacttctgaggaggtgggggctgacttggaacaggtggaggtgctgcagaagaagttcgatgatttccaaaaggacctgaaagccaatgagtcaagactcaaggacataaataaggtagccgaagacctggagagtgaagggctgatggctgaggaggtgcaagccgtgcagcagcaggaggtgtatggaatgatgcctcgagacgaaacagacagtaaaaccgctagcccctggaaaagtgccaggctcatggtccatacggttgccacgttcaactcaattaaggagcttaacgaacggtggaggtcattacagcagttggcggaggagcggtctcagctcctggggagtgcccacgaggtacagcgattccatcgggatgccgatgaaacgaaggagtggattgaggaaaaaaaccaggctctaaataccgacaattatggtcatgaccttgccagcgtccaggctttgcaaaggaaacacgaggggtttgagagagatctggcggcactgggcgacaaggtgaatagcctcggtgagacagcagagcgtttgattcagagccatccagagtccgcggaggatttgcaggagaaatgtaccgagctgaatcaggcctggtcttcactgggcaagcgcgctgatcaacgtaaggccaagttaggggacagtcacgatctgcaaaggtttctatccgacttcagggacctgatgtcctggatcaacggaataagagggctggtctcttccgatgagctggccaaagacgtcactggcgctgaagctctgctcgagcgccatcaagagcacaggactgagatcgacgcacgggcaggcactttccaggccttcgaacagttcggccaacagcttttggcccacgggcactacgccagtcccgagatcaagcagaaactcgacatactggaccaagaaagggctgatcttgagaaggcctgggtgcagcgcagaatgatgctggatcagtgtctggaacttcagctcttccaccgtgattgcgagcaggctgaaaactggatggctgcccgagaagccttcctgaacacggaagataagggagacagcctggacagcgttgaagcactgattaagaaacacgaagactttgataaggccatcaatgtacaggaggagaagattgctgctttacaggccttcgccgaccagttgatagctgccggacattacgccaagggcgacatctcaagtcggcgaaacgaagtcttggatcgatggcgcagacttaaggctcagatgattgagaagcgctcaaagctgggcgaaagtcagacactgcagcagttttccagagacgttgatgagatcgaggcctggatctccgaaaaactgcaaaccgctagcgatgagtcctataaggacccgactaatattcagctctctaagcttttaagtaaacatcagaagcaccaggcctttgaggccgaactgcacgctaacgccgatcggatccgtggcgttattgatatgggaaatagcctgatcgagaggggggcttgcgcgggatcagaggatgctgtgaaagcccgtctcgcggctctagctgaccaatggcagtttctggtccagaagtctgccgagaaatcacagaagctcaaagaggctaacaagcagcagaactttaacacgggtataaaagatttcgatttctggctgtccgaagtcgaggcattacttgcctctgaagattatgggaaagatctcgcctcagtcaacaaccttcttaagaagcaccaactcttggaggccgatatctctgcacacgaagatcgccttaaagacctaaattcacaagccgattccctgatgacctcctccgcctttgataccagccaagtgaaagataaacgggatacaataaatgggagatttcagaagatcaaatctatggcagcgagtaggcgcgctaaactgaatgaatctcaccggctgcaccaattcttccgcgacatggacgacgaagagtcctggatcaaagaaaagaaactccttgtggggtctgaggattacggcagagatctgacaggggttcaaaaccttaggaagaaacacaagcggctcgaagccgagctggccgcacacgaaccagctatacaaggtgtgctggacaccggcaagaagctgtctgatgataacacaataggaaaggaagaaattcagcaaaggttggctcagttcgttgaacattggaaggagctcaagcagctcgccgcagctagggggcagcggctggaggaaagtctggaatatcagcagtttgttgcaaacgtagaagaggaggaggcatggatcaacgaaaagatgacactggtggcctccgaggactatggggacacactggccgcaattcagggcctactgaaaaagcatgaggcctttgaaacagattttaccgttcacaaagaccgcgtgaatgatgtgtgtacaaacggccaagaccttattaagaaaaacaaccatcacgaggagaatatctcctctaaaatgaagggactcaacggaaaggtgtctgatctcgaaaaagccgcagcccaaaggaaggcaaagttagatgaaaactccgcatttctccagttcaactggaaggccgacgtggtggagtcatggatcggggaaaaggagaatagcctcaagaccgacgattatggcagggacttaagttccgtgcaaacactcctgactaagcaagagactttcgatgccggactgcaggcgttccagcaggaaggaatcgctaacattaccgctcttaaggaccagctgctcgcggctaaacatgtgcagagcaaggccatcgaagcacgacacgctagcttgatgaaacgatggagtcagctgctcgcaaacagtgccgcacgtaaaaagaaacttctcgaagcccagtcacatttccggaaggtggaagacctgttcctcacatttgccaaaaaagcctcggcatttaactcatggttcgagaacgcagaagaggacctaactgatccagtgcgatgtaatagcctggaggagatcaaggccctgcgcgaagcgcatgatgcctttcgctccagtctgtcgtccgcccaggccgatttcaatcagttagctgaactcgatcgacaaataaagagtttcagggtggcttcaaatccttacacatggttcactatggaagcacttgaggagacgtggaggaacctccagaaaattatcaaagagagggaattggagctacagaaggagcagagaagacaggaagaaaacgacaagctccggcaggagttcgcccaacacgccaacgccttccaccagtggatccaggaaaccaggacctacttactggatggcagttgcatggtagaggaaagcgggacactggaaagtcagttggaggcaaccaaaagaaagcatcaagaaatccgtgcaatgagatcacagttgaaaaagatcgaggatctgggagccgcaatggaggaagcgctcatccttgataacaaatatactgagcacagtacagttggccttgctcaacagtgggatcagctggaccagcttggcatgcgtatgcagcataatctggagcaacaaattcaagctcgcaatactactggagttaccgaggaggctttaaaagagttcagcatgatgttcaaacactttgataaggataagtcaggacgcctcaaccatcaagaattcaagtcctgccttcggagtctgggctacgatctacctatggttgaagaaggggagccggaccccgaatttgaggccatcttagatacagtcgacccaaatcgcgacgggcacgtgtctctccaggagtatatggcgtttatgatctcccgtgaaaccgagaacgtaaaatcatcagaggaaattgagagcgcatttcgcgctctgtcatccgagggaaaaccttacgtaacaaaggaggagctataccagaatctgacccgggagcaggccgactactgcgtgtcccatatgaagccatacgtggacggtaaggggagagaattaccaacagctttcgactatgtcgagtttacaaggtctctctttgtcaatta

SEQ ID NO: 242090 - DNA, 3444 bp, Artificial Sequence
  Description of Artificial Sequence: Synthetic coding sequence
atggagaacaaccgcgataaagtcctctcccctgtggactctggaaacaaactcgtggccgaggggaatctgtactctgataaaataaaggaaaaggttcagttgatcgaggaccggcatcgaaaaaataatgagaaagcgcaggaagcatctgtcctgctgcgagataacctcgaactgcaaaactttctccagaattgtcaagaactcaccttatggatcaatgacaaactgctcacttctcaggatgttagctacgacgaggccaggaatctccataacaagtggctgaagcaccaagctttcgtggctgagctcgcgtctcacgagggttggcttgagaacatcgacgctgaaggcaagcagctcatggacgaaaaaccacagtttaccgcactcgtgtctcagaagctcgaagcactgcaccggctgtgggatgaacttcaggcgaccaccaaagaaaaaactcagcatctgtcagctgctagatcatctgatctccgactccagacccatgccgatttaaataaatggattagtgcgatggaagaccaactgcgctccgatgatcccggaaaagacctaacctctgtcaatcggatgctcgccaaactgaaacgagtcgaggatcaggtgaacgtgcggaaagaggagctgggtgagctctttgctcaagtcccgtctatgggcgaagaggggggagatgccgacctgtccatagagaaacgcttcctggacctgctggagccgctgggtagaagaaagaaacagctcgagtcctccagggcgaagttgcaaatcagcagagacctggaggacgagaccctctgggttgaagaaaggctgcccctggcccagagcgccgattacggcacaaacctgcagaccgtgcagctctttatgaagaagaaccaaacactccagaatgagattctgggccacacccctcgggtggaggatgtgctccagcgaggtcagcaactggtggaagccgcagaaatcgattgtcaggacctcgaagaaaggctaggtcatcttcagagctcttgggatcgactgcgagaggctgcggctggtcgattacagcggctgagagacgccaatgaagcacagcagtactatctcgatgctgatgaagcagaggcatggatcggcgagcaggagctttacgtgatcagtgacgaaatccctaaggatgaagagggggctattgtaatgctgaagcgacatctccgccagcaacgggctgtcgaagattacggccgaaatataaagcagcttgcatcacgggcacagggactgctgtccgccggacaccctgagggagaacaaattattcgcttgcaaggtcaggtggataagcactatgccggattgaaggacgtggccgaggagcgaaaacgaaaactcgagaacatgtaccatctgtttcagctcaagcgcgaaactgacgacctggagcagtggatttccgaaaaagagttggtggcttcttccccggaaatgggccaggattttgaccatgtaacgttgctccgtgacaagttccgggattttgcacgggaaactggggcaatcggacaggagcgtgttgacaacgttaacgctttcatagagaggctaattgatgcgggacatagcgaggctgccactattgccgagtggaaggacggcctcaatgaaatgtgggcagatctgctcgagctgatagacactaggatgcagcttctggccgcttcgtacgacctacatagatacttctacacaggagcagagattcttgggttaatcgatgagaaacatagagaactaccggaggatgtggggttggacgcctcaacagccgagtccttccaccgcgtgcacactgcatttgagcgcgaactgcacttattgggagttcaggtccaacagtttcaggacgtggccacccggctccagaccgcctatgctggtgaaaaggcggaagccattcagaacaaagaacaggaggtgtccgctgcctggcaagctcttctcgacgcctgcgccggaagacggacacagctcgtggataccgctgataagttccgctttttctctatggctcgtgaccttctcagctggatggaaagcattatcaggcagattgagacccaggagcggccaagagacgtgtcatccgtggaactccttatgaaataccatcagggtatcaacgccgagatcgaaacccggagcaagaatttttcagcttgcttagaactgggggagtcactcctgcagcgccagcaccaggcatcagaggagataagggaaaagctgcagcaggtcatgagccgcagaaaggaaatgaatgaaaagtgggaagctcgatgggaacgcctgaggatgttgctggaggtgtgccagttctcaagagatgcatctgtggccgaggcctggcttatcgctcaggaaccctacttagctagtggggactttggacacacggtggactctgtcgaaaagctgatcaaacgccacgaggctttcgaaaaatccacagcctcctgggcggaaagatttgccgctctggagaaaccaactacattggaactgaaggaaaggcagatagccgagcggccagctgaagaaacaggaccccaggaagaagagggcgagacggcgggtgaagctcctgtatcccatcacgccgcaacggaacgtacaagcccgggtgaagaagaagggacatggccacagaatttgcagcagcctccaccccctggtcaacataaggacggtcagaagtcgaccggggacgaaagacctaccaccgaaccgctctttaaggtgcttgatacccccctgtctgaaggagatgaacctgctacgctgccggctcctcgcgatcacggtcagtctgttcaaatggaaggatacttaggcagaaagcacgatcttgaagggccaaataaaaaggccagcaattccaagggagaagaaggagaggagagaagagagaccgaagaggaggatgaggaagaagaggaaactgagagcgtggcggtagaaatgcagcagcacgcaagccatgtgtcatggaacaatttgtactgcgttcttaggaatagcgaactcacgttctataaagacgccaaaaacttagccttaggaatgccttatcatggtgaagagcccctggcattgcggcacgcaatatgcgagattgcggcaaattacaagaagaagaaacacgtttttaaacttaggctgagtaatggaagcgagtggctcttccacgggaaagatgaagaggagatgttatcttggttgcaaggggtgtccactgcaattaatgagagtcagtctattcgcgttaaagcgcagtctttaccactgccatcattatctggacccgacgcctccttagggaaaaaggacaaagagaaacgctttagtttctttccaaaaaagaaatag

SEQ ID NO: 242091 - DNA, 6320 bp, Artificial Sequence
  Description of Artificial Sequence: Synthetic coding sequence
atgacatcagccactgagtttgagaacgtcggaaaccagcctccatatagtcggatcaacgctagatgggatgcacccgacgatgaattagataatgacaattctagtgccagactctttgaaaggtctaggatcaaagccctcgcagacgaacgtgaggttgtgcaaaagaaaacatttaccaaatgggtgaactcgcatctggcacgtgtgagctgccgcattacagatctgtacaaggatctgcgcgacgggcgtatgctgataaagctgctggaggtattaagtggagagatgctccctaagcctactaagggaaagatgcggattcactgtctggagaatgtggataaggcattgcagttcttgaaagaacagcgagtgcatctggagaatatgggctctcacgacattgtggatggcaaccacagactggtccttggtctgatctggacaatcattcttcggttccaaattcaggatatcgtggtacaaactcaggaaggtagggaaacaaggtcagccaaggacgccctcctgctgtggtgtcaaatgaagacggcaggttatccccacgtaaatgtcaccaattttacaagctcttggaaggacggcctcgcatttaacgctctgatacacaaacatcgccctgaccttatcgatttcgataaactgaaagacagcaatgcgcgacacaacttagagcacgcctttaacgtcgccgaacgccagttaggcattattccgctgttggaccctgaggatgtctttactgaaaatccagatgagaaatcaattatcacatacgttgtggccttctaccactacttctcaaagatgaaggtcctcgcggtggaaggcaaacgtgtaggaaaggtgattgaccacgctatcgaaaccgaaaaaatgatcgaaaaatatagcgggctggcctctgaccttttgacgtggattgagcagaccatcaccgtgctgaattcgcggaagtttgccaatagcctgacgggcgttcaacaacagttgcaggcatttagcacttaccgtacagtcgagaaacccccaaagttccaggagaagggcaatctcgaagtcttgctgtttacaatccagtctaggatgcgcgcaaataatcaaaaggtttatacgccacatgatgggaagctcgtctcggacataaaccgggcttgggagagtctggaggaggccgaatacaggcgggagttggccttaagaaatgagcttatccggcaggaaaagctcgagcaacttgctaggcgcttcgataggaaagcagccatgagagaaacgtggttaagtgaaaaccagagactggtagcacaggataactttggctacgatcttgccgcagtcgaagcggctaagaagaaacatgaagccatagaaactgacaccgctgcttatgaagagcgcgtgcgcgcactggaggacctagcccaagagcttgaaaaagagaactatcacgaccaaaagagaataacagccaggaaggacaacattctccgcctgtggtcttacttgcaggagctgcttcaaagccgcagacagcgtttggaaaccacactggccctccaaaagctcttccaggacatgcttcattctatcgactggatggatgagattaaagcccacttactgtctgccgagtttggaaaacacttgctggaagtggaggacttgctgcagaagcacaagcttatggaagcagatatcgcaatccagggggacaaggtcaaggcgatcaccgcagccacgctgaagttcactgagggaaaggggtatcagccctgcgatccccaggttatccaggaccgcattagccaccttgaacagtgttttgaggaactttcaaacatggcagcaggtcgcaaggctcagctggagcaatcaaaacgactttggaagtttttttgggaaatggacgaggccgagtcgtggattaaggaaaaggagcaaatctattcaagcctggactacggaaaggacttgaccagtgttctcatcctgcagcggaaacataaggcttttgaggacgagctgcgaggcctggacgcccacctggagcagatttttcaagaagcgcacggtatggtagccagaaaacaattcggacacccccagatcgaggctaggatcaaggaggtgagtgctcagtgggaccagttgaaggacttggccgcattttgtaaaaagaacctgcaggacgcagagaattttttccagttccaaggggatgcagacgacttgaaggcctggttgcaagatgctcatcgacttctatccggagaagacgtgggccaggatgagggggcaacaagagcattgggaaaaaaacacaaggactttctggaggaactggaggagagccgtggcgtgatggagcatctggagcagcaggcccagggctttcctgaagagtttcgcgatagtcccgatgtcacgcaccggctccaggccttaagggagctgtatcaacaggtcgtcgcccaggcagatctccggcagcagcgtctgcaagaagcactcgacctgtacacagtatttggggagacagatgcatgcgagttgtggatgggggaaaaggagaaatggttagcggagatggaaatgcctgataccctggaagatctggaggttgttcaacacagatttgatattctcgatcaggagatgaaaacactgatgactcaaatagatggagtcaacctggccgcaaatagcctcgtcgaatcaggccaccccaggtcacgagaagttaagcaataccaagaccacttgaacacacggtggcaggccttccagaccctggtgtctgagagaagggaggctgtggactccgctctccgcgtgcacaattattgcgtcgattgcgaagagacatcaaagtggattacagacaaaacaaaagtggtggaatctacgaaagatctgggcagggacctggccggtattatcgccatccagaggaaactcagtggtctcgaacgcgatgtggctgccattcaggcgagagtcgacgcgcttgaaagagagtcccagcaattgatggattctcacccggagcaaaaggaagacatcgggcaacgccagaagcatctggaagagctctggcaaggcttgcagcaatctttgcaggggcaggaagatttactgggggaagtgtcacaattgcaggcctttctgcaggatctcgacgatttccaggcctggctcagcattacccaaaaagcagttgcatcagaggatatgcccgaatccttgccagaagctgagcagcttctgcagcagcatgccggtattaaagatgaaatcgacggacaccaggattcctatcagcgggtgaaggagagtggcgagaaggtgattcaggggcaaacggatccggaatacctgctgctggggcagcgcctggaaggcctggatacaggatggaatgctctcggcagaatgtgggaaagtagaagccacactctggcacaatgcctgggattccaggagttccaaaaagacgcaaagcaggcggaggctatcttgtcaaaccaggagtacaccctggcccacctagaacctccagacagcctggaggctgcagaggctggaatacggaaattcgaggattttttaggcagtatggaaaacaaccgggataaggtgttatcgccggtggattctggcaataagctggttgctgaaggcaacctgtatagcgataaaatcaaagagaaggttcagctgatcgaagaccgccataggaaaaacaatgagaaagcacaggaagccagcgtgctgctcagagataatctggaactgcagaatttcttacagaattgccaagagcttactctttggatcaacgataagctgctcacatcccaggacgtttcctacgacgaagcgcgaaacctccataacaaatggctgaaacaccaggcatttgttgccgaactcgcttcacacgaaggatggctcgaaaacatcgatgctgagggtaaacagctgatggatgaaaagccccagtttacggccttagtgtcccagaaactcgaggcactgcaccggctttgggacgaacttcaggccaccaccaaagaaaaaacgcagcacttatcagccgcaaggtcgtcagatctcaggctccagacccatgcggaccttaacaagtggatctctgcaatggaggatcagctgcgatctgatgacccgggaaaggatcttacatccgtaaatcggatgctggcaaaactgaagcgagtcgaagatcaggtcaacgtgcgtaaggaggagctgggagagctttttgctcaggtgccttcaatgggggaggaaggcggagatgcagatctctccatcgaaaaaagattcctcgacctgctggaaccgctaggaaggaggaagaaacagttggagagtagtagggcaaaattacagatcagcagggacctggaggatgaaacgctgtgggtcgaagaacggttgcccctcgcccagagcgccgattacgggactaacctgcagaccgtgcagctctttatgaaaaagaatcagactctgcagaacgagattttgggccacactccgcgagtcgaggacgtgctgcaacggggacagcaattagttgaagcagccgagatagactgtcaggacctggaagagcgcttgggccatcttcagtcttcatgggatcgccttcgggaagcggcagctggcaggttacagcgccttagagatgctaatgaggctcaacagtactatttggatgccgacgaggccgaagcgtggataggggaacaagagttgtatgtcatcagcgacgaaattcctaaagacgaagaaggggcaatcgttatgctgaagcgacacttgcgccagcaaagagcggtcgaagactatggccgaaatatcaagcaattagccagtcgtgctcaaggcctcctatccgcagggcaccccgagggggaacagatcattagactccagggacaggtggacaagcactacgcgggactgaaggacgtggccgaggaacggaaacggaagctagaaaacatgtaccatctattccagctgaaacgggaaacggatgatctggagcagtggattagtgagaaagagcttgtggcgtcctcccctgaaatgggtcaagactttgaccacgtgaccctcctccgtgataaatttagggactttgcaagggagacaggcgctatcggccaggaacgggtagacaatgttaatgctttcatagagagattgatcgacgccggtcatagcgaagccgctacaatcgccgagtggaaagacgggctgaacgagatgtgggccgaccttctcgaactgattgacaccaggatgcaactcctggcagcttcttatgatctacatcggtatttctataccggcgcagaaattttgggattgatcgacgaaaagcaccgagagctgcctgaagacgtggggttagatgcttccaccgctgagtcatttcatcgggtgcatactgctttcgagcgggagcttcacttactgggagtacaagtgcagcagtttcaggatgttgccacgaggttgcagactgcttacgctggtgaaaaagcggaagcaatccaaaacaaggaacaggaggtaagcgcagcttggcaagcactgctcgacgcctgcgctggacgacgaacccagctggtagacacagccgacaagtttagattctttagcatggccagagacttgttatcctggatggagagcattattcgacagatcgagacacaggaacgacctagagacgtatctagcgtcgagctgctgatgaaataccaccaaggcatcaacgcggagatcgaaactaggtcaaaaaatttctcagcctgtctggagcttggtgaatcattgcttcagcgccagcaccaagcttccgaagagatccgggagaaattgcagcaggtcatgtccaggcgaaaggagatgaatgaaaagtgggaagctagatgggaaagactgcggatgctgttggaagtgtgtcaattctcccgtgatgcctcggttgctgaggcctggctaatcgcccaggaaccatatctggcctcaggtgacttcgggcacacggtcgatagtgttgaaaagctgattaagagacatgaagctttcgagaaaagtactgcctcatgggcggagaggtttgcagcacttgaaaaaccgacaactgccagtcggggaggaagacgcgacagtagaggcggttcgtcctttccaccctgtggccaccgtgaaaatgtaccaggccagtctttggtctcttttgttta

SEQ ID NO: 242092 - DNA, 6413 bp, Artificial Sequence
  Description of Artificial Sequence: Synthetic coding sequence
atgaccagcgcaacggaattcgaaaacgttgggaaccagcctccctatagtagaatcaatgcgcgatgggacgcccctgacgatgaattagacaatgataactcctcagccaggctctttgagcggagcaggattaaagccctggccgacgaacgcgaagtagtgcagaagaaaacctttactaagtgggtcaattctcatctggcacgcgtcagctgtagaattactgatttatacaaggacctcagagatgggcgaatgcttatcaaactgttagaggtgttaagcggtgagatgctccctaaacctacaaaaggtaaaatgaggatccactgcttagagaacgtggataaagccttgcagttcttgaaagaacagcgagtccacctggaaaatatgggaagccatgacatcgtcgacgggaaccatagactcgttctgggcctgatttggacaataattctgaggtttcagatccaggacatcgtagtacagacccaagagggacgggagacgaggtccgcgaaagatgccctgttgctgtggtgtcagatgaaaacagccggatacccacatgtgaacgtgactaactttacctccagttggaaggatgggctggctttcaacgctttaatccataagcacagacctgatttgatcgattttgacaagctgaaggattcaaacgcccgtcacaaccttgaacatgctttcaatgtggcggagagacagcttgggatcatacccctgcttgaccctgaagacgtgttcactgaaaatcccgacgagaagtccatcattacgtacgttgtagctttttaccactacttctcaaagatgaaagtgctggctgtggaaggtaagagggtggggaaggtcatcgaccacgcgattgaaaccgagaaaatgatcgagaagtactctggcctcgcctccgatctccttacttggattgagcagaccattacagtcctgaactctagaaagttcgcaaattccctcactggagtccagcagcagttacaagctttcagcacatatcggaccgtggaaaagcctccgaaatttcaggagaaaggcaacctggaggttctattatttaccattcagtctaggatgagagcgaacaaccagaaggtgtacactccgcacgacgggaagcttgtgtccgacattaacagggcatgggagagcctcgaagaagcagagtacagaagagaactcgccctccgcaacgaactgataagacaagaaaaactggaacagctcgctcgacgctttgataggaaggcagcgatgcgggagacttggctcagcgagaaccagcgcctcgttgcccaggataatttcggttacgatctggcagctgtcgaggctgctaagaagaaacatgaggccatcgagactgacactgctgcctatgaggaacgcgtgcgtgcactcgaggacctggcccaagaattagagaaagaaaattatcatgatcagaaacgtattaccgcccgaaaagacaacattcttcgcctctggtcttatctccaggagcttctgcagagtagacgccagcggctcgaaacaactctggccctccagaagctcttccaagatatgttacacagtatcgactggatggacgaaattaaggcccacctgctgtcggcagaatttggcaagcacctactggaggtcgaagacttgctgcagaaacacaaacttatggaggcggatatagccattcagggtgataaagtgaaggccattacagctgcaacattgaagttcaccgaaggcaagggctatcagccttgtgatcctcaagtcatccaggatcgcattagtcacctggaacagtgcttcgaggagctatctaatatggcggcaggtaggaaggctcagctggagcagtctaaacgactttggaaatttttctgggaaatggatgaggctgaatcctggataaaggaaaaggaacagatttactcatcccttgattacggcaaagatctgacttcggtactgatactgcagcgcaagcacaaagcatttgaggacgaattgaggggcctcgacgcgcacttagaacaaatctttcaggaggcccatggaatggtcgccagaaaacaattcggccatccacagatagaagcacggatcaaggaggtatccgctcagtgggaccaacttaaagatctggcagctttttgtaagaagaatctccaggacgccgagaatttctttcaattccagggagatgccgacgatttgaaggcttggcttcaggacgcccataggctgctgagcggcgaagacgtaggacaagatgagggggcaacccgggctcttgggaagaagcataaggactttctcgaagaactggaagagtctagaggtgttatggagcacttagagcagcaagcccaagggttccccgaggagttcagagactctccggatgttacacataggctgcaggcactgcgcgaattgtatcagcaggtggtggcccaagccgacctccggcagcagagactccaggaggcccttgacctatataccgtgttcggcgagacagatgcctgtgaactgtggatgggagagaaagaaaaatggttagcagagatggagatgccagacaccctcgaagacctcgaggtcgtgcagcacaggttcgacatccttgaccaggaaatgaagactcttatgactcaaatcgatggggtaaacctagcagcgaatagcctcgtggagagcggccacccacgaagtagagaagtcaaacagtatcaggaccacttgaatactcgttggcaggccttccagacactcgtctcagagagacgcgaagccgtggactctgctctccgggtgcataactactgtgtggattgcgaagagacatcaaagtggatcacagacaaaaccaaggtggtggaatctaccaaggacctgggacgcgatcttgccggaataattgcaatccagagaaaattgagcgggcttgaaagagatgttgccgcaatacaggccagggttgacgcactggagcgggagtctcagcagctgatggactcccacccagaacagaaagaggacatcggacagcgccagaaacatctagaggaactgtggcaaggcttgcagcagtcactgcagggccaggaagacctgcttggcgaagtgagtcaattgcaggcattccttcaagatctagacgactttcaggcttggctgtcaattacgcagaaagcagtggcatcagaggatatgccggaatctttgcctgaagcagaacaattgctgcagcagcacgccggaatcaaggacgagattgacggtcaccaggatagctatcagcgggttaaagagagcggagagaaggttattcagggacagacagaccccgagtatctgctgcttgggcaaaggctggaggggctcgatacaggctggaacgcactaggtaggatgtgggagagcaggtcccatacactcgcccagtgcctggggttccaggagtttcaaaaggatgctaaacaggcggaagcaatcctgagtaaccaggaatacacactagcccaccttgagcctccggatagcctggaggccgcagaagctggcataaggaaatttgaggattttctcggcagcatggagaataacagagacaaggtcctgtctccagtggattccggcaacaagctggttgccgagggtaatctgtactctgacaagattaaggagaaagtccaattgattgaggatagacacaggaaaaacaatgagaaggcccaggaggcgtctgtgctccttagggacaacttggagctgcagaatttcctgcagaattgtcaggaacttactctgtggatcaatgataaactcttaacaagtcaagatgtgtcttatgatgaggcgcgaaacctgcacaacaagtggctgaaacaccaggccttcgttgccgaattggccagccacgagggctggttggaaaacatagacgctgagggtaagcagctgatggacgagaagccacaattcactgccctggtaagccagaagttggaggctttgcatagattatgggacgaactccaagctacaacaaaggagaagacacagcacctgtctgccgcacgatcatcagacctgagattgcagacccacgccgacttgaacaagtggatctccgcaatggaggaccagctccgctctgatgacccgggtaaggacttgacctccgttaaccgtatgctcgccaagctcaagcgggtcgaggatcaggtgaacgtcaggaaggaggagctgggtgaactcttcgcccaggtacccagcatgggagaggaaggcggtgacgctgacctgtcaattgaaaaaaggttcctcgatctcctggaaccactgggcagaaggaaaaaacagctcgagtcttcacgggcaaagttacaaatttctagggatctggaggatgagaccctgtgggtcgaggagagactgcccttagcccagtccgccgattatgggaccaacctgcagaccgtccagctgtttatgaagaaaaaccaaaccctccagaacgagatcctgggccacacaccacgggttgaagacgttctccaacggggacagcagctcgtcgaagcagccgaaatagattgtcaggatcttgaagaaaggctgggacaccttcagtcctcttgggaccgactccgggaggcggctgccggaaggctgcagagactaagagatgccaacgaggcccagcagtactatttggatgctgatgaggcagaagcatggattggcgagcaggagttgtatgtgattagcgacgagatccccaaggatgaggagggcgcaatcgtgatgctgaaacgccacctgaggcaacagcgcgctgtggaagactatgggagaaatatcaagcagcttgcgtctagggcccaggggctgctctccgccggtcaccccgaaggcgagcagatcatccgcctgcaaggacaggtggataagcactatgccggactgaaagacgtggctgaggaaagaaaaaggaaactggaaaatatgtatcatctgtttcagctgaagcgtgagaccgatgatttggagcagtggattagtgagaaggaactggtagcttcttcacctgaaatgggtcaggacttcgaccatgtgacattgcttagagacaaattccgagacttcgcacgggagacaggcgctatcggacaggaaagggtggataatgtgaatgcgttcattgaaagactcatcgatgcaggccacagcgaggccgcaaccatcgcagaatggaaagacggactcaacgaaatgtgggccgacctcctggaactgattgatacaaggatgcaactcctcgccgcatcctacgacttgcatcgctacttttatacaggtgccgagattctgggactgattgatgagaagcacagagaactgcccgaagacgtggggttagacgcatccacagctgagtccttccatcgcgtgcacaccgctttcgaacgggaactccatcttctgggggtgcaagtgcagcagtttcaagacgtggccacaagactccagaccgcctatgctggagaaaaggcagaggccattcaaaataaggagcaggaggtcagcgcggcatggcaggctctactcgacgcttgtgctgggaggcggactcagctggtcgatactgctgacaaatttcgatttttttccatggcgagagatctcctttcctggatggaatcgatcattagacagatagagacacaggaacgtccgagggatgtttcgagcgtcgaactgctcatgaaatatcaccagggcatcaatgcagagattgagaccagatccaaaaatttctccgcttgcctcgagctcggggagtcgctcctgcaaagacagcatcaggcctcagaagaaatcagggaaaaattgcaacaggtgatgagtcgcaggaaggagatgaacgagaagtgggaagcccgttgggagagactgagaatgttgttggaagtttgccagttttcccgagatgctagtgtggctgaagcttggctgatcgcccaggaaccctacttggcttctggagactttggccatacggtagatagcgtggagaaactgatcaaaagacacgaagcatttgagaagtcaactgcttcgtgggcagagcggttcgccgctctggagaagcctactactctcgagcttaaagagcgccaaatcgccgagcgccctgctgaggagacagggcctcaggaggaggaaggcgaaactgctggcgaggcaccagtgagtcaccacgccgcaacagagaggacaagtccagtgtccctgtggtctcgtctctcaagctcatgggaaagcctccaacctgagccctcccacccgtacta

SEQ ID NO: 242093 - DNA, 6986 bp, Artificial Sequence
  Description of Artificial Sequence: Synthetic coding sequence
atgacctctgccaccgaattcgaaaacgtgggcaatcaaccaccatatagccgcatcaatgcacgttgggacgcacccgatgacgagttggataacgacaatagctcagctaggctgttcgagcgaagcagaatcaaggcactagcagatgaacgcgaggtcgtgcagaaaaaaacttttactaaatgggttaatagtcatctcgcaagggtttcatgcagaattaccgatctgtacaaagaccttagagacggcaggatgctgattaagctcctagaggtactgtccggcgaaatgctgcctaaacctacgaagggcaaaatgaggattcactgcctggagaacgttgacaaggcactccagtttcttaaagagcagagagtccatctcgaaaacatgggcagtcatgacattgtagatggcaaccacaggttagtgctgggccttatctggacaatcatcttgcgatttcagatccaggatatagttgtgcaaacgcaagagggacgggaaacgaggagtgctaaggacgccctgctattgtggtgccagatgaaaactgccggttatcctcatgtgaacgtgactaacttcacgagctcatggaaggacgggttagcctttaatgcccttattcataagcaccgccctgatttgatcgactttgacaaactgaaagatagcaacgcgagacataacttagaacacgctttcaatgtggctgagaggcagctgggtattatacctctgctcgatcctgaggatgtctttaccgagaaccccgatgagaagtccattataacatacgtcgtagctttttaccactacttctctaaaatgaaggtcttggcagtggagggcaagagagtgggcaaagtgattgatcacgccatagaaaccgaaaaaatgatcgagaaatactcggggctggctagcgatctgctgacttggattgaacagacaatcaccgttctgaacagccgtaaattcgctaattcactgaccggcgtgcagcagcagctgcaggcgttctcaacttaccgaacagtggagaagcctcctaagttccaggagaagggaaatctggaagtgttgctgttcaccatccagagccgtatgagggctaataaccagaaggtctatactcctcacgacgggaaactagtgtctgatatcaaccgggcatgggaaagcctggaagaagcggagtatagaagagaactcgccttgcggaacgagttgattcggcaggagaagcttgaacagctcgcccgtcggtttgatcgcaaggcagctatgagagagacttggctgtccgagaatcagagactagttgcacaagataactttggttacgacctcgcagccgttgaggccgcaaaaaagaagcacgaagctattgaaacagacacagcagcgtacgaggagcgagtcagagctctagaggacttagcccaggaactggagaaggagaattatcacgaccagaagaggatcacagcacgtaaggataatatcttacggctgtggtcatatctccaagagcttctgcagtcccggagacaacgcctggaaacaacactagctctgcagaagttgttccaggatatgctccatagtatcgactggatggatgaaatcaaagcccacttactttccgctgagttcggtaaacacctgctcgaggtggaggatttgctgcagaagcacaaactgatggaggcggatattgctatacagggagacaaggttaaggctattacagcagccaccctgaagtttacggagggaaaggggtaccagccctgtgatccccaggtgattcaggatcggattagccatctggagcagtgtttcgaggaactctctaatatggcagcagggaggaaggctcagctggaacagagtaagagactttggaagtttttttgggaaatggatgaagctgagagttggataaaagaaaaagagcaaatctacagcagcctcgattacggaaaagacctgacttctgttttgatcctccagagaaaacacaaagcttttgaagatgagttacgtggcctcgatgctcatttggagcagattttccaggaggcacatggcatggtggctcgtaaacaattcgggcatccccaaatcgaggccaggattaaggaagtgagcgcgcagtgggatcaactgaaagacctagccgctttctgtaaaaaaaacttacaggacgcggaaaacttttttcaattccagggggacgccgacgatctgaaagcttggttacaggacgcacatcggctgctctccggcgaggatgtgggccaggacgagggagcgacccgcgcactgggcaagaaacataaggatttcttggaggaactggaggagtcccgtggagtgatggagcatctggaacagcaggcccagggctttccagaagaattccgggattctcctgacgtcactcaccgtctccaggcgctccgtgagctttatcagcaggtagtagcgcaggccgatttgagacagcagcgtctgcaggaggcgctggatctttacacagtgtttggggagaccgatgcctgcgagctatggatgggcgagaaagagaaatggctggccgagatggaaatgccagacaccctggaggacttagaggtcgtccagcatagatttgatattttagatcaggagatgaagaccctgatgacccagatagacggagtgaatctggcagcgaattctttagttgaaagcggccaccctagatcacgggaggtgaagcagtatcaggaccacctaaatacccgatggcaggcatttcagaccttagtaagcgagcggcgagaggccgttgattctgctctgcgcgtgcacaattattgtgtcgactgcgaggaaacctctaagtggataactgataaaaccaaagtagttgaatcaacgaaagacctgggacgcgaccttgccggtataattgccatacagaggaaactctccgggctggaacgggacgtggcagcaatccaggccagggtggatgctctcgagcgggaatctcagcagttaatggacagtcaccccgagcagaaagaagatatcggccagcggcagaagcacctcgaggagctgtggcaaggactccaacaatcattacaggggcaggaggacctgctaggagaagtgagccagctccaggcattcctgcaggatctggacgacttccaggcatggctgtcaatcacacagaaggcagtcgcctcagaggatatgcccgaaagcctgccagaggcggaacagctacttcagcagcacgcaggcatcaaagatgaaatcgacgggcatcaagatagctatcagagagttaaggagtccggcgaaaaggtcattcagggccagaccgatcctgaatatctgctcttgggtcaacgcctcgaagggctcgacacaggctggaatgctcttggccgtatgtgggagtcgcgtagccatacattggcacaatgtctcggatttcaggaattccagaaagacgctaagcaggcagaggctatcctgtccaaccaggaatacacactcgcgcacctcgaaccaccagatagcctggaagccgcagaggcaggtatccgtaagttcgaggatttcttaggttccatggagaacaaccgggataaagtgctctctcccgtcgattcagggaataagctggtggccgagggaaacctgtatagcgacaagatcaaggagaaggtccagctcatagaggaccggcatagaaagaacaacgagaaggcccaggaggcttcagtgctgctgagggacaatctagaactgcagaattttctccagaactgtcaagaactgactttgtggatcaacgataagctcctcacaagtcaggacgtatcctatgatgaggccagaaatctgcacaacaagtggttgaagcatcaggcattcgtcgccgaactcgcttcacacgaggggtggctggagaatatcgatgccgagggcaaacagctcatggacgagaaaccccagttcacagcgctggtgtctcagaaactggaagctctgcacaggctttgggatgagctgcaagcgactactaaagagaagacacaacatttgagcgccgcacgctcctcggacctgaggctgcagacccacgcagacctcaacaaatggattagtgcaatggaggatcagctccgtagtgatgatccagggaaggacctgaccagcgtgaatagaatgctggcaaagctgaaaagagtcgaggatcaggtcaacgtgcgaaaagaagagttgggcgagctgttcgcacaggtgcccagcatgggcgaggaggggggagacgccgacctttctatcgaaaaacgatttctggacttgctcgagcccctgggcagacgcaaaaaacagctagagtctagccgcgctaagctgcagatcagtagagacctcgaggatgaaacattatgggttgaggagcgccttcccttagcccagtccgcagactacggaacaaacttacagacagtgcagctctttatgaagaaaaatcagaccttacagaatgaaatactaggccatactccgcgagttgaggacgttctccaaagaggacagcaactagttgaggcagcagagatcgattgtcaagatttggaagaacgcctggggcatctccaaagcagttgggataggctccgcgaagcagcggcagggcgacttcaacggctgcgcgatgccaacgaggctcagcagtactatctggacgctgacgaggctgaggcttggattggggaacaggagctgtatgtcatcagtgatgagatccccaaagatgaggagggagccatagtcatgctgaagcggcaccttagacaacagagagcggtggaggattatgggagaaacatcaagcagctggcttcaagggcccaggggcttttgtctgccggacaccctgaaggggagcaaattatcagactgcaaggacaggtggataagcactatgccggtctgaaggacgtggccgaggagagaaagcgcaagctggaaaacatgtaccatctgttccagcttaagcgcgaaactgacgacctggaacagtggatctctgagaaggagcttgtggcttcatctccagaaatgggacaggatttcgaccatgtgacactgttgcgcgacaagtttagggatttcgccagggaaaccggggctatcggccaggaaagagtggataatgtcaatgccttcatcgaacggcttatcgatgccggacatagtgaggctgcaactattgctgagtggaaggatgggctgaacgagatgtgggcagatctgctggaattaatcgacacacgcatgcaactattggccgctagctatgacctgcatcggtacttctacaccggcgctgagatcctgggtctgattgacgagaagcatcgcgaactgccagaggatgtaggtctggacgccagtaccgcagagtcctttcacagagtgcacactgctttcgagagggagctccatctgctgggagtacaggtccagcaattccaggatgtcgccactcgcctgcagacagcatacgctggcgagaaagctgaagcgatccagaataaagaacaggaggtctcggccgcatggcaggcacttcttgacgcctgcgcaggccgaaggacacagctggtggatacagctgataaattccgtttcttctccatggctagagacctgctcagctggatggagtccattataagacagatcgagacccaggagaggccacgggacgtgtcctccgtggagctgctgatgaagtatcaccagggcataaacgccgagatcgaaacacggagcaaaaatttttccgcatgcttggagctcggtgaaagtctcctgcagaggcagcaccaggcttccgaggagattcgggaaaagctccagcaggtgatgtctaggcgaaaggagatgaacgagaaatgggaagccagatgggagcggctgagaatgctgctggaagtatgtcaattcagtcgcgacgcctccgtggcagaggcatggctgatcgcacaggagccatatctggctagcggggactttggacacaccgtggattctgtggagaaactgattaaacggcacgaggcgttcgagaagtccaccgcttcttgggccgagagatttgcggcactggaaaaaccaaccacactggagctgaaggagaggcagattgccgaaagaccagccgaggagactggcccacaggaagaggaaggcgagaccgctggtgaagctcctgtgagtcatcacgccgcaaccgagaggacttccccaggagaagaggagggaacctggccacagaacctccaacagcccccaccccctggacagcataaagatggccagaagagcacgggagatgagcggccaacaactgaaccactgtttaaagtactggacacaccattatccgaaggcgacgagcctgccaccctgcctgctcctagagaccacgggcagagcgtgcagatggagggctatctgggcagaaagcatgatttagaaggacccaataaaaaagcaagtaaccggtcatggaataacttgtattgtgtattgaggaattccgaactgacattctacaaggacgctaagaacctagccctcgggatgccgtaccatggcgaagaacccctcgccttaagacacgctatatgtgaaattgccgctaactacaagaaaaaaaaacacgtctttaagcttaggctgtccaacggcagcgagtggctatttcacggtaaagacgaagaagaaatgctgtcctggcttcagggcgtgagtaccgccatcaatgagtcgcaaagcataagagttaaggcgcagagtttaccactaccatccctcagtggcccagacgcctctcttggcaaaaaagataaggaaaaaaggttctcttttttccccaaaaaaaaata

SEQ ID NO: 242094 - DNA, 6998 bp, Artificial Sequence
  Description of Artificial Sequence: Synthetic coding sequence
gaaccagccgacatgaccagcgcaaccgaatttgagaacgttgggaatcagcctccgtactcaagaattaatgctagatgggatgctcctgatgacgaactggacaatgacaactcatccgcacgcttgttcgagcgctcaagaatcaaagctctggcggatgaaagggaagtagttcagaaaaagacctttaccaagtgggtgaattcccacctggcacgagtgtcttgtagaataactgatctgtataaagacctgagagatggtagaatgctgatcaaactgctggaggtactgagtggggaaatgcttcccaaaccaacaaagggaaaaatgcggatacactgcctcgagaatgtggacaaggcgttacaattcctaaaggagcaacgcgtgcacttggagaatatgggttcacacgatatagtggatggaaatcatcgactggtcttgggtttgatctggactattattctgagattccagatccaggatatcgttgtgcagacccaggagggacgcgagactaggtccgcaaaggatgccttgctcctgtggtgtcagatgaagaccgcgggatatcctcacgtgaatgtgacaaatttcacaagctcatggaaagatggactggcctttaacgccttgattcacaagcatcgaccggaccttatagatttcgacaaactcaaagattctaacgctagacacaacctggagcacgctttcaatgtggccgagaggcagctggggattatccctctactggatccagaggacgtgtttaccgagaaccctgacgagaagagtattatcacttacgtcgttgctttctatcattacttttcaaaaatgaaggttctggccgtggaagggaagcgggttggaaaagtgatcgatcacgccattgaaaccgagaagatgatcgagaagtactctggcctggccagcgacctgctgacctggattgagcagactatcactgtcctcaacagtaggaaatttgctaattcactgaccggcgttcagcagcagcttcaggccttttcaacatataggacagtcgagaagccacccaaattccaggagaaaggaaatctggaagtcctcctgttcaccattcagagtcgcatgcgggctaataaccaaaaggtgtatacgcctcacgacggcaagcttgtctctgacattaaccgggcatgggaaagcctggaagaggcagagtaccgtcgcgagttagcgcttaggaatgagctcatcagacaagaaaagctggagcaattggccaggaggttcgatagaaaggccgcaatgagggagacgtggttatctgagaatcagcggttagtggcccaggataatttcggatacgacctagccgctgtcgaggctgcaaaaaaaaagcatgaggcaatcgagactgatacagccgcttatgaagaacgtgtcagagccctggaggatttggctcaggagctggagaaggaaaattaccacgatcaaaagagaattactgcgagaaaggacaatattcttcggttatggagctatctgcaggagctcctgcaatcaagacggcagcgcctcgaaactaccctcgctttgcagaagctgtttcaggacatgctgcacagcatcgattggatggatgagattaaggctcaccttctgtctgctgaattcggcaaacatctgctggaagttgaagatctgcttcaaaaacataagcttatggaggcagacattgcgatccagggggataaagtgaaggcgattactgcggctactctcaaattcaccgaaggtaaaggttaccagccctgtgatccccaggtcattcaggaccgcatttcccatctggagcagtgcttcgaggagctgtcaaacatggccgctggcagaaaggcacaactggagcagagtaagagactgtggaaattcttttgggaaatggacgaggcagaaagttggataaaagaaaaagagcagatttattctagcttggactacgggaaggatctgactagtgttctgatcctccagcgaaagcataaggcgttcgaggacgagttacggggactagacgcccacctggagcagattttccaggaggcccatggaatggtagccaggaaacagttcgggcatccccaaatagaggcgcgaataaaggaagtgtccgctcagtgggaccagctgaaggacctggctgctttctgtaagaagaacctgcaggacgccgaaaacttctttcagtttcagggcgatgccgacgaccttaaggcttggttgcaggacgcacatcgcttactgagcggagaggatgtgggacaggatgaaggggctacacgcgcactcggcaaaaaacataaggatttcctggaggaattggaagaaagtcgaggggttatggaacacctcgagcagcaggcacaaggattccccgaggagtttcgggactcgcctgatgtgacccatcggctccaggcccttcgcgagctgtatcagcaggtggtagcacaggccgacctgcggcagcagagacttcaggaggcgttggacctttataccgtgtttggcgagaccgacgcatgcgagctatggatgggcgaaaaagagaagtggctggcggagatggagatgcccgacacactggaagatctcgaagtggtccagcaccgctttgatatcctggatcaggaaatgaagactcttatgactcagatagacggcgttaaccttgcagcaaactctctcgtagagagcggacatcccaggtccagggaggtgaaacagtaccaggaccatttaaacacacgctggcaagcattccaaactttagtcagcgaaagaagggaggccgtggactctgccctgagagtgcacaattactgcgtagattgtgaggagacttcaaagtggattactgacaagactaaagtagtggaaagtaccaaagatctggggagggacctggccggaataattgcaatccagcggaagctgagcgggctggagcgagacgtggcagcgatccaggcccgtgtggacgcgctggagcgtgagtcgcagcagctcatggactctcatcccgagcagaaggaggatatcggtcagcgacaaaagcacctagaagaactgtggcaggggctacagcaatccctgcagggccaggaggacctgctgggtgaggtctcgcagttgcaagcatttctgcaggacctggacgatttccaagcttggctcagcatcacacaaaaggctgttgcatcagaggacatgcccgaatctttaccggaggcggagcagttgctccagcagcacgccggaatcaaagatgagatagatggccatcaggattcctaccaacgtgtgaaagagtcaggtgagaaagtcattcaggggcagacagatcccgagtatctgttactgggccagagactggaaggactggatacaggctggaacgctcttggcagaatgtgggaaagcagatctcacacgttggctcagtgcctgggattccaagagtttcagaaggatgccaaacaagccgaagcaattttaagtaatcaggagtatacactcgcacatctggagcccccagatagcctggaggctgccgaggccggtattcggaagttcgaagacttcctcgggtctatggagaacaatagggacaaggtgctctctccagtggatagcggcaataagctggtggctgaagggaacctctacagtgataagataaaggagaaagttcagctgatcgaagatcgtcaccgcaaaaacaacgagaaagcccaggaggccagtgtactcctgcgtgataatctggagttacaaaattttttgcagaattgccaggaactgacattgtggatcaacgacaaactgctgaccagccaggacgtctcctacgatgaggcacgaaatctccacaacaaatggctgaaacatcaggctttcgtggcggaattagcttcccacgagggctggctcgaaaacatcgacgctgaagggaaacagctgatggacgagaaaccccagtttacggcacttgtgtcccagaagctcgaggcgctgcaccgactgtgggacgagctgcaggccaccactaaggagaaaacccagcatctgagcgcggctagatcatctgaccttaggttgcagactcatgctgatctgaataagtggatcagcgccatggaggaccagctgcgttctgacgacccaggcaaggacctgacctcagtgaatagaatgcttgccaaactgaagcgggtcgaagaccaggtaaatgttcggaaagaggagctgggggaacttttcgcgcaggtcccatcaatgggcgaggaagggggagatgctgatctatccattgagaagcgatttttggacctccttgagcccttgggtaggcgcaaaaagcaactggagagttctcgcgctaagctgcagatcagcagagatctggaggacgagacactttgggtagaggaacgcctgccactcgctcagagcgccgattatggaactaacttgcagacagtgcagttgtttatgaaaaagaaccaaactctgcagaatgaaattcttggacacacaccacgcgtggaggatgttcttcagcgaggacagcaactggttgaagccgcagaaattgactgtcaggatcttgaggagagactaggccacctgcagagctcttgggaccgtcttcgggaggcagcagcgggacggctgcaaagattgcgagatgcaaacgaggctcagcaatactatctcgacgccgatgaggctgaggcctggatcggagaacaggagctgtacgttatttccgacgagattccgaaggacgaggaaggcgcaattgtaatgttaaagaggcatctacggcagcagcgtgccgtcgaagactatggcagaaacatcaagcagttagctagccgggctcaggggcttctttccgctggccatcctgaaggggagcaaattataagactccagggccaagtcgacaagcactacgctgggctcaaggacgtggcagaggaaagaaaacggaagctggagaacatgtatcacttattccagctgaagagggaaaccgatgacctagagcagtggattagcgagaaagaactggtggcgtcttccccggagatgggccaggactttgatcacgttacgctgctgagagacaagttcagagatttcgctcgggagaccggtgcgattggacaggagagggtggataatgtcaatgcattcatcgagcggctgatcgatgccggtcactctgaagcagcaaccatcgccgaatggaaagacgggttaaacgaaatgtgggcagatctgctggagctaatagacacaagaatgcagctgttagctgccagttacgatttgcaccgctatttctataccggtgccgagattctcggcctgatcgatgaaaagcaccgtgagcttcccgaagatgtggggctggacgccagcactgccgaatccttccacagagtccatacagcgtttgaacgggaactgcacctgttaggtgtgcaggttcagcaattccaggacgtggcgacccgcctgcagaccgcatacgccggagaaaaggccgaagctattcagaataaggaacaggaagtttcagctgcatggcaggcactcctagacgcttgcgcgggacgtaggacccaactcgtcgataccgccgacaagttccggttcttctcgatggcgagagatctgttgtcttggatggaatctatcatacggcaaattgagactcaagaaagacccagggatgtgtccagcgtggaactgctcatgaagtaccaccaggggattaatgccgaaatcgaaacaagaagcaaaaacttctctgcctgcctagagctgggcgagtcactccttcagcgtcaacaccaggcaagcgaagagattagagaaaagctccagcaagtaatgtccaggcgcaaggagatgaacgagaagtgggaagctcgctgggagagattaaggatgctcctcgaggtgtgccagttttccagagacgcatctgtggccgaggcctggcttattgcccaggagccgtacctcgcctctggcgacttcggacatacagtggattctgttgagaagctgatcaagaggcatgaggccttcgaaaagtccacggcttcttgggccgagcgattcgccgctcttgagaagcctactaccctggagttgaaagagagacagatcgcagaacgcccagccgaggaaactggaccacaggaagaggaaggagagaccgctggggaagccccagtttctcaccacgccgcaaccgaaaggaccagtcctggagaggaagaaggcacctggccacaaaacctccaacagccgccacctcctggccagcacaaggatggccaaaagtcaactggcgacgagcgacctactaccgagcctttattcaaggttctggacacacctctgtcggaaggtgatgagcctgccacgctcccagctccccgagatcatggacagtcggtccagatggagggttacttaggccgtaaacatgacctcgaagggcctaacaagaaggcctcaaaccggagttggaataacttgtactgtgtgctccggaacagcgaactgactttctacaaggacgctaagaatctggccctcggcatgccttatcatggcgaagaacccctcgctctcagacacgcgatctgcgaaatagcagccaattacaaaaagaaaaagcacgttttcaaactgaggctcagcaatggctcagagtggctgttccatgggaaagatgaggaggaaatgcttagctggctgcagggtgttagtaccgctattaatgaaagtcagtcaatcagggtgaaggcccagagcctccccttaccgtctctgtccggccctgatgccagcctgggaaagaaagataaggagaagcgcttttcgtttttccccaagaagaagta

SEQ ID NO: 242095 - DNA, 6413 bp, Artificial Sequence
  Description of Artificial Sequence: Synthetic coding sequence
atgacatctgcgacggagttcgaaaatgtaggaaaccagccaccatactccaggatcaatgccagatgggacgcccctgacgatgagctggataacgacaatagctccgccagattatttgagcgaagtagaattaaagcacttgcagacgaacgagaggtcgtgcaaaagaaaaccttcacaaagtgggtgaactcacacctcgcaagggtgagctgtcgtataactgacttgtataaggatctgagggatggtaggatgctgatcaagttgctcgaggttctgagcggcgaaatgctccctaagcctacaaaaggcaaaatgcgtatccattgtctggagaacgtggacaaggctctgcagtttttgaaagagcagagagtacaccttgaaaacatgggctcgcatgacattgttgatgggaatcacagactcgtcctggggctaatttggacaatcatactgaggtttcaaatccaggatattgtggtgcaaacacaggaggggagggaaacacggtctgcaaaagacgccctgctgctgtggtgccagatgaaaactgctggctaccctcacgtcaatgtcactaacttcacttcatcctggaaggatggactcgcattcaatgccctgatccacaaacataggcccgacctgattgattttgacaaactgaaagacagcaatgctagacacaatctggaacacgcctttaatgtggccgagcgtcagctggggatcatcccgctgctggaccccgaggatgttttcactgagaatcccgatgagaagagtattataacgtacgttgtcgcattctaccactacttttctaagatgaaagttctcgcagtggaaggaaaaagagtcggtaaggtgatagatcacgcgattgagacagaaaaaatgatcgagaagtacagcggcctagcttccgatcttctgacgtggatcgagcaaactattaccgtcctgaattctaggaagttcgccaacagcctcacaggggtgcaacagcagctccaggctttctccacttaccgcactgtcgaaaagccgcctaagttccaggagaaaggcaacctggaagtccttctgttcacaattcaaagccggatgagagccaataaccaaaaggtttataccccgcacgacggcaaactggtcagcgatattaaccgggcatgggagtcattggaggaggcggaataccgacgcgaactggcactcagaaacgaacttataaggcaggagaagcttgaacagcttgcaagaaggttcgacaggaaggcggctatgcgcgagacttggctgtctgaaaatcagaggctagtggcccaagacaacttcgggtacgaccttgcagcagtagaggcagcaaagaaaaagcatgaggctattgagacggacactgccgcttatgaagagcgcgttagagccctggaagacttggctcaagagttggaaaaggaaaattaccacgaccagaaacgcatcactgcaaggaaggacaacatcctccggctgtggtcatacctgcaggagctgctgcagagccgcaggcaacggctggagactacactggcccttcagaagctattccaagatatgctgcacagtatcgattggatggatgagattaaggctcacctcctgtcggcggagtttggcaagcatctgcttgaggtggaggacttgttacagaagcacaagcttatggaagcggacattgcgattcaaggcgataaagtaaaggcaatcactgctgccacactgaagttcaccgagggcaaagggtaccagccctgtgacccccaggtaatacaagaccgaatttcgcacctggaacaatgcttcgaagagcttagtaacatggcagccggacgaaaagcccagctggaacagtccaagcgcctatggaaatttttctgggaaatggatgaagccgaaagttggatcaaagagaaagagcagatttactcctccctagactatggaaaagacttaacgtcagtgctgattctgcagcgcaagcacaaggcatttgaggatgagctgcgtggactggatgcccatttggagcagattttccaggaagctcacggtatggtggcaagaaaacagttcgggcaccctcagatcgaggccaggatcaaagaggtttcagcccagtgggatcagttgaaggatttggcagcattctgtaagaagaacttgcaggatgccgagaacttctttcagttccagggggatgccgacgatctgaaggcatggttgcaggacgctcacaggcttctcagtggagaagatgtgggccaggacgaaggggcaacacgcgcactggggaagaagcacaaggactttctggaagagttagaggagtccagaggagtcatggagcacctggagcagcaagcccagggattcccggaagaatttcgcgacagtcccgacgtcactcaccgtctgcaggcactgagggagctctaccaacaggtcgtggctcaggccgacctgcgacagcagcggcttcaggaggcacttgatctgtataccgtattcggagagacagatgcttgcgaactatggatgggcgaaaaggaaaagtggctggcggaaatggagatgcctgacaccctggaggacctggaggtcgttcagcaccggtttgacatattggaccaggagatgaagactcttatgactcagatcgatggggtgaatctagccgctaactcccttgtggagtcgggacaccctaggtccagggaagtcaaacaataccaagatcacctgaacactcgctggcaggccttccagaccctcgtgagtgagcgcagggaagccgtcgattcagccttgcgcgtccataattactgcgtggactgtgaggagactagcaagtggattaccgacaagacaaaagtggtggagagcacaaaagatctcgggagggatctggcaggaataatcgccatccagcgcaaactctcaggactggaacgtgacgtagctgctatccaggcccgagtcgacgcgctggagagggaatctcagcaactgatggatagccatcccgagcaaaaggaggacattgggcagagacaaaagcatcttgaggaattatggcagggcctgcagcagtctctgcaaggccaggaagatctactgggggaggtgtcccagctccaggctttcctccaagatcttgacgattttcaggcttggctcagcataacacagaaggcggtcgcttcagaggacatgcctgaatccctgcccgaggcagaacagctgctgcagcagcatgcgggaataaaagatgaaattgatggtcatcaggactcataccagagagtgaaggagtccggagagaaagttatacaggggcagacggatccagagtatctactcctgggtcagagactggaaggtctagacactggttggaacgctttaggtcgcatgtgggaatcaagatcacatacactggcacaatgcctcggattccaagagtttcaaaaggacgccaagcaagccgaggccattctctccaatcaagaatatacactggctcatttggaacctccagatagcctggaggctgccgaagctggtatacgcaaatttgaggactttctaggtagtatggaaaataatcgggacaaagtgctgagtccagtggactctggcaataagctggttgccgaagggaatctctatagcgacaaaataaaagagaaggtgcagttgatcgaggatcgtcacaggaaaaataacgagaaggctcaggaggcctctgtactcctacgagacaacctggagctccagaatttcctgcagaattgccaggagctcaccctgtggattaatgacaagttgttgacctcccaagatgtgtcttacgacgaggccagaaacctgcataataaatggcttaagcaccaggcgtttgtggcggagctggcatctcacgaaggatggctggagaacatagacgctgagggaaagcagctgatggacgagaaaccacaatttacagccctcgtctcacaaaaactggaggccttgcaccgtctgtgggacgagctgcaagccactacaaaagagaaaactcagcatcttagcgctgcaaggtcttctgatctccgcctacaaacacatgccgatcttaataaatggatatcagccatggaggaccagttgcgatctgatgacccagggaaggatctgacttcagtgaataggatgttagccaaactcaagcgggtcgaggaccaggtgaacgtgcggaaggaagaacttggagaactgttcgcgcaggtgccatcaatgggcgaagaaggcggtgatgcggatctgtctattgagaagaggttcctggacttgcttgagcctctgggccgacgaaaaaagcagcttgaaagctcacgggctaaactgcagattagcagagatctcgaagatgaaactctgtgggtggaggagaggctgcctcttgctcagtccgccgactatgggacgaatctgcaaacagtacagctgttcatgaagaagaatcagaccctccaaaacgagattttagggcatacaccgagggtagaagacgtccttcagcggggtcagcagctggtggaggcggcagaaatcgactgccaggatctcgaggaaaggctggggcatctgcagtcttcgtgggacaggctccgcgaagccgcagctggcagattacagcggctccgcgacgcaaatgaggcccagcagtactatctggacgcagatgaggccgaagcatggatcggagagcaggagttgtatgtgatctcagacgagattcccaaggatgaggaaggcgctatcgtgatgcttaaacgacatctaagacagcagcgcgcagtggaggactatggcagaaatattaagcaactggcttctcgggctcagggactactaagcgctggccatccggaaggcgaacagatcattaggctacagggccaagttgacaaacactatgccggattgaaagatgtcgccgaggagagaaagcggaagctagagaacatgtatcacctgtttcaattgaagcgagagacagacgaccttgagcagtggataagcgagaaggaactcgttgcaagctccccagagatgggacaggactttgatcatgtgactttattgagggataagttccgagacttcgcacgagagactggcgcaatcggtcaagagagggtcgataacgtaaatgcttttattgaaagacttatagatgccggacattccgaggctgccaccatcgctgagtggaaagacggcctaaacgaaatgtgggctgatctactcgaactgattgacacgcggatgcagctcctggctgccagctacgacctccaccgatacttctacaccggagcggagattttgggcctgattgacgaaaaacatcgcgaactccccgaggatgtcgggctcgatgcatcaacagctgaaagctttcatagagtgcataccgctttcgagagagagttacatttgctgggggtgcaagtgcagcagttccaggacgtcgccactcggttgcagaccgcttacgctggggaaaaagccgaagccatccaaaataaggagcaagaggtttcggctgcctggcaggcgttacttgatgcctgtgcaggaagacgaacacagttggtcgatactgcagacaagttccggttcttcagcatggctagagatttactcagctggatggaatcaataattaggcagattgagactcaggaacggcctcgggacgtgagcagtgtcgaactgctgatgaagtatcaccagggcatcaacgccgagatagagactagatccaagaattttagtgcctgtttggagctaggagaatccctgctgcagcgtcagcatcaggccagcgaagaaattcgcgaaaaattgcagcaagtcatgtcccgcaggaaagagatgaatgagaagtgggaagcaaggtgggagaggctgaggatgctgctcgaggtgtgtcagtttagtagggacgcctcggtcgcagaggcatggctgatcgcccaggaaccatatctggcatctggcgactttgggcacacggtggactccgtcgaaaaactcattaagagacacgaggccttcgaaaagagcacagcctcgtgggcagagcgattcgcagctctggagaagcctactacgttagaactaaaggaacggcagatcgccgagaggccagcggaagagacaggcccacaagaagaagagggcgagacggcaggagaagcacctgtttcccatcatgccgctacggagcgcactagcccggtgagcctgtggtcccgtctgtcttcctcttgggagtccttgcagcccgagccctcccacccctacta

SEQ ID NO: 242096 - DNA, 6986 bp, Artificial Sequence
  Description of Artificial Sequence: Synthetic coding sequence
atgacatccgccaccgaattcgagaatgtgggcaaccagcccccttactcaagaatcaacgcacgctgggatgctcccgatgacgaactcgataacgataattccagcgctcggcttttcgagcggagtcgtatcaaggctttagcagatgaacgtgaggtggtccagaagaaaacctttactaaatgggtgaattctcacctggcaagggtgtcctgtaggatcacagacttgtataaggacctgagagatggacggatgctcattaagctgctggaagtgctgtccggcgaaatgcttccaaagccgactaagggaaagatgcgcatccattgcttagagaacgttgataaggcactgcagtttcttaaagagcaacgggtgcatttagaaaatatgggcagccatgacattgtggatggcaaccatcgcctggtgttaggactgatttggactatcattcttcgatttcaaattcaggatatcgttgtgcagacacaggagggcagagagactcgaagcgccaaagacgccctgcttctctggtgccagatgaagacagccggatacccccacgtcaacgttaccaacttcacatctagctggaaagatgggctggcattcaacgccttgatacacaagcaccgtccagacctgattgatttcgacaaactgaaggacagcaacgctcgccacaacctggaacatgcattcaatgttgctgagaggcagctggggatcatacccttgcttgatccggaagacgtgttcacagaaaacccagacgagaaatccattatcacgtatgttgtcgcattctatcattatttctccaaaatgaaggtgctggccgtcgaaggaaagcgggttgggaaggttattgatcacgccattgagaccgagaagatgattgaaaaatatagcggactcgcatccgacctattaacatggattgaacaaacaattacggtgttaaattctcgcaaattcgctaactcattgacaggcgtgcagcagcagttgcaggccttttcaacataccgcacagtcgaaaaaccccctaagtttcaggagaaggggaatctggaagtgttgctctttacaatccagtccaggatgagagcaaacaatcagaaggtatatacccctcacgacggtaaacttgtaagtgatatcaaccgggcatgggaatctctggaagaggccgaatatagaagagagctagctttgaggaatgaactgattcggcaagaaaaactggagcagctcgccagaagattcgatcgcaaagctgccatgcgggagacctggctttccgaaaaccagcgtctagtggcgcaagacaattttggctacgatctcgctgccgttgaggctgcaaaaaaaaaacatgaggcgattgagaccgacacggctgcttatgaggagcgtgtgcgtgcactggaagatttggcccaagaactcgaaaaagaaaactatcacgaccagaagagaattaccgctagaaaagataacatcctgcggctttggagctacctgcaggagctgctccagtcgaggcgccagaggttggagacaacgctagctctgcagaaactgtttcaggatatgctgcatagcatcgattggatggatgagatcaaggcgcacctgctttcggcagaattcggaaagcatctgctggaggtagaagaccttctccaaaagcataagttgatggaagctgacatcgccatccagggcgacaaagtcaaagcgattactgccgcaactctgaagtttaccgaggggaagggatatcagccttgtgaccctcaggtcattcaagacaggatctcacacctcgagcaatgctttgaagaactttctaatatggcagccggaaggaaggcacagctggagcaatcgaaacggctctggaagttcttctgggagatggacgaggccgagtcctggattaaggaaaaagagcagatttattcctccttggattatggtaaagatcttacctctgttctcatcctgcagaggaaacataaggcgtttgaggacgagctgcgaggcttggatgctcatcttgagcagattttccaagaagctcatggaatggtagccaggaaacagttcggccacccccaaatcgaagcaagaatcaaggaggtgtccgcccagtgggatcaattaaaggatctggctgctttctgtaaaaaaaacctgcaggacgctgagaacttcttccaatttcagggagacgccgatgatttgaaagcatggctgcaggacgcccaccggttgctttctggggaggatgtcgggcaggatgagggggcaactcgtgctctgggcaagaaacataaagactttttagaagaactcgaagagagtaggggcgtgatggaacatcttgagcagcaggcccagggcttcccggaggaatttagagattcaccagacgtcacccatcggttacaggctctcagagagctttaccaacaagtggtggctcaggcggatctgcggcagcagcgcttgcaggaagctttagatttatacaccgtatttggcgagacagacgcttgcgagctttggatgggcgagaaggaaaagtggctggctgaaatggaaatgcccgataccttggaggatctcgaggtcgtccaacatagattcgatatcctggaccaagagatgaagacattgatgacgcaaattgacggcgttaatctggcagcgaatagtttagtcgagagcggacatccccgatcacgggaagtgaagcaataccaggatcatctaaatactcgttggcaggctttccaaacacttgtgtctgaacgtcgcgaagctgtcgactccgctttgagagtccacaactattgcgtcgactgtgaagagacaagcaaatggatcactgataagacaaaggtggtggagtctacgaaagacttggggagagatctggccggaatcattgctatccagaggaaactgagcggattagaacgggatgtggctgccatccaagcgagggttgatgccctcgagcgggagtctcagcaactgatggacagtcatcccgaacagaaagaggatattggccagcgtcagaaacacctcgaagagttgtggcaaggactgcagcagtctctgcagggtcaggaagaccttctgggagaagtgtcacagctgcaggctttcctccaggacctggacgactttcaagcatggctttctattacacagaaggcagtcgctagcgaagatatgccagaatctctcccagaagcggaacagctcctgcagcagcacgcaggaattaaggacgaaatcgacggccaccaagacagttaccagagagttaaagagagtggggagaaggtcatccagggacagaccgacccggaatacctgcttcttgggcagagactggaaggcctagacacgggctggaacgcgctggggaggatgtgggaaagcagatctcatactttggcccagtgtctaggatttcaggagttccaaaaagatgcgaaacaggcggaggccatcctgtccaaccaggaatacaccctggcccaccttgaaccgcctgactcccttgaagccgcagaggcaggtattcgaaaatttgaagactttctgggttcaatggagaataatcgggataaggttctgtccccagtagattccgggaataaactcgtggccgaaggcaacttgtactccgataagattaaggagaaggtacaattgattgaagaccggcatcggaagaacaatgaaaaggcccaggaagcaagcgtccttcttagagataatctcgaactgcagaacttcctgcaaaactgccaagaactcactttatggatcaatgataaactcctgactagccaggacgtcagctatgacgaagctaggaatcttcacaataaatggctgaaacatcaggcgtttgtggcagagctcgcatcgcacgagggatggcttgaaaacatcgacgccgaagggaagcagctgatggacgaaaaaccacagttcaccgcactggtttctcagaagcttgaagcactgcaccgtctttgggatgaattacaggctacaacaaaagagaagactcagcatctctctgctgcgagatctagcgatctccgcttacagacgcacgccgaccttaacaagtggatctccgcaatggaggaccagctgaggtccgacgatcccggaaaggatctgacatctgtgaaccgcatgttagccaaactcaaacgcgtggaggatcaagtgaatgtccgtaaggaggaattgggtgagctgttcgctcaggtaccttctatgggggaggaggggggtgacgccgatttgtctatagagaagcgttttctggatttgctcgaacccctcggtcgtaggaagaaacaactcgagagtagtcgtgctaagttgcagatcagtcgcgatctggaggatgagaccctgtgggtcgaagaacgcctgcctctcgcccagagcgctgactacggtaccaacctccagactgttcaactgtttatgaagaagaaccaaaccctacaaaacgagatcctggggcacactcctcgggtcgaagacgttctgcagagaggccagcagctcgtcgaggccgcagagattgactgccaggacctagaggaacgattagggcacctccagtccagttgggatagactgagagaggcagccgcaggacgactccagagattgcgagacgcgaacgaagcccaacagtactacctcgacgcagacgaagccgaggcctggatcggtgaacaggagttgtatgtcatcagcgacgagattccaaaggatgaagagggcgctatcgttatgctgaaaagacatctgaggcagcagagggctgtggaagattacgggagaaacattaagcagctagcaagtcgcgcacagggactactgtccgccggacatcctgagggggagcagattatccgccttcaaggacaggtagataaacactacgctggattgaaagatgttgccgaagaacgaaagaggaaactggagaatatgtaccacctgttccaactcaaaagggagacagacgacctggaacagtggatttcggaaaaggagctcgtagcatcctccccggagatgggacaagattttgaccacgtcaccctcctccgtgataaatttcgcgatttcgcacgggaaaccggtgccatcggtcaggagagggtagacaacgtaaatgccttcattgaacggctgatcgacgcaggtcattccgaggctgcgactatcgctgaatggaaagatggcctaaacgagatgtgggccgatctgcttgaattgatcgacaccaggatgcagctgctggcagcctcctacgaccttcacaggtacttttatacgggagctgaaatccttggcctgatagatgaaaagcacagggagctccccgaggacgtggggctcgacgcttcaacagccgagtcattccatagagttcacactgcgtttgagcgggagcttcacctgctgggggtgcaagtgcaacagtttcaggatgtggccacaagattacagaccgcttatgcgggagagaaagcagaggctatccagaataaggagcaggaggtgtccgccgcatggcaggccctgctggatgcttgcgccggaagaaggacccagctggtcgataccgccgacaaattcagattctttagcatggcacgggatttgctatcttggatggaaagtatcatccgccagatcgagacacaggagcgcccaagggatgtctcaagtgtggagctgctgatgaaataccatcagggaatcaacgccgaaatcgaaaccaggtcgaaaaactttagtgcgtgcttggagctaggcgaatcactgctgcagcggcagcaccaggcatctgaggaaattcgagagaaacttcaacaagtgatgtcaaggagaaaagagatgaacgagaaatgggaagcaaggtgggagcgccttcggatgctgcttgaggtctgccaattctcgagggacgcctccgtggcggaagcctggcttatcgcccaggaaccttatctggcaagcggggactttggccacacagtcgacagcgtggagaaacttatcaagagacatgaagcttttgagaagagtacggccagctgggccgagcggttcgccgctctggagaaaccgacaacactcgaactaaaggaaagacagattgccgaaagacccgcagaagagacagggcctcaggaggaggagggggaaacagcaggcgaggcccctgtgtcacaccacgcggctactgaacggaccagccccggagaggaagagggcacctggccccagaatctgcagcagccccctcccccaggccagcacaaagatgggcagaaatcaacgggcgacgagagacccaccaccgaaccactcttcaaggtactggatacaccactgagtgaaggcgacgaaccggctacattacccgctcctagagaccatggccaatcagttcagatggaaggttacttgggacggaaacacgatcttgagggtcccaacaagaaggcttctaatcggtcctggaacaatttatactgcgtgctgagaaattccgagctaacattttataaggatgctaagaacctggcactgggcatgccgtatcacggcgaggaaccactagcgctgaggcacgcaatttgtgagatcgctgccaactataagaagaagaaacatgtgtttaagctacggttgtccaatgggtcggagtggctattccacgggaaggatgaagaggagatgttatcgtggttgcagggggtgtctactgccatcaacgagtcacagtcaatccgcgtcaaggcacagtccctgccgctccctagcctctctggccctgacgcatctctgggaaagaaggataaggagaagagatttagcttctttccaaagaagaagta

SEQ ID NO: 242097 - DNA, 6467 bp, Artificial Sequence
  Description of Artificial Sequence: Synthetic coding sequence
atggaactgcagcggactagctcaatctccggtcccctttctccagcctacacagggcaagtcccttataattacaatcagcttgaaggacgctttaaacaactccaggacgagagggaggccgtgcagaagaaaacttttaccaaatgggtgaacagccacctcgctcgggtttcctgccggattacagacctttacacggatctgcgagacggtaggatgctcataaaactgcttgaggtcctgtccggggaacggctgcccaagcctaccaagggccgtatgagaatccactgcttagaaaacgtggataaggcattgcagtttctgaaagagcaacgggtgcacttggagaatatgggatcacacgacattgtcgatggtaaccaccggcttaccctcggcctcatctggactatcatcctgaggtttcagatccaggatatcagtgtcgagacagaggataacaaggagaaaaagtcggccaaagatgccttgctcctgtggtgtcagatgaagacagctggctacccaaacgtgaacattcacaatttcactacaagctggcgtgacggcatggcattcaacgctctgattcacaagcatcgacctgacctgatagattttgataagctaaagaagtcaaatgcccattacaacctgcagaatgcatttaaccttgcagagcagcacctgggattgacaaagcttctggaccccgaggatattagtgtggaccaccccgacgagaagtctatcatcacttacgtggttacctattaccattattttagtaagatgaaagccctggctgtggaaggcaaacggattgggaaagtgctggacaacgctatcgaaacggaaaagatgatcgaaaagtatgaaagtctggcatccgatttactcgagtggattgagcagaccatcattatcctgaacaacaggaagtttgccaacagcttggtgggagtgcaacagcagctgcaggccttcaacacctaccggactgtcgaaaagcctcctaaattcactgagaaaggcaacctggaggtgctgctgttcacaatacaaagtaaaatgagggccaacaaccaaaaggtctatatgccaagggaggggaagcttatcagtgatatcaataaagcctgggagcggctggagaaagctgaacatgaacgcgaactcgcactgaggaacgagctgatccgacaggagaagttggaacaacttgcacggaggttcgaccgcaaggccgctatgagagaaacctggttatccgagaaccagcggctggttagccaggacaactttggtttcgatctgccagcggtggaagcagcaacgaagaagcatgaggcgatcgaaaccgatattgccgcttacgaggaacgtgtccaggccgtagtagcagtcgccagggaactggaagccgagaattatcatgacatcaagcgcattaccgccagaaaagacaacgtaatccgtctctgggagtacctgcttgaactgctcagagccaggaggcaaaggctggagatgaatttgggcttgcagaagatatttcaggagatgctgtacatcatggactggatggacgagatgaaagtgctagtgctgtctcaagactacggaaagcacctgctgggtgtggaagatctattgcagaaacacaccctcgtcgaagccgacatcggcattcaggccgagcgggtgcggggagtaaacgcatcagcacagaaatttgccaccgacggggagggctataagccatgcgatccgcaggtgatcagggacagggtggctcacatggagttttgctaccaggagctgtgccagctcgcggcagaacgacgagcccgtctcgaagagagcagacggctctggaaattcttctgggaaatggcggaagaagaaggatggattcgggagaaagaaaagatactgtcatccgatgattacgggaaagatttgacctctgtgatgcgccttttgagcaaacacagggctttcgaagatgagatgagcggaagatcggggcactttgagcaggccatcaaagagggcgaagacatgatcgcagaggaacacttcgggtcagagaagataagagagcgcattatctacatacgggagcagtgggccaacctggaacagttgtccgcaattcgaaagaaacgattagaggaggctagcctgctgcaccagttccaggcggatgctgatgatatcgatgcatggatgctggatattctcaagattgtctccagcagtgacgtgggccacgatgagtattccacacagtccctggtgaagaagcacaaggacgttgcagaagagatagctaattaccgtcctaccctggatacactgcatgagcaagcctccgccttgccccaggagcacgccgagagccctgatgtgcgcggaagactcagcgggattgaggagcggtacaaagaggtggcggagctcaccaggctgagaaaacaggcgcttcaggatacacttgccctctataagatgttttcggaggccgacgcctgcgagctttggatcgatgaaaaggagcagtggctaaataacatgcaaatcccggaaaaactagaggacctcgaagtgatccagcatagatttgagagtctggaacctgaaatgaacaaccaggcaagtcgtgtggctgttgtgaaccagatcgcaaggcaattgatgcacagtggacaccctagcgaaaaggaaatcaaggcacagcaagacaagctgaatacccgctggagtcagtttagagagctggtagaccgcaagaaagatgctttgctgtctgctctgtccattcaaaattatcacctggaatgtaatgaaacgaagtcttggatcagagagaagaccaaagtcattgagtctacccaggatctcggaaatgatcttgccggagtcatggccttgcagcggaagctcactggcatggagcgggatctggtggccatcgaagccaagttgagcgacctccagaaagaagctgaaaaacttgagagtgagcatcctgaccaggctcaggccatcttatctaggctggccgaaatctctgatgtttgggaagagatgaaaactactctgaagaatcgagaggcctccttaggcgaagcctccaagctgcaacagtttctgcgggacctagatgacttccaaagttggctgagtcgaacacagactgcgatagcatccgaagatatgcccaacacacttactgaggctgaaaagttgctaactcagcatgaaaacattaagaacgagatagacaactacgaagaagactatcagaaaatgcgggatatgggagagatggtcacccaggggcagacagatgcccaatatatgtttctgcgtcaaagactgcaggcattagacaccggttggaacgagctgcataaaatgtgggagaatcggcagaacttactgtcccagtcccatgcgtaccagcagttcctccgggacactaaacaggcagaggcttttttgaataaccaggaatacgtcttggctcataccgagatgccgacaacactggaaggagctgaggctgcgatcaagaagcaggaggactttatgacaacaatggacgctaacgaagagaaaattaacgccgtggtggaaacgggaagaaggctggtctcagatgggaacattaattctgatagaattcaagaaaaggtggactccattgatgaccgtcaccgcaaaaacagagagacagccagcgagctgctcatgcgcctcaaggataacagagacctgcagaaattccttcaggattgccaggaactctcgttatggattaacgaaaaaatgctcacagcacaggatatgagctatgacgaggccagaaatctgcattcaaaatggctcaaacatcaggcttttatggcagagctggcatcaaataaagaatggttagacaaaattgaaaaggagggaatgcagctgatctccgaaaagccagagactgaagctgtcgtgaaggagaagttgacaggactccacaagatgtgggaggtgttggagagcactacccagactaaggctcagagacttttcgacgcaaacaaagcagaactgtttacgcagagctgcgctgatcttgacaaatggttgcacggattggaatcccagatacagtcggatgactatggtaaggatctaacatcagttaacatccttctgaaaaaacagcagatgctggagaaccaaatggaagtcaggaagaaggagattgaggaacttcagtcacaggcgcaagcgctgtcccaggaaggaaagtccacagacgaagtggactctaaaaggctgaccgtacagactaaattcatggagctgctggaacctttgaacgagcggaagcacaacctcctcgcaagcaaagaaatccaccagttcaaccgggatgtagaagacgagatcttgtgggttggggagagaatgcccctggctaccagtacagaccacggccataacttgcaaaccgtgcaactgttgatcaaaaaaaatcagacccttcagaaagagatccagggccaccagccaagaatcgacgacatctttgaaaggtcacagaacattgttactgactctagttcgctgtctgcagaagctatccggcagagactggcagatctgaagcagctctggggactgttgatcgaagaaacggagaagcggcacaggcggctagaggaggcccaccgcgcacagcagtattacttcgacgctgcagaggccgaggcctggatgagcgagcaagaactgtatatgatgtcagaggaaaaggccaaagacgagcagtcggccgtgtctatgctaaagaagcaccagatactggagcaggccgtggaggactatgctgagaccgtgcaccagttgtccaagacctcacgagccctggtggctgactcccatccagagtctgagcgtatctcaatgaggcagtctaaagtcgacaagctctacgcgggtctgaaggatctggctgaggagcgccgtgggaaactcgatgagcggcataggttattccagctgaatcgggaagtggacgatctcgaacaatggatcgcggaaagggaggtagtggctggctctcacgagctcggacaggactatgagcatgtgacaatgctccaagagcgttttcgggaattcgcccgagacactggaaatataggtcaagaacgagttgacacagtaaaccatctggcagacgagctaattaactctggtcatagtgacgccgctacaatcgcagagtggaaagacggccttaacgaggcatgggctgatttactcgagctaattgatacacgcacgcagattctggcggcatcatacgagttgcacaagttctaccacgacgcaaaggagatcttcggccgaatacaagacaagcataaaaagctgcccgaagagttgggacgcgaccaaaataccgtcgagactctgcagagaatgcatacaaccttcgaacacgatatccaggccctgggaacacaggtccgtcagctgcaggaggatgccgctcgcctgcaagcggcttacgctggagacaaggccgacgacatccagaagagagagaatgaggttctggaggcatggaaatcccttctggatgcttgcgagtccagacgtgtaagactcgttgacaccggagacaaattccgttttttttccatggttcgcgatctgatgttgtggatggaggacgtgattcggcaaatagaggcccaggaaaaaccccgtgatgtcagcagcgttgagttgctgatgaacaaccaccagggcatcaaggccgagatcgatgcacgaaacgatagctttactacctgtatcgaacttggcaagtcgcttttagcccgaaagcactacgcctcagaggaaattaaggaaaaactgctccagcttaccgagaaaaggaaggagatgatagataagtgggaagacaggtgggagtggctgagactgatcctcgaggtccaccagtttagtcgcgacgcttctgttgctgaggcttggcttctagggcaggagccttatctctcttcgagggagatcggccaatctgtcgacgaggtggagaaacttatcaagcggcatgaggccttcgaaaaaagcgccgctacttgggacgagagattttctgctctggagagattaacaacactcgaattactagaagttaggcgccagcaagaggaagaagagcgaaaaagaaggccgccatctcccgaaccgtccactaaagtctctgaagaggcggagtctcagcaacagtgggacacttccaaaggggaacaggtgagtcaaaacggactgccagccgaacaggggagtcctcgcgtgtcctaccgcagtcagacataccaaaactacaagaactttaattcccggagaacagcttccgatcagccgtggagtgggcttta

SEQ ID NO: 242098 - DNA, 7094 bp, Artificial Sequence
  Description of Artificial Sequence: Synthetic coding sequence
atgaccacgactgtggcgaccgactacgacaatatagagattcagcagcagtattccgacgtgaacaaccgatgggacgtggatgattgggacaacgagaactcttctgcacgactgttcgagcgttctcgcattaaggcgcttgctgacgagcgggaggctgtgcagaaaaaaacctttaccaagtgggtcaactcccaccttgctagagtttcttgccgcatcactgatctatacaccgatttgagagatggacggatgcttattaagctgttagaggtactttccggggagcggctgccaaaacctaccaagggcagaatgcgtattcactgcctggagaatgtggacaaggcgctacagtttcttaaagagcaacgagtccaccttgagaatatgggctctcacgatatcgtcgatggcaatcacagactgacattgggcctgatttggactatcatacttcggtttcaaattcaagacatcagtgtcgaaaccgaagacaataaggaaaaaaaaagcgctaaagacgcattattactatggtgccaaatgaaaacagcgggttaccccaatgtgaatatccataactttaccacatcgtggagggacggcatggccttcaacgccctcatccacaagcacaggccagatctcatcgacttcgacaaattgaagaagagtaatgctcactataatctgcagaacgccttcaatttggccgagcagcacctgggcctcacaaagcttctcgatccggaggatattagtgtcgatcatcccgacgagaaaagtatcataacctatgttgtcacctattaccactacttctctaagatgaaggccctggcagttgagggaaagagaatcggaaaggttctggacaatgccattgaaactgaaaaaatgatcgaaaagtatgaaagtctggcaagcgacctcctggaatggatagagcagactattatcatcctcaataaccggaaattcgccaatagcctggtcggcgtccagcaacagcttcaagcctttaatacatacagaacagtcgagaagccacctaaattcaccgagaagggcaacctggaagtgctgctctttaccatccagtcaaaaatgcgggcaaacaatcagaaggtatatatgcctagggaaggcaagctgatctcagatataaataaagcttgggaacgactggagaaagctgaacacgagagagaactggcccttagaaatgaactgattcgccaggagaagcttgagcaactggcgaggcgcttcgaccggaaggccgcaatgcgggagacctggctgagcgagaaccaacggctggtgtcgcaagataactttgggtttgatctgccggcagtggaagcagccaccaagaagcacgaagctattgagaccgacatcgccgcttacgaggagagagtgcaggcagttgtggcagtagcaagggagctggaggccgaaaattaccatgacattaagcggattaccgctcgtaaagataacgtgattcgcctgtgggagtacctactggaacttctccgggctcgccgtcaacggctggagatgaacctgggcctgcaaaaaatttttcaggaaatgctgtacatcatggactggatggacgaaatgaaggtgctcgttctctcgcaggactatggcaagcatctgttgggtgtggaggatctattacagaaacacaccctcgtcgaggccgatataggtatacaggctgagcgcgtaaggggcgtgaatgcgtccgcccaaaagtttgccaccgatggcgagggttacaaaccgtgtgaccctcaagttattcgagaccgagtggcacatatggaattctgttatcaggagttgtgccaactagcggctgaaagacgggctcgcttagaagaatctcgaagactgtggaagtttttctgggaaatggccgaggaggaagggtggatacgagagaaggaaaaaatccttagctctgacgactacggaaaagatttgacttcagtgatgaggctactcagcaagcacagggcattcgaggacgaaatgtccgggaggagcggacattttgaacaggccataaaagaaggtgaggacatgattgccgaagagcattttgggagcgaaaagatcagagaacgtatcatttacataagggagcagtgggcaaacctggaacaattgagcgccattagaaagaaaaggctggaggaagcatcactgttgcatcagttccaggcagatgctgacgatatcgacgcctggatgctggatattttaaaaattgtgtctagctctgatgtcgggcatgatgagtacagtacccaaagcttagtgaagaagcacaaagatgtcgcagaagagatagccaactatagacccactttagacactctgcacgagcaggccagtgccctaccgcaggagcacgccgaatctcctgacgtcagagggcgattgtctggcatcgaggaaagatacaaggaagtcgcagaactgaccaggctccggaagcaggccctccaggacacgctggctctttacaaaatgttcagcgaagctgatgcatgcgagttgtggattgacgaaaaggaacagtggttaaacaacatgcagataccagagaagcttgaagatctggaggttattcagcaccgtttcgagtccctcgaaccggagatgaataaccaggcttcccgtgtggctgtggtcaaccagattgcacggcagctgatgcacagcggccatccgagtgagaaggagataaaggcccagcaagacaagcttaacacccggtggtcccagttccgagagcttgtagatagaaaaaaagatgcactgcttagcgcactgagtatccagaactaccatcttgaatgtaatgaaacaaagtcttggataagggagaaaaccaaggtcatcgagagtacccaggacttaggcaatgatctcgcaggggtcatggccctgcagcgcaaactgactggcatggaacgggacctggtagcaattgaagccaaattaagtgatctacagaaggaagccgaaaaacttgaaagtgagcacccagaccaggcacaggcaattctgagccgactggctgagataagtgatgtctgggaagagatgaaaaccacattaaagaacagagaagccagcttgggagaggcaagcaaacttcagcaattccttcgtgatctagatgatttccagagttggctctcaaggacgcaaactgcaatagcttcggaggatatgccgaacaccttgacagaagccgaaaaattactgactcaacatgagaatataaagaacgagattgataactacgaagaggattaccagaaaatgcgggatatgggtgagatggtgacccagggccaaactgacgcacagtatatgttcctcaggcagagactacaggcacttgacacaggatggaatgagctgcataagatgtgggagaacaggcagaatctcttatctcagtcccacgcgtatcaacagtttctcagagatacaaaacaggcagaagctttcctgaacaaccaagagtacgtcctggcccacaccgaaatgcctaccactctcgagggcgctgaggccgctatcaagaagcaggaggatttcatgacaacaatggatgccaacgaagaaaaaattaacgcagtggtggaaacaggacgccgattggtgtccgatgggaacatcaactcggaccggattcaagagaaagtcgacagtatcgacgaccggcacagaaagaacagagagactgcttccgagctgctaatgaggctgaaagacaacagggatctccagaaatttttgcaggactgtcaggaattgtctctctggatcaatgagaagatgctcaccgctcaggatatgtcgtatgacgaggcaaggaatctccacagcaaatggctgaaacatcaggcatttatggctgagttggctagtaacaaggaatggctcgataaaatagagaaggagggcatgcagctgatttcagaaaaaccagagactgaggccgtggttaaggagaagcttacaggcttgcacaaaatgtgggaggtgttggaatcaactacccagaccaaggcccagcgcctcttcgatgccaacaaggccgaactgtttacgcagtcctgcgccgacctcgataaatggttgcacggtctggagtcccagatccagtccgatgactacggtaaggacctgaccagcgtcaatatcctgctcaagaagcagcagatgttggagaatcagatggaagtaagaaagaaggagatagaggagctgcagtcacaggcccaagccctttcacaggaggggaagtcaaccgatgaagttgatagtaagcgccttacggtgcagactaaattcatggagctccttgagccgttgaatgagaggaagcataacctgctggcatcgaaagagattcatcaattcaatcgtgacgttgaagacgaaattctctgggtgggagaacgcatgcccttggcaaccagtacggatcacggccacaacctccagactgtgcagcttctgattaagaaaaaccagaccctgcagaaagaaattcagggacaccagcctcgtattgacgacattttcgagcgaagccaaaatatcgttaccgattcctctagtttatcagcagaggctattagacaaaggctagccgatctgaagcagctgtggggccttttaatcgaagagactgaaaagcggcataggcgcctggaagaggcccaccgagctcaacagtactacttcgatgccgcagaggccgaagcctggatgtcggaacaggagctctatatgatgtccgaagagaaggctaaggatgagcaatccgctgtgtccatgctgaaaaagcaccaaatcctcgagcaggcagtggaggactacgccgaaacagtccaccagctgtctaagactagcagggcactggtcgcagactctcaccccgagtctgagcgcattagtatgcggcagtctaaagtcgacaaactttacgccggactgaaggaccttgccgaggagcgcaggggaaagttggacgagagacacaggctctttcaattaaaccgagaggtggacgacttggagcaatggatcgccgagcgggaagttgttgcgggttctcacgagctgggtcaggattacgaacatgtgacaatgttgcaggaacgctttagggaattcgccagagacacagggaacattggccaggagagagttgacacagtgaaccacttagcagacgagctgatcaactccggccacagtgatgctgctacaattgctgaatggaaggatgggctgaatgaggcgtgggctgacctcttagaacttatcgacacacgaacgcagatactggcagcctcctacgagcttcacaaattttatcatgatgctaaggaaatctttggaagaattcaggataaacacaaaaaattgcctgaagagttaggcagagatcagaatacagtagaaactttgcagcggatgcacaccaccttcgagcacgatatccaagcactcgggacacaggtgcgccaactgcaggaggacgctgccagactgcaagccgcttacgcgggtgataaggctgacgacattcagaaacgggagaatgaggtcctggaggcctggaaatctctcctggacgcttgcgaatctcggcgagtgagattggttgacactggggacaagtttaggttcttttcgatggtgcgtgacttgatgctctggatggaagacgtgattagacagattgaagctcaggaaaagcccagagatgtgagcagtgtggagcttctgatgaataatcaccagggtataaaagctgaaatagatgcccgtaatgattccttcactacctgcatcgagctcgggaagtctcttctcgctcggaaacactatgcgagtgaagagatcaaggagaaactactccagctcaccgaaaaacgcaaggagatgatagataaatgggaggatagatgggaatggctgcgcttgatcctggaggtccatcagttcagcagggacgccagtgtcgcagaagcctggctgctggggcaggagccttatctctcctcaagggaaataggccagtccgtagatgaggtggaaaaattgatcaaacggcacgaagctttcgaaaagtcagcagcaacttgggacgagagatttagtgccctcgagcgactgaccactctcgaactactagaggttagacggcagcaggaggaagaggaacgaaaacggaggcccccttctccggagcccagcaccaaggtcagtgaggaggcggagtcccagcagcaatgggacacctccaaaggtgagcaggtctcccagaacggtctccctgcagagcaggggtccccaaggatggctgaaactgtggacaccagcgaaatggtgaatggcgctacggagcagcgtactagtagcaaggagagctccccaattccttcacccacctcagatcgtaaggccaaaactgctctccctgcacaaagtgccgctaccctgccagcaagaacacaggagacccctagtgctcagatggaagggttcctgaacaggaagcacgagtgggaagcacacaacaagaaggcctcatctagaagttggcacaatgtgtattgcgtgatcaacaaccaagagatgggtttttataaagacgcgaaaacggcggcttccgggatcccctaccatagcgaggtcccagtgtccttaaaggaggctgtatgtgaggttgccctggactacaaaaaaaagaagcatgtgttcaaactcaggcttaatgacgggaatgagtatctgtttcaggccaaagatgacgaagagatgaacacgtggatacaggccataagttcagccatcagcagcgataaacacgaagtgtctgcatccactcagagcactccagcgagctcccgggctcagacactgcctacaagcgtggttactattacctctgagtcttctccgggtaaaagggagaaggataaagagaaggacaaagagaagcgcttttcactcttcggaaagaagaaata

SEQ ID NO: 242099 - DNA, 2073 bp, Artificial Sequence
  Description of Artificial Sequence: Synthetic coding sequence
atgaccactaccgtggccaccgattacgataatattgagattcaacaacagtactcagatgttaataatcggtgggatgtggacgactgggataacgagaacagctctgccagactattcgaacggtctagaataaaggccctggccgacgagcgtgaagccgtgcaaaagaaaaccttcactaagtgggtcaatagtcatctcgctcgagtttcctgcaggatcactgacttgtacacggatctccgagatggtcggatgctcattaagttgctagaagtgctgagcggcgagaggctacctaagcccacaaagggcagaatgcgcatccattgtctggagaatgtagataaggcactgcagttcctgaaggagcaaagagtgcatttggagaacatgggttcccacgatatcgttgatggcaatcatcggctgacgctgggactaatctggacaatcattctccggtttcagatccaggacatctccgtagaaactgaggataacaaagagaagaaatccgcgaaagatgccctgctactgtggtgccagatgaagaccgccggataccccaacgtgaatatacacaacttcaccacgtcctggcgagatggtatggccttcaatgcactgatccataagcacagacccgatctgattgactttgataaactgaaaaaaagtaatgctcattataacctgcagaatgctttcaatttagctgaacaacatctcggcctcacaaaactattggaccccgaggatatttctgttgaccatccagacgaaaaaagtatcatcacctacgtggtaacctactaccactatttctctaagatgaaggcattagccgtggagggtaaacgcatcgggaaagtgctagataacgcaattgagaccgagaagatgattgaaaagtacgaatccctggcttccgatcttttagagtggatagagcagaccatcattatcttaaataaccggaagttcgcgaactccttagttggagttcagcaacagctgcaggccttcaacacttaccggactgtggagaagccaccaaagtttaccgaaaagggcaacctcgaggtcctcttattcacaatccaaagcaagatgagggctaataaccaaaaggtttacatgcctcgcgagggcaagcttatatctgacatcaataaagcttgggaaaggctcgaaaaagcggagcacgagcgtgaactcgctctgaggaatgaattaatacggcaggaaaaacttgagcagctcgcacgtagattcgaccgcaaagctgcaatgagggaaacatggctgagtgaaaatcagcgtctcgtatcacaggacaatttcggttttgacctgccagcagtggaggccgcaaccaaaaaacacgaggccatcgaaactgatatagccgcatacgaggaacgcgttcaagccgtggtagccgttgcaagggaattggaagccgagaattaccacgacatcaagaggattactgctagaaaggacaacgttatccgactgtgggaatacttgcttgagttgctcagggcaagaagacagcgactcgagatgaacctgggcctgcagaagattttccaggagatgctttatatcatggactggatggacgagatgaaggtacttgtgttgtcgcaggactacgggaagcacttgctgggggtcgaggatctgctgcagaaacacacactggtggaagctgacatcgggattcaagccgagagagtccgcggtgtgaacgcatccgcgcagaaattcgctacggatggagaaggctataagccttgtgatccccaagtcatccgggaccgggtggctcatatggagttctgctaccaagagctttgccaactcgcggctgaacggagagcccgtcttgaagagtcaagaagactgtggaagttcttctgggagatggccgaggaagaagggtggattcgggaaaaggaaaagattctttcttccgatgattacggtaaggacctgacttctgtgatgaggctgttgtcaaaacacagagcatttgaagatgagatgagcggtcgctag

SEQ ID NO: 242100 - DNA, 7172 bp, Artificial Sequence
  Description of Artificial Sequence: Synthetic coding sequence
atgtcttccacactgagcccgaccgatttcgactctctggagatccaagggcagtattcagacatcaataataggtgggatttgcctgacagcgattgggacaacgactcttcaagcgccagactttttgagcgcagccgcattaaagcccttgccgatgagagagaagccgttcagaagaaaactttcactaagtgggttaattctcatttggcccgtgttacatgtagagtcggcgatctttattccgacctgcgtgacggtcgaaaccttctcaggcttctggaagttctcagcggcgagatcctgcctaagcctactaaaggcagaatgaggatccattgtctcgagaatgtggataaggctctgcaatttctcaaagaacagaaggtgcatttagaaaatatgggatctcacgatatcgttgacggaaatcaccggctgaccctggggctagtctggaccattatactcagattccagattcaggatatttctgtggaaacggaggacaacaaggaaaaaaaatccgcaaaggacgccttactgctatggtgtcagatgaagactgctggatatcctaacgtgaacgtacacaacttcacaacttcatggcgagacggtctggcgtttaatgccatagtacacaaacaccgcccagatctgctggactttgagtctctcaaaaagtgtaatgcccattataacttacaaaacgcctttaatcttgcagaaaaggagctgggcctaactaagctgttggaccccgaagacgttaacgtcgaccaacccgatgagaagagcataatcacctatgtggctacttattaccactacttcagtaaaatgaaggctcttgctgtcgaagggaaaagaattggaaaagtgctggatcacgccatggaagctgaacgcctggtagagaagtacgagagcctggctagcgaacttttgcaatggattgaacagacgatcgtgactttgaatgaccggcagttggctaacagcctttctggcgtacaaaatcagctccagtctttcaatagctaccgcacagtggagaagcccccaaagttcactgaaaagggaaaccttgaagtgcttctcttcacaatccagagcaaattacgggcaaacaaccaaaaagtgtatactccacgcgaagggagattgatctctgacattaacaaagcttgggagaggttagagaaggctgagcatgaaagagaactggccttgcggacggaactcattaggcaggagaaactggaacagttggcggctagatttgaccgaaaagcagcaatgcgcgagacctggctgtcagagaatcagaggctggtcagccaagacaacttcggtttggagttggcagccgttgaagccgctgtccggaaacacgaggccattgagaccgacatcgtggcttactctggacgggttcaggcagttgatgctgtggcagccgagcttgccgctgaacgataccatgacattaagcgaatcgctgcccgtcagcacaatgtagctagattgtgggattttctgcgccagatggtggcggcacggcgagagcgactgctgttaaatctcgaactccagaaggtgttccaggatttgctgtacctcatggactggatggaggaaatgaagggtcgcctgcagtcacaggatctgggccgacatttggctggcgtagaggacctcctgcagttgcacgagttggtcgaggctgatatagcagtccaagccgagagggtgagggccgtgtccgcctctgctctccgcttctgcaaccccggaaaggagtacagaccctgcgacccccaattggtgtcggaacgggtggccaagcttgagcagtcctatgaggctctgtgcgagctggcggctgcccgaagagcgagactggaggagagtagacgactgtggcgctttctgtgggaagtcggggaagccgaggcatgggttcgcgagcagcagcacttgctggctagtgccgacactgggagagacctcacaggagcactgcgcctgttgaacaagcacaccgcactgcgtggcgaaatgagcgggcgactgggcccactgaagctcaccttggagcaaggacagcagctcgtggcagaggggcatcctggggcatcacaagcctctgctagggctgccgaactgcaggcccaatgggaaaggcttgaagccttagccgaagagcgcgctcagcgccttgcacaagccgcttcactgtaccagttccaggctgacgccaacgacatggaggcctggctggtagatgctttgcggctggtttcctcaccagagctgggacacgatgagttctcgacacaagctcttgccagacaacatagggctcttgaagaagagattcgatctcaccggccaacactggacgccctgagagaacaggcagcagctctgccgcctaccttgtcgcggacaccagaggtgcagagcagagttcctactctagagcgccactacgaggaactgcaggccagagccggtgaacgcgcacgtgccttggaagcagcactggcattatacacgatgcttagcgaagccggtgcatgtggactgtgggtggaagagaaagagcagtggctaaacggcttggctcttcctgagaggctggaagatttggaggtggtgcagcagagattcgagacccttgaacctgaaatgaatactttagcagcccagataacagcagttaacgacatcgcggaacagctcctgaaggccaacccaccaggcaaggataggatcgtaaacacccaggagcaactgaaccataggtggcagcagttcagaagactcgcagacggaaagaaggccgcactgacaagcgcccttagcatccagaactatcacctggagtgcacagagactcaggcttggatgagagagaagacaaaagttatagagtcaacacagggcctcggcaatgacttggccggagtgctggctctccagaggaaactggcgggtactgagcgcgacctcgaggcgatagcagccagagtgggcgagttgacccgagaagctaacgcattagccgcagggcatccagcacaggctgttgccattaatgcacgacttcgggaggttcagaccgggtgggaagatctcagagcaacaatgaggcgcagagaggagtccctgggagaggctaggcggcttcaggactttctgcggagccttgatgactttcaggcatggctggggaggacccagactgccgtggctagcgaggagggccctgcgacactgcccgaggctgaagcgttacttgcccaacacgcggcactgcgtggcgaggtcgaacgagcccagtccgagtacagccgactgcgggctctcggagaggaggttaccagggaccaagctgacccccagtgcctgttcctgcggcagcgtcttgaggccttagggactggctgggaagaattagggcgaatgtgggagtccaggcagggacgccttgcccaagctcacggattccagggattccttcgagatgctcgccaggcggaaggagtgttgtcatcacaggagtacgtgctatctcacaccgaaatgccgggaactttacaagccgctgatgcagccatcaagaagctggaagacttcatgtccacaatggacgcaaacggggaacgaatccatggcctgctggaagccggacgtcaactggtgagcgaaggcaatatacacgctgacaaaatccgcgagaaagcagactcaatcgagcgtcgccataaaaagaaccaggatgccgcacagcagttcctgggacgcttaagggacaatcgtgagcagcaacacttcctgcaggattgtcacgagctgaagctctggattgacgagaaaatgctgacggcccaagatgtttcatacgatgaagcccgaaatttgcacactaagtggcagaagcaccaggctttcatggcagaacttgctgctaacaaagactggcttgataaggtggataaagaagggagagagttaacgctggagaaacccgagctaaaggctttggtgtccgagaagttgagagatctccatcgacggtgggacgagctggagaccactactcaggctaaagcccgttcgttgtttgacgcaaaccgtgccgagctcttcgcccagagttgctgtgctctcgaatcctggttagagtcattgcaggcgcagctgcattctgacgactacggcaaggacctaacctccgttaatattctgctgaagaagcagcaaatgctcgaatgggaaatggcggtcagggaaaaggaggtggaggctattcaagcccaggcgaaggctctcgctcaggaagaccagggggctggcgaagtcgaaagaacttcgcgcgctgtagaggagaagtttagagctctctgtcagcctatgcgagagcgctgccggaggttacaagcgtctagggagcagcatcaatttcaccgagacgtagaggacgagattctttgggtgacagaacggctcccaatggcctcatccatggagcatggcaaagatctcccaagcgtgcaactgttaatgaagaagaatcagacactgcagaaggagatacagggtcatgaacctcgcatcgcggacttaagagagcgtcagagagctctgggagccgctgcagccggtcctgagctagccgagctgcaagagatgtggaaacgactggggcacgagctagaactgcgaggcaagcgtttggaggatgctttgcgggctcagcagttttatcgtgatgctgctgaagccgaagcttggatgggagagcaggagctccacatgatgggtcaggagaaagctaaagacgagctctcggcacaggccgaagtgaaaaagcatcaggtcctggagcaggctctggctgattatgcacagactattcaccaactggcagctagcagccaagacatgattgatcacgagcaccctgaaagcacccgcatcagtattaggcaggcccaggttgacaagctgtatgctgggctgaaggaactcgcaggcgaaagaagagagcgtctgcaagaacaccttcgtctgtgtcaattgagaagagaactcgatgatttggaacagtggatccaggaacgcgaagtggtcgccgcatcccacgagctcggacaggactacgagcacgttacgatgctaagagataaatttagagagttcagtcgcgacacgagcacaataggacaggagagggtggactcagccaatgcactggcaaacggtcttattgcaggcggacacgcagccagagccacagtggccgagtggaaggacagcctcaacgaagcctgggccgaccttctggaacttcttgacactcgcggtcaggtcctcgcagctgcctatgaactgcagcgcttccttcacggcgcacgccaggctctcgccagggttcaacacaaacagcaacagcttcccgatgggacaggacgggatctcaacgccgctgaggccctacaaaggcgacattgcgcctatgagcacgacattcaggcactgagcccacaagttcagcaggtccaagacgacggccaccgtctgcagaaagcctatgccggagacaaagctgaggagattggacggcatatgcaggctgtagcggaggcctgggcccagctgcagggcagctctgcggcaaggcggcagttactgctggataccacagataagtttcgtttcttcaaagctgtcagagagctgatgctgtggatggatgaagtcaatctccaaatggacgctcaggaaagacctcgcgatgtgagctctgccgatttagtcatcaaaaatcagcagggcatcaaggcagagatcgaggccagggccgacagattttcatcttgtattgatatggggaaagagcttctcgccaggtcccattacgccgcagaggagatctctgaaaaactgtcacaattgcaggccaggcgccaggagaccgccgagaaatggcaagaaaagatggattggctgcagttggtgctggaggtcctggtgttcggaagggatgctggaatggctgaggcctggctgtgttcacaagaacctctggtgcggagcgcagagctggggtgcacagtagacgaagtggaatctctgattaagcggcatgaggcctttcaaaaatccgccgtggcctgggaggagcgattctgtgctctcgaaaaactcacggctctggaggaaagagagaaggaaaggaagcgcaaacgcgaggaagaagagcgccgaaaacagccaccagcacctgaaccgaccgccagtgtccccccaggggacttagtcggcggtcagacagctagtgatactacctgggacggtacccagcccaggccacccccaagcacccaagcgcctagcgtgaatggggtctgtacagacggggagcctagccaacctctcttgggccaacaacgcctggaacatagcagcttcccagaaggcccaggacccggaagtggtgacgaggccaatggtcccagaggggaacggcagaccagaacccggggaccagcaccatccgctatgccacagagccggtcaaccgaatctgcacacgctgcaacgctgcctcctcggggtccagagccaagcgctcaagagcagatggaggggatgctgtgccggaaacaggaaatggaggccttcgggaagaaagccgctaacagaagttggcagaacgtctattgcgtactgagacgcggtagtctggggttctataaagacgctaaggccgcatccgccggagtgccctatcatggggaggtgcctgtgagtttagcccgagcccagggcagcgtagcattcgactataggaaacgcaaacatgtgttcaaattgggccttcaagacggcaaggagtacctgttccaagcaaaggacgaggccgaaatgtccagttggctaagggtggtcaatgccgctatcgcaacagctagttcagcttcaggtgaacctgaagaacccgtcgtgcccagcaccaccaggggaatgactcgggctatgacgatgcccccagtgtcccccgtgggagcggaaggccctgtggtcctgcggagcaaggacgggcgagagcgcgagagggaaaaaagattcagctttttcaagaagaacaaata

SEQ ID NO: 242101 - DNA, 2805 bp, Artificial Sequence
  Description of Artificial Sequence: Synthetic coding sequence
atgtcctctactctcagccccacagattttgactccctagaaattcagggccaatactctgacatcaataaccggtgggatctccccgactccgactgggataatgactcatcttctgccagactgttcgaaagatctaggattaaggcactggctgatgaacgggaggccgtccaaaagaagacatttacaaagtgggttaactcacacctcgcacgcgttacctgccgggtgggcgatctatatagtgaccttagagacggacgtaatctactcaggcttctggaggtgttgagtggagaaatcctgcctaagccaaccaaaggccgtatgcgcatccattgtctggaaaatgtcgataaggctctgcagttcctgaaggagcagaaggtgcacctggaaaacatgggctctcacgacatcgtcgacgggaatcatcggttaactctgggcctggtgtggacaatcattctccgattccaaatacaagacatatcagtagagacggaggataacaaagaaaaaaaatctgctaaggacgcgttactgctctggtgtcagatgaaaactgcaggctatcccaatgttaacgtgcacaacttcactacctcctggcgggatgggctcgccttcaacgcaatcgtgcacaagcatcgtcctgatctcttggactttgagagtctgaagaagtgcaatgcacactataatctgcaaaacgccttcaatttggccgagaaggagctcggcctgaccaaactgctggaccctgaggatgtcaacgttgatcagccggacgagaaatccatcatcacatacgttgcgacatactaccactatttttcaaaaatgaaagccctcgccgtggagggaaagaggattgggaaagtgttagaccacgcaatggaagctgagcgcctggtagaaaagtatgagtccctcgcatccgaactgctgcagtggatcgagcagaccattgtaaccctgaacgatcgccagttggctaactccctttccggcgtgcagaatcaactgcaatcctttaattcttataggacagtggaaaaaccccctaaatttacggagaagggtaatctggaggtgctcctgttcacaatacaatccaagctgagggcaaataatcaaaaggtgtatacgccccgtgagggcagactgatctccgacatcaacaaggcatgggagcggctggaaaaggctgagcacgaacgcgagttggccttacgcaccgagcttatccgccaggagaaactggagcagctcgccgcacgctttgatagaaaggctgcgatgcgcgaaacctggctgagcgaaaaccaaagactggtgtctcaagataattttggactggagcttgccgcagtggaagcagctgtaaggaagcatgaagctatcgagacggacattgtggcttactcagggcgagtgcaagcggttgatgcagtggccgcagagctggcagcagaacgttaccatgacatcaagcgaatcgctgcccgacaacataacgtggctcgcctgtgggacttcctcagacagatggttgccgctagacgggagaggcttctattaaatctcgagctgcagaaagtcttccaagatctgctttatctaatggattggatggaagagatgaagggacgccttcagtcacaggatctcggccgtcatttagccggagtagaagacctactccaactgcacgagctggtggaggcagacatcgccgtgcaggcagaaagagtgagagcagtcagtgcctctgcactccgcttctgtaaccccggtaaggagtacagaccatgcgatccccagctggtttctgagcgcgttgctaaactgaccgcactcgaggagcgagagaaggaacgcaaacgcaagagggaagaggaggaacgtcgtaagcagccccctgctccagagcctaccgctagtgtgcctccaggggatctggtgggagggcagacagccagtgacactacgtgggacggcacccagccgagaccgcctccgagcacgcaggcaccctcagttaatggagtgtgtaccgatggtgaaccctcacagccactgctaggtcagcagagactagaacactcttccttccctgagggaccaggccctggatctggtgatgaagccaatgggcctcggggagagcgccagacaaggacccggggacccgctccaagtgccatgccgcagtcaagaagcaccgaatcagctcacgctgctaccttaccacccaggggcccagaaccttccgcacaggagcagatggaaggaatgctctgccgcaagcaggagatggaagccttcgggaagaaggccgctaacaggtcgtggcagaacgtctactgcgtgctgaggcgcggaagcctcggattctacaaagatgccaaagcagccagtgcgggagtgccttatcacggtgaggtccctgtgtcgctcgcgagggcacagggctccgtggcctttgattacaggaaaagaaagcacgtctttaaactgggcctgcaggatggaaaagagtacctatttcaggcaaaggatgaagccgagatgagttcttggctgcgtgtggtcaacgcggctattgccaccgcttctagcgcgtctggagagcccgaggaaccggtcgtgccctcgacaacccgcggaatgacccgggcaatgacaatgccaccagtgtcacctgtgggcgcagagggtccagtggtcttacggtcaaaagacggcagagaacgcgaacgagaaaaacgattctcattctttaaaaagaataagtag

SEQ ID NO: 242102 - DNA, 354 bp, Artificial Sequence
  Description of Artificial Sequence: Synthetic coding sequence
atgagctctactctcagccctacagattttgattctctggaaatccaggggcagtacagtgacatcaacaataggtgggatcttccagatagcgattgggataacgacagctcatctgctcgactttttgagcgttcccgcatcaaagcgctggccgatgaaagagaagcagttcagaaaaagacattcacaaaatgggtgaactcccaccttgctcgtgtgacgtgtagggtcggcgacctttacagcgatctccgggacggacgcaatctgctaagattactcgaagtgctcagcggggagatactgccaaagcccaccaagggaaggatgcgtatacattgtctggagtag

SEQ ID NO: 242103 - DNA, 7097 bp, Artificial Sequence
  Description of Artificial Sequence: Synthetic coding sequence
atgtcttcaaccctgtcacccacagactttgacagtctcgagatacagggtcagtattctgacatcaataatcgttgggacttgcccgactcagattgggacaacgacagcagctccgctaggctgtttgagcgctctaggataaaagcactcgccgacgaacgagaagctgtccagaagaaaacatttaccaaatgggtgaactcccatctggccagggtgacatgccgggtgggagatttgtatagcgaccttcgagatggtagaaacctgctgcggttactcgaagtgctctccggagagattcttccgaagcctacaaaggggagaatgcgaatacattgtctggaaaacgttgataaggctctgcaattcctcaaagagcagaaagtccacttggaaaatatgggcagccatgatatcgtcgatggtaaccatcggttaaccctcggactggtgtggactatcatcctaaggtttcagatccaagatatcagtgtcgaaaccgaagacaataaggagaagaagtccgctaaagatgcactgttgctgtggtgccaaatgaagactgcgggataccctaatgtcaacgtccacaactttaccacaagttggagggacggattggcttttaacgccatcgtgcataagcaccgaccagacctgcttgatttcgagtctttgaaaaaatgcaacgctcattataacctccagaatgctttcaatctggcggaaaaggagctgggcctgacaaagctcctggacccggaagatgtaaatgttgatcagccagacgaaaagtccatcataacctacgtcgctacttattatcattatttttccaaaatgaaggctctcgctgtcgagggcaagcggattggtaaggttctggaccacgccatggaggctgaacgcctcgtggagaaatacgagagcctggcttccgagttgctacagtggattgagcagacaatagttacgctaaacgaccgccagctggccaatagtctgagcggagtacagaaccagttacagagcttcaattcttaccgcaccgtcgaaaagccccctaaatttacggagaagggcaatttagaggtgctgctcttcacaatccagtcgaagctgcgggcaaataatcagaaagtttatactccgagagagggcagattgatcagcgatataaacaaggcctgggagcgccttgagaaagcggagcacgaaagagagctggctctgcggacagaattaatacgacaggagaaacttgaacaacttgccgctcggtttgaccgaaaggccgctatgcgcgaaacctggctgtcagagaaccagaggttggtctctcaggataacttcgggctcgaactcgcagccgtggaagccgcagtgcgaaagcatgaagcaattgagaccgacatagtggcatactctggtcgcgtgcaggcagtggacgccgttgccgctgaacttgctgctgagaggtatcacgatataaagcggattgcagcacgccaacacaatgtggctagactgtgggactttttaaggcaaatggtcgctgccaggcgagaacgactactgctgaacctggagctgcagaaagtctttcaggatctgctgtacctcatggattggatggaagaaatgaagggtagacttcaaagtcaggatctggggagacacctggccggagttgaggacttgttacagctgcacgagctggtggaggcagacatcgccgttcaagctgagcgcgtgcgtgccgtgtccgcctcagctctgcgtttttgcaaccccggaaaggaatacagaccttgcgaccctcagcttgtatcagagcgagtggctaagctggagcagtcatacgaagccttgtgcgagctcgccgcagcacgcagagccagattggaggagagccggaggctgtggaggttcctgtgggaagtgggtgaggcagaagcctgggtccgtgagcaacagcacttgcttgcctctgccgacaccggccgtgatctcacaggggcattacgcctactgaataagcacacagctttaaggggtgaaatgtccgggcgtctgggaccactgaagctgactctggagcagggccagcagctagttgcggaaggacacccgggagcctcccaggctagcgcgagagccgctgaactgcaggctcagtgggaacgcttggaagctttggcggaggagagagctcagcgcttggcccaggccgcttctttgtaccagtttcaggcagatgcaaacgacatggaggcctggcttgtggacgcactacgcctagtttcgagtcctgagttgggccacgacgaattctctacccaagctttagctaggcagcacagggccctggaggaggaaatccgttcacacagacccacgttggacgccctgagggaacaggcagctgctttgcctcctacactcagtcgaactcccgaggtacagtcacgggtcccgacactggaacgccattacgaggaacttcaagcacgagcgggagaacgagcaagagccctggaggccgcactggccctgtacacaatgctgtccgaggcaggcgcatgcggcctctgggtcgaggaaaaggagcagtggctgaacggactggccctacccgaacggctagaagatcttgaggttgtccagcaaagattcgagactctagagcctgaaatgaataccctcgccgctcagatcacggcagtgaacgatatcgccgagcaactgctcaaggccaatcccccagggaaggatagaattgtgaacacacaagagcagttaaaccataggtggcagcaattccggaggctagcggatgggaagaaggccgctttgacatctgctctctccattcagaattatcaccttgaatgcacggagacccaggcttggatgcgggaaaagaccaaagtgatagagtccactcagggtctgggcaacgacttagcaggagtattagccctacagcgtaaactcgccggaaccgagagggaccttgaagctattgccgcaagggtgggagaactcaccagggaagcgaacgctctcgcagccggtcaccctgcgcaggccgtggccataaacgcacgactgcgggaagtacaaacaggatgggaagacctgcgagccacgatgcggcgtcgcgaggagagcctgggagaggctaggcgcctccaagacttcttgagatcccttgacgattttcaggcgtggctgggaagaactcagacggcagttgcgtcggaggaaggcccagccactctccccgaagctgaggccttattggcccaacacgctgctctaagaggggaggtcgagcgggctcagtctgaatattctagacttagggccctgggtgaggaagttacacgcgaccaagcggacccccagtgcttgttcctgaggcagcgattagaggccctgggcaccgggtgggaggagcttggaagaatgtgggagagcagacaaggcagattggcacaggcccacgggtttcagggattcctcagagatgcccgtcaggctgaaggcgttctgtcctcacaggagtacgtgctctctcatacagaaatgccgggaacgctacaggccgcagacgcagccattaaaaagctggaggactttatgagtaccatggatgccaacggcgagaggatccacggccttctagaggctgggaggcagctagtgtctgaaggaaacatccacgctgataaaatccgggaaaaagctgactccatagagcggaggcacaaaaaaaatcaggacgccgctcaacagtttctgggaaggctgcgcgacaatcgcgagcagcagcatttcttacaggactgccatgagctcaaactgtggatcgacgagaaaatgctgacagcacaagatgtctcctacgacgaggcacgcaatctgcacactaagtggcagaaacatcaagccttcatggctgagttagctgcaaacaaggactggctagataaggtagataaggaaggccgagagttaaccctcgagaaaccagagttgaaagcccttgtctcagagaagctgcgagacctccataggagatgggacgagctggaaaccaccacccaggctaaggcacgctctctatttgatgccaacagagccgagttgttcgcgcaatcttgttgcgcactggagtcttggttagagagcttacaggcgcagctccactcagacgactacggtaaagacctgacctccgttaacatcctcttgaagaagcagcagatgctcgagtgggaaatggccgtgcgggagaaagaggtggaggccattcaggcgcaagcaaaggcgctggctcaggaagatcagggagccggtgaagtagagcgaacatcacgagctgtggaggagaaatttcgggctctgtgtcagccaatgcgcgaaaggtgccgcaggctgcaagcttcccgtgagcagcatcagtttcaccgggacgtggaagatgagatactgtgggtgacagagcggttaccgatggcgtcatcaatggagcatggaaaagatttgcccagcgtgcagctgttgatgaaaaagaaccagactctgcaaaaagaaatccaaggccacgaaccacgcatcgccgaccttagggaaaggcagcgagcactcggagccgctgcggcaggcccagagttggctgagctgcaggagatgtggaagcgtctgggccacgagttagaactcagagggaaaaggctcgaggatgcccttcgggcacagcaattttatcgggacgcagcggaggccgaagcatggatgggggagcaggaactgcatatgatgggccaagagaaggcaaaagacgagttgtctgcccaggcagaagtgaagaagcatcaggtgttagagcaagccctggctgattacgcccagacaattcatcagctggcggctagtagccaggatatgatcgatcacgagcatcctgaatctacccgcattagcattcggcaggcgcaggtcgataaactgtatgcaggtttgaaagaactggcaggcgagcgtagggaacggctgcaagagcatctgagattatgccagttgcggagagagttagatgacctcgaacagtggatccaggagagggaggtagtcgccgcaagccatgagttggggcaggactacgaacacgttacgatgttgagagataagttcagggaattctcacgggacacctcaactattggacaggagagagtggatagtgcgaacgcccttgcaaatggcttgatagccggtggccacgctgccagagccactgtggctgaatggaaggacagcctcaatgaggcttgggccgacttgttggagctgctcgacactagaggccaagtgcttgccgctgcttatgagctgcaacgcttcctgcatggggctaggcaggcactagccagagtgcaacacaagcagcagcaactgcccgacggtaccgggagggatctaaatgctgcggaggccttgcagcggcgtcactgcgcttatgaacacgatatccaagcactgagtccacaggtgcagcaggtgcaggatgacgggcaccgcctccagaaggcgtacgccggtgataaggcagaggaaatcggtcgtcatatgcaggcggtcgccgaggcttgggcacagctgcagggctcatcagcagccagaaggcagctactgctggacaccactgacaaatttcggttcttcaaagcagtgcgcgaactcatgctgtggatggacgaagttaatctgcagatggatgcgcaggagcgacctagagacgtttcgtcagcagacctggttatcaagaaccagcaggggatcaaagcagagatcgaggccagagcagatcgtttctcctcctgcatcgacatgggtaaagaactgttagcgcgttctcactacgcggctgaagagatctcagaaaagctgtctcagctccaggcaaggcggcaagagacagctgagaagtggcaggaaaaaatggactggcttcagctcgtgctggaagttctagtgtttggcagggacgctggaatggctgaggcttggctctgcagccaagagcccctagttcgctcggcggaactcggatgcaccgtagacgaggtagaaagcctgattaaaaggcatgaggccttccagaaaagtgctgtcgcatgggaggaacggttttgtgccctggagaaactgacagccctagaggagcgcgagaaggagcgcaaacggaagcgtgaggaagaggagagaagaaaacaaccccctgcccctgagccgactgcgagcgtcccaccaggcgacctggtagggggacagacagcctccgacaccacctgggatggtacacagccccgaccccctccatctacccaggctccctccgtaaacggcgtgtgtacagacggggagccgtcccagccattgctggggcagcagcgtttggaacatagctctttcccagagggtcctggccctggctcaggtgacgaggcaaacggcccacgcggagagcgacaaacccggacacggggacctgccccatccgccatgcctcagagtaggagcacagaatccgcccacgctgcaaccctgccaccacgagggccagaaccttcagcccaggaacagatggaggggatgttatgtcggaaacaggaaatggaagcgtttggaaagaaagccgctaaccgttcatggcagaacgtatattgtgtcctgagacgcggttctcttggattttataaggatgccaaggccgcttctgccggagtcccgtaccacggcgaggttccggtgtctctggccagggcccagggatctgttgcctttgactacagaaaaagaaagcatgtttttaagctgggcctgcaggatgggaaagaatacctgtttcaggcgaaagatgaggtctcttgcccttcgtgctcttctctctccgtgcccttccagaaattacccgcagcggacagtcctagctttcccgtgctgcctctattcccgggactcgtcttgtgtggtaaaaccggatgtgttcggaggccacatcaggcagcactgcctgtgta

SEQ ID NO: 242104 - DNA, 7172 bp, Artificial Sequence
  Description of Artificial Sequence: Synthetic coding sequence
atgtccagtacactaagccctaccgacttcgatagcctggagatccagggacagtactctgacatcaataatcggtgggatttaccagatagcgactgggataacgattcgtcaagcgctaggctgttcgagagatcccgcatcaaggccttggccgatgaaagggaggcagtgcaaaagaagaccttcaccaaatgggtgaattcgcatctggctcgggtcacttgtcgcgtaggggatctgtattccgacctgcgtgatgggcgaaatctgctgaggctgctggaagtcttatccggggagatcctacctaaacctaccaaggggaggatgcgaattcactgtcttgaaaacgtggacaaggcattgcagttcctcaaggaacaaaaagtgcacctagaaaacatggggtcacatgacattgtggacggcaatcataggctgactctgggccttgtgtggactatcatcctccgcttccagattcaggacatttccgtcgaaactgaggataataaggagaagaagtccgctaaggacgccctactcctatggtgtcagatgaaaaccgctggttacccaaatgtgaatgtgcataacttcaccacgagctggagagacggactcgcgtttaatgccatcgtacacaagcatagacccgacctgctggattttgagtcactgaagaagtgtaacgctcattacaatctgcagaacgccttcaacctggcggaaaaagaactgggcctgacgaagctgctggaccccgaagacgttaacgtcgatcagcccgatgagaagagtattatcacatacgtggccacttactatcactattttagcaagatgaaggcattggctgtggagggtaaacgaatcggaaaagtcctcgaccacgcaatggaggcagaaagactcgtggaaaagtatgagtcactggcctctgaacttcttcaatggatcgaacagacaattgtgactctgaatgatcggcagctcgctaactcactgtcgggcgtgcagaatcaacttcagtccttcaactcatacaggacggtggagaagcccccaaaatttactgaaaaggggaacctggaagtcctgctgttcacaatccagtccaaactgcgggcaaacaaccagaaagtctatactccaagggaaggaagactaatctctgatattaacaaggcctgggagaggctcgagaaggctgagcacgagcgtgagctagctctgagaacggaactgatccgccaggagaaactcgaacagctggctgctcgtttcgaccggaaggcagccatgcgcgagacttggctttctgagaaccagcggttggtatcccaggacaacttcgggcttgaactcgcggctgtggaagcagctgttcgcaaacatgaagccatcgaaacagatatagtcgcgtattcagggagggtgcaagccgtggatgcggttgccgcagaactcgcggctgaaaggtatcacgatattaaacgaattgccgcacggcagcacaacgtggctaggctctgggattttctgcgacaaatggttgctgccaggcgcgagcggctcctgctgaacctcgagctccagaaagtcttccaggacctgctttatttgatggactggatggaggaaatgaagggaagattgcagagccaggacctgggtcgacatctcgctggggttgaggacctgctgcagctgcatgagctggtcgaggctgatatcgccgtgcaggcggagcgcgtgcgggctgtgagcgcctcagccctcagattctgtaaccccggtaaggaatacagaccctgtgacccccagctagtgtccgagagagtcgccaaactcgagcagagctacgaggctctatgcgagcttgctgccgctcgcagggcgagactcgaggagtcgaggcggctttggcgcttcctgtgggaggtcggggaggccgaagcctgggttagagagcagcagcaccttctggcgagcgccgacacaggcagagacctgacaggcgctctacgactgctgaataaacacactgccctgcggggagaaatgagcggccgactggggcctctgaagctgacactcgagcaagggcagcagttggtagcagagggtcatccaggcgctagtcaagcctcagcccgagctgcagaactgcaggcccagtgggagcgtcttgaggctctagccgaggagcgggcacaaagattggctcaggcggcttccctgtatcagttccaggccgatgccaacgatatggaggcttggctggtcgacgcccttcgcctagtctcaagtcccgagcttggtcatgatgaattttcaacgcaggctttagcaagacagcaccgtgcactggaggaggaaatacggagccatagacccacacttgatgccctaagggagcaggccgctgccttacccccaactttatctagaactcctgaagtgcagtccagagttccgacccttgagagacactatgaggagctgcaagcgagagccggagagcgagctagagctctggaagcggcactagccctctatactatgcttagtgaggccggagcatgtggtctctgggtggaggaaaaagagcagtggctcaatggcctggccttgcctgaacgtttagaggacctcgaagtcgtgcagcagcggttcgaaacactggagcctgaaatgaatactctggcagctcagattactgcggtgaatgacatagccgagcagctgctgaaggccaatcctcctggcaaggaccgcattgttaatacccaggaacagctgaaccaccggtggcaacagttccggcgtctcgccgatgggaagaaggctgccctgaccagcgctctcagcattcagaactatcacctagagtgtactgagacacaggcctggatgagagagaaaaccaaggttattgagagcacccagggcctgggcaacgatttagccggagtgctggccttgcaacgtaagctcgcaggtacagagagggatcttgaagcgattgccgctcgcgtaggcgaattgactcgcgaggctaacgccctggcagctgggcacccagcccaggcagttgctatcaatgccagactcagagaagtgcagacggggtgggaagacctcagggccacaatgcgaagacgggaggagagtctcggcgaggctcggagattgcaagactttttacggtcactagacgacttccaggcatggcttggcagaacccagaccgcagtcgcttccgaagaggggcctgccacactccctgaggcggaggctttgctcgcccagcatgcagccctgcgcggtgaggtcgaaagggctcagtcggaatacagccgactcagagcgctaggcgaggaagtgactcgagaccaggccgatccacaatgtctcttcctgcgccagcggctggaggccctcggaacagggtgggaggagttaggcaggatgtgggaatctcgccaggggagacttgcccaggcccatggctttcaaggattcctcagggacgccagacaggcagaaggcgtgctgtcatctcaagagtacgtgctgtcacacaccgagatgccaggcaccctacaagccgctgatgctgctattaaaaagctggaagactttatgagtacaatggacgctaatggcgagcgaatccacggactgctggaagccggaagacaacttgtgtccgagggaaatatccacgctgacaaaattcgggagaaggctgattctatagagcgacgacataagaagaaccaggatgctgctcagcagttcctaggtagactcagggataatagggagcagcagcactttctccaggactgtcacgagttaaagctgtggatagacgagaagatgctgaccgcccaagacgtcagctacgacgaagccagaaatctccatacaaagtggcagaagcatcaagcttttatggccgaactagcagcgaacaaggattggctggacaaggtagataaagaaggtagagaacttacactggaaaagcctgagcttaaggctttggtgtccgagaaactgcgagatctgcacagaagatgggatgaacttgaaaccaccacccaagccaaggcgagatcactcttcgacgctaatagggcagaactgttcgcgcagagttgctgcgccttagagtcttggctcgagtcactacaagcccaactccattcagacgattatggcaaggatctcacatcggtgaatatcctgctcaaaaaacagcagatgctagaatgggagatggccgttcgtgaaaaggaagtagaggcaatccaggcacaggccaaggccctggcccaagaggatcaaggtgcaggggaggtggaacggacttcaagggccgttgaggaaaaattccgtgccctgtgccagcctatgcgcgaacgctgcagacggctgcaggcttcaagagaacagcatcaatttcatagagatgtggaagacgaaattctttgggttacagaacgactgcccatggcatcaagcatggaacatggaaaggatctaccctccgtgcagctcctgatgaagaagaaccaaaccctccagaaagagatccagggccacgagcctaggatcgccgacctccgggagcggcagagggcactgggggcagccgctgcagggccagagctcgctgagcttcaggagatgtggaaacgcctgggtcacgagcttgagctccgtgggaaaagacttgaggacgctctaagggcgcagcagttctaccgggatgcagcagaagcagaagcttggatgggcgagcaagaactgcatatgatgggtcaggagaaggcgaaagacgagttgagtgcccaagccgaagtgaagaaacaccaggtcctcgagcaagccctggcggattacgcccagacaatccatcaactggctgcctcttcgcaggatatgattgatcacgagcatccagagagtactcgcattagtattcgccaggcacaggtcgacaaactgtacgcaggcctcaaggagctggctggagagcgccgagagaggctgcaggaacacctaagactgtgtcaactgagacgcgagctcgacgacctggagcaatggattcaagaacgcgaggtggtcgccgcatcccacgaactgggacaggactatgaacacgtgacaatgctcagagataaattcagagagttttccagggatacttcaaccatcggccaagaaagagtggactctgccaatgctctcgccaatggattgattgccggtggtcatgctgctcgggctactgtggcagagtggaaggatagcttgaatgaggcctgggccgacctgctagaactcctggacacacggggtcaggtgctcgctgcagcctatgaactgcagcgtttcctccacggcgctagacaagcacttgcaagggtccaacacaagcagcagcaactccctgacggtaccggccgtgatttgaatgccgcagaggcgctgcagagaaggcattgcgcatatgagcatgacattcaggccctctctcctcaagtgcagcaagttcaggacgacggtcacagattgcagaaagcttacgcgggagacaaagctgaggagatcggaaggcacatgcaggccgtggcagaggcttgggcacagttacagggatcttctgctgcaagaagacaacttcttctcgataccaccgataagttccgattctttaaggctgttcgtgagctgatgctttggatggacgaggtgaatctgcagatggacgcccaagagaggccgagggatgtgtctagtgccgacctggtgattaagaaccagcagggtataaaagctgagattgaagccagagcagaccgcttttctagctgcattgacatggggaaagaactgctggcccgatcccactacgcagcggaggagatctccgagaagttgtctcaactccaggccaggcggcaggagaccgcagaaaagtggcaagagaaaatggactggctgcagctggtcctggaggttcttgttttcggacgggacgctggcatggcggaggcttggctatgctctcaggaaccattagtgaggtcagccgaactcggttgcaccgtggatgaagtggagagccttataaaacgccatgaagcttttcagaaaagcgcggttgcatgggaggagcgattttgcgccctggagaagctgaccgctctggaagagcgggaaaaggagcgaaagcgcaaaagagaagaagaagaaaggcgcaagcagcccccagcaccggagcctaccgcaagcgtgccgccaggggatcttgttggcggacagacggcgtcggacacaacatgggacggtacccagcccaggccccctccctctacccaggcgccttctgtcaatggggtgtgcaccgacggtgagccttcgcagccactgctggggcaacagcgtctggagcactctagtttccctgagggccctggccctggctctggcgatgaagccaatggtccacggggagaacggcagacgagaactaggggccctgccccttctgccatgccccagagtcggagtacagagagcgcccatgccgcaaccctccctcctagaggaccagagccatccgctcaagagcaaatggagggcatgctatgccggaagcaggagatggaagcttttggcaagaaggctgccaatcggagctggcagaatgtgtactgcgtcctcaggaggggttccctggggttctacaaggacgctaaggcggctagtgccggagtcccatatcatggggaggtgcctgtttctctggcgcgagcccagggcagcgtcgcttttgattatcgtaaaaggaagcatgttttcaaactaggcctccaggatggcaaagagtacctgtttcaagccaaggacgaggccgagatgagttcctggctgcgcgtagtgaatgcagctatcgccactgccagcagcgcgagcggcgagcctgaggagccagtggtgcccagcactactcggggtatgacccgggctatgacaatgcctcccgtctcccccgtgggcgctgagggcccagtggtgctccggtccaaagacgggcgagaacgggagagggagaagagattctcctttttcaagaagaacaagta

SEQ ID NO: 242105 - DNA, 6465 bp, Artificial Sequence
  Description of Artificial Sequence: Synthetic coding sequence
atggcgcaagttcccggtgaagtagacaacatggagggcctgccggcacctaataacaatcccgcagcccgatgggaatcacctgaccgcggttgggaacgggaacagcctgccgctagtactgctgccgcatcactgtttgagtgttcccggattaaagcgttagcggacgaacgcgaggcagtgcagaagaagaccttcaccaaatgggtaaactcacacttggcacgggtaggatgtcacatcggcgacctgtatgtggatttgagagacggattcgtgttgacaagacttctggaagttctgagcggggaacagctgccccgacccacacgcggaaggatgagaattcacagcctagagaatgtggacaaagccctccagttcctgaaggagcagcgcgttcacctggaaaatgtggggtctcacgacatcgtggatggtaaccataggctaaccctcgggttggtatggacaattattctccggttccaaatccaggtcatcaagatcgagactgaggataatagggaaaccagatcagctaaagatgctctccttctctggtgtcagatgaagaccgcagggtaccccgaggttaacattcaaaacttcacgacctcgtggcgcgacgggctggcctttaatgccttaatccaccggcacagacctgatcttgtggacttttctaaactaacaaagtctaatgccaattataaccttcaacgcgcttttaggactgccgagcaacacctgggcctggcgcgattacttgacccagaagacgttaatatggaggcacctgacgagaagagtattattacttacgtggtatctttttaccattattttagcaagatgaaagccctcgcggtcgaaggaaaaagaatcggcaaggtgctagaccaggtgctagaggtggggaagatcattgagcgttatgaagagcttgctgccgaactccttgcatggatccaccgcactgtcggactgatctccaatcagaagttcgccaactctctcagcggtgtccaacagcagctgcaggcattcactgcctactgcaccctggagaagccggttaaattccaagaaaaggggaacctggaagtgctcctcttttcaatacagtccaagctacgggcatgcaatagaagacttttcgtgcctagagaagggtgtggaatctgggatatagataaagcctggggagagctggagaaggcagagcatgagagagaggcagccttgagggctgagctcatcagacaagaaaagcttgaattgctagcccagcgctttgatcataaagtggcaatgcgggaatcatggctcaacgagaatcagagactggtgtcccaggacaacttcggttacgaactgcccgctgtggaggccgcaatgaaaaagcacgaggcaattgaagctgacatcgcggcttatgaggaaagagtacagggcgtggccgaactggctcaagcactagcggcagagggatattacgatattcgacgcgtggcagcccagagagactcagtcctaaggcagtgggccctccttacgggcctcgtgggtgcacgaaggactaggctggaacagaatctggccctgcaaaaggtgtttcaagagatggtgtacatggtagactggatggaggagatgcaggcccaactcctctccagagaatgcggccaacacctggttgaggctgatgacctcttgcagaagcacgggctcctggaaggagatatcgcagcccagtcagagcgggtagaggccctgaatgcagcggctcttcgcttcagccagctgcagggctaccagccatgcgatccccaggtcatctgtaaccgggttaaccacgtgcatgggtgcctggctgagctgcaggaacaggcggctaggcgcagggctgaacttgaagcctcccgcagcctgtgggctctcctgcaggaactggaggaagcagagtcgtgggcacgggacaaggaacgcctgttagaggcagctggaggaggcggtgccgctggcgctgccggagccgctgggactgccggtggagcgcatgacttgagttccaccgctagactcctggcccagcacaagatcctgcaaggcgaactgggaggcagacgcgctttgctccagcaggcccttaggtgtggagaggagctggtagccgcaggcggagccgtcgggcctggcgctgacacggtgcatcttgtcggcttagccgagcgggcagcatccgcacgtaggcgttggcaaaggctcgaagaagcagctgcgagaagagaaaggcggctccaggaggcacgagctctacatcagtttggcgcagacttagatgggctgttggattggctacgggacgcataccggctcgctgctgcaggagacttcggtcacgatgaagcttccagccgtcgcctggcacgccaacaccgtgctttgacaggtgaagtggaagctcacagaggtccggttagcggcttacgtcgacagttggccaccctgggtggggcttcaggtgccggtcctctcgtcgtcgcactgcaggtgcgtgtggtcgaagctgagcagcttttcgcagaggtgaccgaggtggcagccctgcgccgacagtggcttcgagatgcactcgcggtatatcgtatgtttggtgaagtgcatgcatgtgaactgtggattggtgaaaaggagcaatggctactgtctatgcgggtgccagacagtctcgacgacgtggaagtcgttcagcaccgctttgaatccttggaccaggagatgaattccctgatgggtcgagtgctagacgttaatcatacagtccaggagcttgttgaggggggacaccctagttctgatgaggtgaggtcttgtcaagatcacctgaactcgaggtggaaccgaattgtcgagctggtggaacagcggaaggaggagatgtcagccgtgctgctcgtggagaaccacgttcttgaagtcgccgaggtgcgggctcaagtgagggagaaaaggcgggctgtcgagtctgcccctagggccggtggtgcgttgcagtggcggttaagtgggctcgaggcggcactccaagcactggaaccgaggcaggccgcacttctggaggaagccgcactgctggccgagaggtttcccgctcaagccgctaggcttcaccagggggcagaggagcttggcgcagagtggggcgctctagcttctgccgcacaagcctgcggcgaagcggtcgccgcagcaggacgcctccagaggtttctgcatgatcttgatgcgtttttggattggctggtacgcgctcaggaggctgcgggtggttccgaagggccacttcctaactcactcgaagaggcagacgctctcctggcacgtcatgcggctcttaaagaggaggttgatcagagggaagaggactatgcgaggattgtggccgcttccgaggccttgcttgccgcagacggcgctgaactaggaccaggcttggcgctggacgaatggctgccacacttagaactgggctggcataaactgctgggcctgtgggaggctcgacgcgaggccctggtgcaggcacacatctaccagctgttcctgagagacctgcgtcaagccttagtagtgctgcgcaatcaagagatggcactctcaggcgcagagctgcccggtacagtggagagtgtggaggaggccctcaagcagcacagggatttccttacaaccatggagctttctcaacagaagatgcaggtcgctgtgcaggcggctgaggggttactgcgacagggtaacatttacggtgagcaagctcaggaggcagtgacaagacttctggaaaaaaatcaggaaaaccagctgcgagcccagcagtggatgcagaagctgcatgatcagctcgagctccagcattttcttagggattgtcatgagctggacggctggatccacgaaaaaatgctgatggccagggatggtacccgggaggacaatcacaagctacacaagcgctggctcaggcatcaggcttttatggccgagctagcacagaataaagaatggctcgaaaagatagaaagggaaggccagcagctgatgcaggagaagcccgagctggcagcttctgtccggaagaaacttggcgagattagacaatgttgggcagagctcgaatctacgacgcaggcaaaagcaaggcagctcttcgaagcttccaaggccgaccaacttgtacagtcctttgccgagctggataaaaagctgctacatatggagagccaactccaagacgtagacccgggaggcgatcttgccacagtcaatagtcaactcaaaaaactgcagtctatggagtcacaagtggaggagtggtatcgtgaggtcggggagttacaggcacagacagccgctttgccgctggagcccgcttccaaggagctagttggagaacgccagaacgccgtaggagaacggttggtccgcctcctcgagcctttacaagaacgcagacgccttctcctcgcttccaaagaactccatcaggtcgcacatgatctcgacgacgagctcgcgtgggtgcaagagaggctgccattagccatgcagaccgaaagagggaacggactccaagcagtccagcagcatatcaaaaaaaaccagggtttaaggagagagatacaagcgcatggtccaagactcgaagaagtactcgagcgagcaggggcactagcatcactgaggtcaccagaggcagaggcagttcgtcgtggcttggagcagctccaaagtgcctgggccggtctccgcgaggccgcagagcggcgtcagcaggtgctcgatgctgccttccaggtagagcagtactattttgacgttgccgaagtggaagcctggctaggagagcaggaactgcttatgatgtcagaggacaaaggaaaggacgaacagagcacccttcagctcctgaaaaaacatttacagctggagcagggggtggagaactacgaggagtccatcgctcaactgtctcggcagtgccgggcactgctggaaatggggcaccccgatagtgagcagatatccaggcgacagtcgcaggtggatagactatacgtggcacttaaagaattaggggaggagcggagggtggcgcttgagcagcagtactggctgtatcagctgtcacggcaggtatccgagttagaacattggattgcagagaaggaggtggtggccggtagtcccgagctgggccaggatttcgagcatgtgagtgtgcttcaggaaaagttttccgagttcgcatccgagacaggcatggccggaagggaaaggctcgctgccgttaatcagatggtggacgagctaattgaatgtggccatacagccgctgcaaccatggctgaatggaaggatgggttgaatgaggcttgggccgagctgttggagttgatgggaacacgggctcaattacttgccgcttccagggagcttcacaagttttttagtgacgctagagaattgcaagggcagatcgaggagaagcggaggagattgccacggttaacaacaccccctgagcctcggcctagcgcgtcatccatgcagcggactctacgggcttttgagcacgacctgcagctgttggtgtcccaagtgcggcagctccaggagggtgcagcccagctgagaaccgtctatgctggggaacatgccgaggctatcgccagtcgagaacaggaagtcctccagggatggaaggagctccttagtgcatgcgaggatgctagattgcatgtgtcttccactgccgacgccctgcgattccattcgcaagtgagggacttgctgtcttggatggacggcattgcgagccaaatcggtgcagctgataagcccagggacgtgtcctcagtggaggtcctgatgaactatcaccaagggttgaaaacagagttggaagcaagagtccccgagctcactacttgccaggagcttgggaggtccctgctgttgaacaagtctgctatggcggacgaaattcaggcccagctggacaagctgggcacccgcaaggaggaggtaagcgaaaaatgggaccggcactgggaatggcttcagcaaatgctggaggtccatcagttcgcgcaggaagccgtcgtggcagacgcttggttaaccgcacaagagcccttgctccagagtcgggaacttggctcatccgtcgatgaagtggagcagctgatcagacgccatgaagcttttcgaaaggctgccgctgcttgggaggaaaggttctcaagcctgagacggctaactacaccgcgtcgggaagaccacctgaacccaggcgtgcaggaccagccctggcagcacactgagaagccttccctgcccaagcccaaggccaacaaagaaaagacggctcgcagggatggaacttgtctgtaa

SEQ ID NO: 242106 - DNA, 3930 bp, Artificial Sequence
  Description of Artificial Sequence: Synthetic coding sequence
atggcacaagtcccaggagaggtggacaacatggaaggtctgcccgcaccaaacaataaccctgcagcgcgttgggagtctcccgatcgcggatgggagcgggagcagcctgcggcttccaccgcagccgcatccttgttcgaatgctctcgcattaaggctctggccgacgaaagagaggcagtacagaagaaaacttttactaaatgggtaaatagccacctagcacgggttgggtgccatatcggggacctgtacgttgatctgcgggacggattcgttttaacccggctcttggaggtattgagcggagagcaacttccgaggccaacccgcggtcgtatgcggatacactctctggaaaacgtcgacaaggctcttcagtttctcaaagaacagcgagtgcacctggagaacgtgggctcacatgatatcgttgacggaaaccatcgacttaccctcgggctggtgtggactatcatcctccgcttccagatccaggtaattaagatcgagaccgaggacaacagagaaacacgatcggctaaggatgccctgctactttggtgccaaatgaaaaccgctggctacccagaagttaacatacagaacttcactaccagttggcgggacggcttggcgttcaatgctctcattcatagacacaggcctgatctggtggatttctccaaactaacaaagagtaacgctaactataatcttcagcgggcattcagaactgcggagcaacacttagggctggctcgtttactcgatcccgaagacgtcaacatggaagcacccgacgaaaaatcgatcattacttatgttgttagtttttatcactacttcagtaagatgaaggcattagccgtagagggcaagagaatcggtaaggtacttgaccaggtccttgaggtgggcaagattatcgaaaggtacgaggagttggctgctgagcttctggcctggatccatcggactgtgggacttatctcaaatcagaaattcgccaattcactgtctggcgtccaacagcagctgcaggccttcacagcatattgcacactggagaagccagtgaagtttcaggagaaaggaaacctcgaggtcctcttattcagcatccagagtaaactcagggcttgcaaccgacgtctgttcgtccctcgggagggttgcggcatttgggatatcgacaaggcctggggcgaactggaaaaagcagaacatgagagggaagcagcactccgggcagagctgattaggcaggagaagctcgagttgctggcccaacggttcgaccataaggtggcaatgagggagagctggctgaacgaaaaccagaggcttgtgagccaggacaacttcggctatgagttacccgcagtcgaggccgcaatgaagaaacacgaagcaatcgaggccgacatcgctgcctacgaggagcgggtccaaggagtcgccgaattagcccaagcgctggccgctgagggttattatgacatccggagggtcgccgcacagcgggactctgtgctgaggcagtgggcactgctcacaggactggtgggcgcacggcgaactaggctggagcagaacttggccttacaaaaggtctttcaggagatggtatacatggtagattggatggaggaaatgcaagctcaactgcttagtagggagtgcggtcagcacctcgtcgaggcagatgacctgctgcagaagcacggactgctcgagggcgacatagccgcacagtctgaacgagtggaggccctgaacgctgccgcactccgcttttcccagctgcagggataccagccatgcgatccccaggtgatctgcaaccgcgtgaatcatgtacacgggtgtcttgctgagctgcaagaacaggccgctaggcggcgtgccgaactggaagcctccagatctctttgggctttgctgcaagaactcgaggaggccgagagctgggcacgagataaggagaggctgcttgaggcagctgggggagggggagcagccggagccgcaggcgcagccggtacagctggcggagcacatgatctgtccagtacggccaggctactcgcccagcacaagatactgcagggcgaactgggaggcaggcgggctctgcttcaacaggccctgcggtgcggcgaagagctggtagccgctggcggagcagtgggccctggggcagacaccgtgcatctggtcggcctggctgagcgggctgccagtgcacggaggcgttggcagagactggaggaggcagctgctcggagagagcgacggttacaggaggcccgagctttacatcaattcggcgctgatttggacggcttgttggactggctgcgggacgcctacagactggcagcagcaggagatttcggccatgacgaggcctccagccgacgcctggctcgacaacatagagcgcttacaggtgaggtagaggctcatcgagggcctgtgtccggcttacgcagacagctggccaccctgggcggtgccagcggcgcagggcctcttgtggtggctctccaggtcagagtggtcgaagctgaacagctgttcgccgaggtcaccgaagtggctgctctgcggcgtcagtggctccgcgacgctctggcagtgtataggatgtttggggaggtccatgcttgcgaactctggataggtgagaaagaacagtggctgctgtctatgagagtaccagattctctggatgatgtggaagtcgttcagcaccgctttgagtcccttgaccaagaaatgaattctctgatgggcagagtgttggacgtgaaccatacggtgcaggaactcgtagagggcggacatccctcttccgacgaggtgcggagctgtcaggaccatctgaactctcgttggaacaggatcgttgaactggtcgaacagcgtaaggaggaaatgagcgctgtcctgctggtggaaaaccacgtgctggaagttgccgaggtgagggctcaagtgagggagaagcgcagggccgtggagtcagctcccagagccggtggcgctttgcagtggaggctcagtgggttggaggcggctctccaggctctggagccaaggcaggcggctctcctggaggaagccgcattgctggccgagcgattccccgcacaggccgcacggctgcaccagggggcagaggagctgggagcagagtggggcgcactggcaagcgcagcacaggcctgcggagaagccgtcgcggctgccggacgactccagcgtttccttcacgacctggacgcttttctcgactggctcgtccgcgctcaggaagccgcaggcggatccgagggacctctccccaattcactggaagaggcggacgctctcctggctaggcacgctgcactgaaagaagaggttgatcaacgggaagaggattacgccaggatcgttgccgcttcagaagccctgcttgctgctgacggggctgaacttggacctggcctggcactggacgagtggcttccacaccttgagctggggtggcacaagcttctcggtctctgggaagcacgaagagaagccctggtgcaggcacacatctaccaattgttcctccgggatttgaggcaggccctggtagtgctgagaaaccaggagatggcgttgtccggggctgagcttcccggaacagtggagtcagtcgaggaagctctgaaacaacaccgggactttcttaccacgatggaactcagtcagcagaaaatgcaggtagccgtgcaggccgcagaagggctactgaggcagggcaacatctatggggaacaggcgcaagaagctgtgaccaggcttctggaaaagtgcctcattatacaccctgcgctgctgcatcccccatgggagccacctgatctcccaagatccagttcctag

SEQ ID NO: 242107 - DNA, 7694 bp, Artificial Sequence
  Description of Artificial Sequence: Synthetic coding sequence
atggcccaggtccccggtgaagtcgacaacatggagggtctccccgcacctaataataaccctgcagcccgttgggaatctccagataggggctgggagcgcgagcagccggctgcttccactgccgctgcatccctgttcgagtgctcccgcatcaaagctctggccgatgaaagggaggcagtgcagaagaaaacatttaccaagtgggtgaattcacaccttgcaagagtgggttgccacatcggggatttgtatgtcgacctcagggatggctttgtgcttacaaggctgctggaagttctatcaggcgaacaacttcctcggccaacgagaggcaggatgcgcattcatagcctagagaatgtggataaagcacttcagttcctgaaggagcagagagtgcacctggagaatgtaggttctcacgatatcgtcgatggaaatcaccggttgacactcggactggtgtggactatcatactacgctttcaaatacaggtcatcaagatcgagaccgaggataatcgtgagactaggtccgcaaaggatgctctcctgctgtggtgtcagatgaagacagccggttacccagaagtcaatattcagaatttcaccacctcttggcgagatgggcttgcatttaacgccctaatccatcggcatcgacccgatctggtcgacttctccaagctcacaaagtctaatgccaactacaacctgcaacgagcttttcgtaccgccgagcagcacctcggactggcgagattgctggatccagaggatgtcaacatggaggcccctgatgagaaatcaatcataacgtatgtagtgagtttttaccactatttttcaaagatgaaagccttggctgtggaggggaaaaggattggcaaagtgctggatcaagtattggaggtggggaagatcattgagcgctacgaggagttggctgctgagctcctggcctggatccaccgcaccgtcggattgatatctaatcaaaaatttgccaactccctgtcaggggtgcagcaacaactgcaggcctttacagcttactgcacccttgagaaacctgtgaaattccaggagaagggcaatcttgaggtcttactcttctcaatacaatcaaagctgcgggcttgtaaccggagactgtttgttccccgtgagggatgcggcatctgggacattgacaaggcctggggcgagctggaaaaggctgagcacgaaagggaagccgcactacgcgctgagttgatcaggcaggaaaagctggagttgctagctcagcgatttgatcacaaggtcgcgatgcgagaaagctggttgaatgagaaccaacggcttgtgtcacaagacaacttcggatacgaactgcctgcagtggaagcggcaatgaagaagcacgaggctattgaggcagacatcgccgcatatgaagagagggtgcagggggtcgcagagttggcacaggctctggccgcagaaggctactacgatattcgacgcgtggccgcacagagagactcagtcctgcgccagtgggctcttcttactggtctggtcggtgccagacgaacgaggctggagcagaatctggccttgcaaaaagttttccaggagatggtctacatggtggactggatggaggaaatgcaagcccagctgttaagccgggagtgcggacagcatctagtggaagctgacgacctgttgcagaaacacgggctgctggaaggtgacatagctgctcagtctgaacgcgtcgaggccctgaacgcagccgctctgaggttttcgcagttacaggggtatcagccctgtgacccccaggtgatttgcaaccgcgtgaatcacgttcacgggtgcctagcggagctccaggagcaagctgctcggaggagggctgagttagaggccagcaggtcattgtgggcacttctgcaggagctcgaggaagccgaatcgtgggccagagacaaagagcgacttcttgaagcagccggaggcggaggcgcagcaggagccgcaggtgctgccggtaccgcgggtggggctcatgacttatcctctactgccagactgctggcgcagcataagattctacagggagagctcgggggaagaagggccttactccagcaggctttaagatgcggcgaagagcttgtggccgcaggcggagccgtggggcctggggctgatactgtccatttagtgggtttggccgagagagctgcttctgctcgaagaaggtggcagcggctggaagaagccgctgccagacgggagaggcggctgcaggaggctagggccttgcaccaatttggagccgatcttgatggtcttcttgactggctgcgtgatgcataccggttggcggctgcgggtgatttcgggcacgacgaagcctccagtagacgactggctcggcagcacagagccctcactggcgaggtggaagcgcataggggtccggtgtcgggactgagaagacagcttgcaacccttgggggagccagtggagccggacctttagtggtggcgttgcaggttcgcgtcgtggaggccgagcagctctttgcggaagtgaccgaagtggccgcattgaggcgtcagtggttgcgtgacgccctggccgtgtaccgcatgtttggggaggtccacgcatgcgaattgtggatcggcgagaaagaacagtggttgctctcaatgcgagtacccgatagccttgatgatgtcgaggttgtgcagcataggttcgagagcttggatcaggagatgaactccttgatgggaagagtgcttgatgtgaaccataccgtgcaggaactcgtagagggagggcaccctagtagcgacgaagttcggtcatgccaggatcatttaaactcaaggtggaacaggatcgtggagctggtggagcagagaaaagaagagatgtcggccgtccttctcgtagaaaatcatgtgttagaagttgccgaagtgagagcacaggtccgtgagaagcgcagagccgtggagtccgctcctcgcgcaggcggtgctctgcaatggcggctgagcggcctggaagctgcccttcaagccctggaacctagacaggccgcactattagaagaagcggctttgctcgcagaacgcttcccagctcaagccgcacgactgcatcaaggggctgaagagctgggcgctgaatggggggctcttgctagtgcagcccaggcctgtggcgaggcagtggcggctgcgggtcgactgcagaggttcctccatgacttagacgctttcctcgattggctggtgcgcgctcaggaagcggcaggcggttccgaggggcctctgccaaattcgcttgaagaggctgacgccctgttagcgcgtcatgccgctttgaaagaagaggtcgaccagcgggaagaggactacgcccgaattgtcgctgctagtgaggctctcctggctgccgacggtgccgaacttggtccgggactagcactcgacgaatggctacctcacctcgagctcggttggcacaaactccttggattgtgggaggcccgaagggaggccctggttcaagctcatatctatcagctgttcctacgggacctgaggcaggcactggttgtactccgtaaccaagagatggctctatcaggcgcagagttgccaggaactgtagagagtgttgaggaggcactgaaacagcaccgcgatttcctaacaaccatggagctaagccagcagaaaatgcaagtggccgtgcaagccgcagagggactgttgaggcagggaaatatatatggcgagcaggctcaggaggctgtaacaagattattggagaagaatcaggagaatcagttaagggcacaacagtggatgcaaaagctgcatgaccagcttgagctgcaacacttcttgagagactgtcacgagttagacggctggatccacgagaaaatgctcatggcaagggatgggacccgggaagataatcacaaattacacaagcgatggctccgccatcaggccttcatggccgagcttgcccaaaataaagaatggcttgagaaaattgaaagagaggggcagcagctcatgcaggagaaaccggaactcgcagccagcgtaaggaagaaattgggcgaaattcggcagtgttgggccgagctagagagcaccactcaggcaaaagccaggcagttgtttgaagccagtaaggccgatcagctggtgcagtcatttgcggagttggacaagaagctgctacacatggaaagtcagctacaggacgtggacccaggaggggatctggctacagtgaattcccaactcaaaaaacttcagagtatggagagccaggtcgaggagtggtaccgggaggtgggggagctccaagcccagacggcagccctacctctagaacccgcatccaaagagctggtgggcgaacgccaaaacgccgttggggagaggctggtcaggctgcttgaacctttacaggagaggagaaggcttctgctggcatcaaaggagcttcaccaggttgcgcacgacctggatgatgagctcgcctgggtacaggaaagattgcctttggcaatgcagacagagcgaggaaacgggttacaggctgtgcagcagcacatcaagaagaaccaaggactaaggagagagatacaggcacatggtcctcgccttgaggaagttcttgagcgtgccggagcactggcctctctcaggtcgccagaggctgaggcagttcgcaggggcctggagcagctgcaatccgcctgggccggattgagagaagcggcagagcgcaggcagcaagtgctggatgccgcatttcaggtggagcagtactactttgacgttgccgaggtggaggcttggttgggcgaacaggagctgctgatgatgtccgaggacaaagggaaagacgaacagtctacgttacaactattgaaaaaacacttacagctggaacagggagtagaaaattatgaggagtctatcgcccaactgagcaggcaatgcagagctctgctagagatgggccatccagacagcgagcagattagtcgacggcaatctcaagtagacaggctttacgtcgctttaaaagagctcggagaagagcgacgggtcgccctcgaacaacagtactggttgtatcagttgtctcgccaggttagtgaattggaacattggattgcagaaaaggaggttgtagccggttcacctgaacttggtcaagacttcgagcatgtgagcgtattacaagagaagttttccgagttcgccagcgagacagggatggccggacgggaaaggttagctgccgtaaaccagatggtggatgaattgatcgagtgcgggcacacagccgcagctaccatggccgagtggaaagacggtcttaacgaagcttgggctgaacttttagagctgatgggtaccagagcccagctgctagcggctagccgggagctccacaagttctttagcgacgcacgcgagctgcagggccagattgaagaaaaacgtcggaggctgccccgactcaccactcctccggagccccgtccttctgccagtagcatgcagcgcactcttcgcgctttcgaacatgatttacaactgctggtgagtcaggtacgtcagctccaggagggcgctgcacagctaagaaccgtttacgccggtgaacatgccgaggccatcgcatccagagagcaggaggtgttacagggctggaaagagttgctgagcgcctgcgaggacgccaggttgcacgtgtcctcaactgccgacgctctgagattccactctcaggttagggacctcctgtcctggatggacggtattgcctcccagattggtgctgcagataaaccgagggacgtgtcttccgtggaagttctcatgaactaccatcagggactgaaaacagaacttgaggccagggtgccggagctgactacctgtcaggagctcgggcgttcattgctcctcaacaagtccgcaatggcagatgagatccaagcacagctcgacaagctagggacaaggaaagaggaagtctcagaaaaatgggatagacactgggaatggctccaacagatgcttgaggttcaccaatttgcgcaggaagccgttgtggcagatgcctggctcactgcacaggagccgctcctgcagtccagagaattggggtcctcggtggacgaggtggagcagctaatccggagacatgaagcttttcgaaaagccgcagctgcctgggaagagaggttttccagcttacgcaggctgaccaccatcgaaaagatcaaggctgaacagtccaagcagcctcccactcctttgcttggtcggaagttttttggcgatcccaccgagctcgccgctaaggctgctcctctcctgcggcctggcggttacgagcgcggtttggaacccctcgccagacgcgcatcagacactttgtctgctgaggtccgcaccagagtgggttacgtacgacaggagcttaagcctgaaagattacagcccagaattgacaggctccctgagatcccagggagggtggagcccgcagcattacctgctgcccctgaggatgccgctgagacccctgccaccccagccgctgcagaacaggttagacccagaccagaaagacaggaatcagctgatcgcgcagaggaactgcctagacgacgcaggccggagcgacaggagagcgttgaccaaagtgaagaagcagctcgacggaggagacccgagaggcaagaaagcgctgagcatgaggccgctcactccctgaccctgggacggtacgagcagatggagagacgcagagaacgtagggaaagaagattggagaggcaggagtcatcggaacaggaaatgcccatccggggtgacttggtgaagggtaaggccactctcgccgacatcgtggagcagctgcaagaaaaagaagcaggacccggactgcccgctggaccatccctgccccagcctagggaactgcccccaggaagactccctaatggattggagttgcctgagaggacgccgagaccagaccggccaagagcacgagatcgcccaaaacctagaaggcgaccccgtccacgggagggcggagagggaggaggctcaaggaggtcacgatctgctcctgcacaaggcggaagtgcaccagctcccccacctccgcctactcataccgtccaacacgaggggttcctgctgagaaagagagaactggatgccaacagaaaatcctcgaaccgatcctgggtcagcctttattgtgtactgtccaaaggagagctcggcttttacaaggacagtaaaggccctgcttcggggtccacccacggaggcgagcctctcttgtccctacataaagcgaccagtgaggtggcatctgattacaagaaaaaaaagcatgtgttcaaactgcagacccaggacgggagtgaattcctcctgcaagcgaaggatgaagaagaaatgaacggctggctggaagctgtcgcttccagtgtggcagagcatgccgaaatcgctaggtggggccagaccttgccaactacgtcttcaacggacgaggggaatcctaaacgagagggaggggacaggagagcgtccgggcgtcgcaagta

SEQ ID NO: 242108 - DNA, 2037 bp, Artificial Sequence
  Description of Artificial Sequence: Synthetic coding sequence
atgttgatggcgagggatgggacacgggaagataaccataaacttcacaaaaggtggctgagacaccaggcattcatggcagagttggcgcagaataaggagtggctggagaagatcgagcgagaaggccagcagctgatgcaggaaaaaccagagctggctgcctccgtacgaaagaaactgggggagattagacagtgttgggctgaactggagtcaacaactcaggccaaagcgagacagctgttcgaggccagcaaggcagatcaactggtgcagagtttcgcagagttggataaaaaattgctacacatggagagccaattgcaggacgtggatcctggaggggatttagccaccgtgaactcacagctgaagaaactccaatccatggagtcccaggtcgaagagtggtaccgcgaagtgggtgagctccaggcacagacagcagccttgccgttagagcccgcaagcaaggaacttgttggcgaacgccagaatgctgtgggcgagagattggtaagactactggagcccctgcaggaaagaagacggctcctgctggcctcaaaggaactgcatcaggtggctcatgacttggacgatgagctcgcatgggtccaggagcggcttccactggccatgcagacagaacggggaaatgggcttcaggccgtgcaacagcacatcaagaaaaaccaggggctgaggcgggagatccaggcccacggaccacgccttgaggaagtgcttgaacgagccggagcacttgcgtccttgagatcccctgaggcagaggctgtgaggcgcggattggaacagctccaatctgcctgggccggactaagagaagctgcggagaggcggcagcaggtgctcgatgccgcattccaggttgagcagtattatttcgatgtggctgaggtagaggcatggcttggcgaacaggagctgttaatgatgagcgaagacaaggggaaagacgagcagagtactcttcagctgctgaagaaacacctccagctcgaacaaggcgtggaaaactatgaggagtcgattgcccagttgagcaggcagtgtagagcattgctcgaaatggggcacccggacagcgagcagatttcccgcaggcagagtcaggttgacagactctatgtcgcccttaaagaactgggagaggagaggagagttgccttggagcaacagtactggctttatcaattatcaaggcaagtgtccgagctggagcattggattgcagagaaggaggttgtggctggatcgcccgaactggggcaggatttcgagcatgtgtcagtgcttcaggagaaatttagcgaattcgcgtctgagacaggaatggccggaagggagcgcctggcagctgttaaccagatggtggacgagctgatcgaatgcggacatacagcagctgcaactatggccgagtggaaggatggtctcaacgaggcatgggctgagctcctagagctgatgggcacccgagcccaattactggccgcttctcgtgagctgcataagttcttcagcgatgcaagggagctgcaagggcaaattgaagaaaagagacgcaggttacctcgacttactaccccgccagagcccagaccgtctgcgagctccatgcagcggaccctgagggcctttgaacacgacctacagctgctcgtgtcccaggtccggcagctgcaagaaggcgcagcgcaactgcggactgtgtacgctggcgagcatgctgaagccattgccagcagggaacaggaggtgctgcagggttggaaagagctactgtcagcttgcgaggacgccagactgcacgtgtcctctacagccgatgccctgagattccacagtcaagtccgcgacctactgtcgtggatggatggtatcgccagtcagatcggagccgcagacaagcccagatgtccatcttccttgttgggacttcctgcgtctccatggtggcctacccctgccacacccagtcctcttactgctcctttctccatggagtag

SEQ ID NO: 242109 - DNA, 3924 bp, Artificial Sequence
  Description of Artificial Sequence: Synthetic coding sequence
atgccccactatcccagttgttccagtgcccctagcctgggcactcctcggccacctcagatccagcagctggaagccaggcatcggaaccaggagaatcagctgagggctcaacagtggatgcaaaagcttcacgaccagctcgaactccaacacttcttgcgtgactgtcatgagctggacggctggattcacgagaagatgctcatggcacgcgacggcacccgagaagacaatcataagcttcacaaaaggtggctgcgccatcaggcctttatggcggaactcgcacagaataaggagtggctggagaagattgaacgggagggtcagcaactgatgcaggaaaagccagagttggctgcaagcgtgagaaagaaacttggagagatccggcagtgttgggcggagctggagtccactacacaggcgaaagctcgtcaattatttgaggcatctaaggcagatcaattggtgcagtctttcgccgaattggataaaaaactgttacatatggaatcccagttgcaagacgttgacccaggaggcgatttggctaccgttaattcccaactgaaaaaacttcagtctatggagtcccaggtggaagaatggtatcgggaagtgggggagctgcaggcacaaaccgccgcattgccactcgaaccagcaagcaaagagcttgtcggagagaggcagaacgccgtcggggagagactcgtaaggctgcttgagcccttacaggagaggagacgcctgctgcttgcaagtaaagagttgcatcaggtcgcccatgatcttgatgatgaactggcctgggtacaggaacgcttgcccctcgcaatgcagaccgaacggggaaatggactccaggctgtccagcagcacattaagaagaatcaaggcctccgacgcgagatccaggcccacggacccaggttggaggaggtcctggaaagggctggcgctcttgctagccttcgctcccctgaggcagaggcagtccgtcgcggactcgaacaattacaatctgcctgggccggtcttcgggaagctgcggagcggagacaacaggtcttagacgctgctttccaggttgaacaatattattttgacgtggctgaagtggaagcctggctgggtgagcaggagttactgatgatgtcggaagacaagggaaaggacgagcagtcgactctccaactcctaaaaaagcacctccaattggagcagggggtggaaaactatgaggaatctatcgcgcagctgagccgtcaatgtagggcactcctggagatggggcatccagattccgagcagatctccagacggcagagccaggtggaccgcctatacgtcgccctgaaggagctgggcgaggaaaggcgagtcgcactcgagcagcagtattggctttatcagctgagcaggcaagtctctgagcttgagcactggattgcggaaaaggaggtggtagcagggtcacctgaacttggacaggacttcgaacatgtgtcggttttgcaggaaaagttttcagagtttgcttcagagacaggtatggctggcagagagcggctggctgctgtgaaccagatggtcgatgaactgattgaatgtggacacacggccgctgccacaatggccgaatggaaagacggtctaaatgaggcctgggcagagctgctggagttgatgggcaccagagcgcagttattagctgctagcagggagcttcacaagttcttctccgacgcacgtgaacttcaaggccagatagaggagaagagacgcaggttaccgaggcttaccacccctccagagccacggccatcagcatcaagcatgcaaagaaccctgcgtgccttcgaacatgatttacagttacttgtgagccaggtcaggcaattacaggagggagccgctcaattgaggaccgtctacgcgggtgaacacgccgaagcaatcgcgagcagagagcaggaagtgctccaggggtggaaggagctgctgtccgcttgtgaagacgcccgtctccatgtctcaagcactgctgatgccctccgattccacagtcaagtgcgagatctgctcagctggatggatgggattgccagtcaaatcggggcagctgacaaaccccgagatgtttcttccgtcgaagtgttgatgaattaccatcagggcctcaagactgagctggaagcgagggtacccgagcttacaacatgtcaggaactcggccgttcgttgctcttaaacaagagtgccatggccgacgagatacaggctcagctggataaactcggaacacggaaggaggaagtttccgaaaagtgggatcgccattgggagtggctgcaacaaatgttggaggtacaccagttcgcacaagaggctgttgtagctgacgcctggttaaccgcgcaggagccactgctacagtcgagagaattgggctccagtgtcgatgaagtggaacagctaatccggcgtcacgaggccttcaggaaagcagccgctgcctgggaagaacgattttcaagcctgcggaggctcaccactatcgagaagattaaagcggaacagagcaaacagccgccaaccccgctgctgggacgcaaattcttcggcgacccaaccgagctcgccgctaaagctgctccgttgctgcggcctggcggttacgagagaggactcgaacccttagctcgccgtgcctcggacacattatctgccgaagtccggactcgtgttgggtatgttcggcaggaactaaaacccgagaggctgcaacctagaattgatcgcttacctgagattccagggagggttgaaccagctgccctgccagcagctcccgaggacgccgctgagacgcctgcaactcccgctgcagccgagcaggtgaggcccaggccagaaaggcaggagagcgcagaccgggctgaagaattgcccagaagaagacggcctgagcgccaggaatctgttgatcagtcagaagaggccgctcggcgtcggcgtccagagagacaagagagcgccgaacacgaggcagcccacagtcttacactggggaggtacgagcaaatggagaggcgacgggaacgaagagagaggcgactggagcggcaagagagctcagaacaagaaatgccaatccgcggtgatctggtgaagggcaaggcaactctggccgatattgtggaacaactccaggaaaaagaggcgggacctggactcccagcagggccttcgctgccccagcccagggagttacccccaggcagactgccgaacggactcgagttaccagagaggaccccccgaccagacaggcccagagccagggacaggccaaagcctcgcagacgcccacgccctcgcgaaggtggagagggtggcggttccaggaggtccaggagcgctcctgcccaaggtggttctgcacccgctcctccccctcctcccacccacacagtccagcatgaaggtttccttctaaggaagcgcgaattggatgccaaccggaaatctagcaataggagctgggtctccctttactgcgtgttatccaaaggagagctaggtttttacaaggacagcaagggcccagctagtggctctacacatgggggagagcccctgttgtcgctgcataaagcgacttcagaggtggcctcagattataaaaagaagaagcacgtctttaagttgcagacccaggatggttccgagtttctgctgcaggcaaaagatgaagaggaaatgaacgggtggctcgaagcggtggccagtagtgtggccgaacacgctgagatcgctaggtggggtcagacactgcctacaaccagtagtacagacgaggggaatccaaagagagaaggtggcgacaggagagcaagcggccgtagaaagtag

SEQ ID NO: 242110 - DNA, 7694 bp, Artificial Sequence
  Description of Artificial Sequence: Synthetic coding sequence
atggcgcaggtgccaggcgaagtcgacaatatggaagggctgcccgctccaaacaataatccagcggctcggtgggagagcccagatcgcggatgggagcgggagcagcccgctgcatctaccgctgccgcttcactgttcgagtgttcaagaatcaaagcgctggcagacgagagagaggccgtgcaaaagaaaacatttacgaaatgggttaatagccatttggcccgagtgggctgccacattggagatttatacgtcgatctccgggatggattcgtgctcacacggttactggaggtgctctcaggggagcagcttcctcggccaacccgtgggagaatgagaatccatagcctagaaaatgtggacaaagccctgcaatttctgaaagaacagagggtccatctcgagaatgttgggagtcacgacatcgtggacggtaaccacaggctcactctgggactggtgtggactattatcctccgcttccagatccaggtaataaagatagagacagaggataatcgtgagactcgttcagctaaagacgcactactgttgtggtgccaaatgaaaaccgcaggttacccagaagtgaacattcagaactttaccaccagttggagagacggtttagcgtttaatgccttaatccatagacacaggcccgatctggtggacttttctaagctgactaagtctaacgccaactataacctgcagagagcattcagaaccgccgagcaacacctggggttggcaagactgttagatcctgaggacgtgaacatggaagcaccagacgagaaatccattattacctatgtagtgtcattttaccactattttagcaaaatgaaggccttggccgtggagggcaagcggataggaaaagtccttgaccaggtgctggaggtgggaaaaatcattgagcggtatgaggagcttgctgcggagctgctagcttggattcatcgcaccgtagggttgatctcaaaccagaaattcgccaatagcctcagtggggtgcagcagcaactgcaggccttcaccgcatattgcaccctagaaaagcccgtaaagttccaggaaaagggtaatctggaagtgctgttattctcaattcagagcaaactccgcgcttgcaacagacgcctgtttgtcccgagagagggttgcggcatttgggacatcgataaggcttggggcgagctggagaaagccgagcacgagcgcgaagctgccctacgggcagagctgattcggcaagagaaactcgagctcctggcacaacgctttgaccacaaggtggccatgcgcgagagttggctgaatgaaaaccaacggctggtctcccaggataacttcgggtacgaactccctgcagtggaggccgctatgaagaagcacgaggccatcgaggccgacatagccgcatatgaagagagggttcagggcgtggctgaactcgcccaagcactggcggcagaaggatattacgacattcggagggttgctgcccagagggattccgtgctgaggcagtgggccctgctcactggcctagtaggcgcacgacgtacacggctggagcagaacctcgccttgcagaaggtattccaagaaatggtttatatggtagactggatggaagagatgcaagctcagctgctgagcagagagtgcgggcagcacctcgtggaggccgacgacttgttgcaaaagcacggcttactggagggagatatcgcagcacagtccgagagggtcgaagccctcaatgccgctgccctgaggttttcccagctgcagggatatcagccctgcgatccgcaggtcatctgtaaccgcgtgaatcatgtgcacggatgtctcgcagaactgcaggaacaagcagcccgacgcagggccgagctggaggcaagtaggtccttgtgggccctgctccaggagctggaggaggcagaatcctgggctcgcgacaaagagcgactgcttgaggctgccggagggggaggggcagcaggagctgccggagctgccggtacggccggtggggctcacgacctgtcatctacagccaggctcctcgctcagcataagatccttcagggagaattgggaggacgacgggctcttttacagcaagccctgcggtgcggggaagagctggttgcagccggtggagctgtcggtcccggtgctgacacagttcaccttgtcgggttagcagaacgcgcagcctccgctcggagacgatggcagaggctggaagaggccgctgcgaggagagagaggagacttcaagaggcccgtgccctgcatcagttcggtgccgatctggatggtctgttggactggttgagagacgcctatagactcgctgccgcaggcgactttgggcatgatgaggcctcatccaggcggctcgccagacaacacagggcacttacaggcgaagtggaagctcaccgtggaccagtgtctggtctgcgacgacaacttgctaccttagggggagcctccggggctggaccactcgttgtcgctctacaggtgcgcgtggtggaggcagaacaattgttcgccgaggtgacagaagtggcggctctaaggcggcagtggctgagggacgcactggcagtctatcggatgttcggtgaagtgcacgcctgtgagctgtggatcggtgaaaaggagcagtggctattgagcatgcgtgtgcccgattccctagacgatgtcgaagtggtacagcacaggtttgaaagtttggaccaggaaatgaattcgctgatgggaagggttttggatgtgaatcacacagtccaggaactagtagaaggtggccatccgtctagtgacgaggtcaggtcctgccaggaccacctgaactcccgctggaaccggatagtagaactggtggagcaaaggaaagaggaaatgagcgcggtcctccttgttgagaaccacgtgttagaagttgcagaagtgagagcacaagttcgggagaagaggagggccgtagagtccgctccccgtgcaggcggagcactccagtggagactctccgggttggaggctgcccttcaggccctggaacctcgccaggcggcattgctggaagaggccgctctgctagccgaacgtttccctgcacaggcagctcgactgcaccaaggcgctgaagagctgggcgctgaatggggcgcactggcgtccgccgcacaggcctgtggagaagctgtggcagctgccggaagactgcagcgcttcctgcatgacctggacgcctttctggactggctggtcagagcccaggaagcagcgggtggctctgaaggacctttaccaaatagcctggaagaagcagacgctctgctcgccaggcacgcagcactgaaggaggaggtagatcaaagagaggaggattatgcaaggatagttgcagctagcgaggctctgctagctgccgatggcgctgagctgggcccagggttagctctggacgaatggctgccccatcttgagttgggctggcataaacttctcggcctgtgggaggctcgtcgcgaggccctagtgcaggcccacatctaccagcttttcttacgcgacttgagacaagccctggtggttctcaggaaccaagagatggccctctccggcgcagagctccccggtacagtcgagagcgtcgaggaggctctcaagcagcatcgggacttcttgaccaccatggagctgtctcagcagaaaatgcaggtcgcagtgcaggctgccgagggcctgctgcggcaggggaatatatacggcgagcaggcacaggaagccgtgacaaggcttctggaaaagaaccaggagaatcagcttcgcgcacaacaatggatgcagaaattgcatgaccagttagagcttcagcatttcctcagagactgccacgaactcgatggctggattcacgagaaaatgttaatggctagggacggcacaagggaggacaatcataagctacataagcgttggttgaggcatcaggctttcatggccgagttggcccagaacaaagagtggttggagaagatagaacgcgagggacagcagttgatgcaggagaaacctgagttagcagcttctgttcggaaaaagctgggcgagatcagacagtgttgggccgagttggaaagcaccacacaggccaaggccagacagttgttcgaagcttccaaggccgaccagctggttcagtcatttgctgaacttgataagaagctgctgcacatggagtctcagttacaagacgtcgacccaggtggggatctcgccactgtgaacagccagctgaagaaactgcaaagtatggaaagccaggtggaagagtggtatcgggaggttggagagcttcaggctcaaacggccgcacttccactggagcccgcatcaaaggagctggtgggcgagcgccagaacgcggtaggtgagaggcttgtccgccttctcgaacctcttcaggagcgcaggagacttctgctagcatcaaaagagctccatcaggtggcacatgactggaccacctcctgggcgtgggtgcaggagagacttcctctcgcgatgcagacagagcgcggaaatgggctgcaagcagtccagcagcacattaaaaaaaatcaggggttgcgccgtgaaatccaggctcacggccctcggctggaagaggtgctggaaagagcaggagctctggccagtcttagatcccctgaggctgaggccgtgagaagaggattggaacagcttcagtccgcatgggcaggactcagggaagcagctgaaagacgtcaacaggtgctcgatgccgcttttcaggtggagcagtattattttgatgtggccgaggtcgaagcctggctgggggaacaggaactgctgatgatgtccgaagataagggcaaggatgagcagtctactctgcagttacttaagaagcaccttcagctggaacagggtgtcgaaaactacgaggaaagcattgcgcagcttagtaggcagtgccgtgctcttctggaaatggggcacccagacagtgaacagatcagtcggaggcaatcccaggtcgatcgcctttacgtcgccctcaaggagctgggcgaagaacggcgtgtcgctctcgagcaacagtattggctttatcagttatcgagacaggtaagtgagcttgaacactggatcgctgaaaaagaggtcgtcgcagggtctcccgagctgggacaggactttgaacacgtgagcgtcctccaagagaaatttagtgagttcgcctctgaaacaggcatggcagggagagaacgcctcgcagcggtgaaccagatggtcgacgagttgattgagtgcggacacaccgccgctgccaccatggccgaatggaaggacggcctgaatgaggcgtgggccgagcttctggagttgatgggcacacgggcacagctgctggctgcatcccgcgaattgcataaattcttctccgacgccagggagctgcagggtcagatagaagaaaagaggcgaagactccccagactgacaactccaccagagccccgaccttccgctagttcaatgcagcggaccctgcgcgcttttgagcacgacttgcagttacttgtgagccaggtaaggcagcttcaggaaggagccgctcagctacgcaccgtctacgctggagagcacgctgaggctattgcatctagggaacaagaggtcttacaaggttggaaagagctgctcagtgcctgcgaggacgcaagactccacgtatccagtacagccgatgctctcaggtttcatagccaggttagggacctgctgagctggatggatggcatcgccagtcaaattggagcagctgataagccaagagacgttagcagtgtcgaggttcttatgaactaccaccagggtcttaagacggagcttgaggcacgagtccccgaactgacgacgtgccaggaactcggacgcagtctgttactgaataagtctgctatggctgatgagatccaagcccaactagacaaactaggcactcgtaaggaagaagtctcggagaagtgggacaggcactgggagtggctacagcaaatgttggaagtgcatcagtttgctcaggaagccgtcgtagccgatgcttggctgacagcccaggagccactgctgcagtcacgtgagttgggctcttcagtggatgaagtagaacagctcataaggcgacatgaggctttccggaaggccgctgcagcctgggaagagcggttctcaagtctacgacgactgactacgatcgagaaaatcaaagcggaacaaagtaaacagcctcctactcctctgttagggaggaagttttttggcgacccaacagagctcgctgcaaaagccgcaccacttctgcggccaggcggttacgagagggggcttgagccactcgctcggcgtgcatcagatacgctgtctgccgaggtgcggacgcgcgttggctacgtccgacaggaactaaagcccgagcgcctgcagcccaggattgatagactacccgagataccagggagggtggaaccagcagcacttccggcagccccagaggatgccgctgaaacccctgccacacccgctgccgcagagcaagtaagacccaggccagagcgtcaggagagcgctgatcgggctgaagaattacctagacgaagaaggcccgagcgtcaggaaagtgtcgatcagtccgaggaagcggctaggaggcgacggcctgaaagacaggaatcggccgagcacgaagctgcccactcccttaccctcgggagatacgaacagatggaacgaagacgggagagacgcgaacgaagattggaaaggcaggaatcctctgagcaggagatgcccatccgaggggacctggttaaagggaaggccacgctggcggatattgtggaacagttgcaggaaaaggaggccggaccaggcctaccggcaggacctagcttgccacagcccagagagctgccaccagggagactccccaacggcttggaacttccggaacggacaccaagaccagaccggcctagggcaagggacaggccaaagcccaggcggaggcctcggccaagggaggggggagaggggggagggtctcggaggtctcggtcagcgccagcacagggtgggagtgccccagctcctcccccacctcctacccacacagtgcagcacgagggcttcctgctgcgcaagcgagagttggatgccaacagaaagagcagcaatagatcttgggtaagcctgtactgcgttttaagtaaaggagagctcggattctacaaagacagtaagggacctgcgtctggctcaacccatggaggcgagccactcctctctcttcacaaggccaccagtgaagtcgccagcgactataagaagaaaaaacatgtgttcaaactgcagacacaggacggatcagagttcttattgcaggctaaagatgaggaagaaatgaatggctggctagaggccgtcgcctcttctgtggcggaacacgccgagatcgctagatgggggcagacacttcccaccacgagcagtacagatgaggggaatcctaagagggaggggggagacaggcgcgcaagcggaagacgcaagta

SEQ ID NO: 242111 - DNA, 11025 bp, Artificial Sequence
  Description of Artificial Sequence: Synthetic coding sequence
atggccggtcagccccactccccacgcgagcttctcggtgcggctggccatcggagcagacggccaagcactgagctcagggtgccgcctagtcccagcctgaccatggattctcagtacgagactggacacatccggaagctgcaagctagacatatgcaaatgcaagaaaaaacttttactaaatggatcaataatgtgttccagtgtggtcaggctggtatcaagattcgcaatctgtacaccgagctcgctgatggaatccacttattacggctgctggagttgattagcggcgaggcccttcctccgccttcccgaggcaggctgcgcgttcacttcttggagaacagctcacgcgcacttgcctttctgagggcaaaggttcccgtccccctgatcgggcctgagaacatagttgatggcgatcagacactgattctggggttaatctgggtgatcattcttcggttccagataagccacattagtctagataaggaggagtttggagccagtgccgcactgttatctacaaaagaagcccttcttgtgtggtgccagcgtaaaaccgcctcctataccaatgtgaacatcaccgattttagccgctcatggtccgatggtttagggtttaacgctctgatacatgcccaccgccctgaccttctggactatggctctctgcgtcctgaccggccattgcacaaccttgcttttgcttttctggttgccgaacaagagctgggcattgctcagctactcgaccccgaggacgtcgccgctgcccaaccggacgagcgttcaatcatgacatacgtgagcctctactaccattattgctctaggctgcaccagggccaaaccgtccagaggaggttgacaaaaatactgctccagctgcaggagactgagctgctgcaaactcaatacgaacagttggtggcagacctgcttcggtggatcgcagagaaacagatgcagttagaggcaagggacttcccagattctctccctgccatgcgccagctcctggccgcttttacaatcttccgaacccaagaaaaaccacccaggctccaacaacggggagcagcagaggctctattgttccgactgcaaacggccctgcaggcacagaatcgacgaccattcctgcctcacgagggcctgggcctggcggaattgtctcagtgttgggccggtcttgagtgggctgaagcggcacggagtcaggcactccagcagaggctgcttcaactgcagaggcttgaaactctcgccagacgatttcaacacaaggcagcattgagagaatcgttcctgaaggacgcagagcaggtcctggatcaggctagagcgccacctgcctctctggccacggttgaagccgcagtgcaaagactgggcatgttagaggctggtattttacctcaggaaggaaggttccaagctctggctgagatcgcggatatccttaggcaggaacagtatcactcctgggcagatgtcgccagacgccaagaggaagttacagttcgctggcagagacttttgcaacacctgcagggccagcgtaaacaggtggccgacatgcaggccgtcttgtccttgttgcaggaagtggaggccgcaagtcaccaattagaggagcttcaagaacctgccaggtctaccgcatgcggccaacagcttgccgaggtggtggagctgcttcagaggcatgatctgcttgaggcacaagtctccgcacacggggctcacgtgagtcatcttgctcagcagactgcagagcttgactccagcctgggtactagcgtggaagtactgcaggccaaggcgagaacgttggcccagctccagcaaagcctcgtggccctggtgagggcaagacgcgctttactggagcaaacgttgcaaagagccgagtttctacgtaactgtgaggaagaggaagcttggctgaaggaatgtggccagcgtgtggggaatgccgcactgggacgcgacctttctcagattgctggcgcactccagaagcataaagctctcgaggcagaggtgcatcggcatcaggcagtgtgcgtggacctggtaagaaggggtcgagatctaagcgccagacgcccacccacacagccagacccaggtgagcgagcagaggccgtccaaggtggatggcagcttctccaaacccgcgtagtcggccgaggtgcgaggctgcagaccgccttgctggtactgcagtacttcgccgacgctgccgaagcagccagctggctaagggagagaagaagcagcctagaaagggcgagctgcggacaggaccaggcagcagccgaaacgttgctaaggaggcatgttaggctggagagggtcctgagggctttcgccgctgaactgcgcagactcgaggagcaaggcagagccgctagcgctagggcctccttgttcactgtgaattccgccctgtcaccccctggtgagagcctgagaaacccaggtccttggagtgaagcatcctgccatccaggcccaggcgacgcctggaaaatggctcttcctgcagaaccagacccagatttcgaccctaataccattcttcagacccaagatcatctaagtcaagattacgagtcgttacgagctctagcgcaattgagacgtgccaggctggaggaagccatggcactgttcgggttttgttcctcatgcggggagctgcagctgtggctggaaaaacagactgtgctgcttcagagagttcaaccacaggctgacaccctggaggtgatgcaacttaagtatgagaattttttaaccgctctggcggtcggtaaaggactttgggctgaagtatcgtcctccgcagaacagctgcgtcagcgatacccgggaaatagcactcagattcaaagacagcaggaagagctgtcacaacggtggggacagctcgaggcgcttaagagggaaaaggcagttcaactggcacatagtgtggaggtctgttcatttctccaggaatgtgggcctactcaggtccagttgagggacgtgttgctgcagctggaagcgctgcagccaggaagctccgaggacacttgtcatgcgctgcagctggcacagaaaaagaccttggtcttagaacggagagtgcactttcttcagtccgtggtagttaaggtcgaggagcccggatatgctgaaagccagccactgcaaggccaggtggagaccctccaaggtctcctgaaacaggttcaggaacaggtggctcagcgcgcaaggcggcaggctgagacacaggccagacagtcttttctccaggaatcccaacagttactactgtgggcagagtctgtccaagcacaattgaggtccaaggaagttagcgtggatgtggcctccgctcaaaggcttctcagagagcatcaggaccttctcgaggagattcacttatggcaggagaggctccaacagttggacgcccagtctcagcctatggctgcccttgactgtccagactcccaggaagtgccaaatacgctgcgggtgttagggcaacaggggcaggaactgaaggttttgtgggagcaaaggcaacagtggctgcaggaggggctggagctgcagaaattcggaagagaggttgacggattcacagctacctgtgccaaccatcaagcatggttgcacctggacaacctaggcgaagatgtgagggaagccctcagcctgctgcagcagcatcgggagtttggtaggttgctcagcaccctcggcccaagagctgaagccctccgcgctcacggtgagaagcttgttcaatcccagcaccccgctgcccacacagtgagagaacagctgcagtcgatacaggctcagtggactagactgcagggaagaagtgagcaaaggcgtcggcagctgctggcatccctgcagcttcaggaatggaagcaagacgtggccgaactgatgcagtggatggaagagaagggtctcatggcagcacacgaaccatcaggggctcggcgtaacatactgcaaactctgaaaagacacgaagccgctgaatcggaattgctcgcaacgcggaggcatgttgaagcgctgcagcaggttggaagggaattgctgtcacgcaggccttgtggccaggaggatattcagacccgattacaggggctgcgcagcaagtgggaggctctcaaccggaagatgaccgagaggggcgacgaattgcagcaagctggacagcaggaacaactgcttaggcagttgcaagatgcaaaagagcaactggagcagctggagggggcattgcagtctagcgaaacggggcaggatctgcggagcagtcaaaggctacagaaacggcaccagcaattggaatcagagagcaggactctggcagcaaaaatggccgctctggcttctatggctcatggcatggccgcatcccccgcaatacttgaagaaactcagaaacaccttcgccgactggagttgctgcagggacatctggcaattaggggcttgcagctccaggcctctgttgaattgcaccagttttgtcacctgagcaacatggaactgtcatgggtggcggagcacatgccgcacggtagccctacatcatacacagaatgtctgaatggggcacaaagtctgcatagaaagcataaagagttgcaggtcgaagtgaaggctcaccagggccaggtgcagcgggttctgtcatccggacgatcgctcgctgcgtctggtcatcctcaggcacagcatattgtggagcagtgtcaggaactagagggccattgggcggagctggagcgagcttgtgaggcacgcgctcagtgtctgcagcaggcagtcacgtttcagcaatatttcctggatgttagtgaattggagggctgggtggaggagaaaaggcctttggtgtcctcccgagactacggaagagacgaggccgctacactccgcctgatcaacaagcaccaggccctgcaggaggaattggcaatttattggtcaagcatggaagagctggaccagacagcccagaccctgacaggaccagaggtgcctgagcagcagcgggttgtccaggaacgattgcgagagcaactgcgcgctttacaggagttagccgcaacccgcgacagagaactcgaaggtacacttcgtttacacgagttccttagggaggctgaggaccttcagggttggttggcatcacaaaaacaggcagctaaggggggtgagagcctaggcgaagaccctgagcacgcactgcatctgtgcaccaagtttgctaaattccaacaccaggtggagatggggtctcagagagttgcagcatgtaggcttctggcagaatctctgctggagcgtgggcatagcgccggaccaatggttaggcagcgtcagcaggacctccagacagcctggtcggagttgtgggagttaactcaggccagaggacatgcccttcgtgacacagagaccaccttgagggtgcacagggacctattggaggtcctgacacaggtccaggaaaaagccacatcactgcccaataacgtggcaagggatttatgcgggttagaagctcagctgcgcagccaccagggccttgagagagagctggtgggcactgagcgccaacttcaggaacttctcgaaacggcagggcgtgtccagaagctgtgcccgggacctcaagcacatgcagtacagcagcgtcaacaggctgtgacacaggcctgggccgtcttacagcggaggatggagcagcgcagagcccagttggaacgggctagattgctcgcacgattccgcaccgccgtgcgggattatgccagctgggcggctagagtgcgacaggacctgcaggtcgaagagagctcacaggaaccgagctctggacctctgaagctgagcgctcatcaatggctgcgtgctgaactggaggccagagagaaattgtggcaacaagctacacagcttgggcagcaggcgctcctggcagcaggaacgcccacaaaagaagtgcaggaagaactgcgggcactccaagatcagagagatcaggtctaccagacctgggctagaaaacaggaacggctacaggccgagcagcaggagcagctcttcttacgggagtgcggacgacttgaggagattctggctgctcaggaagtgagcttaaagaccagtgccctgggttcatccgttgaagaggttgaacaactgatccggaaacacgaggtttttctgaaagttctgactgcacaggacaagaaggaggctgcccttcgtgagcgcttgaaaacacttcgcagaccacgggttagagacaggttgccgatcctcctacagcggagaatgagagtaaaagagctggccgagtcacgcggacatgcactacatgccagtctgctgatggccagttttactcaggctgcaacacaagctgaagactggatacaggcttgggcacaacagttgaaagaacctgtaccacccggagacctgagggacaaactgaagcccttactcaagcaccaggccttcgaagcagaggttcaggcgcacgaggaagtcatgacttctgtggcgaaaaagggggaggccctcctggctcagtcccaccctagggctggcgaagtgagtcaaagacttcagggccttagaaagcattgggaagacctcaggcaggccatggcgctgcggggacaggaactggaagatcgacgcaatttcctggagttcctgcagcgagtcgacttggccgaagcatggatacaggagaaggaagtgaagatgaatgtgggggatctgggccaggacttagagcattgcctgcagctgcggagaagactgagggaattcaggggcaattcagctggcgatacagtgggagatgcttgcatacgttccatttccgatctttctcttcagctgaaaaaccgtgatcccgaagaggtgaaaatcatttgtcaacggagaagccagttgaacaacagatgggcctcatttcatgggaatcttttacggtaccagcagcagcttgaaggtgctctcgagatccacgtgctatctcgggagctggataacgtcactaagagaatccaggagaaggaggctctgatacaggctctggactgcgggaaagacctcgagtcagtacagaggctgctgcgtaagcacgaagaattagagagggaagtacatccaattcaagcacaggtggagtctttggaaagagaagtggggaggctgtgtcagagaagccctgaggcagcccatggccttcggcaccggcagcaggaagtcgccgaatcttggtggcaactgagatccagggcccagaaacgcagggaggccctggacgcacttcatcaggcacaaaaactccaggctatgcttcaggaattgctggtctcggcccagcggcttagagcccaaatggatactagtcccgctcctcgttcacccgtcgaagccaggagaatgctggaagagcaccaggagtgtaaggctgagctggattcctggactgatagcatcagtttggcgcgaagcactgggcaacagcttctaaccgcagggcaccctttttccagcgacatcagacaagtgctcgccggactagagcaggaactatctagcttagaaggggcttggcaagagcatcagctccagctgcagcaagctctggaacttcagctgttcctgagtagcgtggaaaagatggagcgctggttatgctctaaagaggatagtctagcaagtgagggcctttgggatcctcttgcgcctatggagcctctgctgtggaaacacaaaatgctggagtgggacctggaagtgcaagcaggtaagatctccgcactcgaggcaaccgctcgtggcctccatcagggaggacatccagaggcccaatccgccttagggcgttgtcaggcaatgttactcaggaaagaggctctgttccggcaggccggaactagacggcacaggctggaagaacttcgtcaactacaggcgttccttcaggacagccaggaagtagctgcctggctgagggaaaaaaatctggttgccctggaggaggggctcctcgataccgccatgctgcctgcgcagctgcagaagcagcagaattttcaggccgaactggacgcttccatgcatcagcagcaagagcttcagcgtgaaggccagcgcttgctccaaggcggtcacccagcttccgaagccattcaggagcgcttagaggagctgggtgctctatggggggagctgcaagacaattcacaaaaaaaggtggccaaactgcagaaggcttgcgaggccttgcgtctgcgtcgcagcatggaggaattagagaattggctggagccaattgaagtcgaattgagggcccctactgtggggcaagcattgcctggggtcggagaactgctcggaacccagcgggaactagaggcggcagtggacaaaaaggcccgacaagcagaagccctgttgggtcaggcccaggctttcgtgagggaaggtcactgcttggcccaggatgttgaagagcaggccaggagactattgcagcggtttaagagccttagggaacctctccaggaacgcagaactgctttggaggccagatcccttctgttgaaattttttcgtgacgccgatgaagaaatggcatgggtccaggagaaattacctttggcagccgctcaggactacgggcagtcactgtccgctgtgcgccacctgcaggagcagcatcagaacttggagtctgaaatgagctctcacgaggcgctgacccgggttgttcttgggacgggctacaagctagttcaagccggacatttcgctgcccatgaagtggccgcacgcgtgcagcagctggagaaggcgatggctcacctgcgcgcagaagccgctcggcgaaggttactactgcagcaggcccaagaggcccagcaattcctaacagagctgctcgaggctggatcatggttagcagaaagggggcacgtcctggatagtgaagatatgggacatagtgcagaggctacccaggcattgcttcgtaggctggaggctacgaagagagaccttgaagcctttagtccccgtatcgagaggctgcagcaaaccgcggctctcctggaaagcaggaagaatcctgaaagcccaaaggtgctcgcccaacttcaagccgtgagagaagcacacgcagagttactgcgcagagctgaggccagggggcacggcctgcaggaacaactgcaactccatcagctggaacgggagactttactgctggacgcgtggctgaccactaaggctgccaccgctgagtcccaggactacggccaggacctggagggcgtgaaggtgctggaggagaaatttgatgcctttagaaaggaggtccagtctctcggtcaggccaaagtatacgcactcagaaaactggccggtactctagaaaggggggctcccaggcggtatccgcacatccaggcacagcggtctagaattgaggctgcctgggaacggctggatcaggccatcaaggccaggaccgagaacctcgccgcagcccacgaagtccattcttttcagcaggccgcagctgaactccaggggagaatgcaagagaagaccgcactcatgaagggagaagacggaggtcactctctttccagcgttaggaccctccagcaacagcatagaaggctggaacgggaattggaggcgatggagaaggaggttgctcggctccaaactgaggcttgtcgtcttggacaactgcacccagcggcacccggtgggctggccaaggtacaagaggcctgggccacattgcaagccaaggcgcaggagcgtggtcagtggctcgcacaggccgctcagggacacgcctttctaggaagatgccaggagttgctggcctgggctcaggagcggcaggagctggcgtcaagcgaggagctggcagaggacgtcgctggggcagaacagttgctaggtcagcatgaagagttaggacaagaaatacgggaatgccggctccaggcccaggatctgcggcaagagggccaacagctcgtggacaactcccacttcatgtctgctgaggtgaccgaatgcctgcaggagcttgagggcaggcttcaggagctggaggaggcatgggcgctgcgctggcaacggtgcgcagagagctggggcctgcagaaactccgacagcggctggaacaggcagaggcatggctggcctgttgggagggtcttctgctcaaaccagactatggccacagcgtgtctgacgtcgagctgctactccacaggcatcaggacttagagaagctccttgccgctcaggaggagaagtttgctcagatgcagaagaccgagatggaacaggagctgctgctccagccccaggagcttaagccgggtcgcgctggatcatcactcacgtcttttcaatggagaccatctggacaccagggcttgggagcccaactcgccgaaacgcgggatccccaagacgcaaagggcactcctactatggagggttcattggaatttaagcagcatcttctgccaggcggtagacagccttcttcaagttcttgggatagctgcagaggtaatctgcagggttcttccctgagcttatttctggatgagcgtatggccgcagagaaagtggctagtatcgcgcttttggatcttaccggggcacgttgtgaacgtcttcgcggacgccatgggagaaagcatacattttctcttcgtctaacctctggggctgaaatccttttcgcggctccctctgaggaacaggccgagagctggtggcgtgctttagggtccaccgctgcccagtctctgagcccaaagttaaaagctaagccagtgtcctccctgaatgagtgtactaccaaagatgccaggcctggatgcttgctcaggtctgacccctaa

SEQ ID NO: 242112 - DNA, 942 bp, Artificial Sequence
  Description of Artificial Sequence: Synthetic coding sequence
atgagacataatcaaatgtgctgtgaaacccctcccactgttaccgtctatgttaaatcagggtcaaacagaagtcaccagcctaagaaaccgattaccctgaagaggcccatctgcaaagacaactggcaggcgttcgagaaaaacacacacaataacaataaatctaaaaggcctaagggaccttgccttgtgatacaacggcaagatatgacggctttttttaagctattcgatgatgatctcattcaggatttcctgtggatggactgttgttgtaagatcgccgataaatacctgctggccatgacgtttgtgtattttaagagagcaaaatttacaatatcagaacatacacggatcaatttctttatcgccctttacctagcaaacaccgtggaagaggatgaggaggagacaaagtacgagatattcccttgggccctgggaaaaaactggcgcaagctgtttccaaacttcctaaaactgcgcgaccaattatgggatcgaattgattacagagcaatagtatcccgccgttgttgtgaggaagtcatggccatagctccaacacactatatctggcagcgggaaaggtcagtccaccactctggcgcagtccggaattataaccgagatgaagtacagctccctagaggcccatcagctacaccggtggattgttctctctgtgggaagaaacggaggtacgttaggctgggcctatcaagcagttctagtcttagctcccatacggcgggtgttacagagaagcactctcaggactcttacaattccctgagcatggatatcatcggcgacccgtcacaggcatacactgggtccgaagttgtcaatgatcaccagtccaataagggcaaaaaaacgaattttctcaagaaagataagtctatggaatggtttaccgggtccgaggaatag

SEQ ID NO: 242113 - DNA, 942 bp, Artificial Sequence
  Description of Artificial Sequence: Synthetic coding sequence
atgcgacacaaccagatgtgttgtgagacgccacccactgtgaccgtgtacgtgaaatctggaagtaaccgctcacaccagcccaaaaagcctataaccctgaaacgcccaatctgtaaggacaattggcaggccttcgaaaagaacactcacaataacaataagtctaagagacctaagggcccatgcctggtcatccagagacaggacatgacagctttcttcaaactcttcgacgatgacttgattcaggatttcttgtggatggactgctgttgtaaaatcgcagataaatacctgcttgcaatgacatttgtgtactttaaacgcgcaaagttcaccatcagcgaacacacccggattaatttcttcattgccctctatttggccaataccgttgaagaggacgaggaggaaaccaagtatgaaatttttccctgggccctagggaaaaattggagaaagctcttccccaattttttaaagctccgggaccaactgtgggataggatagactaccgggctatagtgtctaggaggtgttgcgaggaggttatggctattgccccaacccactacatctggcagcgtgagaggtccgtgcatcactctggggctgtgcgtaattacaacagagacgaagttcagctccctaggggcccaagtgctacgccagtggattgttcgctgtgcggaaaaaagagaagatatgtgcgacttggcctcagctcatccagcagccttagcagccatacagccggagtcaccgaaaaacattcccaagactcttataactccctgtccatggatattataggggaccctagccaagcttacactggatcggaagtggtgaacgatcaccagagcaataaggggaaaaagaccaattttctgaagaaagataagagcatggaatggttcacagggtcagaagaatag

SEQ ID NO: 242114 - DNA, 384 bp, Artificial Sequence
  Description of Artificial Sequence: Synthetic coding sequence
atgaggcacaatcagatgtgttgcgagacccctcctaccgttacagtttacgttaaatctggatcaaatcgaagtcatcagcccaaaaaacccattacattaaagcgtccgatttgcaaagataactggcaggcgttcgaaaaaaacacacacaataacaacaagagcaagcgccctaagggcccttgtctggtgattcagcgacaggatatgaccgcttttttcaaactctttgacgacgacctcatccaggattttttatggatggactgttgttgtaagatagctgacaaatatctcctcgccatgacatttgtgtatttcaagcgggctaaattcaccatttcagagcacacccggatcaattttttcatcgcgctctag

SEQ ID NO: 242115 - DNA, 882 bp, Artificial Sequence
  Description of Artificial Sequence: Synthetic coding sequence
atgctatgggccatccctgagctaggcagcccgtgcccaatttcaattagttacgagatgtctgattcacaagatcctaccactagtcctgtagtgaccacccaggtggagctcgggggatgcagtagacaggggggaggcaacggatttctgagatttagacaacaccaggaggtccaagctttcttgagcctactggaggattctttcgtacaggagttcttgtccaaggatccttgtttccagatctctgacaagtacttgttggctatggttcttgtgtactttcagcgcgctcatctgaaattatcggagtacactcacagctccctcttcctggccctctacttagccaacgacatggaggaagatctggaggggccaaagtgtgaaatcttcccatgggcgctgggcaaagactggtgtctaagggtggggaagttccttcatcagcgggacaagctgtgggcccgaatgggcttccgggcagtagtgtctcggcagtgttgcgaagaagtgatggcaaaggagcccttccactgggcatggaccagggaccgtagacctcaccatgggggagtgcaacgcgtctgccctcaagtgcctgttagacttccacgaggacccggtctcagcccccctcattgctcgccatgcggcctgccgcagcactgttcatcccatcttctgaagcctgttagttccaagtgcccctctttgacctccgagtgtcataggcccccaagccaaaattacctctcgagggttaagaatgcctggggaggggacttcctcatcgtgttacctcctcagatgcaattggagccgggaacttattccctgcgcatatttcccaagcctcccgcacgtcccggtcattag

SEQ ID NO: 242116 - DNA, 1122 bp, Artificial Sequence
  Description of Artificial Sequence: Synthetic coding sequence
atgaatgtcgataagttccttatagtttgctatttgaaaaaagaggtgtggggctttgaatcatactccctgagcggcacgacatgcttccaatggaattatttcgtctggagtctgaggttcttttttagttgtggatcaagtaaataccacctcactccgctgcctattaagaaggtggactacccacataagagaggacaaaattggggtagctatgtccacaacagcctaccaagatttaattgggattaccgaagttgttttcatacctggaagcgcgctagcgataaccgggagagggcatatgagcacagcgcttatggacatcatgaaagagggacaggcggttttgaccggacccgacattacgaccaggactactatagggacccgcgtgagaggaccttgcagcatggactgtactatgcttcacgatctcggagtcctaatcgcttcgacgctcatgaccctcggtacgagcccagggccagagagcagttcacacttccctccgtcgtgcatcgggatatctatagagatgatattacaagagaagtaagaggcagacgcccagaaaggaattaccagcatagcagatctcggtctccgcattccagtcagtctagaaaccagtccccccagcgccttgcttctcaggccagtagaccgaccaggtccccttctgggagcggttcacggtcccgatcttccagtagcgattcgatctcttcaagcagcagcacctcttccgactctagcgatagctcctcctcttcctccgatgactcccctgccaggtcagttcagagcgctgctgtgcccgcacccacatctcagctgctatccagcctggagaaggatgaaccccgaaaaagcttcggcattaaagtccagaatctccctgttcggagtactgacaccagcctaaaagacggtttgtttcacgaattcaaaaaattcggtaaagtgacgtctgtgcagatccacggtacaagcgaagagagatatggcctcgtcttttttaggcagcaggaggaccaagagaaggccttgactgcttcaaaggggaagctattcttcggaatgcagattgaggtcacggcttggattggcccatag
